United States Patent 9,328,346 (POLYCOMB-ASSOCIATED NON-CODING RNAS) - sequence listing, part 97

SEQ ID NO: 18153 - RNA, 293190 nt, Homo sapiens
ggacucaccuuucccugauccugcaccgucccucuccuggccccagacucucccucccacuguucacgaagcccaggugggccgucggccggggagcggagggggcgcguggggugcaggcggcgccaagggcgcgugcaccugugggcgcggggcgcgagggccccucccggcgcgagcgggcgcaguuccccggcggcgccgcuaggggucucucucgggugccgagcggggugggccggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggaggugggugccgcgccucggaaggcggggggaggcugcacgguggggacgcgauaccccccaagaccuuaacccaagucuuuaaugcagagaagccggggguccgucaaugggaccccucuccucuccgcccccgcuugcggacguccagcgcauccccgcuuucggcccagcccugccccagggagucgcgcuccggcccgcugagagggagcgggcgaggcgcuggucucccugguuccgcgccagcccggggcgagaaggguagggggcgacccugagcccagaccccgacuuagucccugccuuggaagcgggggucgggggaggcgagagacauucagacaggggggaagggggaaggagcacguggggaaaaccgaaaacgcagcgucccuaaagccaguccuucgcucuugaaucguugcccuuuccuuucucuugggcccuggggaggaggaggaggagucgggacagcccaggaagcuaggagccccucgcuuuucccugcguucuccgccucguuucaccuuccucucucacccccaucccccuuccuugcuccaaccucuuuucgcggcugcuggcggcggcagccugggugcgacccuagcccgagccggcgucggggucgcgcaccgccuuccacaggcaaacuuugugcauguccgcgucucccuuuuguguaacuugcgagaaaugggaggggucggagacccauagccaccccgcgccuuccccaagucuggacgucccgggaguucgcucgcacccuaagcucugucugagaggcagaagguccgcgggaacaaaagccgcgacaccccgcccucgccgugggccgagccgcguuagucucagugcgccaccgaggcucccgcccggcucccuucccggggcugcgcguccgccugggagggggcagagacgcugccggggcuucuggcggagccucggggccccucugcuucccacccucggaucaccuccgaggcuuaauucugugcugggcuguaaaguccuuggcggggaggaaauaaggcggagagugggaugugcgucuggaaagggcaguggcggaugguggggaggcacgggcucuguccugugcauccaaggaggcguuugucugauuaaggcgcggccucuucccuggcagcucuggggacucugguuuaguuccccugggggcacaggaugcuggggaggguccgaagggucuuuuuuuuagggugcagauaaaaggaucgaauugagugaagauuaagacggagaagauggcgccucugcagugcagcaaagaaaagcuguguggaggcugcagccuagugaaauccacccaccacuagguguauaacaagucuuccccauucauccaacucucgaacauucagcuaacgccugugcacaaugacuguuuuucuuuacaucugaagaugcuuagaaguuguuugcaugacaguugggccagaggaggcuguauuucacuucggacuucgguuggguuccuguuuggcaucuuaacauuugcaaccuuccuuacccguuuuuccccucuuuucccccagccuccuaguaauuuuccaaaagaaaaaaagcaauuuccgggcagauguuuuccuguaauuccacugaggcuguacagacuaucacaccauuaguuuuuuaguuucuaauuugcaaggucauugaacuuuuuucucuucugauuuuuacccacaaguggcucaggaaucaccuuagggcuaguuaagacagguuguuuuaagaguuaaagaauuucguuuuccauguuuuaaaaaaaugcacuuaacuaagagaauucugauuucucucaugacuuacuuacauuuauuuguagaauuauuccaguuuucccgaauggucuuacuacagauuaaaaaccauacauuuaaggaauuaaaagcauaugauaaccguauuuuugaagcuuuugucaaaacuuaaauauguaacuuuguugagcaauauuucuuucuguauaaaaagaggaagcauguaggcagauucgaauuuaguuuuuggucuguuuaauugcauuaauaugcucuuucugccaucuuuugggaccuuuucaguagcuauuguuaacuccuuuaaaggguggaggugagauucacauuaugccauuuugcgaaguguugguagaaggguagguaauucagucuacugagguuugagggugguuuaucugguucucucuguguccacugaaaagauguaauuacgaguugacugucuuuuauagagcuuagaaaauaggucugcugcagguggcuguagaaaagaaaugaauaagggcaaugauaauggggccuuggcuaucgggggaaacaugguuauuaucuggguugaugauuuuggcugguauguugauagaggugugaguuuaacaaacccuaaucuauaugauguuucacuacccuaauauuuauuuauuuauuuauuuuuaaaucuagcuuccucuuaaguuuuauuucccucuguugaggguuuaaccuagucacaaucaucuuaccuuugugguagugcuaauuuauaguuuauggaaaccugcugcuacugacuaguaccucgcuaaagguagaagccgacacacagaauaguaaagcucagguuugauggugaucuguaaggagucacgguucuugcuaaucgaugagaaaccaugauaacuggcagacugcagaagcuuuucucuugucaccggaaccagcagaggcuccugaacgacauuugcaaggcuauuaguacugcggagaaguuacuagauggaauaauacugguccugacugaggaaaugaaaaggaacaugcaaguucacgagguuaaaugaggaauggcugauucaaaaaaauuaaaaagaaauaacgugaucaacaauauugguuugaaggaaugggagagguugucuuuauguuaagucuuguugcuagaggaucucuauuuuauguuacuguuuuuugcauacuagagucuucuacagauauuuguaugaauguugucagucauucuggaaauaagcauagcuauuacuugcauuucacguggccacuaaacuaucagugagaagugcauuaaauucaguagaaauguacauuguuucugcaaauuguauuaccuugagaaucuuacaaagcaucuuucauuaauacauuucuuuuaaaaucucuaucaauuacaaauguaaagauaaaccuguacagaugcauuuuaaauuuaaagcuuccagaauguaagguuuaguucgacugcauaccucauuaccuccccuucccuccucccuccccuuacucccaggaaguuugcaggguaaauaaaacaugcacaugauaauaaaacaaaguggaauguacuaaaauaccaaaaggaaaauacagauuagguauacugaguaaauauguuacagagaaaacuuccuguauuuaaaaaguaaggaacaaugggaugagaucauagauaauccuggagcauuuccugguaguaaauuuccagccagguuuauaucccaggucuggggauuggagguuaaguuucugcauauacaauauuuguuuacauuccucucugccucuaccagacagacagacagacacacacacacacacacacacacacccucugucucuuucucucucuuucucucucucucucucucucucucucucucucucacuugagugacagaugcuggugcaggguauucucaacaggaguagggaauuugaaauaaggaguugagaggucaaagguaaggggcugaaugcaggaccagagagcuucaguagcaucuugaugggcagaguaugagaugaacaguggcaacgaggaggauagggaaaaaucacauuuucuguuuguguuuuguuuuugucuggugguuuucaaccucucucuguuucacuugacuaugcuugauuaugaaaucuuuuuuuuuucuuuuuuuaauuuaaagaucucaacuggcuuuguugugauucuacauucaggcaacacuauucuguaaaauaguauaaauguuccgaugaguugaacagaggagauuggcuuuguagacagaaaagggcugaagaaaacagaaauaaaaaaaucuuuuccuuuucauagugagagcucagaugcaaauguauggaguggggauggaugggaaaugccgucuuuugcaaacccuuggaaacgcugucacccugugggucucacagccaguguacagauaacacccucaucuguacacagaagacagaagguggcaggggaaggaaugagcacaccccagaaugaguagcaaguuuaaucaauaaaauauguauuucuuuuuuuauuguuguauaagaagaaaagcagacagaacucaaacccugaagcugauuuugcaagugaaaagcuuaguaaagggggaaauguuauguaacuauuuuuucaguuuaguguggauggcuuaagaaauaaucauuacugugaggacacuaguauuuuucuuggaaaaaaaaguuuggcaaauuuuccucuuuagauuaaucuugguuauagauuauuauuaugcuugagugguaccucuucagaaguagaaaucuggcaaaaacuggaguacaaugauugcucuaggaauaaauucacauauuuaaauuuaaaagccuggauaugugcaucaauuaauagcuuuaugaaacagggaugcuuaguagauuagcuagcugaguauucagagagggccacagaagucucagguucacauguauuaaaucugcugaaauagaaaccuaagagaucauuuuauuuagguuuauuuuguguggcuacauguugaagaaacaugcaauagagauuuagcuugaaccuugcgagacucacaguaucuuacgaaagaagauaguuaaaauggggaagaugagagguuuuuaaaaaugucaccucuguagaacgaaccagaguuguucucaauuuauaauguugaauuugaugccaggcgugauguuaggccaauaacacugagucauugaguguuucucagguauguagagaaggcagcauugcacacuaaucaggagaguuuagaccagggcaggaaugcaugggcauaaauucugucuuuguuucuuuugagcuagugaccaugggcaaguuucugugccucaguuuuuuccuuuguaaaaugggaugaguacuucuaguuauugaggaucgaauuaauaucuuuguuaaaugcuugaaacagugugugaguuaauauauauguaaccugauggcauagcauaagcacuguguguuaguugcugcuauguauggugaugauguugauguacaauggguauauguaaguuuccugcauaguugaaaguuaaaaaucuagaugauguuucacuuauugacaaauuacuuauuggccaauuaagacuauugcaggaaauugacagauuguugucuaugaguuugaucuaaauuuaaaaagcacaugguaucucagauacaauuuuuagaauacauguuauaaaauuucauuuauuaaauauguauuguguauuucaauugguuuuuugaaaaaugaaaauaauucaugcucauugaaaaauuuaaaacaguacagaaaugugcaaaaagcauaagcauuuuuuacacaaaugggaaauaccuaguuuuuuuuuuucuuuuuuuccacauaacauggauguagaccuuuuuuuuuuuuuuuugagacagaaucucccucugucacccaggcuggagugcaguggcgcgaucucggcucacugcaaccuccgccuccuggguucaagcgauucuccugccucagccuccugaguagcugggacuaugggcacucgccaccaugcccagcuaauuuuuguauuuuuuaaguagagaugggguuucaccauguuggccaggcuggucucaaacuccugaccucaagugaucugcccaccucggccucccagagaccuauuuuuuaauguuguacacacuggcagcuugccacagaugucuaauauugagcaaguuuauacacuggcuugauuauuaacuauuaguuggcuaucagcuaugugcaaggaacugugaacagacuugguuuaguuuucaguagaaucuuugcuagcaaaacgaauaaacaggcuuugccaaucuggguagaaauggaagauuucaaaugccagcaaaagaauuuugguccuaauauggaagcuugaaguuauguucacccaaggacagggaaaccaaaaagcagauugcuugagaaugcggcauuucucuaggaaaucaguuucaaaauaaaaugaauuuuuuguuuuguuuuguuuuugagacggagucucgcccugucgcccaagcuggaaugcaguggugcgaucucagcucacugcaaucuccgccucucagguucaagcgauucuccugccucagccucccgaguagcugggauuacaggcgugugccacuaugcccagcuaauuuuuauauuuuuaguagagacgggguuucacuauguuggucaggcuggucucaaacucuugaccucgugauccgccugccucggccucccaaagugcugcgauuacaggcgugagccaccgcgcccagcugcaguaaagugaauuuguguaaccagccauguuauggcuguuacaucuuuaaaacuuuauagugaucugcuguuuaauugaaauuauauauuuuuuuuaaaaaucagcauauguugcucaaaaauaaaagguuuuuagcuucaaaagcaggccaaggauauuugaaagccuugaguguaugaaacuggugauacugugguuaaaugaugaugaacgcagggaaaaaucaagaagcagagucccaaagaauucacauggguuuuuguuaaccagcucauguaauuauaauuguccuguccaacuaaagacaagaagacaagaaguggguucacauacgaggauguguaaugacagaagccauauuugugauaaacauccugauuacaguagauacagugaggagugauuaagaugguuccagaagcaggaguggaggguucaugagcagggaugaggaauaaauaggacaaacauuuuggaaaagggaaaagaugaauaagccuguuuuguaaauuaauggauccugaugaaugaagugcagugauuccuuaaggucuuauuaaugauggaccccaaacaguguuugaaucucuuaauuuccagaugguuccuuuuuuucuucacaaagucagaagguuuucuuaugagaaauuugauucaacaagaauaauugucacuucuuuuguuuuuuggugauuuuuuuuuuuuuuuuuuuuuuuuuuuuugagacugaguuuuacugugucacccaggcuggagugcaguggcgugucuuggcuuacugcaaccucugccucccggguucaagcaauucucaugccucagccuccugaauagcuggguuuacaggcaugugccaccacgccuggcuaauuuuuguuuuuguuuuuuuuuuuuuuaguagagacaggguuucacuacauuggccaggguggucucgaacuccugacuucaagugauccacccaccuaggccucccaaagugcugggauaacaggugugagccacugcaccuggccaauuuuuuggugauuuugauaggaauuuuuuuuuuugccugaugcuuuuuuugagagaaucuaauaauuugucucuuauuuaauaauuuggcuuucauuagcuuccagaaagccacauacugucuucauugaaaaauguaaggcauccuagaugauacagacugauaaauuacuuuucagccauaaaagauacuuaugagaauaagagaucuguugcauaaagaaaagucauuuguguuaagugaagaaaugcauuauuacucuugcugcuuugcuaaauuucaaacauugaauaacuaauauauuuugacccccuggagauauuuuacaggaagaaaaaugagagguuuaauccuacuguugagauagacuuaacguguuuuagaccugccccucaucccaaguuacuacaaacucauuuguuuaguuuuuccuugucugugugcucguuauuucacaguaaaauuagugaggcaacauaaauuuuauuuuuaagagaaaguaaagaaaauggcuuuauccauuaaagguuuauucaucuuaaaaaaggacuuguuauaucuacuccuacuauuggaugaauuuucaaaagcauauugauacuguguuugguuuuguuuguuuucgggacaaguccucacucugucacccaggcugaagugcaguggugugaucuguagccguggccuccugggcugaagccaucuuccugccccagccuccagaguagcugggacuacaggcaugugccaccacaucugacuaauuucuuaaauguuuuguagagaugggguccccacuauguugcccaggcugaucuugaacuccugggcucaagcgauccuccugccucgaccuuccaaagugcuagauuacaggugugagcuauugugccuggccaauguuguuuuuauaaauaucauuacucaguuauuuuguuuauaauugaauugauaggcucauagaauaaagauggauaagcacuguuucuuaacuguauuuauugauuuuuuuaucuuucaaaaaaaaaauccucaucuacuucaaagauuaagccuuuaaaaccgaugcaaaguuuuugaagucuuagcuuaagucuucagagacuaacauuaaaacccaucauaugaaaagugauauguaguagcaaauauucuccauccugaugcucucaauugcuuauuaugguuuaacacaaauauaauuuugucauuacaguaaauuaguuugaggauauaacugaagaguaccuaagaaacucccauagaaaugugaaaauaugcagacuaauuauucuaagaauaauuaaucauagauacuuacauauuaaauugauuagcaauuuaaaauuaaagccaaauuucuguggaaauuagcuuauuuucauacacaaagaaaccuagauucuuagggguacaaccaagaaagggccacuccuucauuucacaaauauuuucgagguccuugcccccaagaggguagacagaauaaaaaggaggaaggaagugacuuggaaaaaauuaaguuggguaaggaauauaagagaaugcuacguagaaggauguguguugugaaugcaauaguuucuguaguauugucaaaguucucugaucauuucaguaugugaagguaaacuuagauaacugggggaaggaacuauauauuuacuacauuguaaaagaauaauuguagacagaagaucuacuuugggugauuaaauguugaaaacaaguggugggagagagaaguuaguguugauugugaucacacacuuuucuauacaguaauuuguuugaucacucaugauaaugccuuacauuuuguauguacuaaauaaaugaguucucuagaaauucuauguuguggugauaaagaauuacguucagauugaagauucgaacagcugugcaaccuucucaacauuuaagaaacugcgaacaagcauagaaagaagauuaaagccuuuuaaauaagauucuuuuuuuucagccucuuuuuggaacauuuuauugugaaaagguuucauaaauacugucaauacaucacguucagucauuugcaauuguauuucaaaaauucaguuggccugcaaaaagaaaaaaugccucauuuuugaaauauuucauccaugcccugauugauugggacacuuucaauagagggugccuagacauaauuuugugugaagaaguuaguagaguuuggaaagaaaauguguauuggaauuaaauuuaguggcaugaaaaugaaaauuucucugucauugucuuuuuuuuuggcuccuuuuuuggccauuuuacagcuaguguuuagugugacaaggaucaaaauuggcccuuuaaaaaaauauauugaauucuauuaccucuguuaucuaaaagaauuguauuuuucaauuugaagagcuugaagccaauacuacuauauaccauuaacuugacaggaauugaaaaucuaauugaggucauuaugauuagccuuguaucuugcuaguauuuucucaaucuuauuuugaauguuuugugucaaguguuaaauccucuuauaccacagaauccagaaaauuuaaaugcaacagaaguaaaacgaauauaaaaauucuaugguuguuguggaggggcguucuuggcuaacccauaggguguuugaauguaaaggcagcuuacagaacugcugcuaguugaauuguggaggguuucacuuuuaagaguacauuugagacaaaauugcaauuuuggaaucacuuauuccugcuuguucagugaaauaggagaggggggaauuccugagggaagcugggagauuuccaggugaugauagaguagccaugugaguauuuggcugaaacagaguagaagccaccucugucuguuggacagagguggccuuaacacugaguaucaaucagcauggccauuagagcuguccaggacaaacauaaugaauguugugguggcagagaggguauacuuaaaugaacaaaauuggaggcugacuuuccuuguuucuugguaguuccuuucuucguauuugcuauuuggauauuucacuucacuuuugugagcuagacucaaagguuaaauuuauaucauugugaauuuucugggucauauuguagggacacagaugggaagcaucccuucaguuuauugagaguauuucuuaugcgcauguguuuuuaauuguauuuauugauuuaauaaauagccgaugagaugagaaaaaaauauuagugucuuguuguugcagagaaaaagacauuggaugcauucuuagaauuuauuaucacaugcgaaguuauuuagauuuacaaagcaaucugacauguugacuucauugcucguuugcucauuucuaucagagguugaacacaaagccaagccuaagcccgugauucuucugugugcagaugagggggaagguuuaaugcagaauguuuagcugaauauuuggauugugcauuccccuuuuaugucucuacugcaaguuuucucagggcauuugugauugacuucugugauguugacauuuauuuggaguuagauguuuaaaaaauuacuaauuuauggccuggugcgguggcuuacaccuguaaucccagcacuuugggaggccaaggcggguggaucacgaggucaggagauccaguccauccuggcuaacauggugaaacccugucuccacuaaaaauacaacaaauuaaccgggcguggugacaggcaccuguagucccagcuacucgggaggcugaggcaggagaauggugugaaccugggaggcagagcuugcagugagccaucgugccacugcacuccagccuaggcaacagagcgagacuccgucucaaaaaaaaaaaaaauuuacuaucuuauuguuucucucauuuugaauuugugaaauuauuauucauuuuauggacauacugcauggauucuguguuucaguuaugacaggagaucuagaaucuggguggggcugugaguaaauagaaagguaacucagucugugccuugaggaauuccgcaguccaguggaggaagaaagagacggagaaauaauuagguacagugugccaaaggcuauaauagaggagguacaaacucuucccagagaaggcaggcagaauuugaacuagguuucaaggaugugugaaggugaacugggguggggagggcuucccagacagaaaaaacagcgaggguguagaguuucaaagggggaagcccagggguauaauaagugaaggagacagugugaaauuauaaauuuuggaugcccuuaaugaguuugaacuucauuuucuuagaaauggaguacuuuuaaauguuccuaaaauggggacgaggcauugauauucaugguucaguuagguuuaggagcuuuuguagaaguccuuuucaaggucugcuuaaucucaugggccagauagugacaccucgaugcaagggagcauguaaaugugcucuauuagcugggagcauugcuaucagaaauuacauuuccggcucucuucuuaaggguaaaggagagguaggauauugaguggcaacuggcauucugggauguagaagaaauacaguaccauaaagggauagaggaaaauggguagacuuaacguucugaaccaaagcuaagauucuccgugagcgauuagaguaggcuuuugggauuugcuuaccuucucuuaucugcuagccagccacacaggaagcacaucuuuguggagugacagaggaggagguaggaaaugcuuucucauuuuuaugguagaaacauccaagagcugagccuucauucuggcugagagaacucuagaugguucagacuugcauuccugggaaggccuuccagcuagagugauggaacaaagcaaugauuucuguggcccuguguggacagcaguggcagucaguuuacucucccuguugguuaacugucuuucguuugaucuagagacuuccucaaaacaauuuuguugugcuuguucuuugaaagcaacagcagacaaaacaagcuuugagguuuuuagaaaagagcuugacacugagcaccucuuuugagcuagaucugucugucaugcugaaccuguuuucuguggcugcguagcuuuucaaaucuguuuaugcuugcugguguuauugaaacagaaugggaagaucuaugcaaaaaggaacauugaucuuaauaaauuuaugucaguaagaaugggacugccauuuuaaaauuuauuuuaauuccuuaccuauuuucuuguucaauuauucuaaaagugauuaaaugaagauacgucacagaaaguaugcuuugaaaucaagauguggggaaaaccuguaguucugaguaggccugauagaaucaucauuguuagaguauuuggagguuuuguaguagggauuuugucuucacuuaaauauuuaguugaaauauguuccaauaguuugacacauuacagaaucugucugaaagaaaugucuaaaauaugauuccucagaagcugcucuugguuuuacuuucugcuguugguuuuacuuucuaacauuucauuuugaucccgcaguuuuaagaguaaucaaaaaggccgggcacgguggcucacaccuguaaucccagcacuucgggagacugagguggguggaucacuugaggucaggaguucaaggccagccuggccaacauggugaaaccccgucucuacaaaaaauacaaaaaucagccgagcgugguggugcaugccuguagucucaguuacucgggaggcugagacaggagaaucccuugaacccaggaggcggagguugcagugagccgagaucauaccacugcauuccagccugggcaacagagccagacucugucucaaaaaaaaagaguaaucaaaaagcuacauuauuuaaaucuuggcaugucuuuaaaaaauguuaaacugucaggaaaauuaucacuucuggauaccaccuucagaaaaacacaugaaaauuugugcaugucucaaauaguuguuaauuuaugaaaaauuagaaagaguguuugaauguauauuucugucauauuauauugcucauauuuuuaaauuauacuuuuuuucacccgugaagcccauauaguuaaguuugaaaauuuuaauuauauuagaauuugaaaauuaaauaaaucuccuuuaauucaugcauaauuuucuaauagucauauaguuuguauuauauaauuugagaaacuugguucuaaaaaaauugucugccaaagaauguauauuucugaauucuguucugcuuucauacaucugaaaauauuugagcuaucauaacuggcuaugcuucaaacccagucugaaaugggugaccuuugcuggcuuuggauugcagagcugggggcuguuguuugcuuuaucugauuuaaaauagucaguaguuuauuuugcaggcaguuagauguauaccuuugcauaaaaucauugaacugaaaagguuggcacuccaagaauacguugugagaaaagagaacuugaguacucacucucgacucaccugaaucuuauuaauauuuuauugauuaauaucuguuguauuuuuaaguaaauaagcucucuagaaacuaucucugcuucuuuguucauuuaaaauauauuaaacaaauugauacagauugcaaaaauuaguugcaacguuccuaguuagauaucaaugaaauaaaaauggucuauucauacgaguucauuuuaguuauuccuacuaauaucaaauguguuuuaaaaaaugggagauuauaaucuuuuuaugaaguaagauaaauuauuacuuuguauauuuaauucaaagaaaacaaaaaggccacaagugccugcauaaaggcacauccacuuaggauuauuguuaaggccuacaguugauaauuaggauucaggcauagcauaaaugaagugguaucuuuuuuuuuuuuuuuuuuuuugagacgaagucucgcucuguuguccaggcuggagugcaguggcacggucucggcucacugcaagcucugccucccuccuggguucacgccauucuccucccucagccucccgaguagcugggacuacaggcuuccgccaccacucccagcuacguuuuuuuguauuuuugguagagacaggguuucaccauguuagccaggauggucuugaucuccugaccucaugauccacccgucucggccucccaaagugcugggauuacaggcaugagccaccgcgcccagccagauaucaauuauuuuuagacccaaugauauuugcuguugauuuauuguuggugcacaaaauaagaaaacaaaagcaugguuuuaaaacagcccuuuacacauuuaauauggaaaugguaaccuacaggucuguauuccauacagauuccugggcucauuuuaucugugaauuccucugggcgucaugcaugcccaggacugacuuuaaagcagaauuauccaguagagguauaauaggaccguuagaucuaauuuaaaguuuucaaguagccacauaaaaaaauaagcaggcgaaauuaauuuuagucugucacuaaauucaaaauguuauuucaacagggggucaauauaaaagcuauuuaugaaauacauuauuuuuucauauuaugucuucaaaauguucacauuucacauauuuauuuuuuauuuuauuauuacuauuuuuuugagacggagucucacucagucgguugcccaggcuagagugcaaucuagcuugcucauugcaaucuuggcucauugcaaccuccaccuccuggguucaagcaguuuuccugccucagccuccugaguagcugggauuacaggcgugugccaucacacccagcuaauuuuuuuauuuuugguagggaugagauuucaccauguuggccaggcuggucuugaacuccugaccucaagugacuugccgcuuuggccucccaaagugccgggauuacaguugugagccaccgcaccugauuacauauuucacauauuuuaauucagaccagcugcaugucaaguacuuaguagccacagauggcuagugguuacuguauuggacagugcagcucuaggagagucucuucaaccugcagcugucuaggaagagaaucauaguuucuggaacagguagaaucuauaagaccuccuuuuuaagcuucuccacuuuacagaugaagaaaguaauaucuggagauguugaguuguucaaaaucacccacauuuuaaggaucaagagcccagucccuguucucuaacuucuaaucucuuucuucaucacuuuuucugcuucauguugcugcauccccuuuaguuacuaagguacuaacguuagguuguugcuaucaguuaaauauuaagccaggagcuuuaagacaaucuggcccacuugaaggcauggccugauuuggacaaaacuugugggguaggaugaauagaguuaccaggcauaucuucaaccucucuguggacuaguauuauacauauaugagaugauguaggguccagugaucaguucaucuuuuucuauugugagcacuguuggaauaggaauggggggaccuuuugggacccaggauaugugauucugaacccugaaaugucagaugcccacuaaaaggaaggggagagauggaccugucauuaccuuacacauuuuauugucuguauggguauguaaacauguacagauuauaaggaauugcacuucauuucugggcuucuggaaacacagguauuaagauuucauuuaccuccccuuguuuuggaaggcuuauugugugugugcccauaguucuuacccaguuacacuuaaaguaugauacuuuuugacagcuuaagccuauugcauuccuggcauguaaaauaguuauuuucagaauguaagcaaauguggaaagcuuacugccugacauggaggguuggagaagugggauugguguucuuuuguuguaaacucauuuuugugaaauauuugcuuuacaacgugaagcaugcaugauggaugaacuuuuagaauugaaaguuauuuuucauuucauuccugaaauauuuaccagcauggauguugacugagugcuuugaagaguuugcuuagucauauaacuuagguuuuaugauuuuagauuuaauuaaacuuaaaguuuuccuguuugauccucaggacuucucaucuguggcaaggcuuuacucacaaaggaaauaucaaccuugaaguuaagcaugcccuguguuucuuuauauucugaugaaaacgauugaaguuugccagugcugugucugggacaaugcuuagaggauucauggcuuguaggaaugaguuaaaaguacaaggauauuggcuggcauggugacugucgccuguagucccaaaacuuugagagucugaggucagaggauugcuugagcucaggaguuugagacaagccugggcagcauaaggagaucccaucucuauguuuuuuaaaaaagugaaaaacaacaacaacaacaagguacagggguaucugcguuuccuuaggcagcugucuuauauaccuuuaaccuuaaaaaaauccaccauuuuuaaaacaguguuuucuguuguuuuucuuaguaaauauaaacaauaggaacugaaguuuagggcuuaaaauuuuugagagaauaauuuuuauuucaguagcuuuugggguacaagugguuucuuguuacuuaguugaauuacguaguggugaauucugagauuuuagugcacuuaaguaggguaccuuguaccuaaugucuaguuuuucuuuuaaucccuaguccccuauuacccuccuccucgugagucucuaaaguccaauaugucccucugugugccuuugcuuauuccuaacuuaguucccacuuauaagagagaacauacgguuuuugguuuuccaauuccugaauuacuuuacuuagaauaauggccuccagcucuauccaaguuguugcaaaagacauuauuuuguuccuuguaauggcugaguaguagucccugauauauauaugccacaucuucuuuauccucucauuagucaguggccacuuagguugguucugcaucuuugcauuugugaauugugguccuguaaacauauguguacaagugucuuuuucauacaaugacuucuuuuccuccggguagauacccaguauuaagauugcuggaucaaaugguagaucuacuuuuaacucuuuaggaaaucuccauaauguuuuccauagaggugguacuaguuuacauucugagagaauaauuuuuguaaaauuauguuuaagcuagauuuggaauugggaaagaauuacauucuuuauaggaagcuuuugaaaaauauauuuaaaaauauauaaaaauaugcauaauccuaccacccacaaaugucuguauuauuaugucauuucuaaaccauuuuugagauuaugcuauagauuacguuuuagauccuacauuuuauuucuuaacauuaaaucucauacuauuuuaaguucuuuguacauguaauguuuacugaauggguaaaucuguuuagggaaacuggagcuauguaguuguggacuugugcuuuuguuuuguuuuguuuuguuuguuuguacauuugcuuuuuagaaaugucuauucagauccuuggcccauuuuuuuuuuuuuuuuuuuuuuugagauggagucuugcucugucgcccagacuggagugcaguggcgcgaucucggcucacugcaagcuccgccucccggguucacgccauucucccgccucagccucccgaguagcugggacuacgggcgcccgccaccacgcccggcuaauuuuguuuuuguuuuguauuuuuaguagagauaggguuucaccauguuggccaggauggucuugaucuccugaccucgugauccccccgccucggccucccaaagugcugggauuacaggcgugagccaccgugcccagacagacaugugcuuuuuuauuuggcauuucuagccugaacauaggcuggaaguagugacuuagagagggauuguuugccaaauaucagguaauauuuuaauuauuuauuauuuauuguaaugcugugaaucaggagucccuaaccccugggccauggacugguaccggucuguggcguguuaggagcuuugcugcacagcaguaggugagcaaugggugagugaguguugcugccugagcccugccucuugucacaucagcagggcauuagaugcucauaggagcgcaaacccuauugugaaccgcauguaagaaagugagagcugcguugcacacuccuuauuagaaucuaaugccugaugaucugagguggagcaguuucaucccgaaaccaaaccacaaaauugucuuucaucaaaccauucccuggugccagaaaggcuggggaccacugcuauaaauugcugcugucaaguaguguuacgcaugguggucuuuaacauaaaaaaaaaagguaaugaacguacaccacacagauuagcaaaaauaaggaaaggcugaucuaguaguucaaacaagcaauccucuuauuuaaugguucugugauugcucguguaggcagaagcuuaacuguaaguuguugcauuugacaggcaaauguagcuggagcuggaauguagauauuagugaaauugugauuucaguuuacuggagccauucagugggagcaugaaguggguuacaugauuacacggauauaaauaaagcguccuccuugccacuucacugcuguuaaagucucuccugauguuauguggugaaaaacaagucaaaaacauuaauucugucaaguuuccaaagauauaagaaucuuugaccagaaaagagacgguauuuaucuucaaauuuaacaaauugugaugaaaugcugcuguuacagaaccuaguguaaggucguggaguccauucagccagacacauguaauuuugauuauuaacugccguuucuguggucagucggccaguuuuauauauuucacauuauagguauuuggagcaaagacaguguuguuuauuguuuacuuuaaaaaaauacaauacuguaacuacauaaugaguaaauguugauacuguugaaaacuaauaaaaacaaauucuuacacuaucaacaucacagaaauucuaauuguaagaaaauauugauauaauauggaaauccguucauuuauuuggugcauuaauugaacaccaacacuaugccaagcauugggauacaaccaugaaagaggccagcuuccugaucucacagagcuuguacuuuguuggguggggcagagagcaaaucagucaaucugucugucugucugucuaucuaucugucuaucuaucugucuaucuagaugucaaucaguauacucugugccacuugguggucagugcuaugaagaaaaauuaagccagugaggagcuggauagagacacagucuggaaggguaugaaggggaucagaauaugcuacccccaaauaugccauuucagcaaaguacuaauuugagcugaagacaaucgagaaauagcagacccaggacaagcuuuacccccuuuuuauaaaaauuuugcugugugaagguauccuccuuccccucuccaucccuggagagaccacuagagguggcaccaucgccugcagaaacaaaccuuauugaaauaacccuuaucuucuauuaguuucccccauauauuuaccuuaccacacuuccccuggaagcccuaauccccucuccuuugucuugugacuucuccacaguuuauugcucuuuguuaaaaugguguguaugcucucaggccuaacugcuucuuuuggguuuuugcuuuucuguggagcucccuccucuccccucccucauguaaaaauaauaacauuaaauaaaauuuguguuuuuuccccugcgaaucugucucgucaguuuaauuggcaaggccucaugugcugaaccuaacaggguagagaaaaaagguuuuuuuccccuuuucuacaaguauuaaaccuggagagaacaauacaguguaaaggcugugaggugggagcaugcugggguguuggaagaagcacaugagcuuacaaacauuccaucaauuugcauucauuccaaaaauuguaugcaauuuuucagugacgauucccauugaucaaucauuuauaaaaacuaauggugagggucuuccauacucaguuuacucccuucuuggaaaagaauguacauuuuaaucaagaugauuucaugaaagacauucuguacuccaaacauuuaaaagagcguuuagaguauacagcaauucaucuuuucuucuguauuuuaaaauuuaagacagggagaauuauuguauuauacuuaguucagauuugguggugguuuuguuuuuugguuccagugaaaagaaauugcaucaguaaccuggcggucaaccgugccauauuguuugugauuuauuagucuggaaaaaauaacuguauuucuggcauauguaaaaauaguuugcugagaggccuccuugguuguggcaauaguaauacuaauuaccagguacuguauguagcucauucuaugaaccaggccuuguugaaaagugcuuucacuuaauuuuuucuuuucagcagccugugagguaccuacuguuauccccagcugggagggagcuggccaguggacuggguuuaaacuauguuuucauugucuuuacucuuaaccacuuaucuucucugccuccagcaaaauaagucaaagaguucagccaguguuucuucuuggacuaagcagucagccuccuaaguaagcaagccuuggaaugcaauugauugguaagauacuaaaguaaucaguaaggcccucaguuccuggcugccagcuucuuucacccucuccugcaggaaguucugaaugcugauaucucuacuuggugucuucucucccccucccaauuccauuauuucccuuuuucucaaucccaagugaaggaaguucugaguguggauguuggagucauucagaccuuggaucugagucacaacucuuucaauuuacuagaaauaugacugcaagaaaaugauguaagcuucccuaaaccaauuuccacaucuacaaaguaucuaaauagauugcuuaggagaaaaauugaauuaaauugaauaaagugcaaagcacagaacauggccaggaguaggcccuggaugaaugagggaaaaaugguucugauuuuuauuuuugagccucuuuguaacauuuguuggccccuucagaauaauccuuagaguucauaucagccacccuucaucccuccugggaugggccaggggagaggcccaguugccugugacacugcuucguuucacauuucacugcuuuagcaucucaacauuucauugauaacauuuuugaugccugaaaacagaauaacuuauuuguaauucuacauacauuuuguuugugaucaaguuguuagaguuugaaaugagccucauuuccuuggguuuugucccuccccaucugaccuuccucuucucagugaacccugaagaaaaaacacuagcaaaggaaucucaagaauguugguucgggacacagcucucuccaucuacucuccugcccuaguccugccccuccuuguguuuucagcggugaccaggcacuggugacagccuuggcugcuuggaccagcuggagguagcugcaaaaugccugccugcuagcuuugaaaaaucucugccaaccucauugaaauaauuguuuaccacauaucagaggggacugggaaguggguaauugagagaucuuuuugaagggguuuguggcuucuccacuugcagaggcuuccugaaaugguggguaaugcucaugccucagggagaaucaauauccuucuccuaaaaccugcucacacguagcucuaaguauuagacaugcauuuuuguuaacauuuuaucagugcauuuuucuaccugugucauuuggaccuuagauucgggagaaaaucacuguguaucuuuggugguuucagguggcucuuaaauuucauuaauucacaaaaucugaauugaauggaauagucuguuuugggagguuuuuuuggggggguuggggagggauuggauuuuucaguccuuccaagagacuucagguuuuuuuuuugauguucugauuagcccgguguguguaaggcccuaucagguguucgccugugugauccuaucacacccacauccuguagcugcauccaagugcuuugaggccgacuuaauggggauuaacuuaacaguugcucugugggaacagaugcucuuugccgcuuauuucuaauaaauugauugagccauuuaaaagauuuuuuuuuucuuuuaaguuacaucuucuuaagaaacuguagacaauaaagcaaaacuaaaauacuugggucuaaaauuaguguauuauauuuaaaacacugggcuucagacugauuauaucaugcucuuuuacugacuuucuagucagaugcuuauuuauaaaaauaaagcuuauauaaagggcagcauucaaauguuacaccagucgguuuuagcaguuugaccuuccacaguagcuaaauauuuuuuacacugagagaagaauucuuuaacauuauaugcuaucagcaugucaagugaauucugagcuugcaugcaacagaugagacccuagguggaaacauaaaaacauaccagugugaaagagaaaagcaggcucucugucuuugggaaggaguucugcagggagggguguuuauaaguguaguagauacuuaggaaaauuaauacaauuauuauaaaagucaucugggaaaaaccauuagguaagaauagccaauaaaaaaccagaagcaaaauguaaagauauagaaauuaaaacugcacaucccaugcauagauaggucaauggggcaaacuggaagucuagaaauaaaguugugcauauauuggaaauuagugcaagauaaaagugucuuuuuacaucagaaaggggaaagauggauuauuuaguuaaugguguuggguuaucugacuguacauagaaggaagguggguaauuauuuacccaguaccaauacuggauuaccuaguauuauguacccaguacaguuugucagcaacaaaaggcaaacuuuuuuauuccaugaaguguucuuacaaaucaguaagaaauacuaaauaugaacaucuucagagaaaaaugaacauuuuugaaaacuuauuaugaaaagaauuaaacauacacaagagagaauagugcgcugaaugcucagcaaugaucagcucucacccagucuuguuuuaucuguauuccccuuucucaaccugcucaauucucuuuucccucacuggguuauuuugaaauaauuucaauucuauaauuuuauguauaaauauuucaguguggaugucuaacagaaucucuauuagacguggacaaaaaaggcaaagaauuuuauaguacacaggaaaaaauacacagccaauaaaccuaugaagauaugcucaaucucauagucgucagggaaaugcaaaguaaaacagugauauaacauuguuuuuuaaaacccugaugggcaaagacuaaaaaggcuugccagauuggcauuuucaucuacugucaauugauaacagauauuucuuugcuuggaguacaguggcacagucuggacucacugcaaccucugccucccagguucaagugauucuccugccucagccucccgaguaccugggauuacaggugugagccaccacgccuggcucauuuuuuguauuuuuaguagaagcaggguuucaccauguuggccaggcuggucucgaauuccugaccucaagugaucugcccacugcaggcaugagccgcugcaugcagcugguacagaaauuuuuuagaucagucauuuagaauuuuauguacauaucccuugaucuaggaauucuagaaacuaauuaguucauaguauauuguauaaaugcgcacagaugaggauauuaugagagcauuauuuguaucaacuaagcaagccuuuaaaaaacucuuauacaguagaauauuaugcugauacauuaaaagugggcauaaccauacugauguauagaaauaucuaaaaucauaccgauauaagugaaaacauucagaaugcaggcauaaucacagauuaaacaguaauuuauauaaaaaacagaaaauuuauauguguauuaugucaguagcagauucaagugaaucugacaaaaucugacucugggcaaugagaacauuggaauggaggagaagguaguacauauuuacuuuguauauuaucaccuuuuguacuauuugagucuuuuuaacuguacgcagauacuuuagagcagggguccccaacacccagccauggacagguacugguccauggccugcuaggaaccgggccacacagcaggaggugaguggcaggcaggugagccagugagcauuacugccugagugcugcuuccuggcaguagauucucacaggagcacaaaaccuauugugaacuaaacaugggagggauccagguugccugguccaguccuugugagaaucuaacuaaugucugaugaucugagguggaagaguuucaucccaaaaccaucccaucccauccagucucaugccaucccacccccaacaccccauggauaaauggucuuccacaaaaccagucccuggugccaaaaagguuagagaucacugccuuagaggcugcucccucuuggcacaucuugaauguaggacuccuugguucugccauuccugguagguagucagccagcuuuugauaguucuccccagagacuucaucccacaggcaagccaucccauuccacguaaaacaucucuaauguuaggaaggcacguauuuugaugugauaucuagaauccucccagcuguucuucagaggaacauuacuuuuauaaaguugaaaagaacguuuuauuguauuauaaaacuaggucauuucagugaauuucaucuauuuucauggguaacugauucuuauaucaaaacuugcuuuugaaaguacuggaagcauaaauuauuacuucaggcccauuugcuuuacuuuguucagcacauugaacaucaaggagcaacucccucgaucuaaaauuucuagcauuggugcuuguaauaucauuuuucaaguugacauuaaugcuaucuuuggaauucucaugguaagucagaagaaagcaguuuaguggaacuguucuuucucccacugaauuguauacugagaucuguuauauuuucugcauuuuaacccagaaaguuguucaagagaauugaccaugauaagacaucuguagcuuauuuuguauuuuuuuaauggaaaauuguaacugacuuuuaaauuuaagauugaguguagccuuucccaaaccaauagcuaauguuuuuauaacuauuuaguguaggagauuauaauaaaauccacauugcuuaagauauaaaauguuugugcaguaauaggcuguauaaaaacaguaaauugagauuguaucaggaauaauguauuauaaaccauauaugaaaccagguacuaacuugguauucugcauagcuuuaucagaaaggcagagcaaauacuaucucaaaaugaaguauaaacaaaaugagguucagugagugaugugguuuggcuccauccccaccuggaucucaucuugaauuguaguccccauaauccccauguguagugggagggaccagguggagauaacugaaucauagaggcgguuucccccauccuguucugguaauagugaguuaguucucacgagaacugaucacuuuauaagggacuuuuccccccuuuugcuuggcacuucuucuuccugccaccaugugaagaaggacguguuugccuccccgucuacccuaauuguaagguuccugaggccuccccagccaugcugaacugugagucaguucaaccuguuucuuuuauaaauuacugagucuuggauaugucuucauuagcagcgugagaucagauuaauacagggaggcuacauaauuugacccaaguagcaauaaacaauaggggugagguugaaauccaggccccugguacuuauggccuuaagcuaagugaaauaagccagacacagaaaaacaaauacugcaugauuucauuuauauguggaaccuaaaacacucaaacucauggaaacaagaguagaagggugguguuaccaggguuuggaugugggggaagugaggcgauguuggucaaagggugcaaacuugcaguuaugagauuaauaccuaauguacagccuagugacuaguuaauaauagugaauuguacacuugaaaacgucugcgagaguaaauguuaaauauucuuaccacacagaacaaaaaaaguaacucugaggugauggauauguuaauuagcuugauugugauaaucauuucacaguguauacauauaucaaaacaucacguuguauacauugaauauacauaauuuuugucaauuauacuucaguaaagcuagggaagaauaaaagaagugaccuaaccaggacaccuaucuguagcucuaugguaaagccaaaagggauaauaacuuuugauuaucaaaacuucaucaucauuauuauuuuuuaagacugggucuugcuauguuacuuaggcuggucucaaacuccuaggcuaagugauccuccugccuuggccucccgacauauuaggauuauaggcaugagccaucacacccagccaguuuugaagguaucuuuauuacauuuuuuuguuuaaauauuuaauaguaaguguuuaacuugaagcauuuuuuucugccuuaaaauugauuuucccacucauuuuauggaucaaaacuauuaucagauuuuaauucccacuccaccacauuguuuauaaaaguugacaauuauggaaaguaaaguaauacugaauuuuucuaaugccuaucuuugacauggaauaaagauuauaaaauuucuuauaacuugaaugaguuuuuaaaaauuggacaucuuuuuauaaaaaucuagcauugaccauuucaacauaaguuuuacuuaucucugaaauacagguaguaccuauuuuuauuaauuuucuuaagugaugcugagugacacuauuuuuguuuuuuuucacuuuuucuuuacuuuuuuuuugagacaggaucucagucugcugccaaggcuagagugcagugguguggucuuagcucacugcagccucggcuuccugggcucaagcgaugcugccaccucagccuccugaguagcugggacuacagguuugcaccaccaggcccagcaguuuuaaagauuuuuuguagagauggggucuugcuguguugcccagacuggucuugaacuccuggccucaggcgagccuccgaccucuaucucccaaagugcuggaauuauagacaucaaccaccgugccuggccccagugacacugucuuaauuuugaauagggaaguaucuaaugguauuaaaauggucuggcagagaaggggauaugaggcuuggugaaaauaagcacaggaugcaccaucuuugaguaaguguuaguuucugcagugagccagcagcaacauucuuagcagagccuagaaagaucgagugagggcugugugguggugcagccucuuaagucucucugguuccacaacaugcucagauugguggcuuugauauuuucuccauccaggacgcauugugcuaagcuuagggaagguccaguggauauuuaccaagccucuuauacugccccgcauguugccaugagacagcagcguuaucaccuuaaauggugcaaauacuccuugugcauacccuaccccugagaucuaacaucuggauucuggauacuguuuccuauucuuccaucuugcugcaugguucccagguuauguauauaguguggcuaggcaccacacauggcccuggcuccuugcagccauacagaggugaccuaacuggauguaauuggguauguaccggguguuggcuaccugugcagguugagggccuuccacaggucuagcaaagcaauucauugccuuucugaauuuuugaaugcuucauuugugaaacccuugauguaauaacuguugauauuauuucuuuuugaaaacuccccuuacucuucccuguuucuucauuuguaaacuggaaccgauagaaaaguaccaaacuuaggguuguugugaggcguaaaagaaauaauacagcccagagaacauaguauauacucagcaaguauuuauuaauaugacuacuaagccagcauuggugauugauuggcucauagugucuucuauuugccagauguuuucagaggcucuguucauguucauacccauguuuguaaaugacagaauguaaauuucuuaauccucugucuucuccuuuagcaucagcucuuguccccaaaguaaaagaacucagucauccagaacccaguuuuguagaucuauuuuucaaaauugggcaguuaauagaaaauuaaaagcagucuagggaaaagccuuuccuuuggguuuguugcuuucuuuucugucauaauaagacugugcccaaacuguagggaaaaaucaagaaacuguaaaauacaucaucaggguguuuauaguaaauguaaaacguuaaguaacauuugaguuaaucugugcuuguacaaaccucagaagcuuaaauaaugaaccaaugacauauaauuuagaaaguuuucauuagacucuuugcguugguauuugcaauaucagauuugcaugucaucauuauuagccuuccucuauuuugaguguugacuaggugccaggcgucauguugagaaauuuaugugcuuauuuaauucucacacugacuccaugagauagauacuccauuuuacagaugaggaccccacaucauaaccuuuuggccagaauuacaguuaguguuagaauuuaaaccuaugcagucucauuccaaauccucugucuuuacuccuccagaaugcuccauuaaaugaauuguuucuuauaauccgguuguuuuaacguuggaaaagaacuugagaacauuuagcccaaccacccuaugaaguuuggcaguacuucuugccauucuuucaauagauaauuuauuugaguuuaagggagagucuaugaauuaacacuaguaccaaaacucccaugagaaaauaauguagacagcuuuuguuaaaaaagcagaauuuuuaaagguguucauucaguuaucuucuugccuaacaaguuccuguguugugauagacuuugaauuuguuaaauaugaauuggcuuccugauucuagcuguuuugccagaggccugauuuagagaagggauuaaaccacuggucaaccuuggauggaauuugggccagcaguuccuucuccacagccccugacacuuggcuuugugccaagaaaauccuacaaaaggaaauugauuuacucuacccaagacagaguuccggaggcuuugguuguccauuguuagcuuagaaguuggcgcagugugcgugugauccacgccuaaauagcacagccuugcugugcgugguagaaguuggguuaguguugacaugcuguugacucacccucccgaggauggaagcucuggccugggucaaguuguggucacugcaguuaacaguuuguugaucucagggaguauuccacaguugcugauguaauugacaaugauuggagccagcucuuccccagauucaaauggaccaauuagaggacuuguugguucuguuuaucaacuauguaagugaguacugugaaguuggcauuguuuuuagucuguauuuggguaagaugaaacucuguucucagacaguaauaucuuucaaaaguacaauguuacuuauugugaccaaaguagggaugaaguuugcaaauuauuugguguaaugauuuaauuuggccauccaugcagugcaguucucuaccagugugauuguucucuuuguaaaauacucuuacuuugccagaaaauuguuuguuuguuuguuuguuuguuuguuuguuuguuuguuuugagacggagucucgcucuguugccaggcuggagugcaguggcccgauauuggcucacugcauccuucaagcaauucuccucccucagccuccugaguagcugggacuacaggugugugccaccacguccagcuaauuucuguauuuuuaauagagacgagguuucaucauguuggccaggauggucuugaucucuugaccucgugaucugccugccucggccuccuaaagugcugggauacaggcgugagccacugagcccuguugaaaauucuuauuaauaagauguuucucauagaauguuucaaaaaauugugacugguuucaaaaucagaugauuugcaagaauuagccauaguauaaacacauaguucucaaaccguuuucugggagugggcccagagaucuauuuaacaaaaccuugaguagagucuggugcaaguuaaaauuggagaaccacuaauguaaccuuaccuuaucuguggaccacauuuugagcuuuggaagaaauaacccuuucuauccuucacaagguaacagaugauuuuuuugcacaauuauuugauaaugagcuuauauuugagauuaagguaugcacacgauaauguacauucucacucuaggucuggggaccuugauucuuugacucuucuguccuuuucucuccaguuacuugguuuugugcauuaacaaacuuuucaauuuacuuauuuuuuuuuacuuauuuacuuauuucucaucccuuacguaauguugcaucauuguuuuuuguagccucugcaguucaagauacuaaucaccccuuucuaccacauuaaaauacagacucuaccuaaaaucauguaugggaguaacuugauauauacgaaaguguaaccgugucacaauuccccgccccaccccgccagucuacauaaaacugcaaacacuuuauugcuuaccaagaaaguagacaauaauaucgaagaaagcccuccuuuuccucuucuuugaccaacaagggagcaguuccugacaaaugucaguuugcuuuuugaguuccuuagguuucuguguuguguuugcaauggauaaauauugaguaacagguacugacuguauuguauacauugaaaacuauccaccaacagaauauuugcaggaggauuuuguuuuguuuuguuuuguuuuguuuuguuuuguuuucugagacaggcuaucucucugucacccaggauggagugccauggagucaucauggcuuacuguagccuuaaccuccuugucucaagcgauccucccgccucagccuccuaaguagcuaggacuacaggagaggaacaccaugccuggcuaauuuuuuuuuuuuuuuuuguagagacagaguuucgcuguguuggccaggcuaguguugaacuccugggcucaagaaaucucccaaagugcugggauuauaggcaucagccacugugccuggcuugagaaugacauucuauaaguaguuucagucccuuaguuuaaucccauauuuugauccuauaacauguacaauauuuguguauaguauaugaucugccaacucucuaagaagauuuuaaaacuuauuauguuaaauuucagacauauacaucauccagcuucaaaaauugaccacauuuugcuguucuuguuucagcaccucccccugccccauuuucuuuucugaagcauuuuaaaauaauucucagguaucauaucauuuuacuucuguucauagguuucugaaaggauuugaugcagaauguuauuauuaaaccaguauacagagagaaaggccacuggauauuaguacauguuuugguuucagacgguccuuuuaagaguauauuaaaucacauaaggauuuucugaguacccauuagaaccacaaaaaauaccuaugauacccuucuuacugcaguagaagaugaguuuccuaggguagcccuuuguugauggaacaaacauguauuuuguuucaucaggaaaaucauuggaacagccaugacucagauccacuaaaugaaggaacaaaaauaggaccugccucaccuccugauuuuuuuuuaaaucucuaggaugaguaaccagaauauuuuuauguugugcuaaguagguuuguuuguuuguuuuuuacucugacuuauauuauuugaauuguagaaauauauuguuuuuacuuuuuucuuuaaaauucuaucuggaguuucuaaaugagagauuguagcuccuaaaaccuuucuuaguuuuggugucuugcuuucuguucuuagcgucuguggucauuucuaacucccagugaggaaagagcucucuggucuuguuucuuuguuaaaugaaggagcaaaccuccgucucguugauccacucccaacccacuuguuuuguaacaaugaaaguuaucucauacuuaaaagacaacuugaaauuauaacacaccuguaacaaaguaaaggguauggguuuuuacuuagguuuaaaaaaagggcaguaacccuuuucauaaaaaagcaaaauuuagaugggauagaacccccguuuauagaaaagauuuuaaaaucucauuugcucucauugaaaccuuaaccuucucucaaauacuggcgcaccucugaggaacuucaaauacgguuugaaaacuaaugguuuaaggagggccaggcgcaguggcucaugccuguaaccccagcacuuugggaggccgaggugggcggaucacuugauguuagccugggcaacauggccaaaugcugucucuacugaaaauaggaaaaauuagcugggugugguggcgcaugccuguagucccagcuacucaggaggcggagguggaggcgggaggaucucuugaacccaggaggcauaggugcagugagcagagauggaucucuugaacccaggaggcauaggugcagugagcagagaucgcgccacugcacuccagccugggugacauugagacugucucaaaaaggaagacgaauggucuaaggaaacuaguuugugguuucucagcggagaaugacauucuaguuucuacagaucuggcaacagaagacaggcacauaaacuggccugcuuuggagucagggccaagacuuaaauccagauuuaaaaccagcuuuuuuuuuuucuucuucuaaaacaaccaaccuguguuuuagguccagugucugccuuguaaguugcucaaagcucagauacaaggaaguaaucagcacacauuuuugugauaacauuccugaaaagaaaaagaugagguggacuaagguaaauacacugcuccuuaaaaauccauauuuuuagauuauuuauaaaucaaaugggcaugguuaccaaagaugaauucuagagguguaaaacuccagucuuauaccucaaauuucaguuuuccuuagggagcaaaacacuuccaugaucuuacugaggaccuaaaaaagccuguacauauuuuaaaaauagcacucccuagauaaagccugauggauccaggguacaguagaaucaugaaauugccuguuucuuuuuaaaagauguauaugauugcucgguggcuguauauuguccaucgugugcgugccugugugguauguugguucuuucagagaggcaguggcgugcagagugagaggaucacagauguguaugugacaaaacuauuucuuuucuuucuuuucuuuucuuucuuucuuucuuucuuucuuucuuucuuuucuuucuuuucuuuucuuuucuuuucuuuuuucuuuuuugagacagagucucacucuguugcccaggcuggagugcaauggugugaucuuggcuuacugcaaccucugccuccuggguucaagcgauucuccugccucagccuccugaguagcuggauuacaggugugcaccacgaugccuggcuaauuuuuguauuuuuaguagaggcaggguuucacuguguuguucaggcuggucucgaacuucugaccucgugauccgccugccucggccacccagcgugcugggauuacaggugugagccaccgugccuggcugacaaaacuauuucuaaaacacaaguccagauauuccuaccaagggcucucuggggcuucguuuugauuuauaugcaaaacacuccuaauguggugacauuggggagauaaagaucugggaugaugagagagaaaggcagguaggacacaugcccuuccaguaacuuucccagcuagggcuugcauuuaaccucugauggaggccucaccauccaggcagauguacuugcuuaggaaugaguuugagauaauaaggcuaaaugugcugccuucuguauauaauuugcauuuguccuaauguacgacuaaggaaaugaaaaaucaaaguuugagugacuaaaauaaaagaggucuguggaguaauuggauugaauuugcaccaagucaaggagaaaacuucuguauuuuguauguuuugucaugguucuaugauuacuuguuagaaagugauauaaaauucaauaacuuaguuugauaugaacuuggcuaucuuuaaguuauagaagucgugcauauaauguggcuguuuucaacccccauacccuuucugagugguuggagaugucuugaauuucgaagugagaaggucuggugcuguuacauagauaaucauguuagccagcuuuaccuucugauaagcucucaauuuaagaaaguacuucuaauccuggcuuuaucuuuggcuugcuaucuuauuaugcacagagcauaauuguaagaagggaauaauaucucuugcugucuauucacuaagaauagugugaggacagggcucuuaaaaacaugaagagaugggcacuauuguauagauauagagauuugaugaaauguuaaaauguuggaugauuuuaaaugacaaguggaguggugagaaguuuauuuuuaaccuuauguggauaccuuggauauuuagaaacaucgaaguuuuaaggaagaacaaauaucuugacuccaagaaaauggucaugugauacuguggcaucuauuuggucuuccugauguauauguuuccugacauuuagcuccuaaaauccuuggaaucuccagugcuaagaaggucuuauaugcuaaugagaugacugguggcuggguaaccuaccaugugauuagaggguuaggacuuucagucacccuccccaaccuccaggagcugaaguuugaguugauaaacuaaugaucaaugauaccuacauaaugaagcuuucuuaacaacccugaaggaccgcguucugggaacuuccagauagcugaacacauggagguuccuggaggguuggaugucaggaaagggcauggaaucucguuuucucuucagccgcaccucaccccgugcaucucuuccaucuggcuguucaucuguguguccuuuguaauauccuuuaaaauaaaugggugaauguaagcaaguauuucucuuaguucucugaaggugcuccagcaaugaaucaaaacgaaguaaggggucuggggaaugguagccaguuggucagaagcacaggcuacaaccuggggcuugugauugacaucugaaguugggggaguuuugugguacugagcccucagccugugggauguguaaucuccaaguacagugucagaauccaguugaauuagaggacacucagcuggcauccauuauuggcaugcaguauuccuugucaugagccugggcaacauagggagaccucaucucuacaaauauagcugggagugguggugugcaccugugguuccagcuacucaggaggcugagugggaagaucgcuugaguccaggaggcaaacauugcuucuccuccaaaugcuguacuuuaacauguuuggaaacuccugcaaaggaauuucaacauaagcgaagucaauggguuauaaaggacugaaugccauuuuguaaaugucagaaaucaaagucacaaccaaguuaaguucuagauuagggccaggaagagaaauguauuaucuggucaaccauaucaaaucuguauuuugguggaagagcauuuucuuauauugguucugauugguuugauacggacagggaacuguuuucuuuauuccaguuauuuguuuuguuuuguuucugagacagagucucgcucugucgcccaggcuggagugcaguggugcgaucucggcucacugcaaccucugccccucagguucaagcgauucuccugccucagccucccgaguagcugggauuacaagcgugcuguaguuuuuguauuuuuaguagagaugagguuucaccaucuuggccaggcuggucuucaacuccugaccucaugaucccacccgccucggccucccaaagugcugggauuacaggcaugagccaccgcgcccggccuauucuaguuguuaaucaguuaacauagccaaaagauauagaauaagauuguagacugaauccauagucuaaugauuugucuuccuaguaauugugaauaauucagacauucaaaauuagucuggcaucauacaaacauuagacuaguccuaaaaugaggauauuggcaaguguguuaauaaaaauugcauaugcaguauuaauagguuccuuacguaggcugccgauuacucaggaacugucagauguuuuguuuuguuuugucuuugagagauggggcaggguuuuacucugcuggagugcaguggcacaaucuuggcugacugcagccuugaccugcugggcucaagcgauccucccuccacagccuccuaaguagcugggacuacaggcaugcaccaccaugcccagcuaauuuuuguaucuuuuuuuagagacgggguuuugccauguugcccaggcuggucuccaacuccugagcucagggaucuacccacccaugccucccuaagugcugugauuacaggcaugagccacugugcccagcccccagauuuuuaaucuucucuuugacauugaguuucagaaaugaaguauaaauggugaauuuuuaguguagaauaugaugcacuaggaagaucacuuacccguuuauucacuuucuuagaccaugucaacccgauucugaauuuaggguucuguugugaugguguucuuuagaagugauuuuaacacucaaaauacuauagucuguaacauaauuuacugauuuuuuaauuuuugcaaacuaaguugaaguaaucaaguauuuaugaguucuuugggugagaccaucugucaaagaauucugggcuuaauggagauacauauauguugugaauacuaaacagauauccaaguaauaaagcagaaaucauaugcuguguaacagaaauguaaaguucugaauuaguucacgaguaggagagaaacuuuuuuuuaaagguagaggagaacuaaaaguaauuucuuaaaagagugccuauuuuacaucuugaauauuaaaagucuaauucagugccuugggaucuuguucuuuuuguagauuuugauuugaaugaacuucaguuugcugaaaugucuaaugggugcaaaguacagauuuaauuauaagguugagcuaaaaucagaauuuaagcauauggcauauauaauaccaauuuaaucuuucccccuuaaauuuaguuauuuuuagugagucccaaacaccauauuugagacaucacuuuuuucuuuuuuaaagagauagggucucccuaugugaggcuggagugcaguagcuauucacaggcucgaucauagcaaacuacagccuugaacuccuggccccagugaguguaaugucucaccaugccaaaguacuuuuaucuuaaauugcuuauuuuuuuguuuauuuuuuuaacugacucuguuuacaaaauuaaccuuuuaucuagugacagcuagauuguaucacauuugucaucuauggacaacugauuuuuaguuguuuaauaugguaaguuuauuauuguuuuuccuuauuuaagaaaacaggaucugagugaaaaaaaaaaaaaucuuaauucaacuaucacgauuccaguaggaaguagacagacauucaucuguauacauuaggugucaaaguagaguuuugugguuuaucauucugaagauuugagauucaagacaugacuaucuuucagucauauugugcaauagauaacauauaauguuucucacugaugagaacaguugguuagaucucucagaugacuugaauuagguauuaguucaagucaguugucaguaaguuuggcuuuaucguucagaggagcuucuuaugacuggacauuucucaaguauugccguauuggucauuuggcuaucaaugcuuaaauuauacucaguauaguauaaauuuucuuauuucccuuauuuaagcaugccuccauuacacuguuguugucucuaauaagaguuuaauaaucuuuguuuuggcuuaguaaaaagagccaacaaauauaugagugacugacugaguguauugcucuaugcgcaauugucuuaaaggaaaaacguuuauagaaucacugugaacaauaaaaugguugcauuucgcuggaaaaccucggugcuccuuugguaaauaaugaaguguuuuguuuuacgggccuuuucacuacuucauugacaacagaccuuuuuuuuuaaauuaauuaauuaauuuauuuauuuauuuauuuauuuuuugagguggcguuucgcucuuguuaccugggccggagugcaguggugcgaucuuggcucaccgcaaccuccgccuccuggguucaagcgauucuccugccucagccuccugaguagcugggauuacgggugagugccaccacgcccagcuaauuuuauauuuuuaguagagaagggguuucuccauguuggucaggcuggucucgaacucccgaccucacgugauccaccugccucggccucccaaagugcugggauuacaggcgggagccacugcaucugaccaacaacauauauuuauauuacccaguaauaggcauagucuaaggaagauaauagaauuuauucuuaguagugaacucuuuggcuuuugaagcagaauuuuuuuuucuuuguucuuuucugugauaguaaggaaggaaggaagggaaggcuacuacuaaaaauauaaauugcuaaauagaagucaagucucuggguguugaagcucacauauuggugcuguccagaccugacgcaucuagaaacaggaauuugcccuuagcguaagcuuagccaaaugguugagucauuucuaaguauuuuaacauuauagaaugccuuaggaaaugucaugaauaucuaaaacaggucuucuugaggauuuuauuaguuucuuaaaacauggaaaggaacuugauucucagugcugguaccuaaaauucaaagacauuaguugugaguugcugugcuccucagcucuaagccacaguugucauggccaagccugucuccuuauggagaguggccuugcuguuuccugcagagcuucucuugugccuggcuugugccuggaagucagcgugucaccacuucagagagacacuauagaagcuuggugaucuucaaacaagaacuuaaaacaaagaaguuuucuuucacagauaucuuaaaacuuguagcuaaauaaaacgugaauaacugugagagccucauuacagcaauuuuuaaaaaagcaguacauguuuuguuguaucuuaaacaucacagaaugguauuguguguccaguuuuguuuguaaaauguaaccuucgugugaaugaccaucuauuccuuucuuuuuggaagguuaguuugucagcuguugugugaugcucaacauuuuauguaaugacauuuagcacaacguuucaauauaacaucucaggaaaacauuuaagaaauagugaaguucucuggguauuacauuaaucauauuaauuaccuguugcuuuuaauuuaucaccguaucacccuaauaucacaaggcauguguaguacuauuuuguaaagauuuucuaaagaccuucccucuauaggaaggaaaauuuaauucagaaauugggcugaacucucuuucacuugugugaaaaugggaaaauuagaaguaauuuguauuuuuuauugugaaaucaguguaggaaccugugcucguaucauggaaacaacagcacuaauguuuuucuccccucgggugugggcuuugcugcagauauccaugucuucuacuuuuucuguucuuaguucuuauucacuuauugucuauacuucgugucacuuuauugaauuucacaaaugcaauuuaggaauccagggaugugauaaaauuugugcaucugcuugucauuagccaucucacguuuauaucgcuaagugaaaauuuaacuuaguuuggaacaaaccaccaugauuuaguucaccuguauaguuuaaaagaccuaagaccugaaauuuuuuuuuuuuuuugaaacggagucucacucugucacccaggcuggaauacauggugugaucucagcucacugcaaccucugccucccggguucaagcaauucucugcuucagccuccugaguagcugggauuacaggcagcugccaccacgcauggcuaauuuuuguauuuuuaguagagacgggguuucaccaucuuggccaggcuggucuugaacuccuaaccucaugauccaccugccucggcuucccaaagugcugggauuacaggcgugagccauggugccuguccaagaccuggaauuuuacacugcauugggaccuuauaaaauucuugacuuguacccuuuuggcauuuucugaaugcucaugauuugcuucugaaauauuuuaggccuuuggaaacacuccuucauucuaauccucucuuuucuugcucucaauucuucaugucauguaauuauuuugccuagagccaaaucugauguguuauuauaaucaucauuucugcaggagcuugguaacacuccugcuuuuguucccuuuaaggcuucuuuugguuuuguuuauuuuguuucacucagaaugaucugguuaaguuuugcuugaucauccauuucaaaucucuuaguacauuuuucaaauucaguuccaagcauguuaaaugugucacaauggaaguggcccacggucaaauacauuuugggaaaccuugguuuuaaaaaaguuaaacugacuucauuauuacgguuuuuuuuuucaaaagccuccaguauccaucuugaaugauccauuucccauauguguuuuaugacagaauucuccccacucccagguaauaacuguugacauuuucugaaaacuguuuuugagaacacugaauuagauaugaaaugaggcauuuauucauacuucgaaacgaaugucuuaaaccucacugggccauuuugaguauacauuacuagugauauauuuaauaacuuagugguauaagcaugcaauaacaaauuucuuacacaagagaaguucuguguagaaacaaauuuaauacuguggcuaaagaaaugaaccaaaaaaauuuaauaucuugaaauuugcuucuuagcucuguuuagaaucauugugauucacggauaguaaauugucagaguggacuucaugaaccuuauaucagacauucugaaaagagcuaaaauugccauuaaacugcaugaguuaaaauaucuuagauaguuuaaaaauacuauguagacuuggugagucagaucugccacacugagcguguagcugggguugacgacacacguguugcagugucguuaccaguuugucucuuuuagagacaacuuggcaggcagacgucuugcagauaaacaaggaaagauugucuauuuuaaauggcauaagacauucuuuaaaccagugugucauaugugguuauauagucagcauuuucuuuagugcaggaaauccucucucaggguuccugaauaaauagcagguaucuuuguagggauagcucgcaggagauuucaaaugcuguguauucaucaguucaggcuccccagaugucuuacgaacgugcucauuuuaguuuucuuuucuuuucccucuuccugcuagauacaaguugagacaauaugauuagcucuuaaagugcuuacucuccauuuuauguauauuacugcauuuuaauccucauaauauccugugaggugggauguuacuauguccauuugagagauaaaggaaaucaagagguaaaguuaacuggcuuucuccaaacagcugguaauuacuaaauacagaauugacuuuugccuuuugauuccaaagaucauauugguacuuucaugugugggucccuucagccaguuccuacagugacccugacccagcuguaaguccccugaggucucuagagauauagacagugauggauuagacccuguucauaguugcagauacaagacauagagagguuucuagcaauaauuuuuuuaguuauauauuuucauagggcuuuugauuuauguaaccuauuaguauauauuuguuauuccaguagaguuaauacauuauucaaagagauuccaguuuuuaagccuuuucuccguuugucuaaguuguucauuaugaaaugauuggcuagaauuugaaagucuuuaccuacagagagauucugacuggcuugcuuggucuuggaacccuaguuaugagugcauugucuugcuuccuggugaacuuugcccagaaauaguuaccaccucauuuuuuuuuuuuaaaugaaagcuggauaauuaacccucaagauuucuuaauuaaaagauuacuauuauaaauugacccacagggaguuaauacaauaaaauuauuuuugaucauuuuauaugaaauaauuauggggcaaucuucuguaaucuugaguugaagggguuaucuugcuuaauguuaauaacuuuugauacaccaacuaccuuuuaaaaauuaacguuuuuuuuuuuugcuucuguggaagggaggcuguauuuuguaggauuuacaguuuacauaguuauuguuuuauaugaugucaguuggauuaauuauguuuugaguggaaacucuguuugguucaaccaauauuugaaugcuaauuuuguucugugaacaaauagaaauacagagaacaguaagacaugacucuuucccccuaaguaaaggcuuagguuggaguuuucaaccugggaauuacugacauuuugagccaaauaauuguuuauguugggugggggagggccuacagcggaggcugccuguacauuguaggauguuuaguaacaucccuagcuucuaccuacuagauagaugccaguagcaccacccaagucgugacaaucaucuuugccaagaacuuugaaccucuaccuagaaacaguucauagggcucaaaaagcaaaguggccuaggacccauguaguuaacaagcuuacccuguuggagaaccacugcauagcugaacaacaugggugagacuagugucaggguaaaggagcucuugacuggagauuggccguacacagaaaacaaagugaguguuauggauauuuggggauuuaccuucauuagggcacaguugguuagcguuagguguacaccaacauuauucccucuuuagaaacagccaugcacguaacauuuuagcacaucugaagaggcacuucuauucuaauuaccuaaaauucuuauuaucuagaauuacaugcuaugaacaacagcaguaaagucagaagccagaaucuaugugauguuaucuguuuugcgaucacaguuguguucuucucuuaguuuauuugaacaaguuugugaaaaaauuuuugugcuuauguaaauacucuuugcuuagauuuuuugguagaauguaaaucuuucccacacagugcaauaccccuccugcccaagggcgagauauagauuguacaguuuguuauuucuguguuuuagggcuuauuccucuguagacaugucaaaaagacauccgucggggguaaggaaugcauuagcaauucaagcugauaaucugcauggugagaguccagauaauuuuuuccccaggucacauaggcagcucugcacaagucuguuaaacauaugcuaguuuugaaaauuaaaauaaguucccaucacucaaggcaaugaaacguagaugaauugcucugccagauugacucuuagaacuccugaugugauguggggcuagacagaaugggauguuugcuaauaaaucagggagguagugauuguuuuccuucuuuuucucccccacccccgucaggacaaacucacauucuguagccuggugcacucuaauaaugccuguugaccuuggccaugaaagcacucuagacucacccccuaaacaccgcaccgaaugugcucauccuugaaauuuacaagccuuagaaucuucccuaccuccacuccuguuuacugccuccuguuacuccuggugcuuccagucagaccguagucuuggcugugcaguaccuuuaggagcccucaaaaauguuuaauuucuuuuaaaaucagaaggaaaaauaaagaacaagauaauaaucaugaauauacaauaaugaauccagccugacuuagaguugucuuuauaccaaucaacagagcccuaaaauauagcuuuuaauguuuuuuuaagagagaaagaggcccacgaaaguuguccuggggcccccgcauccuccucauacacuggugggaugcugcucuugcuugcuuuggaauguggcagcagcucccagugacuucacacguuuauuacaaauucaaggucauuuggacgcuagccuugugcuaccuuucaugcuuccuguccgacccauacucagccugggcauguuuucugcucugaucuuuggucugccuuccuucuccuucuccaagucaaaccagucacucuuuccugagagcucuucgguguacccuugccagaccucugcauuaacacuccagcaccuuugguuagccaauuuggccuuauuugugucuccaccauuggauuaucuguccaucaaggucaggaauguuuucggguuaccccacuguccccaacuuugaauauguucacugccuggaaaauguuuaucugaauauaaggcaucaagccagaacuugcccaaaacuuaaccuaggacucaaacagcuuugaaaucuuaucuguguagagugggaacggcauguguuugauaaccaucagcauuugcuguuuugcuuagccaucaacaauccguuucuaucucuuccucauaguauuuucagcuguauuuuuguacagcagucauucacguuagguguuagguuacacugaaaucucugacaaccaguucugugcuacugaaggcuuuuagcagcaggauuaaaaaaauaguugauugcacauucgaagucucacugcucacacuguuuauguaauucuuggaguccaguuagaucaucugauuuuuaaaauguugccugaauuacaaaggaguucaggaauguguuaucaaagaauuaggaaauuaacauugaaauuuauugagcaacauagcuaauagguugucuugcuuuuuaagccuucuuguuuucuaggaggagccugaaguccguggacaaguugaacuguagcugguauuuaggaauugguaaagacagagguguggaugcuauguuuucuuuucucuguuaggaaauuacucuccuggugccacaauaaaaaauuucacagguaucuaaaguggaauuuauuuuguauuguuccacaccuuugucaauaauuacauuuucuaccuucuaguuuauuacuguuauuauuuuucaugccagguguuucuuaauuguuggcauaaguauuuauugaaugcuuauaugugggagugagagagucaggccagugcuaaagaguagggaauaaccccuagacagugaaguaacuuuugucuuguuugcacauuaaaaaaaaaaaaagauuaggaauccuugcucuauauacuagaaauguuugauguucucuuuucuucucuucaaacagagaaaacuuagaugaauacuuauaggcucuacugucaacuaacugcacccuccuaauauuggcgucugcauauuuuuaccauugucaauaucagauugccucugauguugugucacugaaacugauaguaacauuacauccaagaguaagacugcagugugauuuuuggcucuuggucuucuguucuuucggcaacaauuuuuuauaaauauagucaagaaaauagaaauaagagucuucacugcuaccuccccuucagaauuauuuucuccuaguauugugguuccugauagccuuuauuccuauagaaauggcaauucgaaaaauuccuucugugaaucugagggcucuacaaagggagagcuucuuugauagugcuuugguguaaguuauuuaagaaggacaaucuacccaggcuuaucaagcaaauaaccuggaauuuaaaccuggaguauucuuuaguguuccaagucugcaggaaaagaaguaaucuuggcuuaaacuaaauaaguuaacagaauacaauuugaacaaugaacaagaaugcuguuugaaaauuaucuuggguuuuuaugucaaguuaauauucucacugaauuucuauuauguuuguaaagcagcuuucuccuagaccaaaaauccuaguaauaaaaccacaacaguaugagaguuauaagcacacaguaaaggcugaugaguaaauguuaugacacuuugaaaggaaauaaaccagacgauauaauguaaauauccuuugugcuuaucaaaaauaagugacuucauguucuguuccugcaauauuucuguaaaucugcuaaaaauagaaagguaaaggucuaagaucauaaaucucugaugcccuuuccuuaaaaguaaggaauucuugucuuggauucuuauauaauauacuuauuuauaaucucacuuguucugauugcagguggccucuuacuaucuuuacauccaugugaaugugugugcuuugauguguacauaugagagacaagaacaaaaguaaaugucaaauauccgaauuccuguuucagugagcuuucacggaguaaauucuuuuugucuacuugccugugaucucuucuaauaugacuugcguuaaugaccuuuaagaaaucuuuuaauaaaauaaaaaauuuuauuaaaaucuuuuaauaaaaaaauuuuauuaaaaucuucuaauaaaaaauuuuauuaaaaucuucuucauacguguuacuugaauuuacucauggcaaggaccaguuaguaccauuuuaugaaaucacaagcucaugggcuugugauaaaacauauaagugcuuuaaauuuggcauugguaacggcaggccgacucacuugaaaaaugcucugaacugcucugccucaugcuggugggaagucagauggaaaugacuuucuagagaguuuagcuggccuccaagcuuaguggguacucacucuccuuaucccccgauagcugcucugagauuuuaaugcacauugaagacaauaugauaacuuaaccuggaaaauuagcauuuugguaagggucuuuaacuucauuaguauuuucauaccacuuugguauuagaaauuguaaagauauuaaaggguauggacaauguggaauguauguaccagacucagcaguguauacugacucccucacuauagcccagaacuggaaaucccgcuaacuaccucuccccauccuagccugaauugcccucuccaccuauguugguuuuacaauggccugacgccugaaagcugguagaaacuguauaggaaaauaggguugggauaaauuucugggcugacaaaggauagaggaauaugcuucuuuuuccccuuguccaaguauaucagcaacucuaagaugcagauuuaucaguauggcucuacugggcauguucuaguuaaaugguagacccacuaccucuucuggaaucuuguuuuccauuauauucccaccugcagcuuuucaaagacuuauucucuucucuaauggucucuugguucuuuuuuuugcccaugcucuacguuccgagugggucaacauugcagugggucaaugagaagaaauagaggggaaaaauaaaagaaccagaaagaaaccuguuaaguuugcacuuacuugugcauuaagcauauuagcguaagccuuaaacucuagaaaacucacuguagugcuguaaaguaccacugauaaaguaaaaguucauuuuuaugcugugucguuauuuagugaugaauaugauauugcauaaaagaugaggaucuguaaggccaggcgcgguggcucacgaggucaggaguucgagaucagccugaccaacaugaugaaaccccaucucuacuaaaaauacaaaaauuagccggguguggugacgcgcgccuguaaucccagcuacucaggaggcugaggcaggagaaucgcuugaaccagggaaguggagguugcagugagcugagaucacgcuacugcacuccagccugggcgacagagugagacuccgucuccaaaaaaaaaagaugaggaucuguguauaacugccagguguugugugagguaccaugaauaaccuggcaauauccuaacugugcagguaugaggagugacccccaggaauauaauugcaauuaaacuugcaaauuauguggggauacucuauuucagggcaauaaaauaaauuaugucuagagcucauaacucuuacacauauuuggcuaggucuaugcagcaaaacccaggugauaacugaggcuuuaacuuugggauuuguuuggugcugacucugccacauggugaaauuugguaggaucucagugcgagugucacaugaucagucugcuugacccaacaugccagaauuccauuucucagcccacucucuucucugcauacauaccuaccucccggagagggcugggcgggagccuacguguggcaagagcccucacugcuuuuguuacacagauuucaacacauauggcuugauggagugugauugcaguagcaugaauguuuggugaugaaauuugcauguccuuugcugggagaaguauaauuauaagauuuuuguauucacauagccacaugugagguaugagcaggaacggggucuauuuaauagcauuagauugcuuucagauuugaaauauuuccuuuuagaaauauauuguguaaacaaaauauguuuaauuuuuuuuaaaaacuaugccuuuguacaaauuguuuaucauuugcagaggucuaaaaaauguaggagaaaagaagcucacaaaaucaaucagaucuaaagauugcaaagauugauuaccaucuccuuaaaagcuucaguacauguguuuacaguaucauucuauuugccucugcucagauucuuuccaauucuaggacaacccaaaguguauagaucauaagccauaacugauccuaccuuacauaauacauuaaauauaaaauauuuauggccaggcauggugaccaguucuguaaucccagcacuuuaggagaccaaggcaggaggaacacuugaggccaggaaguugagaccagccucggcaacauacugagaccuugucucuacagaaaaauuagccagguauggugguaugggccuguacucccagcugccuaaaaaaaggcaacuugagaaaguuucuaccuucugaaacaaucuaugccuugauucuaucacuuaguauuuuaguuauuccuaucaaauacaugacuguguuaauuucuuuugccacaaaaaugcugcaaagccacaaacucacuccaaaauuuaguggcuuagaacaauaaccauuuauuauagcccacaagcucaagggucagcugaucccggcuuagcuuggcuacauuugauauaaaacaguagaaauuuagaaauugaauauauguagaauaucucuuguaccaaaaaugaagaggaauaauagauuuugauuuuucuuuguuguauucugugcugggugcuaaucuguccuagcugucagaacaaguagaagccauacuggaaaaucauuuauuuguuacuaucaaauuuauuucagugaaugccauucaaaccacucucucugaggagcccaguuaccaaguccuccaccuuguuagcaacauggacuuaaaugcacuaauucuagaaugagaucuuagcaaaguaccagcauuugagauuugugcaaauugagcucuuaaacuguguguauauguguguguguguguguguguucauucuagcacucccacuacauaccauacaaguagcuguauagcagguauauauacauguguauauguacauagguagguauaugucaacuguugaaaaacuagaaaauacacauuaaauaaaguaaggguugauaaacauuaguaguuggaacauugggagauuuggacuucuacuuugcagauucaguuggcugcauuagauuuaaggaaagaacuaacuuuggagaaauuuguguuugcauuucaggagagauuucuuaaagaggaaacuaccagagguuaguagauauuaacaucuagugauuuaaauuugagaaaugcaaauuagacauuuaagcuguggguuugcuucccguuuuacuugcucuaaaaguaauuuuuuuaaaagccaguaacaaagacaugcaaaauaguacugccaugggggaaaaauuacuugaaaauaauauucaagauugaagaauuaaaaaagcuugacaucuaguaccaggaaugccagcuggcuuguucugucaaaaagcaagcaugugcuuuggaauaacacucuugaguagacucuaggcggguuuugagcccuucugauuaucuaaauagauguggaagugacuuaucuugguuuuucugagucaaaugagauaaugagcaaaggccuuaguaggucuuugauuuuugccucuaacccuuuuucuaucugcauguucacaaggucaaggcugaugagauauggcaauauugagagagucagaauaggauaaagaucucaaauacuauauauauauuuuuuuuucauuuuuuuuucccuuuggugacuguaugagacaugucaguaaaacuuuaaagacaggccaggcguuguggcucaugcguauaaucccagcacuuugggaggccgaggcgggcagaucacuugaggucaggaguggcaacauggcaaaaacccgucucuacuaaaaaauacaaaaauuagccaggcguaguggugcacgccuguagucccagcuacucaggagguuaaagcacaagaaucgcuugaacccaggaggcagagguugcggugagccgagaucaccccgcugcacuccagccugggcgacugagcaagacucugucucagaaaacgaaacaaaacaaaagacacacagaaaaacuguaaagacagaaugaaagagaugaacuuuuuacaucucgcucauuucaucacauacuauauaguauguguaugguuucauauauguuaguguguguguauguauauauaugaaguuaaaagaaaacauucaccuuuuaagacuaaauggacauugacuagauuguaaacuguuuuugaggcuaagaguuuguuugccaugcauaaggcucuauuuuuuguaauuccacuuuuauauucauuuauaucaguccuagcaguagaugccacucuuacuggguccugccuaaaugcaugcuucaaauguugguuauuaauuucacgaguagugaauaacaaagacuccuauugagggaccucuugauuuccuacugggcaccagcagcaagcaugacuuacuggccuucuuaugaguggguaggaguuuugggucaacuugagaacaucuauccuuugaguaguaaaaaagcuugguauuagguuggcacaaaaguaauugcgauuuuugcaccaaucuaauaucaacagaggccgugaaaaacaucaagggaggauagcuuguaauuagaagccagaucaacagugacccaaaaagaauuucagguuuccaggagugaaauauguagauuacuccucugaaaggaauuguuuuucuccuauucgcuuucauggcaaaucauuuuuuaagccgaaacucaagcucugaaauaauuguguagcaaauaguggcugugaauagauguggcaacucuccacaaggguaaauagaaaccacuugcaguuucagucaucacauuuuauuuuucuuuuuuaauagcuucucuauuuuugcucaccacaaauacaugcacacacacacacaggggcaaagccuuggaaaauugcaauuuuccauuuuaauuugagagacagcccggucacauuaacagaacccuugacggaauagguugaauucccuucucugucccuauaaccccauggccuuggacauauccuuaccuggugcccuuuccucccucuuaugguccacuuuugugauucugauuuuaauuucaguucucuguuagugaugaaaugagcaacugcagauguuccgcuuacacuggaaauacuuuuuuggcauuuaaaagaaaacccuacagaugaauuauuccccugaaagggguucacucagauuuucuagauuaugauucuagaaaauaguucuuuacauuugacaauggagaauuuaaauguuuuaauaugaaaauguaaagcacucuugugggguauaguugaauuaugcccagguuaagggaauccaguauuuaugucaggaaaccauggaugugauagaaauaguaucgcuacaaagcugggcacaguggcucaugccuguaaucccaacauuuugggaggccgaggcaggaggaucacuugaggccaggaguucgagaccagccuggccaacauggugaaacccugucucuacuaaaaauacaaaaauuaucugggcgugguggcacaggccuguagucccagcuacuugggaggcugaggcaggagaauagcuugaaccuaggaggcggagagguugcagugagccgagaucaugccacugcacucuagucugggugguggagugugacaguguauccaaaaaaaaauacugagauuaugcaagaaucugacucgaagaaguuugaacugauuaaaaaguaccaaauacuucauuauaugaggccagcuauuuagacuagucagcgggugguucaaaugcagaaaacagauggcuuucauuagccagaaaccuuaaaauuacauaaauccacggaugcaacuaagcuauggaucugugcccucuccuugccaaacaggaccucucagcuagcaaaacagagagcuccuuguucacuuuucccuccuaguugagacccuguuggggaggaaugcugccaagccugcucuauaaggaauuuugaucuccuagaugauaacagagagaaacuuuuuggagaaagggaacacccuguuugaaaggacaacaagagaacuuguucaagaagguggcuuugcauuuaauugaaaauuguagcaacuguaggcguaggguuuccagauucacaucugcagacugguccagauuagguauauauguuuauauucguuuauguuauccccuuaagccucuuuuaaagccauuucuaaaaauugcuuuggaaaguccauuucacuucaguauucuuuauauuguggcucaaaaauauuuuuuuucugguaacaaaaauauuuucuuucuguuuuuaagacuuguagcauuuuuaaguuugauauguacgucucuguaguucagagcacuugguaaacagccucuugcuuuugaggcaauuuaugaaugcuucauuguuuuuagcugguuauuuuguucauugucaggaacacuguuuucccaugggaaagcaucuccaguuuuaugaugucaguggcaagucauucaguuuacaagaauuaccuucauauucagucuuagaaaagcauagaccacaaacggccaguuauaucacaguucucaucuuuuaaauguugucuuagauuuuugcaaaguaaucuuaacucaccuuagaauaguguuaagacauaaauagaacuaaaauguaguaguuaagugguuauauuucccaucuacuaagguauuuauauuucuuuucuuuuagaaaauaaaaauguuuaaaaaauuaggaauaauuaucuuuaggaugacuuuguaagacugugcuuuuuuacuggcagcaaauaccugccagauuucagguauuuggcagguaaauugaaucuuaaaagauuucaauuuuaagaguguccauauuaacagauccugaauaggacccuguguaucauuuauuaagucauuucuuggaggcuucacucaggaaaagggaguuaacccuuggauggcaauguuuaauguggccacauuuccuucuggcugaaugccagggaguggcugcgcuuagcaaccaggcuuuguuucauaaauggguuauuugaugcaggugaggaugccgugaguuguuugucuuguuuuaauucagggagacaggcauauguagugaaagcauggaauuguuugcagaugggcuucaguaagaauaggaagguuucugguucaauuuguaucuccaagcuaauugcucugauuuccauauacacaucugguguugguucggggggaaaaaauuuuacuugagaaacauggcuuuugugaguugauauuuauuugugaagggccucuuguaaugucaaauguaagaagaucuauacacacaaccaauuuuacaauuucuaauucaacagcuuacccuauuauugaggauucgcaguuuaaauuauuaaaugaucuccacuugaagaaaauagagcauguuaaucaucacgauucuccaaacauuuauuuuuaaaguuaauauuaaaucucaucugguggaaaaccugacaggaacugaagcauauauuuucuagucuaaacucucauuguuaaaaugaagacaacaugagacaguuauagcgccguaaucaaguuauuugaaaaaaauguuuuaaaaauuaccacuuuuugguagucaacauacacacauaugccaacagauggcauuaaaaaauggcaagaacaugagacaauuauagggucauaauaaauuuauuugaaaaaaauguuuaaaaaauuaccacuuuuugauagucagcauacacacauaugccaacagaugacauuaaaauagcuguaaagucaagaagcagggaggaugacaaagugaaaaauagaagaaaucaaaggaaguuaagucaaaagaggaaaaaaaaaugaagcauuuacuugguuugucagguagggugauccaguguauuuugccaaaaacuuuccugguuuuagcaccaaaugucucagaacauggcagcugaugaccucccucacagugagugaucccagagagcaaugaagaauugugaugcccuucaugaccuuguuuuggauguuacacaucaucaugcccuucagugaccuuucugguagcaaaggguuuguuuuuaaaagaguugcagcaucuuuaagucuaauauauacaugcucggaaguuacaccaucaucacuucugcuguacuccauuuguugcacagacagacccugauacauuguggaguuucccaggguccaugaauagcaggaggcagggacuauugggggccuucuuggaggcuggcuacccuggggagagaaauugucaauuuccucuccuugcggggaggaaauggaaucaagugcauuuguauugacaagaagguagaacgcuuuccuuagacauuguaaugaacagauuguggauaaacaaaaguacagagagaguuugaggcagaggaggagacuguuucaacagaauauuuaccagcuaugguaaaggcucauuagugucuccguacaguuaacaacaugcugccaagacuggaaaucuuugggacaggaaugaauucggaaggugaacagaauaaaguacugugggaacaauggcgauuccauuaguggauuguacauuccuuacgggcagggcccuccauagcaucugauguagggccuuauccacagguaucugauuauuauuugacuuucuuuaauguuuuugcaguguuauuaucuauacuacuuauuucaguaagauugacaacauuugcauuucgauuucuaagaucaagacaaugaauuuccucuuaaucccucaggaaagcugugaaauuuaaauuuauagagcauucuacuuagccugcugcuuugcaucugucagagaaugagaccccccaguuucauggaagucacaggaaguggcaaggggcucagauggaguugagggguucuagcuauuucugcagaugaucuggauauuuuggcaucggcugcuuugacuuaaccaucuggcaauguaaaggcagaauuucguuaaauauuggaaaaguuacuugaaaacauggcucuagagauuuugccagcagcuuuugcacucaugacuugguucaaucuaagaccuguuuuguuuuuuuguuguaaggaccuaaguccucuguuggguuuugacgaaguauguguaaaaaugacuaaaauggccagagguaucuuauuuuacauuuaugugggaagaaauguuuggaaacuguuucauuucuuuaacugaaaauuucucagugcaauuuuaguugguguuuuuccuccuguggacaguuuuuaggaaugauacaaguuaucguggaaucacccaguucuugagugugugaacgaauggcuucugcuggaaguuaauucuucuuggcaugggugucucacauuuccccagcagcuggauuugacaagggagggccuaucaugauuaauaugccuucuaauugauugguuuaauaacaccuuuacuccuguggauauauuuuucauuucuugcugaauuuuuuuuucuuuuugagauaccagaaccuguuaagugacacgguauagauauuucaggacuuccauuuucucuuuuaaaaauauuuuuguaaagguaaugccuguacacagaagaguuugaaaauacagaaggcacccuuuuucaugaaguuauuuugugaaguggucuauugccugcaaugguaauagcuaggaccccuuacuuacuacccagcaggcacuauguagagcuccaaaugagaaaauguuggcuccuugcagaugguugggagaggagacaccagcacucuuaacagacuuguuaagaguugagacugauaaccagagaauauucugggggaaaccaggagggaucgccaacauacucaguuauauuuguggauggugaauucuacagugaauuuuucuguucaaaaucauaauacagucacuugcuaacuaccaacgccauacuugcucucagugcugagagguggcacaaauauuauuuucagucuuggucaucaggcagggccuggcaggcaucaugcucugugugagucaguggaguuuauuauaagaaugcgguagccuccacagugauuauauuuauuauaggaaaacguguaauuuuguugucagaaccuuucagcagguaccacaaaaucucauaugggaaaacguguaaauuuuucaugaauaaauuccuuucgguauugguaauuuccuucucuguuuuaguauaaaagaaagcauugccuuauagguggcuaagaacaucuguagcauacauaacacuuaaucuaaaggaguguugaagaccgggcugauuccuaauugagaaugagcaagaauagaacucuuuuugauaguuaucccuguucuuccuccaagccucugccuuggagcuauggauacuauaacuaacugaagcuucuucuuucagguacccacugaugguaaugcuggccugcuggcugaaccccagauugccauguucuguggcagacugaacaugcacaugaauguccagaaugggaagugggauucagauccaucagggaccaaaaccugcauugauaccaaggaaggcauccugcaguauugccaagaaguaaguccuguccgguggcuagcaauucacguuggaucacaugcauuuguuuucaaaaaauuuaacuucuuguauuuugcaucaguauuuuaacccuacaguaaaaaucuugguuccuaaugauucaccauaccauuaauauauuuauuugcauuacccuaugauauacauauaaauguuuuuaaaauuaugaugucguauuaugaccaucacuaaacaguaguuuaagaugucacagcacuuuuuuuuuuccucacucugucacccagguuggagugcaguggcaagauuauggcuuacuguagccuugaccuacugggcucaagcaauccucccaccucagccucccaaguagcuggacuauaggcacaugccaccaggccugacugauuuuuuuuaauuuuuaguagagauggggucuccuuguguuggccaggcugucugaaacuccugggcucaagcgauccucuggcuggaccucccaaagugcugagauuacggguaugagccaccaugcucagcccuccacacuccuuucaucuucaguauauaucucaccacggcucuacagucaaggucuuuugguuaaaagugcuagcauuaauuuuuuucuguuaccagcuugauacauauuuuaguucauuuguaucuguuuguauucuauuauaguuugguuuuuuccucccuuauuaauuuuacuuuuugacuaucauguuaguucuaugaaauauacucagaaagcucacuuuucacucauucucuauugauaaacauuuucauuguuccugauuuauuuuuuuggcaaaagaaaauacauauuuuuccuucuuguacaaaaaaaguacaaaguucacuguucugcacuuugcuuuuuuuuuuuuuuuuuuuuuuaacuuaacuuuguauccuggaaaucauccuuugucauuucguggagaucuucauuuuuguuuaauucuuuguagucuuuuugcuguuacuauacagggugcuccuuucuuauucaauuuaaaauagcuggaguuccaggcauuuuaucucacacuucuuagauaguuaucucugcauugugacugcaucuuaagaacauuagaaguaauuagucuuaugcuuguuggcaaagcagaauucucgacacucauuauaaacagcagauagccuggcaacauuuucuuuuguuguaauccuuuuuguacuagaaauuuuucuuuagccuacuuggauaaugaauguuuguuguuuaauuaauauuacuauucuauugagauccuuuuauuuuaaauuguaaauacuaaaauuauuauuauuaaaagguuuaauuuguuuugauagcgcucuguuuaagaaaggacaagcucuaauuacuaauugguguuuugagaagcaaaaagcaucuacauuaucacaauauauuacauauuaaguaauuuuuaucuugaaaggaguaugaaccaugaugugaaaugaugaauaguggaaaucacuaauacuuaaguucauuauauguauuuuuuguuuuguuuuguuuuuuuuugagaugacaucuugcucugucgcccaggauggagugcaguggugcaaucucagcuuacugcaaccuccaccucccggguauaaaugauucuccugccucagccuccugaguagaugggacuauaggcacccgccaccacgcccagcuaaauuuuuuuguauuuuuaguagagacaggguuucaccauauuggccaggcuggucuugaacuacugacauugugauccacccaugucagccucccaaagugcugggauuauagccgugagcuaccacguaugguccauuauauguauuuuuacaagaacauucugugugcugauuuacuaaguauggauugauaauaaaucagcuuuugccugggugugacuuuuauaaagugucaauguuagaaauaauauuuacauucugcugaagaguucuuguaguacaauuguguagauaaguuauaaauuuuauaaaucagaacucugugcauacuuauauguuuuugauaccauuuuuuugauauaugcauacagacuauguauucugagugucaaauaaacuuuuuuuaaaggcuagaauuaaaauuuaguuuaugacauugaccaaauuguccuuuucuggugaaucgacuauuuugauacaugugucauaguuugcaucuaaguuuuucuucccuuaguuucacguaugaauaaccagauguuuucacauuuguaugguggccauaccaaaaauuacucuucuugaccccaggaacaccccucuuuucccguuucacuuagagauccuacuaaugccuggguagcuuuacuuucugucuuagccuguuguuugucccaggguguauuagucuguucucacauugcuguaauaaacuaccugagacuggguaauuuauaaagaaaagagguuuaagugguucacgguuccaaaggcuguaugggaagcauggcuggggaggccucaggaaacuuagaaucauggcaggaggugaaggggaagaagacacauguucacauggccagagcaagaaagagaaagagugugaagggagaggugcuacacacuuucaaacacccggaucucaugagaacacugucacgggacagcacucgagggauggugcuuaaacauugaaaccacccccaugauccaaucccuucccaccagaccccacuuccaacacugggaauuacaauucgacaugagauuuggguagggacacagagccaaacuguaucaaaggguugagcacagagugguucuucccaguucuggacuuuaccagauuguugguggccaccaugaguggggagaauuagcccuuugcugucaccuuccucuugcaauucugguauuaucuguccucugccuaccacccacccacggaagucuuguuggaugauacacaccagccagauucuucaacauuaggcgccauaaguaagaaagggccaaaacaucauaccuugugagccauuuuaauggauuugggcuuuauuuuguagcaacaggaagucacuagacuuuauuuuuuaucuauuuauuuuuuucuuuuuuuuucuuuuguuuuugagacagagucuugcucuuguggcccaggcugcagugcaguggcacaaucucagcucacugcaaccucugccuccuggguucaaaugauucuccugccucagccucccgaguagcugggauuauaggcgccugccaccacgccgggauuuuuuuuauuuuuaguagagacaggguuucaccauguuggccaggcuggucucgaacuccugaccuugcgauccacccucuucggccucccagagugcugggauuacaggcgugagccacccgcacccggccuagacuuuauuuuuucagagaagaggagugauuguagauuugcauuuaaacaaaucaccuucuugcuuuaucacuauguccccuaccauauaucuucguucucccagagacugccaugcugcagccucuagccgugugcuguccaguacuguagccacuggcccuaugugguuguuuggcacuugaaauguggcuaguggaaacugaugugugcuauaaguguaagauagauaccguaucucaaagauauaaugugagaaaaccuguaaaaugaucacauucauuuuuauauagguuuaacauugaaauaguuauguuuugaauauguuguuaaauacaucauaaauguuacugaguuguaacuaugugauuaaaauugauuucacuuguuucuuuugacguuucacguggcagugaggaaauugagguuccauaggcaguugcauucuguuuccguggaacagugcuguucucugugcuaucccgagccaccagugacucugagcuguaagggucuuagaucccaugaucuggcaagugggagagggagguagaaaugagucccuccauaccuucaaccagaacuucacugcauguugcaagucagggaacaaggcuuguuugggguccuuuuaaauacaucuuucauuaaauacauuuggauguaagaugauuauaugccuuucuagaacccuguggugcucucuuccuccucagacauaaugucuuuggauacuaagggugcauugaugaacagaacacagggccuguucuucaaagggggagaaaagcuuguaaaaucauaauuuuagcaaucuaaaaacuacauggugacagugacacuaauaccaucagcauugagcauucacaaagggucacaaagggucagcuacuaugcuaaguacuugcacucauuuuacccacucagugacaccuguggagaagaaccgaagaaagcaccuuggggaauugcagcauugaaggcaaacaaagagagacgauuccccaugagggagaugagcaguggccagagagauaggauaggaaguaggaggcguuacaugcuggaaggcaagccauguaaauuucuaaaugaggggaaagauaagagugcaagcaugaugcaaacggaaagcaguugaaguguaguuuuugacaugguaaaaucaugucugucaugcagacugaacacaugucaaauauuuuauucaauucauuaaugagaugaacuguaagaugugaaaaaugguucauuuugacuuggagagauuuaaaauuccuuccccagcacacuugaguugcauggcuaugaacaggaaucaucuggaauuaucuggaauaucgucaaauuauuuccaugguacaggaacacuugcauugcuauggggugucugcaguauccaucuuuacaaagcucuaaggguguggaauagcuuguaaggauguaaguaauaaggguguaagaauuuuaaggguguaagucguaaaauagcuuauuuaguagcaagucaacuggaggaacaugcuguagaaucagauaauccuuuccccgccacccucagggucugcaagacaacaccugcauuucaaugcuaggacacccagcaaucucuuuugcucauaucuuguuuuuggacauuuguaugugugugugacaaaacauuguuaggaucuggcaaauagaaggucauuguugacccuguggaauagcauggggagaaguuacguuguaguccauugcaggaaaaacaacgugggucaauggugagucagcuguggacuccuggaggaaagaccuagaggcaaaaagcuuugaggucauugaagacaaaaggaaaggcuuugugauuuugauuuuuaaauggaaggaauuugggccuaaggaagcuuaaacuaaacugugggaaggacugauacccauccuaagcacuaguugcagguaucucuuaagaacuagguuuuggccgagcuccguggcucagaccuguagucgcagcgcuuugagugagaggaucgcuugggcccaagaguacaagguuacaguaagcuaugacuaugguauucaguucuguaagaacuaggcagaaaggagauccaguggauaugugauugccugggucuuggaaaggggagggaacaucuccuuuucugaggaagaauggggagauaggguggguuaauuaggcaguuucuuuugccaggugauaaaaacccccuaaacaauuuguauuuuauauauggagaauauuuucucccacugaugggaaggaucguagugugggggaugcuuacccaauuucuuaaaaauguacacagaaaugagaucccuaggugcuggaaccgagggucaguacugccuagaauuuccccauuagggucucuuuuguuucugcuuaccuuccugcuguguguuuacuccuuuucuccugcuaagauggguguccucaaggagaccagggauguugguagccacgaccucugguaguguuaguccugguuuggcaucccaacuuuguucugcccaugggcauuaucagggagugcuucugguuggcacugcuuugaguuacacgucugcccuuggagccaccaccguaucugcagggacucaguaucaggacuagcccaucuuggccuuguggguguggccgugugauguggggagaggagcuguugccagaagagggaugaggaauggcaugggcaaaauagaagaaugaccccagugcugcaacacaguggguauggauuagaaaaggcuuguaggcuggacagggcgaggugagggagugcaucaugcauuaggauuuuaaguggcuuuuuggggaguauugagcagguggcaggggagacaaguucacucagaaguuuuagacaguguugacauuuucuuucaaauugugcaucuugaauucucuagaacauucuuuauagauauuucaggaucuuccugccacuuuccacauuguagcuauucugguguuuuucuuuuauaauuagaaauaaugaauaguucucauuuguaggcuuggauuuucaugcguguguuggaaaguguucguuuugccuuuuuuuuuuaacuucauguuuuuauuuuuuaaaccguauugauggauucauugcuaggaacggcaaggaaaagaauacucucacaauguuaccacguuuccuucucacagguuuuauaaguuguauuauuuuuauauuuucaaaguuauaaucuuaccaucuccucuguugccauacuucucauucauagggucugucuuuaacuggacucauuguuuacagcuagucuuuucaucagaucaucucaaacccuguauuacauuaauauuuugauuccguuuuguuggaugacuuucaucuuaaucauucuuauuguugaacaauguuuuucuuauuauugaacaauugcuucauuagguauagaauuccugguugauggguguuugauucagcaccaugaaaauucacgguauucugguaucugucauugggcaaauucuucuucuuuuuuuuuuuuuuuuuuuuugaaaaaaaugcguggaaaccauuaguuaccauugacagagcuacucauuuaaugauuuuuuuuuucucccaauagugguggaugaauuuuuuacuuugcguucucacuuugugucucucaugaccaaaauauuuuagagauaacuagcuggcuaagucugagguggcuguuaacagucugguccuaggauagaacaaaaccaacagaacucaucaccgucacgucguuuugacuuuuugcucacaaguuuaacucauuguuuaauuuguuuuuccaaaggauugcuuugcaguauacauguuggugcauagcuuaacaugaugauaaauacauaacuuugacugugaauuaucuacucugcuccuuucauagucucaugcuucucugaauuuguauuuuguguuacuggguuguuuuguuguuaucauucauaguguuuuuuuugcccuugauucuuugaaccagguuuuggucaagggcaagguucaagagaaaaaguaaaaacacagucuuuuauuuuugcucuugguuauaaacccuuguaaaguuugauugagaagauaacuuggaucuuaugguuuaaauugagucuuuguuuaaucccaagucuuccaaauucuuugugcuuauguauucuuuccucuuucccaaucguaauaguuuugcuucugccuagucauuggucaaauaccugccuuucaaugcauuuaaaaaauauuuuguguuagcaccauuugagauuuuuccccccuuuuuuuucaaguauguauugaggacuguuaugggaugaauguuuguguucccccaaaauuuagauauugaaacccuaaccccaggcuauucggagaugguauucggagaugauaccuuugggaggugauaacuguuagaugaggucaugaguaugugcccccgugauggaacuagugcccuuauaagaaaagauaccaaagagcuugccuuuuucucccugcucaaacgaagaagucacauaaggacacagcaaggagguggcugucugcaagcaaggaagagcggccucaccagaacucggucaugcuggcaccuugguuuuggacuuccagcuuccagagcugugacaaaagacauuuuuguuguuuaagccauucacaguaaggcagcauuuugagcuaagacaaagaccuacuguggcuucuguaggcaaaagcccuacagacccaaaguguugugagaauuaacauuucuagggaucaugccuuacaguggauuuuauccaacacuuagcucugaccuagagcacgcuagucgucguuagguaaaugcuuguggaugguaguuucuggcacagagauuggagcgguaaugggcaggaguucuguauccagcuuaugcugagagagcuucccauaaaauggagccuauacuuuccuuuugcagagaccauuucuauccauugauagaauucuuuuuuuucuuuuucuuuuuuuugacgggaucucacuccaucgcccaggcuggagugcaguggcaugaugucaacccacugcaaccucugccuccuggguucaagugauucucaugccucagccuccugaguagcugggauuacaaggugcacgccaccacauguggcuaauuuuuguauuuugguagagaugggguuucaccauguuggcuaggcuggucuugaacucuagugauuuaccugccucggccucccaaagugcugggauuacaggcaugagccacugcacccagccuuccaucgacagaauucuaaagacauguuuaggcaagaguugguggaauguuggcguguaguccagauuugccuucaguuuguuuuuauccgcuucaaaugcaaaggccaugauaauucaauaguaaagucauaaauccauaguaugacuuaaaauauuugguuguaauauuacaaaguaugcuuccaaacacauuaagcaugcaaaauccuuauauuguucuuuuuguuuaguguuuaggguaguuugugugaaucauagaugaccacaguagacuguugaguuguuauuuucuuuugacauucuuugauagaaaacagugcuuuuccucuguuauuuauacuagaagcaaaaaguaucucucauagcauuauggaaacaacucgaauacaacuacgucaauuauucaucuuuuuuuuuuuuuuuuuuuuuuuuuugagacagagucccacuccaucaaccaggcuggagugcaguggugcagucuuggcucacugcauucuuugcauccugggcucaagugauucucgugccucagccucccaaguagcugagauuacaggugcccacaccauucucagauaauuuuuguauuuuuacuagagaugggguuucaccauguuggccaggcuggucucgaacuccugaccucaagugauccaccugucuuggccucccaaagugcugggauuacaggugcgaaccacugugccuggcaguuauucaucauuuaacagcauaaaguggccacuugcuuuaauaaacuauuauaguaccaaaauuuuggccugaggaauuuauaaauauaaauagaacaaaacaaaaauaauauuccccuugaaacauauucuaaaaccaggggcuaaaaguuagaauuguuagauuuuauuguccuguuucuuugggaugaaaugaaauuuuuuaaaaaccauaguuuuggccgggcgcaguggcucacgccuguaaucccagcacuuugggaggccgaggcgggcagaucacgaggucaggagaucgagaccaucccggcuaacacggugaaacccugucucuacuaaaaauacaaaaauauuugccgggcgugguggugggcaccuguagucccagcuacuugggaggcugaggcaggagaauggcgugaacccgggagguggagcuugcggugagccgagaucgcgccgcugcacuccagccugggcgacaagagcgagacuccggcuccaaaaaaaaaaaaaaaaaaaaaaccacauaguuuuacuuaaaccaaaggcuuugggauuccagaagaauaaaggaaguguacuucaauucuacaucucaagaaucuauuucuucccaaauuuaauacaggcaaauuuagucuauauuuauugggcacuguuagguuuuugugucagguguugcugaguggcgggauaccauucuuggcccauaaggaccuuauaaaucuauuaauacaauuaaauugugaagaaaauuuagaaaauugcaaagguagaaugagguugcaaauuggagggucuuauucuggagauagguggaagcuauggcagauuuuuagcaugaaugcuuucuggucaagacacuuuuagaaaaauuagcuuguuuccaagaguagauuagauuggggagagaaggaauucaaauuacaaaauaauagugugaaaagcauugugggagaucauccuguccauccccucauucaugauauccugaggugcuguauuaagggcaucauugcucuuugucacccgagcaguccaggaaggcugccuguucagucuuagacuguauccucacagucuuaaaccauauccucacuuuaugauagaaacacacaggcaaguguuguaagaguuacauauugucaguuaaacaagaaauuggaugaguccccauacuauucuuccucuuuuaaagagagaacuugggccgggugccauggcucacaccuguaaucccagcacauugggaggccgagucgggcuggugacgagaucaagagaucaagaccauccuagccaacauggugaaaccccgucucuacuaaaaauacaaaaauuagaugggcaugguggcgcacgccuguagucccagcuacucgggagacugaggcaggagaauugcuugaacucggaggccgagguugcagugggccgagaucacgccacugcacuccagccuggcgacagagugagacuccaucccaaaaaaaaaaaaaaaaaaaaaaaggaaaaaaaaagagauaacuugaaacaggcucuuccagccucucuauucuuuuaauaacaugcagugcacuucuuggagcuaggggcuagggucuaggggcuucuugaagguguugaugucucugguaacuuacacugcagggcaggucucuggagggaacuuugaacagguuaagccucaaaugcaggcagagauuuccaauugggaaaguuaggugaacguggcuuuaucaucucuuuuauugguuuauggguauuuucucuuuuuccuguuuucuuucccaccauuuaacauuaucuguucucugccuuuuuaaccuucuggcuuuaaaugaacaguugcuuaaucuauagauuaacaggaucagcaaacaaagcacagcagugccugcacaaagcagaaacugccuguuagaugaguugagcaaaaccauuuccuuugcccaacuuucuccucuaaaauacauaacugaacaugggauucccagacacgaauuguuucucaaccuuucuuuuuccauucuacaguuguaugaaauuaaaauuaaauaaaaagcaaacaacagagguagucuuuuuaaucuuaccgaguuggaagguauacuauauacauuauccuaugguagaaggucugguacauucuugaccauuauuacuuugcuaugggcacccuucacccuuguaggcugaaaauuggcaaaucauaggcacguauacauugugguuuuggaauuugaaagaucucaaauucauauugagugagacaguuuuugaauggagggaucaggcugucuauauguggauauauuuuaugcauuucuggucuguauaaauguaaggauugcuuuacugaccguagauuucuucuaggguuaaaaaguugaaggcaguuuggauauuuuaaaauaagaaaauuagcccuacauugaaagagagaauaggaaaaucuaggcuauguguacacaucugcuuguguuuucacaauuguguccuguccuauuuauuuuuauuucucucccaucucuucccucccacccacaauuuguuuuucauucaacacuuugaaauuagaauagcuuaucuaucaaacaagguucuuugacaggauuuuccaacucugaguaugaaaguguggauauaacaauauauuuauauagaaugucagaagcagaguuuggccagauuauugggaaauauucuaacgcccugcagcauuuuaccgccuuugcuuuuacauaaggccaucauuuggaaacauagcaugcugauaccucccauuauugcaguagcguuucaucagcugcacgcugccucucagcgccucauuaaguugcaagcagagaacguuuucguuuuccaguucucuuucucaauuaaguuagagauuguauuuucaguauuccucauuauuaaaagaauuuuuguugagaauaguuuaagaugugauauuucuuuguauuccaggaaaauuuaaagaaugucauugaaauccagaaacagaaguauauauugucuaggacaugcuuugucuugguuuauaugccuaaguccgaguaguuuaaaauuuaugauuaauauacucuuugaaugcuuagaaauggcaucgauuuuaguuguucuaguuucaucuuaaauaaauuggaguaauuacuaacucaggauuaugaugugcuacacauaaaacauuugcagugaugucugguacuuaggaaacccucaguuaugacauuuuucuuacuuucuucuuggauauguucuuugaaaaagggacugguauggaaaagcuuugagacgaugaaaauauacaagauaggcuaucucugaaacaauuugguauagagcauuugauucucuguuucauguauauauucauauaugcuagcugcagucaugcagacacaauuuggaucuggguuuuuuuuuuuuuccuuuuucacaugcaguuauaaauuuagaaaccuggcuguuuccucuggacuaaauguauuuauuuaaauuuucagugcuuuaaaugcaaaauuacaagcauauguacaaguagaaagaauaguaaaaugaacccucccaucuaucugucacugaauugcaguaaugaucaaaucuagucagucuuguuccugagucagucuggaaugcagguuuuuucccuuaacuauucagguucuccagcaauccuggcaaaacacaugcggguuucagcucaucucuuucagugaccuguaaauuaagaugugcuaaagcaucacauguuacucauugacguuuuguuaauauauuuaaaacauuuuauuaguaccacauaauuuuuagcguuuucaaaaagaaauaagaauuuggcuaaaggugaauuuuaaaaauugaaugacuaaguagaaaaguaggcaaacuguuuucagaauuaguagcaauuuccaauuccauuuacucuguucauuaacuuuguuuucagccuuuuguuagccauguuugauuuuguguuuuugaaauaccuuuggucauuuuaggacuuuuggcauuaaucaccugucuuagguggccuguuuacaaaagggacuuuucgguucuccauuugcccuuaauguugggaauagagacaaaguuucuguaggacucugacaacauauggcuuuacaaaguuuuuuuuuaauauauacauuucucuucuuggcuuucuuaaauaucaucaaugucuuuucuugcuuuacguauuuagcaacuuaaaugucaucuugucugagaucaauauauuuccaacuuggagagauagugagaagagagacuucagauuuuuaaaauguggaacaaaacauucugauggugaccagguuuuaagguauuucuucaguagacaaaacuacuuaggcuaccgaugauaagcuuuuaauauuaauaauaauuauuauauauaaaaauauuaauauaauaugaucuaagauuguuucuauucccccucuuuccugguuguuaggauuuggaauuucuuaugcacucuuuuuuuuuuuuuuuuuuuuuuucugagacagagucuggcucugccucgcaggcuggagugcaguggcgcgaucucggcucacugcaagcuccgccucccagguucacgccauucuccugccucagccucccaaguagcugagacuacaggcgccugccaccaugcccggcuaauuuuuguauuuuuuaguagagacgggguuucaccauguuagccaggauggucucgaucuacugaccuugugauccacccgucuuggccucccaaagugcugggauuacaggccugagccaccgcgcccggccuaugcacucuuaaaauuauuucauguacugauacauucacuuucaaugauaaaacauggcuguaugaccagguagguaggcugcuuuucagacuccuguacuaacugaaugggccccauuagcccaagugagagcuuaacuugucacucuuccuaaaugccuuccucagcugagugcuuauuuacaguaaucuacugcuuauagcagaugcuaugauuuguauaagcuguccauaucuacuuggaagaacaauauugaaaggcauugagauacuuacuuucccucaaaagcccauaauccaacaacuauuuagaauaucuuauuuaagagauagguuuauaauacccaaagggaacuuaauguauacugaaagucccugauugaauggauucugaccuuaaccagaaauauuaauuacaugcuuaucagacacuuacugugcuaucccaggguuugccacuguugagggaacaccagaugaaucauauugucccugccuucaaggauuauauauucuaauaggacagacagcccaucagcagaauaggagguagcaaguggucagggaucagauaaagugaucaaggcaaguggaggaugcagugguaggacagaauggucugcgcacagagauugagggcaucauguggugggaauuagugaacuagcaugcaagccgggccuuuuucuuggcuuuuguucaauuggaaggagcauaaagcuacuaaaggagcuuauguuuagaaauagggcuuauugaaggggacaaggcaucuccuagaauccaaaugcacaucccaagacuuaaaagaguuagagggcacaggcaggcccugucagauccggucucugccagauccagucuugucuguuucucaucuucccuugucucucugaguauucccuguuuuccuuuccuggacuaacugcuucuuccagaugccuaguuugaguccacccaugguuuuuugggggcuuuucuuuguuuuuuuguuacguucuguuuuuguuuuuuguuuuuuugaggcggggucucacucuguugcccagacuggagugcagugacgugaucccaguucacugcagccucgaccuccucgcuuaagcuguccucccaccucagccucccgaguagcugggacuauaggcgcaagccaccaugcacccauggguguugacaugccaccuguggcucagacuuaugcucaccuccagucaaguuucuuccuuaucuaacgacagccuuuguguguucgugaaagcccuugagggaaagaaugcuacguacaguuugguuuucuugggcucuaauaagcuauaggggauggugcugcagaguuugaaauacagucacuaaugaguccuccuucagagagcugagggugggagcaccacauaaaaggaguugggggucagcagccuccugauagucugaaagccaaagaugauggauguggggcuccacggggaggcuauaacaugccacguuauguuuucugcccuugaggaaagcuucuuuucaccaggcaggcaguacagauacaaacuuaauagcgaugugaggcacacugauaaauaccagaaaacauucuguaagagggguuagcauuauuucacugugugcagaggagguuuguccauguggggggacccuaaugggcguaggcauuugaaguguagucuaagggaucuuagguaagaguguguuuggaacacaguguacguauuuauacagcaaaugcucuguguggcuauaauuuaggaaaauuuguaggacuugaggacagcuuauuuuucuacuagcugacagaggcuuggguuugcuucugcuuuaaguauaaguaucucgaguccuuuuuuaaaaaggaaaaucaaggaaauaguuggaauuggguuucacauaaaaaacauuuuagaaaagaaggggaguaugagaguuaggauuugcuaauguuugcuguauuagcaaauuauuugcaaugcuugucauauuagcaauacauguauguuuuggaaaacacaugcaaauuaagcagcuuaaggaacuuuuaucuuuauuuccuauguaagauuugagaugcugcaaagaaaauauuaaaacauugaaccgauacuuacaguaguccuccuauaucugcagaggauaacuuccaagacccccagugaaugcccgaaaccuuagauaguaccaaacccaauauauacuauguuuuuuuccuauagguacauaccugugauaaaguugaauuuacaaauuaggcacaguaaguaauucacaacaacuaauaauagaauagagcaauuaugacacuacgccaccaucacuacucuugcacuuuggggccguuauuaagucaaauaagaguuacuugaacacaagcgcugugaugaagugaucaauggcagguagcauguacagcauggagacgcuggacaaagggaugauucacuuucuggacuguguggguuugagauuucaucacacugcucagaauggugcgcaauuuaaaacuuauuguuggcugggcaugguggcucaugccuguaauccugguacuuugggaggccaggacaggaggaucucuugaggccaggaguuugagaccagccugggcaacauaggaugacccuaucucuuucuuaaaauuaaauauaggccgggcacgguggcucacgccuguaaucccaacacuuugggaggccaaggcggguggaucacaaggucaggagauugagagcauccuggccaacauggugaaacccugucuuuacugaaaauacaaaaauuagccgggugugguagugggugccuguagucccagcuacucaggaggcugaggcaggagaaucgcuugaaccugggagauggagguuacagugagcugagauugcaccacugcacugcaaccugggcgacagagugagaguccaucucaaaaaaaaaauaaauuaauuaaauaaauagaaaaauaaaacucauuuauuuauagagcuuucuauuuaauauuuuuggacugaaacuauggaaagcaaaaccacagauaagggaggacuacuauaguuaugauaaaaaucaggaacuuaaucuagccacgagaacauuuguauuucugaugaaauuuuuauucuugucuaaaauguugaacuauauuuauauuuauaucuuuaaauauaaaugaacuauauuuauaucuuuauaaaugagcuauauauuuauauuuuauauaaauauaaauauuuuuauaucuauguaaacauaaaaaggcuuuuuuuccucucuggauguuuacugggguuauuuaauaaaaaccuagggaugauauugggaauuuuuguuggaauuuuaaauuuuaacguguuuguuucuuuuuuuguuuuguuucguuguuugcuuucugagcugggaguuggcugugcauguggcaguugcuuuaucaaaagggucuugcucugcuucagaagaaguuuuguuaccuugauugcuaauguucucccccuuaaauaaaccuccugauguuggaacagcaaaauugcauuauguuuggaaaaucuaaauuaauaaucccuuaucucugaauaaaaguaacugaaucagguugaauuuacugcuuccauuuuaauaggacaguaggaaaaaacuaugcaugggcuuuaugugguucaaauuuuuuuuuuuuuuuuuuugagaccgagucucgcucugucaccaggcuggagugcaguggugugaucucagcucacugcaacauccgcuuccuggguuccugcgauucuccugccucagccuccggaguagcugggacuuaacaggcgugugccaugacgcccagcuaauuuuuguauuuuuaguagagacaggguuucaccauguuggccaggauggucuugaucucuugaccucgugagccgcccgccucggccucccaaagugcugggauuacaggugugugccacugucuccggccugguucaaauuuuguaaucuccacauccaucugcauauuaacaauugucauuguugguguuauagagagagaagcugaagcacagaaaauaacacgcauguucuagauuuccuggugggaacuggaaguaaauucuguguuuggcugaucacuguauaaaguucuaguacuagucuuuagggaaaagccccgucuucauggauuuuaauuugucaauuugcaauucuaccuacuuggaaauagucaaccuaaucaguuacugcccuguugcaccaacuauuaccauaggaaucugaagaugguaugcaaccaacaugaaaaagagauccuuuucuccugguaaucaguuuguacccuacaaacaauucguugguuuuaaguuguauagagggaaccaugaugugaauaugccugccacuggguuuauagaaaaccgaugacuccugaggaaauucucagcaggguugucuuucagugaaaagaacccuuuagaaagaugcaguaacucacacuuuacugcacauaaagucaugucccucaggguggacucucaggugucauacaguuuaugacucaugagugcugcagcuuugugaucuaauaaacaaguaaagacggugggagaauuauauuccuguacaaaaagccacuucaccuuucauuauauaggaaaaaagccaugggaauauuaaauuuuuaguggcauuuuuagagcauuuucugugaucuaaagugccugcauugagauauuaagauacuuaagaacaaaguaaaauaaagagaaguauuaauagcaggaucccuuuggagcuagguuacuguggcagugguuucaagaauaacucucucagcacccaccccaggauucugauuuagagauuucuuuguguguucucuuagcauauaccucuaccacugaguuuauccccugcugcuacacugauugauaccuuauuuuuaaauuuuuguuuuuaaaauagacgguuuuuuagagcaguuuuagauucacagaaaaguugagaggaagguacagagguuucccauauacuugcuaccugcacacaugcuuagccucuccuauuauaaacaucccccacagaaugguacauuuguuacaaucgaugaaccaacauugauacaucauuagcacccaaaguccauaguuucccugaggguucacucuuggcgguauacauuuuuuggguuuggacaaauguauaaugacauauguccaucauuguaguaccauacagaguaguuucacugcccuaaaaaucuucugugcucuaucuguucauccucccccugcccccaaccacccaaacccguggcaaccacugaucuuuuuagucuccauaguucugccuuuuccagaaugucauauagugggaagaaugucauauaguauggagccuauucagaugggcuucuuucacuuagcaauauuaguuaaguuccuccaugucuuuucauggguucauagcccauuuccuuuuaguguugaaugacauuccauuuucuagguguguaccccacaguguuauuuauucauucacaguaccuuauuuuuuaacugauuuuuuuggggucugggacuaaggugagguaaacaaggcagucaggaauugagauuaagaauuuuuaauguaauauuuuuaaaaaucaaaauuacugcaaaaaaacuccaugaugaacaaaauaucaacuuuuuagacagagauugagucacgcucaauugacaucaagccaugcauaguucuccuacugccuuauuaaaauggaagcaguaaauucagccugauucaguuacuuuuauucaaagauaagggauuauuaauuuagauuugucaagcccucugaaugucauggacaauugugagugaaauuccguguaucgucuaacuccccauggauguuaucuugcucagaaaccuuguucucccuccaaggaaggcacuacuucuccuguagccuucucaggucgaaguucuuuucucaaaauccucacagcguugccccuagaggugggaauguccucuuuuccucuucauuuccucuuuuccucuucauuuuuguuuccaaaccacucuuccuuucucuucccuaaaagccccccuaccucagcuugaagugcaugcuuucagacaaaucacuuugcuccuccaccuguuggucaucuccagaccucuuucuaccucaucgauguucaccauucagacuuugaagauuuuagcuccugccuugcugucaucagguguagcugcuucauuugcugauucuuaagugauccuaauauugaucucaaugauccuuccaguauuccaauuugucaguucaugauucucaucccuccagugaccuuguuuucaucauucuccaucacccauugcuuacaauggucauauuauacuccuugcaaugaccaaucacugcaacuccuccaaaauuuuaauuucaauuauuugacucuccaaguacuacuuauuaccaccucacuuucuccaguccugugcgccauacauucuuuagccccuggagugugaucaguggacucagauuccacuggucccuaccaccuuuuaccugugucuaauuccccucauguucucacuuuugccacuugagauugcauggcccagcauucuaaucauucccuugcuuauaccgucacuucucuauucguuguuauuuaucuggcaaaacaaccacccuguugcaaugcaagguuuaugcaagggaaugcacauuuucgaaauagauuuuuauguuuauguuuuucuuucaaaucucuacucauuaauaaauagaagugguuugauauuucacaaaugugauuuaauugaucaaguuucacauuucauucuaagugcucaguuaaacaccaugauguauucacaacaguaaucaaagcaaggggcuguaguuaguuauaggagcaaagagaauucaugaguuuauuuuuaucuaaaugacacccuugauaacuuuucgauaaguuauuuucauguaaauuacuuggaauaagagcaggauuuuuauauagaaagcuuucuaugugucauauccuguaaaauguuuguccgauuagugagagauagggggagguugaauuuuacuaaacauaauauccccagccauaucuacuguaacguuuguuuaggacauuacagacuauuauccuacaccaauuuauuucacaucaaaaaucaccccaugcuuguaagaauccuccuuucccccucuuguuucuauuuuagcuccccuggaaaaauaauauuuuaagucuaaaugaguacaauaaauuaaaaaguugcauugcuuaauauuuugaauggaauagcuagaugcuuguucauuugcuaucuuuuucuuuguacugaauuucuuuagcuuggucagagguagagcaggcuugacucuuaguggauagugguauagguugaguaucccaaauuuaaaaauccagaguccgaaaugcucaaaaacccaaaacuauuugcaugucaacaugaugcucaaaggaaaugcucauuggaguauuuuggauuuuggacuuuccggauuccagaugcucaaccaguaaguauauaaugcagauguucuaaaaucggaaaaagucagagaccuugaaagcacuucuggucccaagcauuuuggauaagggacacuccaccuguaccuuacaguggaggcuuguuagaugcuuguaaaugccagccccugccucaaguaacaauugauucuuuuugugugcucucccaggucuacccugaacugcagaucaccaaugugguagaagccaaccaaccagugaccauccagaacuggugcaagcggggccgcaagcagugcaagacccauccccacuuugugauucccuaccgcugcuuaggugagccggccggccguggggcugguguugauugggggccuggucuugagggaagaaaaagaggaugcuccuguuaggucacauacacagacuuguucuucagcacauugccacucuguguuguacuguguuuuggacucuugcaguuacauucugugcacugacccuauaggagcaguauuuuugaguucccugccucagaaugaauuuacccaggguguauauugaaauuacaaauuccugggccaguuccaggacuccugaaugaaaaaugccuauaguagcggauccgggaauucuuauuuuaccguaucgcauagaugauucucaugaacaggggccuuguguguuucuucacauagacuuucuagaagaaagaaucuaaugugaagcugcagcauuuuguuaauuucuaaaaaaaaaaaaaaaaaaaaaaaaaaggcuguucuacaauaacuacuccucuuauuuggugauaguagaggaauuggaauugggaaggcuuuuuuucugcuuacaucaaacuggaggaaacagucugauuacuaauguuuaauguuuguuuugucacaaaccucaaauuuaccucaacauuuuauuuaaaaaaauugaguaguuuuaugugguaucgugcucuuuuccucuggaaacugucauacuccauauuuaaucuaacuugguuauuagucuguuccuaguuguuguuuuuaugugaccagucauugcagaagucaaguucuuugcucugguaucuuacaucuagauguuuuccacaaguguauucaucaguaggcagguuguaaauaaggauauagagauugucuguggagauuguggacaaauauugauguauauucugaugacuucuuauaaagguuaaaaggaauauuucaaagaaaauccaacagcaaacuuacaaaguaaggauauuuacugaagauuccggagaucuauguaauauauggucaaaaaugaauguccuaagagcauacugauugcuguucauucaugugcauaauuugagacauaaaaugaaaacacugggcauuagaaagaagauuucaccuggugaauuuacuuacaauguaauugaugaagagaguguagaaaacuagauuucuuaaacaucugauaauucaagaguuuccuuuuuccuccuuauuccuuguuccuauaugcuuuauaaggccucaacucuuuucugguucaucaaaaagugcaguuuaauuagaugaaaauaagcagcacuuaaauucuagauacagaacuccuacucaaaaaaauauagaagucaucuguccccaggaacuguguauuuuauacucacuuaguuauuacaccaagaaauaacacacagagauugaacaauucaguacaaguuaggaaguagaucaugagucuguuaauuugaugggccaggcuuuguuaaugauuuguuucuuuugguucuuacuuaccuguucuaugaaguauuccaaauauauuuucauuagaauguaagcucacugagaacagguagggcuuuggaugggcauuauugcuccugguaugacacucaaaacugcagucauguuucagaagugaacuuaucauuuuacauagauuuuucugcuucauauucuauucagaaugauuuguauuaaaguugauggaaagaugaaauccacauuaagauuguuauuuacuaccuagugccaguuguuguagcaaauauccuuugaaccccaggucuauuuuauccuaucuguugaucacuuccuuugccccugcucuucaagccuccucaucucugaaaagcucuccuuccacugggugugguggcucaagccuauaaucccagcacuguaagaggccgaggugggaagauugcuugagcccagcaguuagagaccagccugggcaacauaaugagaccccgucucuuaaaaaaacaaaaacaaacaaaaaaaccuccaagugaacgaacaguacaacaaguaauaaaggauauaaaagauguucucagaucucaauaucaagucagaagauuuuauaauaauauuauaauuacacggagacuguccaaauauuuguauuuguugugcuacacugcauuaugcaccauuuagggaaacaacagccuaaguaaugugguuuuaaauaauuaaucucaucuaccaaauaccuguuugauaguaaaguuaaugaccuguccucaccuuauguuuuuaaccauuauggaaagagaaccacuugaaaauauaucauuccacugacagauaauuacccagcugugaagcacaggcuggagacuggcaaggagaaauggagagaagccuauaaaauaauucuuucucagggaaggaguuuauuccugccaaggcuuugccaucaaccauuaucagauuucucuuucauccuccgaacagauucugggcuccuuugauguggagguacauaauucaaaaaguugggucacuugugacauguuaagcaaauuucucaguucugguugugucugaugugaaaugagcacguugacacuaacuguucuugacuacuaugggacuagauaaucauuugcuauuuccuguagguacuuggcguguugaaucauuuuaccauauuuucucauuuuaugaaucacugguccuuuuccauuggaccugaaauuagacccuaauaugacaaguagagcauauguugucucuuacuuuguuauuaaccuuagauuagaauuaaggaauauaggugcugcuuuuuucuuagguaguggcaaauuuuccaaaggucucaagcccagaguauaauacagaguugauaaaauaaccugguagaguauguagagcaugccuugucuuucaggaaaaggaacugaaaaacauagguuuuccaauagguguaacauagguaacauagggacauagguguaacugauguacauuuuacuugcacuuaauagacaggcaguguuaguucuucgucucucuucacaggcuauacaacuaccaagauccagagagguugaauuucuugcuauaacucacagcaaauaaaugggagagucagcacuacaguccaagcucucuugauuauugguccaguguuuuuuacaguauacacaaaaauuuguuuuaaaacaaauauucacuaugaauuagagacaauagcacuaaaaaagaaacucacagcuaucguuguguugacagaggagacaaccaugaccuaguauaggauaaaucuccaugugauauguuuucuacuuuauaguaguaguagguaacauucuuacauauuauuccugcuuaacaaagaauuacuguucagcauuaacauaaguaugcucuaaaaucucuugacuguauccaaauauauguuuuagacaagaguuuuuuuuuuuuacugaccuagcaaacaaaauaaaauuaucuuaaacauuaagcguguuaaaauucaaaacaaagcuugaagagagaaaaaugcuuguuauguguggcauacaaccuuccuaaccucuuuaucagaugaaggauccaguguggcacuggauuauuuuucuguaauauuuugccucggacauaugugcuauacauuucuugucugcauggggaaaguaugucagguugcuguugccacuuucuucccauggaguggauaauuucccuugagaauaaguuggcuuucucaucucacccuuugcuuuugguaguaccucuggaaccagaggguaagauucaucuuaaucaugugaacauuuuauuaauuaucucaugugugauucaagcacaucauuacuguuacucaaggagaauauuuucuuugcaaagcuuucaacccuuuccauuugaaugacugcucuucaugguguaauagauccacuguugaaauuggcacuuuucuguacuugucucugaccagcaaaggcaaggaacauugcguaaaauaaauuacuguugaauuauuggggcaaagucagguuaauagcuuaauccaaaaaaggaauuacaagugaaagaauuuuaccuuaaaugucauucuguuucauuuuguaauuaagaccuuccaaauguguaaguaguaaugaccagaaaucuuaucagauauggucaaaugagaaagguauucaauucauauuaauuuugaauuuuauuguuuuaauacaauuuuaggaaaagcaugccuuguuuucuggguuucuuggcugccuuuguaucaauuaucuacagcuaucuucuuuagcauggaaaggauguauuugaauacugugacauuuuauaccaggguaauucuuugaauuuauguaaacaacaacucucuugagacacaucaguacaacacaauagucagaaaugucacaugagaguucaccaaacuuuaaagauggcgaugaggauggaaaaacauuuuuauuguagacuuuaaggaucuuguaaauccccguauguaauccagugugcuagagaauuggugcccauggcgccuccucuccccaccgaccugcacuguggaaauccuacuaauuuugaagucaugggagaugcaugugugggaccuauacaugcacugugaugagaaugaugacuucaucauucucauuauuuaaugagcccagcugcugcauacaagaaggaugcaaauucuugaauguucuugauuguuuacaucauggucucauaaggaaugaccagaauugcugggcauuucuucaucaggaaaggcuaaucagccauccuuggagagacaucagacuccuuuauauguggccuucccaugggaccuuugaauggucaacguuaaucaugcuucagaaccagcauacuaaguaaaagaaaacauguccggaaaagaaaucuuaucaguguuuaucucccaacagugggauuacaggugauuuugauuuuauuuaagcaauuuucuaugacuuuguauaauaaaugaguagcuuuuauaaucagcaaaagauagacuaugaaaucaguacauauaauuuuguauuuguauguaguaccauugaaggauaauagaaaaaagucaaaagacuugaaagucgacacagaaugaucauuaauuuguuuuaucucuugguaguuguacuuuaugagcuuuauacauacaguaugggaaaauacacuuuaguuuugaaaacaccaugaugccaaaauaaaagaaaauaacguucauucauacgaucuucaacaaaauuuaagcagcauuaaucaucacugauucuucaggaagauucuugaucuuccuuaauuuuuuuucccuccaaaauugcauauggcagccacauuuguuucaggccagaaggaagaaugggaagagcuuacauuuaucucacagauuccuucugggugaggaagacuuagaaagugaagcccucuuccauuugauuaagcaagaacaccuauaaaaauggugucuucggccgggcgcggugcucacgccuguaaucccagaacuucgggaggccgagaugggcggaucgcaaggucaggagauugagacugucuuggcuaacaacggugaaaccccgucucuacuaaaaauacaaaaaaauuagccaggcguggugcgggcgccuguaaucccagcuacucgggaggcugaggcaggagaauggcgugaacccgggaggcggagcuugccgugagccgagaucgcgccacugcgcuccagccugggggacagagcgagacucagucucaaaaaaaaaaaaaaaaaaaaaaaaaaaaauggagcccuucuagguaggucauccuccauggcucacugcagcacuuccuuggcccugucccaaguuccauaauugccucaauugcauuggcuccugcuugauuugcuuucuaaaacucaggacagaggaugaguugaggagacugacuuuuuuaacaaucgcauuuugaaaagaaggaagcguagugguguuucuuggcuccguuuccaguuuuguuucuuuucauuuuaauuauuguaccugguauuguguccucuuucugggacuuuuaacaacuaauguuuugauugauaagagcucuaauagcaugggugauuuauacuucauuacaucuucaguuuugucuucuuuacuggaguuguauucaggugucauuaaguaacgaggcauuaaaaagaaacgauaacuuuugaaaaacugcuguuauggcuuaugagugggcuuugcugauauuuucuugaagcacagaauuuaucuaucucuguagguccuagaugauaggugagaaaaagaaacccagcuuauuuggcaugauauugucccaaggcuuguuaguaauugcuuugaaaaaugaauagcaaggcuaauggacaucugauuuguaguacaugcuaagaauugcaaaugugugcucaaaagaaauuucucugauuacaaaaguaacauauauucaacguacaaaguugagaaaauacaaccacuagcuaaaaauaaucaaaaccauuuggcuuccuugcagucuacauuuuuuucauguauguuuugcuuuuguuuuuaguguuauuuaaucguuuccuguuuugugacuugcuuuuuacaccuaacauuuuuagaauacucuaccugugaaauuaaauauucuuggagagcauaauuuuuaauguagcaucacaccagacacuguaauguguuuacucuuuuuuauggucauuuaggugguuuucuuuauuuuguggugguguaauaguuguuauaaaugaugcugugauaaacauccugguagauaaauuuguguuuaguugauuuuuauauaacaguuauuggcggaaugccuugcaaaucuuauaguugguguaauaaaauauaugcgccacauaauuguuuaugaaaauauggaggaaaauuuuaauacugauuuaugauccugaguuuaacauaagcauggauaccccuacauuuagcuaugauuuuuuuauugauagaguaaaagcgccuguaauuucuacuuaaggccauuuaaaauaauuacuauuuaaaucuauuuaaacaauuuuaaauauugcuuuuccaaauuuccaccuuaggaaguaguuaauugaauauucucagagaaauaaguccuacaaaauugaccaauaaaaggucaguuacguauucauuguguacguuuuauugaucacccacagugugugagccccuggaggugggugaaaugugggccucccucuuacagaguugauagugggccugaaggggaugggauuucagcucaggaauuuaaggaagacuugacaggaaguagcauugugagccaagauuucaaggauaagauuucaaggcaagaaaggagauguauuuuagguauucagacagagggucaacaaagucuuuaagguaggaacuaguucacuuuucaaaaagaagagguaauuggucaugauaagaguaguaguuuuuaaaaaucauuacuguuuucauucauuuauaaugaauacuauuauuuuauaauuuuaaaguuuauauccaaauaauuguuuucaagaugguaaugaauguauauugcuuuuauguauacacauaguacuuuuugcuuuuugguaacuaaguuuauaauuuuugagggcaggaaauauuuuuguuuuucacuuacaaagaaacuauauuuuaauaagaguuuuuugacagcagugcuuuaugccaaaggaaaauaaagcaacauuuaacauaucaaagaaagccaaugcaaaacaaggauuauuuauuuauuuauuuauuuuauucauuuuugagauggaguuucacucuuguugccccggcuggagugcaauggcgugaucucggcucacugcaaccuccacuuccugggaucaagcgauucuccugccucggccuccugaguagcugggauuacuggcacccgccaccacgcccagcuaauuuuuugucuuuuuaguagagaugggguuucaucauguuggccagguuggucucaaacuccugaccucaggugauccacccaucuuggccucccaaaguccugggauuacagacaugagccaucaugcccagccaaaacaaggauuuuauauucaaucaaacugacauucagauaugaucacaugaaauaaauaucaacguacaauaacucagggcauauuuucacauuauuuuccuguagaaucugcuagagaacaaguuucagauacccaaaauaccuagagaaaaacugauauaaggauggguaaugagcauuaaggagaaacauaaaaacuaagacucaacgaugguaaaaaguaugauaauauaguauuccacagcuacaugcugugacaauaaagagauucuguaacugucaggccucugagcccaagcuaaaccauccccugugaccugcacguauucgcccagauggcccgaagcaagugaagaaucacaaaagaagugaaaauggccuguuccugccuuaacugaugacauuccaccacaaaagaagugaaaauggccgguccuugccuuaagugaugacauuaucuugugaaauuccuucuucuggcucauccuggcucaaaaacucccccacugagcacccugugacccccaccccugccccccagagaacaacccccuuugacugcaauuuuccuuuaccuacccgaaucuuacaaaauggcccuaccccaucucccuuuccugacucuuuuucggacucagccugccugcacccaggugaaauaaacagccuuguugugacaguaacuuuaauggggaagaaugagaagaagauguggguaaagaaacaacuguuuuucuauuaauggugguaguauuaguguguaauucugagccuggugcauaaguaauaugguguaacauaagugaauaguugugugauauuuuaauucaaucaucccauguauuugagaaucagaauuuugaugugguaaaagaagauucacauguaacauauaaucuauuaaaaagauacccuguagucaugaguuugacuuuuagguaucauuucucaguauaacauauuguuguagauuucagauaacauuuuuuccccauaaauacuguccgcugcaggccuaaaaauaaugaaaaggccuaaaagaccaacucaguagcgguaaacaccaguacugcaccuagauuauggucuuuaggaaccauuuuccaguaaaagauaccaguaaucuuuggaaagcaggauuuuuuuuucuuuuuuuuuuuuuuugagauagagucuagcuucgucgcccaggcuggagugcaguggugcgaucuuggcucacugcaaccucugccuccugaguucaagccauucucugccucagccuaccgaguagcugggauuacaggugccugccaccacuacuggcuaauuuuuuuuuguauuuuuaguagagacggaauuugaccaccuuggccagucuggucuugaacuccugaccucgugauccacccgccucagccucccaaaguacugagauuacaggcaugagccaccacaacccggcggaaagcaggaaauuuuuuaaaagcuauuuuaauucagucauguaaaaaaaaugagcagaaagaaacaaaaaacuuaaaaaaaaacuuaaaaaaugagcagaaucuuaggaaucaccugcgacuuugguuauucaugcuuagccauuucuauaggaaauuccagcacuauuugaguuagaccacuaauuauauguguguuguagcuuucuccaagagauaauggaauucacaaaucaaaacuuugagauuauuaaguguuacaagugaauuauaaccccagucauuugcuuucaaaugaacagcuaaacauauuuuguguuaauuucuuauggaugcugcuuuguuuguuuguuuguuuauugagacggaauuucacuccugucaccuaggcugaagugcaauggugagaucucggcucacugcaaccucugccucccggguucaagugauucuccugccucagccucccgaguagcugggauuacaggcgugcaccaccacaccuagcagauuuuuguauuuuuaauagagacaggguuucaccauguuggccaggcugguuucgaacuucugaccucaggugauccacccaccuuggucucccaaaaugcugggauuacaggcgugagccaccauucccggccuagauaggcuuuuaguugguuuccauauacaguguauauagggagaaacagacuaagacagacacuggcauccacagaaguaaaaauaaaaaguaagguauaauuuaaauuucacacggucauggucacauuuuucagcuuuuugcaccuauguuguauaaaaaagacaaaaaugccuuuagaggcucaaguuuucaggacuuccugaagcugugucauaguuuaaaaaugccauaaaaaugccgucagauuuaauaacguaucagcugaacacuggauuucuguuauguugagucuucaaaaauuucucccuguaugaggaauuaauacuguuaugucugaucugguggucugaaaugugaacuuuucugggccaaccaguaaacagcugcuguugcuuuauagcugcguaauucagucuuggaaauuauuagauaauucccacaccauuucagcuugcuguuuuaccauaaauuuaaugugaacaguauuucuagcuaaccucaagcuguguuuauugucguggaauuuucucuuuuauucugagguaaaugauuacaaaugguuaugaugaggaaucaaagaagaaaguggacuuucuucaaaguucuuuuucuacucuagccgcuucugagcaucuuucucaagcacuguguuuccaucagucccuaccccaagcagagaaaggaaacaguuuuccccuuugucuucagaacccucuucucaucgugucauuuuccaaagcaaauaaaaaucuugagauauugucuugaguuugauuuuuuuuuuuuuuuuuugagauggaguuucacucuuuguugcccaggcuggagugcaauggcacaaucucagcucaccccaaccuccgccuccuggguucaagugauucuccugccuaagccugccaaguagcugggauuacaggcaugugccaccaugcccagcuauuuuucuguuuuuaguagagacgggguuucuccguguuggucaggcuggucucgagcucccgaccucaggugauccgcgccucggccucccaaagugcugggauuacaggcgugagccaccacacccugccgaguuugauguuuuuuuuaaccauucaagccaguaaauaacuuuccagacagcuguaguagaaaacagaauuugugugugacaaaacuuaagauuuugggauugagagcucuaugguuuaugccauguggauaauuguagccagaugaagaauaugaaauuuaaggaaguguuuagagugguacagacagcuauuauuacgauucuugggguagaagaguagcuuacauacaacauaaaauaauggcauuaacugaauuaacuucagccuuugccaugaaacccaagcuuucauuauguuuuaaauaaugaacuacauuaaaaauaguauauaaauauguaaaauauauuagacauagacuucucauaauaaauuaugggaacuuuugauguauuucuucccuaggaaaagaacuaaacaagugcuucuuuguggacuuaaaauuuuucaguuuacuauugugaauuagguacagcauaucuuuauaauuccagauaauacccauaaaagcagaacuguuuauuuacuuauuaugaagggaauacugaaaugaaauuaaggacaauuuuuuucucacguauuauauuuuuaaaaaguuauuugauguuugugauuaaauaaagaaugaauuuuuaaagccaguucucaauuagcacugaggaaaagaauaugcuuuuuuucagguacacaaauaagcaucauggauauaagaaacgacauaaagaugaaucuacagucuggauuaagacguauuuuaauuucagugucaaaggcuguuaggaaauauucagauuuuaguacuugacaaagaagguucucaauauuuguuucaguguucagugaaaggauaaauucugucgucuuucucuuuuaucauauuagucacugagugguuucauuaaacauucccucuuccauauccccugauaaauuucaacuuguuggugaugcaucccaggagugucugucuuuuuuuuuuuuuuuuuuuccuucuccugucagugagucuuaggcuuuggcuuugaaacccuauagugaagggaaaucucaggcaacagcugugcaaccgucuggagagcagcuaguccagauuggaggagacgaacgaggcuggucgcaggagagaggccuccaggaaaaaauggcauugaugcauuaccugcguuaaagauuuuccuguacuuagcaugcuucuuaggguucuacuggagcguuugggaaagauacaguauugauggaugcauagaaaaugaggcaaauuuuuuaaauggggcaaauauuaacuguagacaaagaaaagccaaaaguacaaaauaacagcguuguaagauacgaagauaaaaauacgccuaaguaugagcguucuggcagacucacaauacagaugccauauaugggguaaaaccauaccaguaggauggugggaagggaaaggggugggcucauguuccauagugggaagaccuacagcggaaaaaucaggagaauaguuauuuaagcacagaguuuagggaguaaguugcagaagagacaacuaaaugagauggccgugaaugauuuuuaugaccuccucuuguuauggagaaaucgaucaaggaggccuauauuugauggcaggaagaaguugaguuuaagguuuccagacauuuguuuuaaucuggaaaauuucuuuuuuucuuucuuucuuuuuuuuuuuuuuuugagacagagucucacucugucgcccaggcuggagcgcaguggcgcagucuuggcucaucgcagccuccgccuccuggguucacgccauucuccugucucagccucuugaguagcugggacuacaggcgcccacaaccacgcccggcuaauuuuuuguauuuuuaguggagacuggguuucaucguguuagccaggauggucuccaucuccugaucucgugauccgcccaccucggccucccaaagugccgggauuacaggcgugagccacugcgcccagccuaaaauuucuuuuaagcuuagaaguugcaagucaaguuacuguuaaaggcguccuaacuuugaauuagauaaagcuaaacugugguuuaauugagcugaguuuguuguaugcuauaucucaacuucacaagauguuugcuuuuucuuggcuauaaccuaagauuauacaaauauaaaauuaccuuuaugcccauuugauagacuuuagggcugaauuucccuguguaagauguuguagagguuuguacuugugauuguuuuuacucuagaagcauguuuaucuucacuccuuuagugacacguguuuguucaggaacuucaaacucaaugugaucaaaacuagacucauguucccugaauagucucuccugacuacaaaucuguuggaaacuuccaauccuaauuaauaauuguaaacuuuuuaauguaagucauaugagggguuguugugagcauaggagguagggagaugguagugugagcuggagcauaugguaaaaguuguuugaaagaaaguagacccaugauguggauccugagggauacguaaagaaaaugaagagguguagauuuaaaaauguuuauggggccugggcgugguagcucacaccuguaaucccagcacuuugggaggccgaggugggcagaucaccugagguuaggaguuggagaccagccuggccaacauagugaaaccccgucucuacuaaaaguacaaaaauuagccaggcauggugaugggcgccuguaaucccagcuacucaggaggcugaggcaggagaaucacuugaaaccgggaagcggagauugcagugagccgagaucgcgccacugcacgccagccuggaugacaagagcgaaacuccgucucaaaaaaaauuaaacaauaaauaaauaaauauauucauggggauguuccagggaaaguaguuuguguugguagccuugagaaauaauaauagaaaauuagaauagaacuaaguugguucauuaaaguuggaacacuuguagagauuuuugauuuggacagacauuaauucauuugauuauuucucuuauucgauguccagaaaaauaucuguacauucaaugugguuuuauuuguacugcacaugucauuaauaggcuaaaguuaccucuaagauaccugcuuucuuaguccuuguuacgcuguaaauucugggcaucaggauauagcuuuuuauuauguuagcucuuuuaauagaugauacaauuggauuggggaaaaaacugauuauacucuggaguaauacuuucauagccuguaguauccugcaaauagcuccuggucaucuucgaauuuuacuagcaaacuuguaggguaauagguugggacaaaguauuauaaucaguggcuuugagggccugauaagaggaaacaauaauugugcagcuauauugugaauaaguagugcaugaugcugaugguuaacccuuuccugcggugcucaaacauugggaaauaauugcuuuuuguucaaaauguaagcucuucgauaauugagacuuuugucaauucacugaaauauucccagagcuugaacaugucugguacauaguacauauuuaauaaauauauagauuuaaugaaugaauugaggauguagccaaauauuggaaaaggaaagggaaaagaaagaauagcccaaacauuagaaagacagaagauguggagcagcaauuucacaugccuaaaagaauuucugagauuauggcaaaaucauuuacuuuacuuacuccuuauugaucaacaaaggaagagcagguuuuauguaacaaccaagaaguaacauagggaucucagaagagaagaaaccaagugucuuuggaucuuaauaaaaagaacauucaacuccagaaauaggguuaaaccuauccuacacaugucuaguaaaaagucaguguaucagaggcaucuguguuuagagauaaaacauaccauuagauucauuuauaauaguuucauuguccuuaguuuuuaaggcuaaugauaaagauuuuuuuuuuuuugugagacacagucucucugucacccaggcuggagugcagugacgcaaucucugcucacugcaaccuccgccucccggguucaagcgauucucuugccucagccacccaaguagcuaggacuacaggcacacgccaucaugccuggcuaauuuuuguauuuuuaguagagaggggguuucaccauguugcccacgauggucucgaucuccugaccucaacagaucugcccgccucggccuagugcuggaauuacaggcgugagccaccacgccuggccuuaagaauuaauuuucacagaaaucugcuucuaaauauuauucagugauaauagauuuuagaaauuucagauucuuauguuguaccuuaaagguuaggauacuauuuauaaaugcuaaacaugaacuccugucauccuauuuuaaugucuuuauuaagugauuacaugaauguggcguuucaguagguguuugguguauuaauagauguagguacuccccucuuaaaccuuuaaguauuuucaugccaugaaaaauuuggggggcauucucuuuauuuauugauuagguaccuguauuuucaagaauauuacucagcuucaguucccccaaaucuuuuuuaguguuaacuaccuuccgagaacgugguauaacauuuuaaaauauauuuuuugaagguuuggaugucacugaagaucccccuauuuauuggaugguaucuuuaucagcugggaagauaauuaguuucccaauguugcuauauuuuuaugaauagguccuguagcucuugcuuucuugaaagcuuagaauugauuguaagccauggacuaaugauauucuccaagcauauuuaacaugaauaggcucauguucaguaugucaagaaguuacccuguuguacuauuuaaauaauuugagcuuaguuuucuuuuuccaccuuuguucuaaauucuuaggugagucugaauuccugggcaucugugcacacagcuucuucaguagguccuuuacucucauuguaucugaucuuugacuucauaaagacccuuggccuacugacccuguauuuaauuucacaucucaauaguauuuagccuucucauauuuuuccucuucuuuagagcucccugaucccucacuccagucauucaacucuguguauuccuuuaacuuccacccucgcucugucucuucacagauaugcuucuuuauaugguagucagaaguuccugugugaucuucguaaccuccaguucccuccacagucaccuguuaucaggcaucuguuccuugagcuccagggaaugagcucuuugcuaucauucugguugucggacucacugggcacuguuguguccuccacagucucucaguggcaucgguugaugggugcauucuccccacacugaugucauucugcugcuucugauuuucuuucugcuguccuccauuuuccuuucaggcucccuuccccguccuccccgcgccaccuuuugcaauauuuaggauucagaaauuccaaauauugcaaaauauuuagaaucagaauucagaaauucuaaauaucaguguuuaauaggaguacccugggguuguccauuuucucacacaacacauacuugcuaggagaucucauaagugcagugguuuuucagaggccugcauugaugauuccugagucauuauguccaggccaggccucauacauacuauuuacugguucucuuucugcgggugcuccaccaagaauucagacucaauggaauauuucuucuaagauguacaccaguuccuuaucaaaaaauggcaaauucagacuucuuagguuaaacagagaacucgugaacauggcauaugucuguuauuccauuuuucucuguuggcuuauugcugaguaccauuugggauaaaaaucuguuucaggcaaaggauaggauuguuuucagcuuuuauuaaauucuccuagacccuugauuuuaugcagagaacuaauuaaauuugaaugaauuuaauguagaaacccugcuauugaugcagaaaucaaccugauucuggacuagcaccagaaucaacuauuuuuguuguuuuugcuuucuuuuuuuuugcuuuugcuuucucugccgguaaauaacaacuaguauguaagaaucaaaugaaucaagcauaaaucccuaggaaauauuuaugcauucauuuuuaacaauuuaaagaugugaagauauauaauuaagcauaauccucucaaaguuugacguugaaaaguauuucagauacuucaacuuaaauauauuuuuugcaaaauaucuuuuuuaaaaaaacagauguggucucagcaauguaauuauuacagugugaggagagcuuacaguuguaccaaaauuuauaacuaggaagaagagaaugugaaauaauccggaaaccuacaaaacuguccuauacaggaauaccaauuaaacagcuacuaaaaaugaguguaaaaugacaauauggcuuuaucaagugcuuagggucuggaaaaaugcacauauugccuguuauuuauuguuauacuuaaugaauguucuuuugcacgugagaacuguuauaaaagaugucuuuuguacauacuugguacaccaguuggcuuuuuaacccauuagcuguuuucccccaaagguggccuacucuagaugacguuaaaaauacacauuuuccagggacuuauauaaauagucaacugcccuauuauggaaacuuaaaagcgaaggcccugaaauauccagacaguuugaacauaaaccaaaaaugaagugaaucucuagaauugcuguguaauagcgugaguggggagggggucccucaagagagggaacugaccuuuuucuuccucgugggugaccuugaguacacacuuuauuuagucauuaaaagggucaccugaagcuuagagaaugaagauccuacagccuguuaauuuuaucauuguuagaaacucucugccuuuggccugaaaaugguaaaucaccuuucuuagaagauucucauauccagauauucuuaccaaaucagaaucuuuuccagcauuuucuucaaaaaaccacaguucuggguuaaaacacagcagauccuaacuguaauuuuccuuucauguacauuuuagucaucuuuauaauuuuaaaugaaagacaggaacuacauuauuugaaauaaggguuaacccccucuaauuauaagcauuaaucacacacaguuuucucauuucuaaauguuaaauauaaaaugggagcuaucucuucagacacuuuucuguugccuucugugugcggcaggaccuuacuuuuaagcuuaguuugauuuaaaggcugaguuucugcuugcuuggaaugcuugcucuucaaaauauuugcucccuggagagggaaacugaagauggagcuuucacgugacuuuggauugcugaccuggaagacguuugggguaauaggaugggcuagggcaugguuccacugcuuucuguuugaguggggucaggaaaggaaggcggggcucgcugugugcaaacaggaaaacauagucugaagauguuugaagccugagugcacuuucauuugaugccuugcuuuauugcuuaagagaauuuuaaacugccgaauccgcaaaugugcugcagccuauaaugacacauauuuaaaugauuuuugcaucuaaacaaaugcauucacucuuugccugguguguacaauuugaaugacacucgugcucugccuggaaggaacagacguuuuucauuauaaaauucagucaagcagaaaaguagcaaaggaagcagaaauuuccauuuacaucuaugauugaaguuguagugauaaaagaggaugacuaaguugaagaguagccuuguucucauucugcuaucugacaugggaucuugucacuuugguaauaguuuuuaaacuuacauuauugaggaaggcucugaucagaagucucaaauuauacauguucuucaaccuuagauuuuucuggguguuuuguuucaaaagucucaaauuauauauguucuucaaccuuagauuuuucuggguguuuuguuugguuuuuugguuaucuauagauagauuugaguaucucuuuuuuucuuaaaauccguuacuuacuaguaauaaagacuuaagugguagcuuuacgcuccauuaucacagagauucacaguacuuuuuaguuuuuacuugugagccucagcagguguagacagauaccuuaguugccacugauaacauccaguugccacuagaucaagaaaugguucaaaauucuccaggggcauuuucugcuaaagaagaguuggugaucuuccuuuuggaagccuuaauguacuuaaaccuucuuccuuagaaguccagaaauucaauuauuucagcucucuguggagugauaaguccugccaaauugauuuacaauaaugaaacuaagccuuguuuacaaaucuaaguggugauuucuaaguccacagaggcgugguaacagagagagagauucugauuuaucugggggucuauccguguuugaacagauugugugauuuuugaaacaugauucaaaagggauguugauaaauucuaaaauacauuuuuauugaagagcuugaugaaucauguauacuuacuuuauuuguuauucuauuagauauugucuuccucaucccuaggugguguugcuaguacagugacagaauucaaauccuucuuuuuccucugcucuaacagagcuuugugaacucauagcaauauuguaaugccugguaaaagguggugccaguuucaaguacuauauccuaauuacuucauggcuaacucuuguuauuguuaacaauauuguuaacucuuuuguuaaaugcagugacaucuuuuuucuuucucauucucuguguacuuuuugcccuaaauaguucugcaucuuuuaagauacaaguuugcuuuuucuuggagguuuuuauuuggaaaaugccugaaauauauagaccaacauuuguuccuccaaugguuaaauuacauugucucccaaagugaggcauuuuaagucuggacuauacccaggagaaucuaaaagaggcaguuaauaagcucuugaagagcacaguggggugguuguguauuuauugagucucacacuuaggagagaaauaggcuggaccaaaugagccugggcaucaaaagcauguggguggucguuggugauaugugcagugaugagugugugugcugaggguccuagaccaggcuggcagggaaaugaacugaaggcagugaagccuccccugauaacugcagagagugcugcagcauccaggaccucaggaucaugaugaacaagcuguaguggauggaagggagaggaacuaugggaaggaugaguuucuggccagaaagugguuuacuggagugcugugucugaguauuacaugaucugaggaccaugagguccagcuuugggaguauggagaguuugaguggaguagaguuauagucccauggucuucugauucacagacauucaugagcgauaaguaucuauugagaaaguggaagcaugauuuuuaugaccuccucuuguuguggggaaaucgaucaacggggccuauauugguuggguucuacaaccaaauagaauguguucagcaggagucauguuuugggcuccucacaauguucaguguuaguucuguuccuuucucuugcuuccacauaggaaagacuuugacccaaugaggaauuagucauuguccuuuggguacacuuccggaauuugauaaucaguugggcacuugauucuaguacauuugcuaaaaguaauuaauacccugcaauuggaagcaugcagcaagcgacugggaaugcuaagugaaaggucagaauugaaagaguggaggaggcuguugacccuuaggcauggaugauaugucugagugagaaagcaagaagaguagaagacagagccuuacuuuauaaucagaauuaugaaaagaggagccaaugagagggaaagaaugauuggcuugagauagauugguggaaacuggagaagauugaauuuaaagaagaaaagugggccaaguucaguggcccaugccuagaaucccagcaaauugggaggcugaagcuaggagaguugcuugaggccaggaguuugagaucagcuugggcaacguggcgagaccccugucucuacaaaaaauaauuaaaaaaaaaauuagccaggcauguuggcaugugccgguagucccggcuacuuggaaggcugagacaggaagguugucugagcccaggaggcugcagugagcuaugaucacagcacugcacuccagccugguugacagaggguauccccgucucuuuaaaaaaaaaaaaaaaaagagaauguggcagaguagucagagaacuggagggcugagaagagacugauggcauuuguuguucuugaccuugaaagaagaguugcagauuguuggagcaaggccagaugguaauagguuggaaagaacaagugaggggcgugagagugacagucuacaaccccguuaagaaguuaucugugaaaaugccucuuccugucuugauuauagccucccucgcacauggcuuucugaguaugguaugugaaaacagcaugcuguauauuuuuaccuucccauaugaguuaagguuuugguaaugacuugugguucuuuugccucacggaacaccaaccugguugguauuuugucggcaauuaugugguuuuuaaaaagccccguauauaaccuuaauuaauugcgucucuaaaaucuaucaggcuuugaguuuuuuguuuuuuuuuuuuaaauaaggcagaaagaaaggaaaguguuaggagaaagcaaccagugagaauaccuauauuuugaagaaacaaaguagggaauuuagaauuaucucuacuauaucugcuuuuucagcucaucucucgggauacagaggacugaacuaagcuaaaguagguucaagucuaaaggaaaccuuaaauuaauuucuguauuagaauuaaucacacaccuauaaauacaauuuaugauaugagaacugcaacaagagaaauggggggagaugagcaguuugcugaucaauaggguuaaugaugguaacauagaauccuagugauaugccucccauugacuaaaauguaugcguuaagauagcauagcgcauaaaaugguguacugcagucucaguguauucaagcuuauuaugguuucucugccuagguuugugucuuuggcuuuagauuuucucccauaaccccaaccuguccacauucaagucacuacuccuugaaauauauuauugaucucuaaaaucugaugcuaagucugucuugcccaacgguggccacuagccacccauggccauugaauauuugaaaccuggcuaguccaaacuaugcugugaguauaaaaaacccaccagauauuaaaaaguuagucugggagaaaaaaacaaauguagaaugucuuaaugauaauuauuuacauugauugcauguugaaaugaugaaauuuaggauguacuggguuaaaauauauuaauaaaauuaauuuuaccuguuucuuuuuaccuuuuuauguuaauguggcuacaggaaauuuuaaauuagauauguggccucuauuauauuucugugagacaaagcugcuccaagcuguuuugguccagaacuauaucucgguucuuuuguauccuacauggaccugcauagaaugguauuuaguaauacucagcaguagcagagaugaucucuuaucaaauuauguuaaguuuuaauuuuuauucuugucucucacccuaugugcaccucucuggccaggaggcauuuaucauaucaccuuuuaauauuuggaaaucacuugaucugcuugagucauuguguuguuuucaaaucuagaacucuuucuaccuuauuuuguaacuucuauaauuaaacaaaaggcgaaccaggagcagcuuggcucuuagggaugugugaaaaggcgcucaguccuuaaguuggugccaaaagugacaaaucuauaggaugagaugcagguuuauggaagagaagcaugaaaauuuuuauuuuuuaaaaggacacagcaagcuagucaccaaaagacagauacuugauucuacuuauaugcgguaccuuuuugaauuugaagagucaaauucaaaaagauggaaaacagaauggugguuuccagguucuggaggugggggaauggggaguggaggugggggaauggggaguggaggugggggaauggggaguuguuuaauggugugcaggguuuuaguuuagcaagaugaaaacaguucuggagauggaagguagugaugguuguacaacgauaugaaucuacuuaacacuaaacuguauaauuaaaaguggguaagcaaagagugucuuacaaagcaauaacuuguaacuuaaaauuuuuaaaaaccuuaaugagauuaguuguaauggguuaucuuaaguagacccuuacugccggaaggaacagcugaaucacaucacuugggagcuuguuagaaaagcagacucagucccacccuagacuuguccaaucaaaaccugcauuuuaacaaggcccccaggugauucauaggcacuguaaagcuugagaagcccugcuccaaauaucauuucucaaagugugauccaugagccaccugaagcagagccacccugggaaggucuguuuucaggcgcgucccagaacacguaaaucagaucuaggcuguggagcuagggagaagaugaaucugcagacugaucaggaucccaggugauuuugaagcaugguuugaguuugaaaaccccuaaucuggaaagcuuuaacaacuauuacucuuacaauuccaucuuuuaacgaauguuggaauuauuaaauacuuguaacaagaaguccuguuauugauaaaaucaagauaugacuaauagugcagucaaaaagaggcaacaaaaaagcaccuauaacuuaucuuggguugguuaaugaggaagcugucauucaaaauuaguaagacuacuguaacauuucuugggguccugaacauuggaaugagagucgguuuucagaguugagcccaccucugucauuagcuuugugcaaaccucaucaggcucaagauuccucauuuguaaaggggaaugaauucucugaccaguuaguuuacauuccuaagacaagguuaaauuuggaaagcaaagaauuuucgguauauaugugauaauuuugaaauucuugaauuuuuaaaaaauuuaaaugccacauuacuuauauuuuuuucuaaaaaaaagucaaaccaagcgcugucuaguuauuaauagauaccacagaugagaugccugaguugguaagcucuuuuuaauucuaguucuuuucaacuacaauaauuuuauagacuuuuuuuugaaggcuagaauguugauguggaaucaaauagguaugccucuauguaugguagaugcaccugacagggaucacuugacuugaacaugcccugacaaugauccuguguggcaggugcaccugauucugaguucugaguuaagaaauccgggagugggccgggcgggguggccggugccuguaaucccagcacuuugggaggccgaggcagguggaucauuugaggucggaaguccaagaccagccuggccaauguggcaaaaccccgucucuacuaaaaauacaaaaaccagcugggcgugguggcgcaggccuguagucccagcuacuuuggaggcugaggcaggagaauugcuugaacccgggagguggagguugcagugagccaagaucacgccagugcacuccagccugggcgacagaaugagacucuguuucaaacaacagcaacaacaaaacccaaaacaaaaaaacaacaacaaagaaauccaggaguggcuaacccagagagccauuccuuaucuguaaggaacaucugagcccucaucuccuucuguggaacaugggccucgccggggauugagacccuuuguuaugaguuaaguggaaguugccagguggagauuguuagggggaggguguuaaaugagaaugcuguagagaccacaugccuuuugcaagcggcugcgguuccucuguccaacccaccaccacuggacucucuacccuguaugcaagcccccaguaaaacccuaugagacauacgguucacuagcucugggccucuucuggcucuugaaccuggugccauccacauugcagucaguaggaguuuggcaugacaccuuauuaugugaacuuuuauaucaagccauuaaauuuuuuuaaaauagacuuuauauuuuacaacaguuuuaaauuuacaggaaaauugagaggauaguccagagaguucccauaggcuuugcauccaguuuucccuauuguuaacaucuuauauuaauaugguacauuuguugcagucaguaaaccaauuuugauacaugguuauuaacuaaagucuauacuuuauucagauguccuuaguuuuugucuaauguccuuucuguguuccaggaugccauccaggaaggcgcauuauauuuaauugucaggucuccauagccuccuuuccucuuggcuaugacaguuucuuuauacuucucuaguuuuuuaauaaccuuaaagguuuuguauuggucagauaauuuguaggauuccccucugugggaauuuucucaugcuuugccugggguuauugguuuuaagaaggaagaccacagagguaaaaugcccauuucaucacaucauaucaaggguacguguuuaucaacaugauacagcccuguuggcauugaccuugaucaccuggcucagguggugguuguugaguuucuccacuugaaaauuacucgucuucccacuuuaugugcucuacucuuuggaaggaagucaguuugcacagcccacaauuaaggagcagagaauuaugcuucauuuucuugagggcagaguaucuacauaaauuauuuggaauucuucugcgcaggagauuugucucuuuuuuccuauuuauguauucauucauucagucauuuagacucauggauauuuacauuguacuuugauuucuaauccagcacuacuucauaauuuuuauugcucaaauuauuccggcuuuagcuauuagaagcccuuucacuugguuccuaugcucauuugacauagccucuuuuuuuuuuuucuuacaagaugcugcagucucaucuugcauauuuucagcccuaauccuagaaucagcuguuccuccaaggagcccuuguuccuuuuauuggagaguaauguuauuggagaauaguauuaaaaucuggauguuaaggaugcucguugccacuggaguuucuuugcuuuuaagacuucucaguugauagagcaaggcaauguauuuguccauguucacccuuauguuaugcagaucuauaaauauuucuauagcuaacuaguuguauuuauauuaagcuauaauaucuagucuauauuaagcuaaauacaaguucauccggauguuuccuacucuaacguauuaccacauggacacuauaucucuccuccuugguuauguauaaauucucacuccauccaccaucuauguacuuaauuguucaguuucaguauaugugcguagccguaucagaauuguuaacccaggcuggguacaguggcucaugccuguaaucccaauacuuugggaggcugaggcagguggauugcuugagcccaggaauuugagaccagccugggcaacauggcauaaccccaugucuacuaaaaauacaaaaaaauugcuggucaugguagcaugugccuguagucccagcuacccgagaagcugaggugggaggaucaccugagcccaggaagucaaggcugcagugagcugugaucgugccauugcacuccagccugggagacagaguaagacucuuucuuaaaaaaauaaaaaauaaaaaauauaaaaaaauuuguuaacccacaccuauauggaucuuuuuaaaagcugcaagacugcuaacaaauauuuauuuauuuauuuauuuauuuauuuauuugagacagagucucccucugucacccaggcuggagugcaaugacacaaucucagcccacugcaaccucugcuuccccggcucaggcgauucuccugccccagccucccgaguagcuaagauuacaggcacccgccaccaugcccagcuaauuuuguauuuuuaguagagacgggguuucaccauguuagccaggcuggucucgaacuccugaccucaggugauccacuugccucggccucccaaauugcugggauuauaggugugagccaccaugccuggccauaaauacuuauuuuguucccgugguuuuuuuuuucuuuucucuuuuuuaaaguaaauccuuugcacuauuuuuauuauuuuaagaccaguguuauucagagccuggguuaaacacuauucuguguguguguguguguguguguguguguuuguuuguuuguuuguuuuuugagacagagucucgcucugucacccaugcuggagugcaguggugugaucuuggcucacugcaaccuccgccucccugguucgggagauucuucggccucagccucccgaguagcugggacuauaggugcgcgccaacaugcucagcuaauuuuuguauuuuuaguagagacggagugucaccauauuggccaggcugguuucaaacuccugaccuugugauccaccucggccucccaaagugcugggauuacaggcaugagccaccacucccggccagcacuauucugucuuauacucacucugccaucuguguguguauaugguacguaugugaggcuggaucugugcacuuggaaaaguuggagagaugauuuagguaaaacuuuuaguuuucacuucuuuugccuuuuugcuuaucuugauccauuuaguuccuaccaucuggcaaauaguucucaucugaagaaucccaucugucaguucucacuauuauccgguaauaguuacagugaaaugcuggugacggcaacagccacuuuuuaaaaggauguguaauucacccucauguccucuuugagaacccaguaacugcccacacucugaagcuaaaaccauaacaguuuuaucacauggaaaguuuguugagaaauguuuggcuguuucugugaaguaaucgucccgucucuugaguacagaugccucccaggaaaauuuucccagccuauuuguuaaugugaaaguuacaaaagauagcauauaaugagcacauucaagacaaaaaaauuuguggaguaagagucugaaaugguaaaauaaaaaaucacuuaagaaaacauuuaucuguagcugucauuuucauauacacauaucuaguguauacaaguuaguaaguacauaauucucaaaaguucuaccugucuacacaucuacacagaaaaauuaggaaagucuuguccagacuuuuccaucaucuucaguauaaagcaucuucuagcuguuggaauagaaacaagcuagauucuugacuccuuucuauuugauuauuuagaucugaccuucagacgacauccagaaucugagaacacgcaccaccucuacugcucucauccugguccaagucauugucaucucccaccuggauuaaugccagagcccccuuccuggucuucucacuucuagucuugacccccuagggcaagaauaauuagcuuagaaaaccaccccagagccuuccagcauuacucugaguacuggccagaguuggacaauguuuaaggccccgugcagucagcugucccuguccuguccuggcugucacucacucgcuugcccacugaucucuuccacaucauuccuccacgacagcacugaucuccuuguucuucugugaguucaccaggcaugcaucugccucaagacuuuguguaauacuuguugcuuccucuggcuagaauauucuucccuuugauucugaauacuuuguucccucacuuccucaagucuucacugaaaugucauauuuucaaguaggcauucccugaccacccuauuuaaaauuucaccccucagaaaaaacaaacaaaccaccccuuucucugcuuuaucuauguaacauuuauuaccauccaacagacacuguauuuuuaucuguauuuuuuaucgcuuccccgcuaggaucauauaucguuuuaucuguuuuguucacugcuguauucuuagcacugagacauaauuguaaguaugcagugaagaguuaguggauaaaggacaguggcugcaagaggggauuuaggaaacacccccucccagccaggaccagcacucggugcaagaguugaaagaguugaucacucagauucucugcuucuccagucguagggacuccaccccgcuguguugauugcugucauguauucaccccaucauaagcaguacucacauguaaaacaguaccaugucaucucuguggggcuacaaguagguggugauggugcaaugaacauauaaaaccccagugucuucaguaggugcgaaauaggugauuagugaaugaugaagaguagcuguugcuguuuugauuacuaugauuauuauuaugagaaacuacugugguugaugagauagauacuggggagaaggauacuauuaauauaauuuauugagcaacuuuguucugggcacuaguugaguacuuuagggauauuaauucauuuaauucucccaguucugccauuuacucucuaugugaccuggacuguuacauagucucucagucucacccucucuuuuuuuuuuuuuuuuuuuuuuuuuuuuuuuuugagacggagucucgcucuuucgcucagucuggacugcaguggugcuaucuuggcucacugcaaccuccaccucccagguucaagcgauucuccugccucagccuacugaguagcugggauuacaggcaugcaccaccacgccuggcuaauuuuuuuguauuuuuaguagagacgggguuucaccauauuagccagacuggucucgaacuccugaccuugugauccacccgucucggccucccaaagugcugggauuacagacuugagccacugugcccggcccuugccuucucuuauaaagugaaaucauuguagcugcuuuggugugguucugaggacggugagagaagacgcacgugaaguauugagggugguggcaggcacacaguucagaguuacuaacaauacugguguuuuaucuucacaaggcagaucugggcccauagcacaaggaaaccgaggcuuuggcauuuuacaguaauuacauugccagaacauuucccccacuuucuugaaucaucuuuaccucuugagagaugaggaagagagggcacaccucgggcagaaguccaaagaccucaggcauuuuuggccuuucauucccaugauucuggccaacaucauuuuaguccccagcaguucauagaaauauugucuuuuaaucugauauucaaauaaucugugccuugaagaaccuguguauggcucuagaaucuuuuacauuaaucuacucaaccccacucugaugcucaaaacuucagcagucuguuuuuuuuuuauuuuaaugucuuuauuauuauuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccuugugauccgcccgccucggccucccaaagugcugggauuacaggcgugagccaccgcgcccggccuaaugucuuuauuuuaaacauuuauuuuuagagguagggucucucuaaguuaugcaggcuggccucaaauuccugggcucaagugauccucccaccacagccucccaaguagcugggaugacacccccaggugccgccauccuggcagcagagucaguuuugauacaucuuucccuucucauucuucccaaugucauggauugggaaguuacugugguuuuaguugcaguacuuuuuacucugaauucuguuugcuuccuggaauucugucugucuuuugaaaagacaacauaaagaaaucgaaaaauauacuuuaaauuccauagugugggagccucugcuacucgccuguuugauauucauucccauuuuuuccuuucuaaaagaauuccagauuuuuuuuguucagggugacaaugugcucugcugaaaauacuuucacagauucccuugcaggugcaugugaccagaucacaguaauggcacauauggccucaguggaauuugcugaggaguaugucccucccaaguaacagcaaagcuuuauuagaggaaaaaacaacaacagaaaaccuuucaccuuugucuuguuucuccugccuucugucuggaacuuggacacagagucuugaauuucugugaccauaaaacacgaggauaaaaccaacgugcucaggauggcaguacagaaagauaggaauacgcuggucccugauggcaucauggaauaucugcaguggcccuagcuucagugucacuucuuaggugagauacauaauccuaccguguguuuaagccacgguuugacauguggucuauucucugccgcugacugcauucccagcuguucuauauggcuugcuagcuaauuuaagucuaguuuuauugucaaauugaccacauuguagauuauaauauuaaaguacuucacagucuaaaagugaacuacuuuuguaaaagccaaaggaaaugggccaaaugaaccauuuugaacagaguuuaaaugagugaguugaguuaccacucuuggauggagaacuggagaccuggauuuucagucuaguucuucugccaguuggcucugugggcaagucacuugaccugagcucuuuuccucccaucugcaaaaugagguaauuugagcuagacaguccucccaaagaccaccaaagagcuagcagauugaggccugcagacuccuauugaauuugccauccuuguucaccuugccaagacuucauagccaagaagccagacccagauuuuguucauuagcuuugaaaacacccuuucaguuggguguguguguguguguguguguguguggugugugacaugcguuuugaauauaaauugugaauuguuuuagcaagaaaccagguuguauguuucucaauaaacaugcauacuguauauugaugaauuuauccacuugaaauaaauggugccaaauugccuaaaguuugcuguaaacaggaacaugauuucucauuaugauguuuaauuuguuuuagucuuugaucucuuacaucagaauucuguuaagaacucuuuuuaccugaaagaucaaagcaaauaagcagaagcauuuauaaaaauaagguauacguggcuguggagagaaacuccagguauauacgaucauaggcuuuuuaaaauuaauaaacuuuguuuuuaaaaacaaagcaguggaaguucacagcaaguuugaguagaaaguacaguuuccauguaacugcuguccuagcaaagauuuuuaaguacaauauuuuuuaauuaaaaagagaaaauauaaaccgugcuaagccaguuggugaaaaaggcuucauuauacuuuuagcacucuuaacgcuuauuaaaaguuuuuaaaaacagauuuuugugguugaaucgcuuacaauuucugauguguaaccuucuaacauguuucaucaaauuuuaaaaguaauguaagcagugcuguccacugcuaaauuuuauuuuaauguuagaauacaaugagguuucuauuuugccauuaguccugagagcuuauuaaguaaccaguuuuaauccuuuaaaaaaccauucucauuuugagggacacauauuucuuagcuuugugcaauauaagaagcuaagaccaucuuggcaguaucaaaugaaauguuuugcaaguuagaaaguucaguaaccacuuauaaacauaaugaacaauuguuauagucagucuaaugcagaaauacagguguugggggcagggggguggugggugggcagacuugguccacaaguaguaguuugccaaccucuguccuaaacacaaguucaagaauaugguucucuuggauagauuuucugccagaugaaaguaagaguaacauccuuagcuaaugaacuccuaauauccaaggcaacuuuuaauuaauucaggcuuuuaagaaaagcuuguuuaccaacuccucauuaaaaauguucagacuggcuggucgugguggcucaugucuguaaucccggcacuuugggaggcugaggcaggcagauugcuugagccuaggaguucgagaccagccugggcaacauaucuagacccugucucugcaaaaagugaaauaauuagcugggcaugauggugcacagcuguagucccagcuacucaggaggcugaggugggaggauugcaugacccccggaggucgaagcugcagugagccauugauccaaccacuacauuccagccagggugacagagugagaccuugucugaaaacaaacaaacaaaaagauuaaugcaguacauguccuuuuggugaauaaguaaauauguuuugguaacuuuagcuuugcauuauaaucuagucgucagcagauugacuaagggcagauaaaacaagaugauuugguuuugugguuuggcacuuacugucugauuuaugcccccaagaacucuugcaggccaaggucgaguguaucugauaccugcucuggcucuucucacgaacugauuuaguagcuuugggccagcauuagauuuuuuaaacucuuugaccuauuuguacaugacaggcauuuaaucuuuccaguaguuacuugucaaauagaaaagcaucacuucuuaguuuggacauuugcaaauaugacugagcagagcugacagaugaggugggcaucuucaggccauaggguacuucuggccuccuguaaccuagaaaauugggaugccucagauaucagguauucuuccaagcagcuaggguuagucccugaccucagaaacccugagagcccucagaaacccugagaaauccaccugggaaugguguauuuguuuuggaugagauuaccuuuacuuuccauucuccaggucuucuuguguuuuuuguuuuuguuuuguuuuguuuuguuuuauaucauucuauguaaaagagaaaugugguaucauuugcauuaucauguuauuucuuuccuuauaauuuauaucuuaaugcuuaucucuggggcuagguuauaaucuccugaguuagguagccuuagguuucuuggcggagauuccuccccugggaagugagguuuauaaaagaacccgugauguggcccuguggagcugcauggggugugugcucaguacucacugguuucuucccugcaaagugacaccugcagccuuugggguaccaugucucauaauuuuugcauucccugcaacacacacuauacugcuaugggcaucauugaucauuuuaaagauuuaaggaaugacaagauacagugcuuauucuccccuaugauuugcuuagauuuuuaucuaaauaguacuuauugaaauaaguacuucaguaucaugcuacaucuuacauguuugagcuagaaacagacuaaaguuuaaacccuuuuaugagaaugaaaaguuacuuccuuccccuucuuagggcuuuuaaucccucuuuauguugcauuucagaaaaugcccuauagcguacuaugaaagaaagacauucauuccugucuuugcugcuguguggacgaucuguauuccuugcuccgugggaguuguggguuuaugucuauucuugcauguuuugccugaaggaccacagugaccuacuugguggucucccugcuuucaugguuucacuaugcugaucuauccuucacuuaauuauagagucuaucuuaaaaaaaaaaaaaaaaaaaaaaaaacuuuuggccuauguugcuucuuccaaaauggcauccaaaaccuaagccucuuuaaaauuggaguccagcaugcuuccccagugcuacuuccuucuggacucccuuugccacuugcuuucugcuuccacccauauccagaugggcugcaaauaugccuugcugguucuuuacucugucuuugcacaggaggcucccucauuuugaagggucuuuugcuacccauccauccauccauuuggauucuauaauagaguucuugauguuugacagaacuaggccaggaauuguggggguauaauggcaagcaagacagagucuauccuuacguuauggaaguucaauucauuucccauguggcauacuacuucucaccauucagauucaucucgaauauuguuucuucuuugagguuuuucccacugcacccaagauacuggccugacacuuuccuuaucucuauuacagaauuuaacuuguucauucauuaacagauauuuauugccuacuaugugcaagaaucugugcuaaaagcugggaauauugcaguaaacaaaaauuaaguuuacagcuuacauauaaugugguaauuauccaucuuuuaccuucauuagacugaguucauguaggacuuuauguaauaucuuuauaucuucaauaccagaaaugccuagaaauaauuugcauaauauacauuuucuuuaaagauuuaacaaaagucugagggacaguuuucagaauaaacugaauuaaacucucucucucuuauguguguuauguaaacauauauauaaaauacacuuuuggguuuuuugcuuaggaaguagaaaaaugcuaaaauuucuguuacuuacaagcagauuaaaauguccaagaaagaaaaguagggauuuauauugauucugcucaaaugcuuaccuagacaaugucaauauuuauauuuuacuccccuguuguaguagaaugguaauugguucucuaguuaagcagcuuuuuuaggauuaauuuugaagcaagaaauucagauuaauuaagggacaauuucacuugcagcauuuaggcauuauuuuaaccaucaaacuugaaguggcaagaaacggaguugcuuaaggaggccagacguaacauucuaaagguaguagggucuugauuggguugcuuaggcauuaaaaggcuguuuaacuugucuugaagucuaucuuuccuugaugucuucugcgguaagaacacugugauacagauggaaugacgggaagugguuuuccuuucuuucaguuggugaguuuguaagugaugcccuucucguuccugacaagugcaaauucuuacaccaggagaggauggauguuugcgaaacucaucuucacuggcacaccgucgccaaagagguaccagcccauaaauucuuucuuauugcaaagugaagauuuccuggggacgugcuuaauggcauuuuagggguauuuugaggcaacagcuauguugauaaguuauuuaagaaaaaaacccagugcuacuauccguaacccagauuuuaguuuuuagagugauuuuagguucacagcaaaaucgaacagaaaauagaguucccguguacccccuguccccacacaugcgcagccuccccauccaugaauauuuuuaaaaagucaaaaauagggccaguugaacuagauucauuaugugccugugccguguuucgcaacuuaaaaauauaaguugucugugccaugccuuauaacuuaaaaauauaaucucuaauaguuauaacuuuaaaguuuacccuucagauuauuuuuaugcaccuguuguuuucuuuugucauauacaauuuuuuaauaauuuagccuuuuccccuguuaucuauuagugaauacagugguagaacagugaaguagcuuuuuuauaccagccugaaagcuccaguuagaauucaguuucucaguuauaccauccaguuuuauauucagcaggccaugccuaccaucuugauuuuuccacagggugagucugaccgagcacuugguuaaccucugcuuuuggcuaagccaauaaaagauguaagauacuuagcaugaaaaggucacugugugguaagaccaccuucacagcugcuguguccccuugauagguuuccuaauaaauuuauauagguuuauuuguggcaagaucagucuuaggcuaacuagaauuaggcuccuuuaucuagcucauagugcuucacuugagucaauuuugauccccugucccucaccggaacaugucuggagacauuuuuuguuauuacagcuugagggagugguguuacuggcaucugauagugcccagaggccagagauucugcuaaacauccuacagucaacaggauaaccacccgccacccccaagaauuaggcaguccaaaacaucaauagugcugggguugagaaaucugaucuagcuuagcuuaaccauuguaucauagcuuuauagcuguuagacagaaaauaccacugaagauuuaguauuauuuuaugccucuuauaaaauaguauauuuggauccacuguagaauaaaauguuuuuuauguaaaaauguguuuuggagguuuaagagcuugcugaguuuaagaaaacaaaccaaauaauuugaaguccagcuaccuauuugauaaccucauuuuuuauuccuucuguguuuucaaaagaaaaauccuuugucucuaagaaacggaaaugacucccauaaggucaaaauacagucuguaauauuuucauugucuaccuuuaugucuugaauuauucauccuucauuuaucacuaguggaugcucucagaacuuuaugcuaaucuagauuugugcaaauuuagcaaaucccagaaaagcaaaaagacauucaaggagaaaucucuaaugacuguaaguucugauucuuaguggcugcaggggauaauuucuucucuucccaggauuguuacucugaaagugaaccaagagagucagaauuucuaggauaaggcagguccaugugagauaaacuuccaucuguaagggagguaggagugagcuggggaucuaccuggaaugcgcacaauuucuggauacacgaauuaagccagaaggcauuaauucucugguaucuguucaccaguggagacugcuacaucuuauuucccaauuaguuuccauuccaguuguucguauaaaccucuauuauauaacaucguggucuuauuaaauaaauaauaaacaagaauaaaaagaguaccaaaguguaacccaugcuaaaaaaaauccuguuguaaauucacucaaaaagcaaauaaucuuuuccuuugugaaauugguuccuaauauauugggucugcauguugauuauuuuauguggaguuuucuuacaaugaaacacaucuacucuaccacucacuguuuucuccuuacacuuuguagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagguaagguggccuuuguguucagccucagagaugcugaaacaucuuguauggaguauuuguauccuguaaauuaaucuuucuguuuaucacugaaaaggucucugcccacucccaucagagucugcuguuaugcaaaaaucugaacuaugaauuuuuauggcauccuguugaauuaauaauaucagucacccaucacagaguuaauuuuaacuauuuaauauuaaacuugggaucaaaaucccacugauaacuaucauagguuacugguaguucuaacagggaguugaaauaauaauggcguucuguuuuggucauuaauuuaaaaauauuuuuaaaugcucucugggauugucagucauuaguuuaaggugaauuuucguuaaagguuugguuugagauuuugggcguucucuguguggauguguaaggguuuuuuuuuggccuuuuaucauuucuuuuccuucauaguggaagucaaaggcauuaauaaaugcuuguuaauuuuuuuuaacuaccuuugauuuguugauuguaaagaaaccuauuuucgccucuuuuucuuagggagcuuagucccguuacuucuuaccugauucucauucuuaacugaaggcaaacaucuauauucaaaucauaaaauuauaaaaugagaaucuuuggguuggaaaugccaucugguucaggcauugauuuuaugcugucucaucccccgaagggugaugauuguaucacuuaucuuauuccuucaguauucucuuagauguucccuagagcuacagauuuccaaacagcacauucaauaggaguuguaaguuuauaaucggcaaacuacaggaugcuuguuuuuuuuucuuuuaauuucugguguaaucugcuacuagggcccccauagaguuuauugucuauaucagcuagaacacugggaccacagucauaaacugaaggauccaggcaaacugggucauaugguuacccccaccaauuacagucuucagugaugaugucacuauccagguugauauucaguugaaaugcuagccagcuccuuccuaguuaccuucauuuacaucccauuucaguaccugaacacagucaugcuuuagacucugaaauuccuuagaaauaguaccauaagguuuauagcuuugauauuccucucugaucaugaucuucccucauaaucaccuccccaguucaggcuuuuaguccauuauccucuuuuucccugccugccuuucuaaucaggauggaaucaauggauaaccauucuuaccuauuccauugaacauccuugacuuggcugaaacccuucacauuuucuaaacauauuuuugucaauucuccauagcuaggaaaaauuaauuucuuucuuuaguugcuucugggauuucuaaaguaucaagucauguaaccuuaccacuuaauuccauuucuuauucaugcuguaacaucagcugggaucuuaauguuacuagaugcaccuaauuaucucugucuugaugaccuaucaucuuccccauagcaguugauccagcccaacuucauucuccuugguucccagcguaacucucucucaugcucuacagaugaccccuccaccgucauccauugugaauuucugcaacaugguaccugacauuugguaggugcccaguacguguuuguugaauaaaccauugaauuuucuccuguacuucagcaacucuuguaccuucuucuaucccuuuguuuccugucuucccuuuuaugauuauguucugcuggacucucaaucaucuccucucccuuucuugcauuuucagucucccucucccccacacccccaggcuucauccacccuccucccagauaauucuuucccauguguuacuaucuuucuacuauguguuuuuaauccuguugacaguugguaggaaauauuugaugguuuauucuaccuguagaaaaguccaaauucucuugcagggcauucagaagucucuuacauggcuucagccugcauuuucagccuuauacauguaugugacucuccuggcauccuaaaaccauugaccuuuucuuucucuaggcuuucauucccaccguucugccccaucugaaauauuuuuccuuuuuuugucaaaugggguuaauguaugauaaagauauuugucaacucuaaagugccacuucuuaugacccgucaaaaucuauauauuuauaaauguucaccugaaaagaugcagccuuuacaagucuuuacaggugccuugcucugcuauacuacccuugcuuuaccuuuuucuuauaagaccauaacuuaucuuccaauuaauuguagucauaucucuuuuuaucuguuagaauccaaacuauaguuuaugugucugguaugucuugcacauagguccucaauaaauauuagacaaaguaaauuguauauuuuaaauuuuuuuucauagcuuuugguaaggacuucaugguccacgauuggauauuguagaaagcuuauccagcccacugcccaggacgacuuugaaugcggaccaacacaaauucauaaacuuucuuaaaacauuaugaaauuuuuuugccuuuuuuuuucuauaggcccuguuauagagccucccaucuuuuagcaaagaacugucuaauacaaauguaaugugagccacauacuuuuucguuuucuuuuuuuaagauggagucucgcucugucacccaggcuggagugcaguggcgugaucucggcucacugcaaccuccaccucccggguucaagcgauucuccugccucagccuccuaaguagcugggauuacagacaugugccagcaugcccagcuaauuuuuuuuuuuuuguacuuuuaguagaggugggguuucaccauguuggccgggcugaucucgaacuccugaccucgucauccaccaaccucagccucccaaagugcugggauuacaggcuugagccaccgugccuggccuuacuuuuucauuuucuaauagacaguuuaaaaauaguaaaaagaaacaggugaauuuaauuuuaacaacauuuuauuuaauccaguauaucugaaauaucaugugaccaauaugaaaaauuuaauaagauaguucacauucuuuuuuuauguuucuuucuuucguaagaagucuuaacacuucuuuuaacauuuaacagcacgucucaauucauacuagccacacacuguguuugauaguuacauguggcuggugacuacuauauuuggacaguguaguuccuggaugacuugaaauuucuuaucacucuuuauuuuuccauuaagacagacgguuuguauaaccuaguaauguuuucuaaggcugagccacugaauuuuuauuauuguuuuuaacuauucuuguuuuuaaaauuuaaaaaaauugguuuggauucaguauaauuaguauaucaggucacuugcaccauuuuauuuuuuaacuucuuuuccuguagcccugcaggcgggcagggcuucuuucauguggacaaaaccagaaagguguugcaucacugauccacacacaaggugggcuccugccaacuggcagccuccuuguuccaggaaccagcccuccuuuugacacuugaaauguaaaaucagaauagaaguuuaacguaccugacuuaaaacaucuucaggggaugcuacgugacaauucuugaagaaggagaaacgagcuaccauuuuccuggaaacaauauuugauucacaguauuuuguuguuugguaguuaaugaggcuuguuuugauagaagaugaguguuuuucuaucgcuaauggggcauuuagagaaacauuccuuguaggaugagcucuguuuuaugaccucauugaaaaagagguaugaaaaagagguaaaucuuuaacauaggcaaaacagguaguguuucagaaauuuauguguaaauuaccgaguauauuuuucuccaguguuguaauggucauauucucagaucaccucaaaauaccuauuuaugcagucuguaauguagcauaauccagacuguuacuaacauuauguagcauaauguuaauaauaauaauuacguacauaauguuaauaauacacagacuccagccaucguggguaagauuuuuuuccaugggaaaauucauuuggaaagcuaacuuguaagacuagccagguaggcagccuagcccuggaggcagagcugcuccucaccuggaacugcagaaucugauugaacccagugguccauggggguugcugaauucguaaagcaaaugaaauguuagaagacccucuaauuguuguagagucacacuuuuccucuugcagaggagguacucacauuuuuuuuaagaaacaaucuuuaauuaucgauguauucuuuuagguuuagguuugcagacacuggugagcgugugcugagagguaacuugauguaucuuucuggauaauuagaugauuuuuuuuuucuauuucuuugaacauuuuuuuuuuaaagagcugcuuaagaucuggaggagugauuccuuuugaccgugucuuauuuucauuaagacuguauaacuuggaagaguuuuuuuuuuucuuuuucuuuuucuuuuuuuuuuaagaugaaguuuuugcucuuguugcccaggcuggaguacaguggugugaucuuggcucacugcaaccucugccuccuggguucaaacgauucuccugacucagcuucccgaguaauugggauuacagguguucaccaccacacccagcuaauuuuuguauuuuuaguagagacaggguuucaccauguuggccagguuaguuaauguuacucucugguuuggggggcagugauauguuuuggcuuuuuucccacccagaucucuucuugaauucccauguguuguggaagggacucggugggaggcaauugaaucaugggggcaagucuuucccaugcuguuccugugaagugaauaagucucacgagaucugaugguuuuaaaaagagggguuccccugcacaaguucucucucuuugccugcugccauacauguaagacaugacuugcuccuccuugccuuccaccgugauugugaggcuuccccagccauguggaacuguaaguccaguuaaaccucuuucuucuguaaauuacccagucucagguaugccuuuaucggcaacaugcaaaugaacuaauacagcucgggguggcuugugugggugcguauggccauguaugcaggugugcgugcauuggaauauacaauuccguauugaacccaguuuaaacuucaucaguucuggugauugcuggagugucacauauggcaagacgucaccuugcccucuaacuacaccagaaaaccaggccagcaccauugacuaucuagauacagugggccguuuauauuauuauuguuucauauuuuuagauuauuugguaaacaauuuacagaacuaagaauaaaggaauagugagaaauaacuauuagcaauuuuaauaagaguuaacauaguaaauauuuuaauuuuacgaagaauuuaaauaugguaaacccacauguuuauucuguauuuucccaguuuugaagguauggauuucugaaaugagcauuauccuuuggaaugcagcuagcugcuaaucaccugccaugcacgaaccugaaauauauccgucuuacaaauacugguucuacauuucaaauacaucucuauuagguucaucauauuucuuggucuuuuuuuuuuauacuugcaauuucauuuaauuauuguaaaaauuuaagauauuuaaaacauugacagcucauaauuuuauugaagagagaauauagccaucuucccucaggaauaaaauguuuucaaguuuggauuuguaaacagcuauuaaaaugaucaagccagucuuuuuuucccccuuuuuuucugcauuaucucuucuaaucaccuuagagagauuccugccuugggcauuuguccacuuccuaaugguaucaaauaaauguguugcacagacauaaaauguguugcauaagcaucauaaaauggcaaggaauacugucacaucauuuuagcaaugaugguuaauguuuuugucacauaauauugagugaugauauccuuccuguugaaugacuaaguggaugagaauaccauauuuccuuuuuauucuuagaaauacauugcucagccgggcgcaguagcucacgccuguaaucccagcacuuugggaggccgaggugggccgaucgccugagguugggaguucgagaccagccugaccaacauggagaaagcccaucccuacuaaaaauacaaaauuagcuaggcgugguggcgcaugccuguaaucccagcuacucgggaggcugaggcaggagaaucaauugaaccagggaggcagagguugcagugagccaagauugcaccaucacacuccagccugggcaauaagagcgaaacuccaccucaaaaaagaaagaaagaaagaaagaaauacauugcucacuugucaauucuugagcuugagaaaauucaucuaggauaucaugugaaggcucauagccuaagguuuuacuuacgugaucaauuucauucuucuucugguuuaucuaauugguaaaaugccuccuucugucaguuguuccuauuugccaauauguggaagaugauuuuugacuauauucagugagucuccagacuucuuuuuaucaugcuuuuuaaagagaugggaccucacucuguugcccagacuugagcgcaguggcuauucacuggugugaguauggugcauuacagcugcaaacuccugggcucaagugauccucaugccucaacaucccaaguagcugggacuaugcagacuuuuuuuaaaccaucuugaaagaugaugcaguacuuugggaacacagcaauaaaaaugugauaauuucccuauugcaucaccuuucuaggcaauuauaucauucuuucaugcucauauuauuuugucuucuuuagcacaguuuuuaaauaguugauggcuaaugaugaaauaauucuucggaugauaaauauuuuguaacauaggaacacaauauaggaaaaagaucgagguucauaccauaucucagacucaugguuaaguacaagcuagaaugaguuuuagucgauuaaauuucuuuuucucuaugaauggauaaagugagaauaucagcccacaaguaguuagaagugcucagaacucaaagguaaaauuguguccaagaccugaugguauucuaaagguuaacagccuauccuacuuaccaagaauuuacauuuauuaugaggccuguacaaccugaugcaggaaaauacuuggcauaauuuucuauaaguuagguaguuaggugcucaacaaguauuugaguugaaucacauuggcauucacaucaaacacauacaccuacgucaucauguuaacuuaagguuaauagugucaccaaaacuaacuggucuuuaaaaaagaaaaacuaggccaggcaugguggcucaugccuguaaucccagcacuuugggaggccgaggcuggcagaucucuugaugucaggaguucaagaccagccuggccaacauggaaaaacccccucucuacuaaaaauacaaaauagccaggcaugguggcaugugccuguaaucccagcuacuggggagacugccagagaaucgcuugaacccaggagguggagguugcagugagcugagaucgcaccacugcacuucagccugggcaacagagcaagacucugucucaaaaaaaaaagaaaagaaaagaaaagaaaaacuaaggaauaucauucuagacaugcaguaauuaaguaaaauugcaucaggagucuaauaacauagcaugaugggucccauguuucauuauuuccaugggcagaagagggauggcuacauuauaaauaaaggaaaauuguaagaauaagaaaagaugaaguaugaaauauuuccaacucaaaaacaaacuguaucugagcaugcagagguacaaaaugucaccuuuuuccuccaguguaaugaagggcacuaaaccucuugagcauuugauauguuccagauacuauauuaaagugauuuuuuuuuuuaggagacagguucuugcugucacacaugcuggagugcaguauugcaaccauagaucaguguaaccuugaacuccugggcucaagugauccuccugccucagccucccaaauggcuaagacuacaaacacauugccaccaugccugccuaauuuauuuugauuuauuuauuuuuuuuguagagacaggggucucacuauguugcccagacuguuuucaaacuccuggccucaagugauccuccugccugggccucccaaaguguugagauuacaggcaugagccaccacgccagaccaaggggugaaaucuugauaacaauaaucaaugcagucaucauaaaacgcuugcacaggcucaauuuguagguggcacagugcuacaucuagucaaaagcaaauuuaauuauggucauugugcucugagaacuuuucucagaaaauaauaaccagaugguauuauagauggugcauuucacaaauacaugauuuguaguuagugaaaacuugucauucaaucauguaauaaauuaugcacaugccggucuuccacuuagcuagugauguugaaacauucauagccuuaccugaugagcucaggcugucaugagaauuuaugucuauucaguacuuugucuuuaaaauuaggugagagagaaagagaggcuguauuugacuauauaucuuuuuauuuguaucucuggaguuacaaguuuuugaauauauaaucuuucagcugccuuucugcauugcauuuugagaaaugauauuaaaugcucaaggaaaaaaaaccuaacaacuuuagagggccgcaaagugaaucauacaaaagauaaauuaaagcuuuaaaucuuugccaguggaugagucaaguaagaguggauuuaaugaaauggcucauggcuuugagaagcagcugucauaaugcuggguuggcagcuuccaggacugugugaggcuuucugacugucuauacugaaauaggagaacucauuugaaaaugacgaauaggagaauagcagaaacuugcauuuucuuuugagggaacuggcugccaguuuugagguccuuauuuagaaaugcucgauuccuguauugaauaaacuuggacuacauguaugucaaaaagaaaagcaaaacacuuuuauagccuuaagcagauuacagauguguggccaaaccaguggggucuguuuuuguuuccaagcaggugauggcuggaagaggagaugccucuguagugcagggcuugaguugcugcugucugagcuacaucuggcaaugagacugugcugcuuacugagaccuaauggcacagguugccccaguaacaggauauugcugaaugagaaauacuguaggauucauuuguaagaguuauuuggaggguuggauuauucagugcuaaggauccuaagcuacugaugcauggacucuuuucuucccuccaguaucuuuuaauuaaacuguacaaauucccuggcuuaaaaauaguaggaaaagaggaagaaaauacagauucuuaugauuuuaacuggucucuggcaauaguacaccgaaacauuaauuucuuguugaaaccaucuggauauuuguaucuucaguguaaaaccccuaauuuagauaggacucuccauugugacauggaaaaauaacccuuuaauuaguuaauuaauuuuacuguggccucaaaaucuacauauuagcauaucaagccaaaaacuguuggcuuuacuugggagccauguggcuuaaacuaguaccaguaacuuaccacaaggaacucagcaaaauuauaaguccauguuuguuuuggaaggaaggcaauuauuacgaaaauaauuuagagauguucaaacuauuuccuuugaguagagguagagagugaacaaaaucugucccaagugggagcuaacuagcuuccuuuuuugcccucccuguuuacaaaguaacacuuuuaguuuacuagguaacauuugcaguauccccaguguuucaauguaaaauuguaggugguagacuaaugccacuuagccaaagccaugaucaccugaauuuuuaauauauauuuuuguauggagugagauacugggagaacagucuucauuagcuuaaacucuagaauguacuguuuguuuguuuguuuguuuguuuguuuugagauagagucucgcucugucacccaggcugcagugcaauggugcaaucucagcucacugcaaccuccccucccaaguucaagugguacuccugccucagucucccgaggauuacaggugccugcuuccacacucagcuuuuuuuuuuuuuuuuuaauggagacggagucucacucuguugcccaggcuggagugcaguggugugauuugggcucacugcaaccucugccucccagguucaagcgauucuccugccuuagccucccgagucgcugggauuacaggugccaaccaccaugccuggcuaauuuuuguauuuuuaguagagacgagguuucaccauguuggucaggcuggucucgaauuccugaccucaagugauccacuggccucggccucccaaagugcugggauuacaggcauaagcuaccaugcccagccaagaauguacaauauuuuuaaagaaaugcgguuuauuaccauaaaauacagguugagcaucccuaauccaaaaucugaaaugcccuaaaauccaaaauguuuugagcacugacaugacagcaaacguagaaaauuaugugacuuuauguguucaauguauacaaacuuccuuucugaaacaaaaauuauuuaaaauguuguauaaaauugccuucaggcuguguguauaagguauuuuugaaacauaaaugaauuuuauguuuauacuugggucccaucuccaacauaucuuauauguauggaaauaucccaaaauuugaaaaaaaucugaaaucugaaacacuucuggucccaggcaguuuggauaaggauuacucaaucuguaaauacaguagcucaaauugauuuuguaaggcagucaaguuauuauuuauaguauuuuaauuuguauuauucuuuuaauauagcaauucauuuuauauauuuauauaaauaaauuuuuugcaauugagcaaauuaaaaaaauuaagugcuuccuucagaucuacauuuuauuuucuauuuguuaucaauuuaauaaguaaaggacacacagaucaucugauuguguugucagacauuugaaggugcaacugaugaauguucacuguuguacuuuguuuugucauguaaauuguuuuaaagagaagugaauguugagcauauaguaggccacacgugccuguggauuggcucauuguuuuaggaauguguaauucuggaaaagauuugccaaggguauucaaaaguauaguuugauauuagaaauuauuugaaaauaaucuuuauagcauagcaccauuuuauuuagaucaauaguaauucaagcaguauacauaauuugcuauuguaagcguagcauauaaccuaaguuuucuuuuacauuugagaccacuguuugcuguuggucgaauuuggucuuccaagauuuuuugcuuagugaccuaauugccagccuuugugaagagcuguuacuuauugucaaaccaggcaguaaggguuugcuuuuaucuuuuuaucaguucuuucaaugcuaguagucaugagauuaauguaguuggauacuaaaauguuaauacguguuagauaacaaacugggaaagagaugaaugacaucaugaaggaaagggcaguauugcacuuacagugauuucaugaugauagaacuaaccugccuaaaaagacauuggguggaaacagaaaccagguguaauagacgcauccaaguagucaaggaaagaaaagacuuguaaguaaauaagauaaucuuugcuucaaaaauaucuucaaagguuuaaaaugugcuuuacccucauauauaaucuuuuugagccuauuucuuuaccucaaacauggggaaaauugcaauaaucuguaucacgguauuugcuuccaaaacgacuaauugguguaaaugcauaucaagccgguaaaguuuacaguggacuuguuuaaaaugcguagauuggaauuguugggggagcaggccagcagcaugggauguuuuuuuuguuuguuuguuuguuuaagacucugucgcccagacuggagugcaguggcacaaucucggcucacugcaaccuccgucuccugaguucaagcaauucuccuaccucagccucccaaguagcugggauuacgggugccugccaccacgcccagcuaguuuuuacauuuuuaguagagacaggguaucaccacguuggccagacuggucucgaacuccugaccucaggugauccgccugccucgggcucccaaagugcugggauuacaggcgugagacaccgcgccagcuggggugauuuuuuucuuagucaaaucacuucucuacccaucaucucacacugucgaauacaaagacucuccuuggggcucaaugacucaucucccaccucugguuugauaaucauggcuauuauaacauguucccuuuuuaauuaguuauuuuaaaauuauuguaggucuuguaaucauaaucaauaauaauacguaauggcuccuuaagcacuucuauccuagauaagguugagaacauuauuaaaauuaguuuugguaguaaucaaguaaugauaauucuuauuuaugaauuuaaauauguaggaguuuuuuuauuuuagggaagcaaaaaggacuagaaaguaugaugucucaugauuagaaaacugcuauaaaaaugaagguagaauugauuugggcuguuuuggacauuuuaaauagaaauuuaaauagguauucaaauagcaaagucauucuacuuuaaaacuucuauacuuuuuuaggaucuucaauuuuauauuuaaauuauauuuuugaaaugguuuuagaagaaauauuguaucuuaaacucuaacuacuaauaaguaagagaagauauaucaaagguuugaucuuuuaucuccuagaauauacuauucauucguuucccauuguacgucauuugaauguuaaugguuagccucaaaugguuuucaacauaauuguauagcuacuauuauuggaaaauuggagccaaggacucauacacauaucagaagugguaaugaagcacuuugguuuuaugaaaauauguuuacaagguagucacaggauagcaauauugcauuuacuguaauacaaugaugguggaacuaagugcaguggaacaggaugcugagaccacaguuaccgcaucucuaagugccucgucuaguuaugguccaaccucagauauaacucauugguguugaaacacaccuagcaacauuuuaagcauagaccguucauuaaaagguaccuuuuuaaaaauuuuuauuuuuaaaaauugacauguaauaauuguacacauuuacaggguacacagugaucagaucagacugaucagcauauucaucucaggcauguaucauuucuuuguguugggaaaauucaauauccugcuucuagcuguuugagauuaugucauauauuacuguuaacuguagucauccuacagugcuguagagcacuagaacuuauuccucuuaucuagcuguaauuugguauccuuuaacaaaucuuucucuauccucaguuucuaccuacccuucccagccuccaucauccucuguucuacucuuuacgucuaugaaaucaacauuuucuagcuucugcauaugagagcaugugguguuuaacuuucuguuuuuggcuuauuucacuuaacauauguccuccaguuccauccauguugcuucaaaugacaggauuuuauucuuuuguauggcuuaauaguauuucauuauacgugcaugcacgcacggacacacacacauacacacacacacacacaucacauuuucuucauccauuagucucuuuggacaucuagguuauuccauaucuuggcuauugugaguagugcugcaguaaauaugggagugcagauaccucuuuuaauauacugauuucucuuccuuuagauaaaugcccaguagugggauugcuggaucguaugguagcucuauuuuuaguuuuuugaggaaucuccauacuauccucaaaugguuguacuagaacagagcuuuuuuaccuuccuuccauuugggaaucuucuuacccaacauguauauuaguaacuuggcuauguauguuccauucucugucucaaauacugugucuaggacaucugcaaucuuuggcuaugaccacgacuguaaagugcaugacgcuuuugcucugucaucaguauuaguugacaggcaaguaagauaguacuucucuucauaaccccuuuaccugcccagcagaauaccaguacagacagacccagaauaucucugggcucaagaauccagacauuuauaggaugggacuuuuaucuauaaaucaccuuaagauuaguaaguucuuagaauugguuaccuuugccauuucucagaagcccuuugucuaguaaccugugugucacugucauuuccagccugucuuuccuacacauuguuuaugcaggcuuuaggagugcccaccccccaguucuaccccccacccccacccuagccuuugugguuuuaauuauccugucuuggcugauuuuguuuuguuuugacauuucauccauuaaauuccugacacuggcuaucucuuuacaauuauuauacuauuuuucuuucuggcucgcucuuccugauugcuguaauccaugcccuugacuuuaaauaccauuuguaaguagacuaggccaagguuuauuucucuaggccagacucuaccuaguuauuucauaggcauaugaauccuaacauguccaaaugagaguucuuaauuccccugcuacccaguccucaaugugguucucucaaagcuauucuaucucaguaaugguccuaugcccucuccuagggauuauugcugagaaccuagaacucaucaucgucucuucugcacauccuaugaauucuggauuuauccacuuaucuccaucuuuuccagcacuaaucuaaacucccauuguuucuugcuggaguuauuuccguauccugcuaaucucugcucucguucucucucccugacacaugcgcugcuuucuucucccacaccaagccauucucuguacagcagccaggauguagaguguuuauuuacauaaagcagauccuggaacccccaaauuuaaguuguguucguggcuuaccaauacgcuuaaaaaccaagugcacagagagaaaacaaugaagccuuauuuggauaugcugaggauaauugauaacggguaacaacuaacaaacacguaguuggugucagguuugaccuccuacauuccuuacagguauuaguguauuugacccagcuccucccuaccuccgcaguaucaccccaugccucucuuucccccgacucuccccugcucagugucacacaagucaauauccccagcuugcuaacccccgggcugacagaucucauugucuauaauggauguuccaaggucccaccuucagccucaguuuuguugccaucuuuccagaaugaauucccuugaucauucuguuuuuuggagacaagguccugcucugucaccuaggcuggagugcaguggcaugaucauggcucacuguagccuugaccucccuggcucuggagauccuccugaguagcugggacuacaggcugcaccuggcuaauuuuuuuuuaauuuuuaguggagacaagaucucacuuuguugcccaggcuugucucaaacuccugaacucaagcaguccucccaccuccgucucccagagugcuagaauuacaggcaugagccaccaugccuggcccugaucauucuuuucugaagaaaacaccccuucuucauuauucucaauccuagcagccuauuuacuuccauucugaaaugaaucacauuuuaguauuuuauugguucguugucguucucuccccccauagaauguaaucucucugaguacagggagcuuaucuuuuucccuuuuggagccucggauccagcagaaugccagacacuuagcagccacuagcauuugaugagugaauggcuuuucauacacaauuuuagacauuguuccugauuggucucucuagucaauaauagauuuaucaaaucuaaucgauaauagauuucuuuuucuuuucuuuuuuucuuuuucuuuuucuuuuuuuuuuugagaagucuugcucugucgcccaggcuggagugcaguggcaugaucuuggcucacugcaggcucugccucccagguucacgccauucuccugccucagccucccaaguaacugggacuauaggcgcccgccaccaugcccagcuauuuuuuguguuuuaguagagaugggguuucacuguguuagccaggauggucucgaucuccuguccucaagauccgcccgccucagccucccagagugcugggauuacaggccugagccaccgugccuggccgauaguagauuucuuuuauugauuagagagacuaaucagcaacaauguuuuaaaauucucacauagaucucugaaugggaaagcagucuugaauuaugcuugcagggagagagaggggaaggaaggaggaggaaugguauaauuagacuucauaaggcuagauuuuguuucuacuuaaauaaugguaucacagugggacauauuauccaugcagaaagugagugggcaucuggucuauuaucuguggucuuucaggaauggcagcucuuuaguuuaaaaaacaacaaagugcagcacuguuuauuuaauggaaauagaaaagcagugccuguguauuaguggcucagauuuuuuuguucuuuguuuucagcugucugcuguaugccucuccagcggggucuuacagaaucucaagucuaccaugaucaaagcugaacccauuagcuccauuucuuaauuccuccuguauccucuguuaccauuaguaacuauucuccaacucaaagcaucagauuccuccucuuacucacucccuucauccccagucaccaguucugugcuguuauuuuauccaaguucucaguaggcuucacgagcaccgccuucacaucccaacugucgcuccuccaccuaucuguccuccaugcuucugcuagcucauguuuguugcaauacaacuaaccuugccacucuucugcuucaggcuuuucuacuaggcucugcaucuagaugaugguccagacuccucagccugugaaacaaagcccuucauaaaagagcagagcuacagcuagucagcucccuuccugcaguccacccccuccuccaccauacugagaauuggcaauuccuguagcacucuuuguaugaguccauuuucacacugcuauaaagauauaaccaagacuggguaguuuauaaaggaaagagguuuaauugacucacaguucugcauggcugaggaggccucaggaaacuuacaaucauggcagaaggggaagcaaacacauccuucuucauaaggcggcaggaaagagaagagcgaggagcagagugggaacagccccuuauaaaacugucagaucuccugagaacucccucacugucacgagaacagcauggggaaaccacucccaugauccaauuccgucccaccaggucuuucucuagacacauggggauuaugaggauuacaauucaagaugagauuugagugaggacacagccaaaccauaucacucuucaucugcuacgggugccauucccuguuucuacaguguccuguuugcuaccuucuuuguagauuucuauucauucaucaugucccaguuuaccuguuaccucuucaacagauuauucuucagucugucccucccaaacuccaccaaugaacauucuuuguucagcccauuauuguuaauaugcacuucacugaaaacacuguuuuaugcuuguuuacaucccaucucugcagggcucugagccuauagucagcaguugggaacuuacuaggcauagcgcccaguaaaggauagcucuuuauauauauauauauauuuuuuuuuuuucuaaaauaauaagccccaagaaaaacauuaccugugaaaaacaaaugauauuuuuauaccauuuucaaaaccuaauagcaauaaaaagaaaagaaaugucauaaguauacauuuaagcuguaguuaaaaacaguaaauaggcacaguauuuaacucuuaucaugugcuguuccaaguguguuauuuacaucauuggcuguucacaccauccccugaggugguuaauauuuccaucccauguuaaagaugaggaaaccaagucacagcagccuaagugacauguucauagucacauuggagcuggcagguggcagcacugagaaugaaacccacguggcugagcucuggaaagucaccauuaaucaccacacuagaccuucucucuaggaucuacauaacuagaacauacaauuaacuggaguauauguaaguguagucguuccuugagaaaggaaaagaauucacaaauuucauagccucaucccuugugcauuuguggcauugugcuaggggugucuauuugauauuugacccuacagauuucucagaugccaaccaaccacagauacuuuaaaaaaagauacuuaauacuuaccaaugcaagaaagugggcuuguuggaagaggaaaaauguuagcucacuaauggaaaaucaacuaaaagucuuaccucuccagaacaugcuuuuccuaaauguuguggcuaacccaagaagcuacaucaucuuuaccuuuaugauacaauuuaaaguacuuuucuacuuacuucaagcccucagagcacagaggcaagggaggccuugggcuauaaacccuguagccugagccacauggcuucuucuccuggacagauaccuggcauauucugccacugaggaucaguggugcagauguaucuguuuucuccuaggaauggggcuccacuuacgaaucuggggcaggacaagguauugcugcauuuuggggagcgugcuggaaggaggagcagaguuuguuguuuuugcuuccugauauggacuggcugugucuccauucaaauaucaacuucaauuauaucucccagaauucccacauguuguggagggacccaggggagguaauugauucaugggggcugaucuucucuguacuauucuugcgauaaugaauaagucucacaagaucucauggguuuaucagggguuucugcuuuugcuucuuccucauuuuucucuugccuuuuccucauuuuucucuugccgccaccauguaagaaaugccuuucaccucccgccaugauucugaggccuccccagccauguggaacuguaagucccauuaaaccucuuuuucuccccaaucuuggguaugucuuuaucagcagcaugaaaacagacugauacacuuccuuaacagaaccaauuauuuuuucccaaaaaagagggggagaagcccagaagcaugcagcuucucucuucuuucuaaggaauaggucuucacaaagugcccccaaaagaaaaggaccaggcuuuucucuuacuuugugacuuuccuagguugcuuuguagccauuuuggacacagaccaccuauagcuguguaguaguucucauguguauggacacaguggaaggagaugccaggcacauaguucuugcugcauugacaccuuuucagggcaucuucuuuuaccaucuucuguagaaacugcaacagcccggccaacuaccagccccagcccaccccuagcuuugcugcuuucauuuucucuguaacacuugucaccuuguaaugugcuaguguaacaucguuguuuuaguuuucuuauaucuuuccuucccuguagaauguaaauaccaggaaggcagggaauuuugucugcuuuauucucugcagcaucccuagacuccagagcagacccuggaacucaaauauuuguuagacagccaaaggucauauacuuccaacucuccacccaaaauauauauggaucacccauccuuaguagcagcuaaaccuuuggacaugaggaauuugcucguucacaguuuucuggccuagcaucugauuaaccaaacuuuuucacauaucaagaauuuaaaaugacuccaaaacuuuuuaugaccuuaggugcuucuccuuaauucuaguugguucauaaagcugucagaacaauaaucugcuuuugauaauauaugacuuuucuugccuccaagauagccuuuaaaaaagcaauuuagccuuuuacuguaauuauauuccaaauuuaagucuugccagaauaucauuuucccccuuuaaacauacuuuuuaugaugccaagauauuuuaaagaaaaguucagauaggaagcauauuuaagaugucaguauaugucucuaaaaucuaagaacauuuuucuacagaguccagaugauaccaucucacccacaaaauuaacauaaauuuuuaguaccauuggauaccauguccauauucagauucucccugaguuccagaaagguccuucacagguuaugcauuucacauccuauccggcaccagggccagcaucuuacauccuuaauucuuaggauucagaauagcacuuuuuauauccugacacugacuugcugaagaagcuguaccaguuuuccuauaaacuguccacuccuuggauuugucuuauaucaugucccagggguauuguuuagauuguugcucuauugcuaggauauucauguuacccuaaguguguacugagauagcagaguaaagagagauugucuuuuaaagguucugcccaggaacugcugguuuacacaaaagcugggcuuuagugcuucucggaucucuuugcuuguuucaguaauuuuuuuuuagaaauucacuaauucacuaacguaaguggggcaggguuuacaggagcauguguugagagaaguugguuugacuuuaaauggucauuuuuacaauccguauuuaggccuuacaggucgcauacaaucucugucacauauugcugucauuuuuacccccuuucuuuucuuuuuauaauccuuuaaaaaaugcaaagcccacccuuagcucacaggauguacaagaacaaguugcggguugcaguuugccaagaccugcucugugccacugcugacuugccauucuuggagcccacuuucuguucuugucagccaauucccuuucaggugcucagguuucccucccuccugucaccgggccuuugcacaugcucuacccacccugccuaguggagagcuaucuuuggccccuggacuucauucacuucggaccuucuuugggucacauuucagucaugccucacuagacaccuggaaucucugccucacuagacacacuagcacucacucuuuugggucuucuggcuguauguaauuguuaucagggcaguaauuuugcauuuauacaggugcugaggucagugucuggccuuuggcuacuugccuugugagccaccuuugcuuuccaguguaccccuagcuccuggcccaguguccagcuucccagcauccauucauguuuucccuggagaccauucugugcccagcagccagagacaucauugcaacuuaaaucucauugagucguuccaguugcuguaagaaauguaaccguacuggguaacacuaugccugucugucuccaccaccagaucuuauacuuccucccucaucugcuacucccuaagcucacuggcccuuuguuguuuuugcugaacgugcuaaucucuuccucacaccugggccuuugcacuugcucuuaccccugccucagccauccaugcacucucuugguuuugccgugcccgacuucagcauuuuuaguucacauggcucuuccguggggcccuucccugaccacccuguuugaaaugcuacccaucccuggcacacaucuaucauagucauucauuagcaauuagccccaucuccuuucccuauaguacuuuuccauaauuuuuuuucuugcucauauuacaccuccccaacuaauagauagauuccaagaaauugagugcuuuaucuucacuaccuggaauaguacuggcacuugguaaagcacagcgaauauuguugauugaauuacuagggguuggcuuagagagguacuuaauggaaugauucaauggaugaaugaaugaaugcauugccacuuuuuugcucauuaucaucaauuuguacauaugccuuucaacucaaauauuuauccauuggcuaaagaaaaaaaauaccugaauccccgugucucugcaguuuacccuuccucacuguuaaaacucagugccuguguaaaauuucauuauauuuuauuuacuucuuauuccacuugugcauuauguggauauuccugccucauccccacagccaccuaucacuuccggccaacucagaugccucuggucgcaacaaucacuucucuguugaauuucugaagcguuuaaucugcaguaugucuguuacucauacagcaguuagugugaauugucucacucagaauaaguauucauuaaauguguaagaaugaugauauagccuaauuucagaucaagauugugauuuauagcucauucuuaaucagcugugucaugacuuuauuuauuuauuccuuuuuuuuuuuuuuuugagacagagucucacucugucacccaggcuggagugcaaugcagcuucugccuccugaguucaagugauucucaugccucagccucccaaguagcugggauuacaggcgugcacccccacguccagcuaauuuuuuguauuuuuaguagagacggaauuucacuauguuggccaggcuggucucgaacuccuggccccaagugaucugccugccucggccccgcaacgugcugggauuacaggcaugagccaccuccucaggccugagucaugaauuuuugguaguccagucaugugguuaucuuccuaaagcuggaggccuuaaaccuagggccccaggugggcuuaugccuuuagcugcaaguaacaagaaacccuuuucaaccuuuuuacugauuuauuuagagagaaguacacauaagagguaaugcaaguaagcaaaguuuuuuaagaccacacaacuagauagccagcauccggaccagaacacagagacuugcuggccccuagaauccucucuccuggccccugccaguuacuggccuuuccccugaguucuauuugccugcaguuugcuuguuuucauauuuaauucaaauagaauuaggugauguguccccuuguguuucgcuucuaacagugccuuuaugcgggagaaguacuggcuauuucuuacuuugcccucccuccccggaaacauuuuccuaauuuaguagcaguaauuucaaaaacugcuuuccuuucggacaaacugacuuauccagccauuguaccuuccaguuuagacucuggcaguuuggagaguugagacagagagaaggagaaccgucuguuuaucuucuugaaaaaaacuacuguauuuucucucucuucugacucugggagccucuagacucuuuuuucccauuuucauauccacagaggaagagucugaaccucuuccugcugagcuuuccccugguugguugcauuucaggaacugacauugguugucuucccucuucccucaucagugcaaguagguuggaucucaugauaguccauauucacauaaccaugagaaucagagcuuucucucugucauuuccucccuguuuaucuguagcaagaagaaaaaaguccgucuuaacagagacugugaaagaauaaauauagacuuuauuguuuuagagcaguuuuagguucacagcaaaauuaggcagaagguacugagauucucccauauacucccuguucauacacuugcacagccucucccauuaucagcgucccccuuagagcgauuuguuacaaucagugaaccuacacugacaccauuauuaucacccaaaguccauaguuuacauuagcauucucucagcauuguuuauucugugaguuuggaaaacugucuaaugacauguacccaccauuguagugucauacugaguacuuuuacuaucccccaaauccucuguguuccuccuguucgacccucucuugccuuuaaccuuuccaagccacugaucuguuacugucuauaauuuugccauuucuagaaugucauauggcuuucuuagaaaauacaaauggugacuuuuuuggcaugacuuuaauaaacagaaaugaaaauuggugugugaaucaaaaucuuucacucuguaaagggacuuaucaggcggcaccugcauguggaauuauaucaaggucagcuuuaguuagaaacagaaggagagucaccuuugugaugucauuucuccuucauccaaguaaaaucucgcaugcugacacauaaaauuuuaucaucagugauuuauuuccucguaggaaugucccuuugaccuuauuaaauucagauacucuggggauggucagcauuuucagaugguucccuuguucuguaaaaauguuuguuauugguguuuaaaagcuguaaaagccacccacuauaaauugauagccacuaaagucugcgaaugugguaugaauguuccacuauguugccaagcguuuauuuuauugugaguuguuauuugauuguuuguaaggaaauuguuuuaugaugcucagcuuuauauuuccauaaacuguuccucccuugcaacuccuuaaacugugaugagcuuuucaaaacaaguccacaggacaacagucuguccagcauuugaagaagugguggaaaagucauuuuuuuccuuucaguguuucuagcuguucaugaaaacugcaguuaaaaguuguaauguuguuguguuuggcauucuuugggaagaugcagcauuauucaaacaaaaccgugugcucuuguuuuaaauaguguccaaaugaauaauugaauucauggacaucuaaauuuaauuccagaaaucaaagcuaugguaauaagaacuuggaccugaguucucuuaggccaaguaauuuaauuccuuagccgguugaacuauuuauuacgugucuccguuccugguuauuaugccaguaaauugcucaggcagaugcagggauggaugaugggcauauaauucacucuuuuucacggcuagacacauaccagaaugcagaucacacuaaacagcuguuuuuacaaacaugguuucuauucagagcuuuaagggccacauccaaguaauaacaaagaagccuggagaaggaaccuggggauacccagggucauguuuucaccaucccaccuggaaacacggugcuguccaaacccuggaugguacacuuggacaucgucauuccagucaugguucaagaucacguguauacaucaugauuuaaagagaauacugguuugauuuuucuuccugacuuucccugaauuuuccacuuaaauuggaaaacagcgcuaguuagugcccaugauuugauugaauaaguaagagaucucaaacacgguaaauuaacugaugacaugcaucaggucaucuuucuuugauucaccaguaauacaacagugagauccuacagaaaaaugcaaaggcagaagcucagggcagcugagcaacuguuaaggauucuuuugaaauguagccccacguaguaaacuuucgugcaauaauuugggcagucaaaaaaaaaagucaguuauuucaccucauuuauuucuacgaggagauaaaggcuuccaacaucugauuuucagugccaguguuuucuguuucucuuuucaccuauuucguccuagucuuguggaaauguuacaauaacugauuaggauuuucucuguauuaacacuucauuuauuaacauaugaguaaguugcuauuaauaaauuauucugcuuaaucaguuucuuuuuauucuuuagccacaugcuaaacuucuucggaugucuucacuuaauauccuuacaucauauuuaaucagaguuagaaaggcguuccacuugggggucauacacauuuuuuugaaacuuuuauaaacgcccuuuauacuauucuuguauccuacguaaucagagucagguguuccauggggaucauacacaucuuuauacaacuuguguaacacaugcuuuaaauccugagguaaucagagaauuccugccauugauggauuaaucucuuuacauaucuuucccuuucacucucagcaaaacuacuuauggcgguccuguuagacuuugaaagccuuucagguuuauggaggagucuuccuuucuauugucguagaucauggaaucauaguguucgcuugucucacguguuuggaaucugauuuccuacauaaugcugugcucucacuacgaguccaaggcuuccuguggcuacaaaucccggguuccuaucacuuuucccaaugaugagcuucuccuuguuggccagaaucagcucugugguaauaauucccuucugcuuucucccucucgcuuuuuuuuuuccuucuggguacauuauaaugucagcauagcagcuuuuaauucuauuacuaugguacuucucgaauagaccugugguaguugccccagaaagguugaaacccccugccacaucuaggucuuucuccuguauugguuuugugaucugaucaaggacaucuauuccucuaguccugcuaggugguauacgauaggcuuuuacuauuagauauucaaaugcugucaaccaugccugccuugacagguacaugauuuccacaaggauuuccuaauaggccuuuuuaauuuuguucuagacaugcccuucuuuugccauccaaauuugcuuauuuuuuacaaacuaugaugcaucagcauguaaauguuuaauaccauaaauauuucugauccucuucccaauuucacugaguuacugguuaucucuugccauuauucucagcauauugcaguggaucucagaauauuuuccccugaccaccagcaucaguauuaccugggaauuugaaaugcacauucucaggccccaccaaggccucaugauucagaaacucuggagcugcauuagaaacugccacaggcaccuggugaucuguguugguuuuuguuuguuuuuaaggagacagugucuuugucucccuggcuggaaugcagugaugcagucauagcucacagcagccucgaacuccugggcucaagcaauccucccgccccagccuucugaguagcuggaacuacaggugcacaccaccaugccuggcugguuuuuguuuguuuuuaaggaggcagugucuuugucucccuagcuggaaugcagugaugcagucauagcucacagcagccucgaacuccugggcucaagcaauccucccgccccagccuucugaguagcuggaacuacaggugcacaccaccaugccuggcuuuuuuuuuuuuuuuuuuuuaauuuuuuuggagacagggucucaccguguggcccaggcuggucucaaacuccuggccucuagguuuuuucccaccucagccuuccacagugcugggauuacaggcaugagccaccacauuuagcagguaggugaucuguguuucaauaagccuuccaggugauucugaugcucacugaaauuugagaaccacugaaauauuugguuuucuacaaaacauaagcaguuaguaaccauaggguacgcaacuaaauaguuccagcaggcaucccugaccacagggcauugcagauuuacuuaagucaguuucaucuuccaccugugugaguuccagcaggcaucccugaccacagggcauugcagguuuacuuaagucaguuucaucuuccaccugugugaguuccagcaggcaucccugaccacagggcauugcagguuuacuuaagucaguuucaucuuccaccugugugaguuccagcaggcaucccugaccacagggcauugcagguuuacuuaagucagcuucaucuuccaccuguguguccaguuuaagcucucaguugcaguuuuuaaaccaauuuccaccagcauauacugaguauccgcuaccgugcaaugcguugcggcucuuguaugugcacuaugagaaguaauucccauaauacggcaaacucaguuuugauauccaccaccccacuuuuuauaauggacuacauuuuucagagcaguuuuagguuuacaaagaauucaagcagaaacuacaaaaaguucccucuaccucucacuuccccacuccccaacaguuuccccuggauuaacauuuugccuuaguaugguacguuugaaccaauaucgauacacuauuauuaaccaguauuccuguuuuaacaugagaggcgacuuuuuguguaguauagucucuugguuuugacaaaugcuuaaugcuguguaucuauuauuacuuaugacaguaucgugcagaguaguuucuaaaaauccucucuacuccaccuauucaucccuuccccacucccccugaaccacuggcaaccgcugaucuuuuuauugucuccguaauuuucccuuuuccagaauguccugugguuagacucauggcauccccuuuuagcaacugcagaaacuaagaacuguccccaaggauaaaaauuuuugcagacccacugagcugggauuuauacuuagaccugcugaauugaaguuuuggguguguuucuucucaaauugccaaaauuccauauggacgacuuuucuuuuccuucccugaaauguguuuaauugacuuuuucuguuauuuguguuugccuucacagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgagguaauccaccauuugcuuggauuccccccacccccaaggaaaagaaagcguaauaccagaguuggaaauauccacccuagcaccacugccuuccccaaucaaaaacauguuuuuuuuuccaaaaggcuucuuaugcuugugaaauuuuuuugguuuaacaagcaaacaauuucaaauaaugugaaaucuuuauuauacaguuuguuuuguaccuuguauaugcugcuuggcaaaucccaaguuaauucuacaagacuccgcccaaccagguagucaucuaauuugacaaacacugaguuaggugacuccuugguauuccuuuggcagugaguguuuguuauauaauauugucuguuaccaccuagacgaugagcuccuugaggguaaggacuugauuuuauucaguauugcacagagugccuggcuuguaguuucgauaaaucuuaguugagugaguaguugugauuagauuucauuaaagaaggagauuugggccaggcacagugccucacaccuguaaucccagcacuuugggaggccgaggcaggcggaucaccugaggccaggaguucaagaccagucuggccaacauggugaaaacccaucucuacuaaaaauacaaaaaugagccaggcgugguggcacgcaccuguaaucccagcuauuugggaggcugagacaggagaauugcuugaacccaggaggcggagguugcagugagcugagaucacaccauugcacuccagccugggugacagagcaagauugucucaaaaaaaaaaaaaaaaaaaaagauuuggugaguaucgcauuauuuuaugcuaugaauuuuaacagaggugauuuauguugaguuuacauuguuuuauugggaaguacggcagugcuuucuucaagaaguaaauauaguauuaaugucuuagacuuucucuauugaauuaauguuuguguugcaaauauugugaacuaaaagaacuaaaggucauacuugucuccaugaaauaaaaacaaacauucaguugauauuaaaugaccaaauguuacagaaacgaguaaacuguuggauugaguuccuuaaagaguaugcauuuguuccuuaaagaguucugcauuucauaucugccaucugcuuggcagauaguaaaagaugcuucuagagcuagauugaaugaauauguacuugacugaauuuuaauguacugcaaauacuuauaaaggucaaccacaaauguuacagcauuuacaaaaaguggcuuucucucacuuuuugcuaaaguuuaaugauuucagauuuauuguucuauuagagcuuaacaugggcuauuuugucucccucaacuauauucauaguugucacuauaguauuuucuucccuuuguugcauuuuuuaccuuauuaagguguaauuuacauauaaguuucauuugcuuuuaaguauauaauucagcggcuuuaagaaauuugccaagcugugcaacuaucaccauaaucuaaucuuagaacauuuucgucacuccaguaagaucacacauacucacucccaguuaagcccucuacucaccucuagccccaagcaacaacuaaucuacuuucugucucuauagauuugcccuuuuuuggacuguuauuauaagugggaucauauaauacauggucuuuuguguccgacuucuuucacuuaacacaguauuuuugagguucuacauuucuuuaacuugagcuuuuaaaauugagauuauucugaauuaaacacucagcguuagcuuaaaauuuauugaaaguuuuacauguucuuugaaaaaaaagaacagagugcaagauggauuaaguuuaucauucccuacuuaaugacaguuucuuacucacuuuagcacauaaguaaaugugcuaguaaaugcgcauuuuguuuaaaccaccauuuuucaaauacugagacaugcuuucucaggguguuuuucauacaacuguuaggaccaacuauggcagaucuggucaaaugaacuuguuagccugaugccuguagcagggaaggacagcuuuucagggcuucucuucucgaaaccuaaaugaagugugaauacaaauuacagcagcuagcagccugcagugggacugaaaguccuuggugaaucuccaucaagcugggcuguuuaauagaaccaguuuagugucccauuuuacuugaaacauuagauuuugagcaccugcuugguacaagccauuuugcuaggccauguggaauggaugaugagcacacacagaccagcuaacccuaguggauguuaaaaucucuuaggaaauagaagucaaagaaguacaaagccaucuguguuguaagaaaugugaacacagaaccugccuccgagaguaagagggaacuucuggauugaucagagaagguuccauggagagcaugacauuugaacuagagccaaaaguguggguggguggugugucuaccaguggauuuugcuguagagucaucaggacuagcaaaacaaauguggugccauggaaaggcauauuuaggagacaggauugguccaauuuaagcuagagcagaugucuuuuagguugggaccaaaauauagagaccuucaaugccaggcuggcaaagaugggcauuaacugcaggugauuaauuaacaaauauuaauucagaagcuacugugcgcugcagauuuuuccaggagacaauaaagagauuuuguuuugaugcuaguacuguugagguaacaggugaacaaggagugacaucaguuaugcaguacaaugagaggaugccacauaaacuuaggcccauauucuagaacaagacaauuugcuugagauaaauuggucucauuaucgucugcauuaguccaguucuuuuugcuugaguuuugcagguaguauuauuugauauuaagacggaacacagagauguuguauuguuuuauuuccuguagaaagacgaaggcaguuaaaagaauuucauaaacaaaacacuccaggcuaaaggcaaaaaagaaaugaaccuuaaaaaauaacaaguuaauaauuuuguuggcaagaagagcaacaaaagcaaccuucugaaagcaagauaccuggucauugagagauagcaacuguuaaugccccagaaauagaggaaucuuuaaugcagguccauucauuccaccucaaacuccugaacaaaagcucuaauugaggcaagucuuccugggaaagggggccuaacagaaacauguuauggucaguugugcccaugcgagauaauuuuuuugugcuuguagcuaauuccaguaaagaaguagauguuuuagaggguaacguuaaaggggucagcugcaaagaguccuuuuccuccuccucacuguuacaaaaggugacuugugguucuucccuaauugagagcaauggcaacgccauaggugauuacucauuuuguaaaacucuaauuacaaguagguugcuucuguguucaacauaaaaauuagaagugacuugcaaagaugagauacugcagggaggcuuacaaucuuguuuucaguguuaguguuucaguaccuggaacaaaaugugauuuacagccauccuuucuaagaaaauugucaucauuaccaacauauugcuacugauaccaguccuuaaugugcuucauaaaaaacucaauaauuucauaacccguuaaaaccggaaagaaauggagggaagaaaaauaagacacuuuuagcguagucauaaucuucucugccauauuguguuagaaucgaugauacccaaaugagaagaugucuguucucugucacugauuccaguagaauaaaauuauuguuuaaaaguaagcacauucgcugcacuccagccugggcaacagagugggacccugucucaaaaaaauaaaaauaaaagugagcacacgauugcaagaucuaucugguuuugggggcuuauugucaucuuugguuguuaaaaaaauacuuggauauuauugguuauuggucuaguggaauaagccauuaccgauuugaguacaacagugguguauuuagauacuugcuccuaauuuucuguucuucaagaagggauuguacuucagaaaccagagauaucaggguaguuuugauugagccauaaauucuaaauucugauugaaauggguauuguaauaaauggcauaaucuuuuauuuaaucuagccaauugugcccuguccagaggaacuggacauuucuuccuuauguuccauuuauucagcaacuauucguuguaccccugcugauggcuaggcucuuugcuacuguggaaggcaucguuggggcagagcagacagcauuuuaccuccugggagacuggcagauuuuugaagccuuuguugcagauauagauuuucacggucaccacucuugcccuuuaauguaauuuaaauuuuuuuuuuuuuuuuuuugacacgggauuuugcuauguuuccuaggcuggauucaaacuccugaguucaaaccucagccucccaaguagccgggaaaacaggccucuugugcuuuaaagcagugauucucugucuuuaaaccuuguaacuaugcugugugguggaaauuuuacuuccccguuuaaagccaagaucucuaaggccaagaauuuuuuuuuuuuuuuuuuuugagauacagucucgcucugucacccaggcuggaguguaguggugcgaucuuggcucacugcaagcucggccucccggguucacaccauucucccgcuucagccucccgaguagcugggacuacaggugccugccacgaugcccggcuaauuuuuuuguauuuuuaguagagucaggguuucaccauguuagccaggauggucucgauuuccugaccucaugaucugcccaccuuggcggcaccccccgccccccgccccccgccccccacaaagugcugggaauacaggccaccaugcguggccgaaaaaaauuuuuuuaauuggccugggcugggcgcaauggcucaugccuauaaucccagcaccuugggaggccgaggcaggcggauaacgaggucaggagauuaaggccauccuggcuaacacggugaaaccccaucuguacuaaagauacaaaaauuagccaggugugguggcaugcgccuguaauccuagcuacacaggaggcugaggcaggagaaucgcuugaaccuaggaggcggagguugcagugagcugagauugugccacugcacuccagccugggcaacagagcgaaacuucgucucaaaaaaagaauaaaauaaauuguccugggucacauaacugguuaagugaugaaaucagaauuuggaccuagauaggccaggauauuucugcuacacucaugucaaaauuacacuuuuuauuuucuuuauaaauacacacaaauucauuucaaccuguguucccuuguaaaugcauauaccuuugauauaggcauauauucaucuauuauuuuacacugugcauuucugaauuuuuagaauuuuuacuugaagugaucaggcuggcgcuguggcucacgccuguaaucccagcacuuugggaggcugaggugagcagaucaccugaggucaggaguuagagaccagccuggccaacauggugaaaccccgucuucacuaaaaauacaaaaaaauuagcuaggcaugguggcgcgugcccauaaucccagcuacucagguggccaaggcaggggaauugcuuggaccugggaugcggagguugcagugagcugagauugcgccacugcacuccagccuggcgacaagagcgagacuccgucucaaaaaaaaaaaauagaaaaaugaucggggguccacaaauaagaguaaugaucaagggucagcaaauuggggccaaaaauagccuguuuuccuguuuucuacacaaaaguuuuauuaggcacagcccaucccauuuguuuaaaaauugucuauggauguuuucauguuuuggaaguagaguugaggaucgcaaaagagauuguuuugccugcaaaacugaaaacauuuacuaucuggccuuuucaguaaaccauuugcuaaccccugauucucacuauaagacggugacugugaaguucuuucuauuucacauacugccauaucaaguugauuucuuuugagguaggguuuguuuuuuuuugguuagagauagacuaguauaguguuugagagaauuuuuaugaccuugggccaguuaaguaaccuguuuuuuauguguguaguguagaugguaauguuaucuugcauguuucuuguaagaaugacuuuagguaacuuauguuaaacgcuuaccaucaugcccaguaaguguucaauuuacaaacucaagcuguccagauucaaaucuuugccuuacaagcuacuaacuguguaaauuuguauaaaucaaauaaccuugaauccucauugcuucuuuuuguaaaauagggauuaauaagaccuauccaauauuuaacuauuuugugaggauuaaauuaauuaauuuauaggaaacacuuugcauaauuccugguauacaguaacugcucaauuaaccuuaguugcucucuuaguuaugguuauaucaucauuccgauccuccauugcauuugaaacauuagcaaacuaauguuuacuacuaaugaggaauguuaaagguaaaccaauaaguugacuuuuaauuauaaaaggcauaaauguaaccuauccauaucuauugguauaauaaagcugauauuuagagagaacauuauguuaugauuaaaagaaacauuucuugcuuaaauuuuuuuugugugaauauacacuguauauugaaauaucugcacuuaaauuuuaaauccagcugaaaauuggauaagauaguauuagaugccacugcauuucaagauagaguuuuauuucuugcagguauuuuaagccuugugggaguucuucuguuaagugaacagauagagacacugauacagauggcucuuucaccgucucaugugaugauaaaagcuaaaagguuugauccgaauauugcuuauauugggcuaagugauugaccuuggcagaauuaaauuauuuuucuucuucuggugacaauuaaucugggagaaguaccauuugauuuauugcuauacauuucaccaauauccacaaggcacuuguagguaccagacauggcauugguugcugggggcacagagauaggaacaaaguggcuugcucagguugcuucuagccauaucugcauuguccuugagagggaugagucucucaggccugccuaggaaggaauuuuggcagcauggagaagagaaagugcucagcccggaacaaaaguuuucaccuacuauguugcagagaaguuggcguaucaguaauuauaaaggaagaauagggauuuacugggugauagagcaccaaauagaaugaaugcaauacauacuugaaguaaaucagaguagcuuguauugaucucaaggggagaagaaacaaagcuuagcuuaauucucaugccucuguuguuacuuguuuguaauggacaugacacuuacaagguauccuauaauucacuaacgggauuuuuacuuaugauuaauauuuaacucuccacaaagcuugggguaaacugugaacuuaacuugcugugaacccgaacaugaacucacauacuucaguuggaggccucaguaguagcaugcuguacaaaaaugaaacuaaagcuccagggaguauuugggaacagggcaaaaggguaauggcuccuccuuauagagcaagccucaggccuuuaccuuuguguuuugaagauggagaggaugcacuucuacucucgcccggguuguagcaugcuugcuaaugaugucaagagaacuagugucagcacugaccauagaugugacagguaacagccuguuauuuugugccccaugucauggcagccauugauuccgagguguuugauacacacuuugauagaggcagagugaagcaggacauggacaagcaucuuuccguguaguuuaauggucucaaucuagaaagcccacucagauaauuagguugcuuaaaaugugaugagacuagggaauagagccauauagaagugugugugagagagaauucagugguuuaguauauucacaaagauacacauuugacaccagccugggcaacauagugagaaccuggcuuuaccaauuaaaaaaaaauagaauagcagaaguaaucagugaaaggcauuuuaauacaauuauaucuagauuuauuaaaaauaaaauuuuaguccaauuuaauuaaaggccagaaacuagauuuuuaaagaauauuagucuuucucauauuuuccccaaaucaguugcuuuaaaaaaaaaaaagugugcagaugccucaggcacaauaacuguacucaacucaagaauuugcaauuaagaaaaaaaaaaaucaaaccucaaagaagaaauccagcaacucagagguucagguucauuuaaacaugcauacauuuacaugggcacacuuuuuuuguuuuguuuuguuuuuaagauggaguuuuuguuugucgcccaggcuggagugcaauggcgcgaucucggcucacugcaaccucugccucccggguucaagugagucuccucucucagccuccugaguagcugggauuacaggcgcacacaaccgcgccuggcuaacuguuguauuuuuaguagagacagguuuucaccauguuggccaggcuggucuugaacuccugaccucaggugauccaccugccuuggccuccuaaagugcuagcauuacaggugugagccacugcaccagcugggugcaccuuuuuguuuguuuguuuuguuuuguuuuguuuuguuuuguuuuguuuuguugacauggagucucagucacccaggcugggauucaguggcacgaucuuggcucacugcaaccuccgucucccagguucaagcaauucucaauucuccugccucagcuucccaaguagcugggacuacaggugugugcaaccacaccuggcuaauuuuuguauuuuugguagagauggguuucaccacguuggccagacuggucucgaacuucugaccucaggugauucacccaccuuggccucccaaagugcuggguuacugguuugagccaccacacccaaccgggcacacguuuuuagccaagccauaggucugauuaaguacagucagauuccuugagcagguuacaaagcuguggauuugaauggagaucuuuaguucccuugcagaacaaugaguuuccaaaagcagaguggcuuacagccuaaccagcugcuucucucagccuuuaaccauuuugcccuccugaaaauucaucuuugguuuccaaccaccucuuccaauaugccugacuuuuugugauucuguuaguagaagaguaaaaagucaaggggaggcaagaaugaaugaaucucauauaaaaaugaugcucaagagaaucccuuaauuuucaagacagcagcccaaauuguaaacauugagacuuuuacaguguuaaaaaaaaaaaaguguuuacaggccaggcaugguaucucacaccuguuaucccagcacuuugggaagcugaggcaggaugaucgccugaccccaggaguuugcaagcagccugggccccauagggagaccaaaaaaaaaaauuguuguuuuggcuguagugucacaggcuuauagucccagcuacucaggaggcugaggugggagggucgcuggagcccaggugaggucaagccugcagugagccgugaucacaccaccacacuccagccuuggugacagugagacccuguccaaaaaaaaaaaagauuaaggcagaggaaauguuaaagguuacgcuauauuuaguugauaauaaugguaagacuguucagguguuuuaacuaugagaguaggguugccucuuucuuaaauuuauauauguucuuauuggguauaauuucuagacagaauaugcaaguaucacagaauauggauggcaauuuuauguugcuugcacgugacuuuagguucuuauguuucaugauaggagcaaagaaaagucuugcuugccaauucuuaugauugcaucuguucuggaaauuuacuagcauuuguuacccaggauuucugaagugcuggugacugcugcccaguagucuuggugggcaaaguuacuaaaaugcaucacgaauccuucugguguuugcuugggcuauggcaggguuucuggaccuuaguacuauugauguuuugggccagauaauuguugcggaugauuguccugugcauuguaggauguuuagcugcaucacuagccucuacucgaugccagcagcacccccaagugaugacaaucaaaaauguccccugggaggaguaggggauagacucucucugguugcaaaacacugggcuaugguguugagaucugcagugaugagcagcuuuagauaugugaacagaagcccaggcgugguggcucacacuuguaaccccagcacuuugggaggcugaggugggcggauuacuugagaucaggaguuugaggccaaccuggccaacauggugaaaccccgucucuacuaaaaauauaaaaauuagccgggcaugaugaugggugccuauaaucccagcuacuugggaggcugaggcaaagaaaucacuugaaccugggagguugagguugcagugagcugagaucgugccauugcacuccagucucggcagacagacugagaugccgucucaaaaauaaauaaauaaaaauaaaaaagugaacagagaaauacccgugcaauacugugucucaucccccaaagacggagucuugcugucgcccaggcuggagugcagugacacgaucucaguucacugcaaucucugccuccaugguucaagcgauucaccugccucugucuccgaguaccugggauuacaggugugccucaccaagaccagcuaaguuuuguguguuuuuuuuguuuuguuguuuuuugcuuuuuuuuuuuuuuuuuuuuuugagacgaagucucacucugucacccaggcuggaaggcaguggcacagucuuggcucacugcaaccucugcugcccagguucaagcgauucucuugccucagccucccaaguagcugggauuacaggcaccugccacugcgcccggcuaauauauuuuuuuuuuuuguaguuuuaguagagacaggguuucaccauguuagccaggcugaucuugaacugcugaccucaagugauccauccaucucggccucccaaagugcuggguuuacaggcaugagccaccaagcccggcuggucucauuuuaauguaagcucuaacuucuguaucacugcuuugcacauuguagauaaccagugaacauuuuuuauuguauaagaaaaaguaaaauaaacaaaaauaugccaaagcaaauaugauaaauacacauuuaguaagguaaaagcaaguauuugauaaaauguguaauguagucuaguagcuuuauuuagaaacagaaaacaacauaaaauguugacuugaaacauugcguaugcauauuugccauguagacagugagauauggagguaaacugcuuuccuaguuuuguuuuguuuuuuuuuuuuuuuguucaaaaggaauucacucuccccuuguccacuguuauaaaauagcaaauggugauuagcaucugugcuguaaccagagacacugcuguucccagcuggaaucuguagguuguuugccugcuagagauugugacaagaagccaguuaacauggagagguguacaugucagucuuccccagaaaaggacaugaaacaguaggaccauccuuccaacccaugaccuacaucuagaggcauucuuuuuuucuuuuuuuuuuuuuaaaccggaacagaaauaucaucuaauucuuucuuuacagagaagugguauaaggaaguacauucuggccaggcacgauggcucaugcuguaaucccagcacuuugggaggccgaggugggugcaucaccugaggucaggaguuugagaccagccuggccaacauggugaaaccccucgcuacuaaaaauacaaaaauuagccgggcgugguggcacacaccuguggucccagcuacucgggaggcugaagcaggagaaucgcuugaacccgggagacggagguugcaguaagccgaguucacuccauuguacucuagccugggugacagagcgagauucgucucaaaaaaaaaaaaagaaaagaaaagaaaaaggaaguauauucuaagcccuugaauugaucuuggcuuucuucauuauuuuuacaaguaaaaauaaaaacuuugauauuucugauguucugggauauuauaggaaugauaccacuugaauucagcuuucuaagaagucugguauuucaauagucuuaauaugaguaagaaaauuaugaucuugguacuggaucuaaggcagagguaucgaagcuguuuuaauguugcuugagauaggacagaacuucagaguaaaauaaauguguauagacaaucuguucaaucuguucaaauuaaguuguugagcuguauauuugaaucuuaagacuacuaauuuuguuguaucugucuuuucccaaauauauguguacuucuuuuaauaagccaaaaccuaugcaacuuuuacuaauucuucccuaacuacuucuuuuggaaaaugauuaaaucuuaugucucacguuuugacauaucuauugcauuuaaaagauaagguugaucaugcugcuucucaaacugagauauccauucgaguuauccaaggcccuuggaaaacaaucguuguugagucuguauggggggccugagucccaggugguguugacucugcugguccaugauccuauuuugaguaguagacucuaguagcgucuccugccuuccauauggugcagauuugcagcauugagacaggaaguaagaaacugaaaaggaaaaccauucuuaccuuugguguuauuguucuugguauauuacagauaccaacaaguaugaggcaauccugagacaucuaccuacugagcuuuucuuuccuuaaauucacaccucaagaccaaggaaaccgaaaaacucuuacagucucccuacauguguucacuugugccccuauuuccugucauuaacaugguaguguagccaacuccugcuagccuguaaaagcuaauuauuacaguauagaggaauuuuguaagccauagccauuaguagcuugaaauaccaauggugggaguauuuauaccauggcaguuggcauacacuguaacucaagaguguucuauuuguuuguuuuucuagacagugccaguuucccagcauacuccugucucucauucaguaagacaaagcacuuccccuuauuuuccaauacaggacaugauaucccgaguuuugagcuucuuguuaauagccuguugcacgcuaaccacgcagcucagugaagagcaaguuuauucccauaacaaacaggaaacaaagguugaggaaaaaccacagugguacccuuuugugaguguucccuaacaccgucacgggaguccugauuagucuaaauacuuuacaaguaaaucuccuucagguggcauuuuauaaacaaucuuucaucauggagagaugagaauugggucagguauaauuagaaugacagauguauuggcuagccugagagaauuaacgcaauucaguaaaaaggcuagccaacugcggauaucuucuaguuacuuccgugacaaauuagcaccauccucuuguacugaagcagugcuuucauuagcaugcacagcuguuugcaucaucuuuguuuguauuucaauccauauuuggagcuuaagugagauuugucauaagacuucaguucaagcuugcuugccuaauuuuacaugcuucuauuuaguaaaauaugauuacuaggucauaaauauuugauaauuuauugccuuauuagaguaauuuucuaaacauguuuuuugacgacugcuugccacuacguacaagcacuugaaaaauguucuuuucuauuaaaaguacaugguuccagaauugggaaaaucacguucuuaaaaaauaaccaguuuucuauuguguuggcuuuuaaaauuuuuucaucaguagaaucaaaugcaaauauugucugcuuauuuuucaacagaauacaaguuugauuuuaauaacuuaggcucaugaaaugucaccacguaguaauacuuagaauuacagcaauaacuuaggcuaaaaaaauaaaguuguuaugaacuacauugagcucagacagauauauguauuauguaaacauuuauauaaaauguauauaaauuguauauuguauuauauaauuauauauuguaauauauaguauauaauauauaauuuauaaauauaauacauaaauuauauuuauaaauuauaaaguuuuuauauaauauauuauaaucuaauauauuauaauuauauuuauaaauuauaacguuuauuugaaauauugaaguuuuguauacuuaguggauuuuaauauuuaugucguuuucauuuuauuccacuguuacauuaaggaaguaacuuauuacaaaaauaaauuauauuugucuuacauuugcccuuuuuacucuacuuaaaauuggagaaaaagaguucaagauagggaauuucugucagaaaggagaaauaguuguauuaugugaaguuuaaguagauauucuuguagaguauggagaaaauaaugcuauaaaauguugccuuuuaaaaaaaaguucagaaaauauaguuccuagcucucucuaaaugacuaguuugauugugacugcuuucccaaaauuuguaaauuuaaaauuuauacaucacauggaauauaguuuuauuucacauacauuccaguaggcugagaauacuugaaauucaaugauuaaaaaugaaauaauaauaaccagcuuugcuuuauucuaaaaccagcuuuauucuuuauuuaccacuuuauuuacagcgaauuauuugcuaaucuguuaacuuugcuucauaagaaggcauuauaauuaucguacauuugaaaguggagauuuucuccccauucugguugccaguuucacaacuguguucauucuaaauuuauuaaaauauguaaaaucagcuuucuaaccuugguuguccacaaagaauuucacuccaauuugaaauaucuauucagaacuaauuuuuugugguugagcauuauuuuuugaacaaugaauugcauaaucauuuuguauaauccagggagcucuggcuuagauucuguauuauuuuguguuauacugauuuuuagaaaauggaauguagcguugacacgagcacaaaucucagcaagggccuaccuuacaaagauaaaaugcguggaguuuuauuagaagcacaugauuuugcuuuguguuucguauacaccagcauuucaguguaguaaauggcauuuugucuugaagagugagcagaguuguuacaaaagaaggcauaaugcuuccuugccagcagaauucagauaagugaauaucagaaaagcuauuugugaucuugaaaguguaagaaauucaacaucaauaaaggauugugguuccuuagauagccauguaagucuuugccuauguuucuaacauuucucuuuaggaaauauucuugcuuuuauuuuucugaacaaauuuucuccauuauuaucucugauauuuacuuugaacagaaagguggauuggaaaucaaaaaauaaguuugauuucaaaaaugauuucaaaauguuaguuuucucaguauuuuacauuuugagaagagaacaaagaaggcagaugaagaguuuuuuguuuuuucuuaaauuuguuuucuuuucaacuuuauuuuuaauugacauaauaauuacauauaguauacauuuugaagauacgguuuuaauuuucacaggaaucuuauuuggguuuaguuauauaaggucuaauuuugcauccucuacauuuaguggcugauuuauaaauuuccacugagugauaauaguaauuaaugugaaacagguuuuuugcugauguuuuuagaaguuucaguagauuaggaaggaagaaauuaugcuauugagaaaaauagaaaauguaaacauaagcauuugaacucucucuugagauauuuuuaucuuccaugaaacuagaugcggcuuauugaagauguguuucaggucucagugcucuaaaacucuucuacuuggugagcaucuugauugguuagaucucuuacuaauaucccauugcuagagagggauguaaaggaaauuuucucaaacugagauuuccaaaucuuccaaucucugagucaaguaaagagacaagguuagaacucuuaggcaaacugaaaaaucaauauuccuauauuaucauuauuuuuuucuuuuuuugacaccaagucucacucugucgcccaggcuggagugcaguggcacuauuuuggcucacugcaauguacgcuucccagguucaagugauuccagugcuucggccucgcgaguaggugagauuauaugugcacgccaccaugcccagcuaauuuuuguauuuuuaguagagacaggguuucgccauguugacuacguuggucuugaacuccugaccucaggugaucugcccaccucggccucccaaagugcugggauuacaggcuugagccaccaugccuggcuuccuauauucauuuuuuuaugugggcuuuuuaaaaucuuuucaauagcaaagacuugacaccaacccaaauguccaucaaugauagacuggauuaagaaaauguggcacauauacaccaugaaauacuaugcagccauaaaaaaggaugaguucacguccuuuguagggacauggaugaagcuggaaaccaucauucucagcagacuaucacaaggacagaaaaccaaacucugcauguucucacucauagguggaaauugaacaaugagaacacuuggacacagggcggggaacaucacacaccagggccuguugggggggugggggguugggggagggaaagcaucaggagaaauaccuaauguaaaugacgaguuuaugggugcagcaaacaacauggcacauguauaccuauguaacaaaccugcacguugugcacauguacccuagaacuuaaaguauaauaaaaaagaaaaaaaauuaaaaaucuuuucuuugagacaauuguagauuuacaugcaguugaaagauuuaauagaggccgggcgcggugccucacgccuguaaucccagcacuuugggaggccaaggcaggcggaucaugaggucaggagaucgagaccauccuggcuaacacagagaaaccccgugucuacuaaaaaaucgaaaaaaauuagccgguguguggcgggugcuuguaaucccagcuacucaggaggcugaggcaggagaauggcgugaaccugggaggcggagcuuggcgaagccugcagugaguggagauagugccacugcauuccagccugggcaacagagcgagacucugucucaaaaaaaaaaaaaaaaaaaaaaaaagaauuaauacaaagagacccugcauagucuucacucaguacaguaucacaacuauuaaauugacauuaaucccuuaacacugcuuuaacccaagucuaugcugcugcuucuccguguucacuucugagaggcacuggccauuucuugugugcuuauucauacuuuguguaaaagcauuagcaucauacaucgcuggugcugacccuacccucagucccagcuucucccagaguaggcuaagauucucuuuucuacuacauggaaaauuguucuggaauaauaaaggguuagcaaaaaagucagagaaaacaaacaguugcauucccuuucccuguaguagaguaggaauauaauuaugagugauagaggauacguuccauuccuuucccaguccucuccgaagucagcuucacugcuguaggaaguugcuguucucauuauuucccugagggaaaguguugggaagugagaguugaggugauggggaaucaggguugcugacaauugggggaauuauaacgagaagcucuuuuucaccaggagagggguugcauguuaagagaaggccuaucugcucauccuccaugucagcagaugagaaccaguuggacaagguagcugucucuuagagauugagaaguaacaaaagcacacugucaguccuguucuuccagccucacguacaucuucuccauacauuauguauuugacauuaaauuaacauacacuguuacacccauuccugaccgcauuaucucagguagccuuuuguauuugaguauugugggaucuguugcuauugcccaugaugcccacuuggacuccaccaaggcagugaaacucuugggggccguucaaagucaagagugccaacugccccuaacaggauugggagaaccaaccaacacuccccgaauagggacuaacucacucuuuucuuggccuuuaugaaaggaaggaguuaaggcucuuacagcuggagacuccagcaagaguuguaggcucaacguguagcuuauacuauuuacuuaauuaacauguaaauggauuuugaguucugaaugcuuguucuaguugauuagggcucauuuagccuggcuucuacgaauuagcuauaacaaaugguuucauagcuguuauagaaugaggcagaagaaaauaaaaugaauguagcauuauguuuaauuagugguauaggaaaauguuaauauaaugccauuuagauucuggacuggggagauugugccuuuaucauaaguaagaaauuguugcuagguuucacauaagggcacauaguuaucaugaaucaucuccuucgaucaucauucuuuuaucccauuacuugacuugcacccauccaaaauucuaccacuuuuauuuaauauauagacucauaaagacaagguuugugcaucugcagagcugugauguucacugcgaggcccguggcacacaucuauaagaagacacauauuugguacucuaagaugauacuuuuuuuuaaugccaaaaugugagggucagcauaaauugccaaggcaugguaaauuuuguugccaaugcucccgugacuauggggugaagggauucugugccucccuugguagcaaugaccacggugcuugcaaucccagugccaauucccggcacagugcaggcucuggaggcacugcugccuugcagucuuauuggaauuaacacugccugaguaagagauuaauaauggguauuguugugucuuagaaacguuaaagagcaugugacaugaauauguacacauuggugaaggagauacagagaaggaaagcaaagugaagcuguagauguuuguuacaacugaagguaagcucugggagcagagaccacugcuggcuauaguugaugggauccacaaugucaauacaaauggggacuaacuauuguuuuacuucccuauacacguugcucuuucaguagaugcaauaaaguacugguaaaaccagagguggcuaccaucacgaugaugucaacaggagggacagucagcacuaagcccagaaggugucaaacacuccgcaggagaaaugcgccaugcaacggacaugaagaugaucugacacucuucacgugguuuucagauggaaacguggcuacgaaagcaucaaccucauuaucauccaucauuaaggccaucucacucaguacugcugcuuucaaaguccacgcucccaaagcaaauuggauuucuguacacaauacucuuacaggaugaaacccaaccaacuuguugacguaaguaucccaucuacuucgcaauuuuauuuaucuuccaaaauuaaaggacuggcacccugauuuauuaaaagugaauugggucuagggaccauauccccucugaguuacugacagagcagcuucuggccugugaagcucaaagccaugccuagaugugauggauccuugucuuugauuggcuaauuagaaucaaucuguugaaggaccaguggcaguggcucacgccuguaaucccagcacuuagagaggcugaggcagguguaucacuugaggccaggaguucaagaccagccuggccuaccuggugaaaccccaucucuacuaaaaauaccaaaaaauuagccaggcgugcugguacaaggguaaucccagcuacuugggaggcugaggcgcaagaaucacuugaacucaggagguagagguugcagugagccaagauugugccacugggcggcagugcaagacccugucucauaaaaagaaaaaaagaaucuguugaauauuccuaacuuggaaguaaugggugaugcguggcuuucaucuuuuagaaagguguuuuuuccucugucaguaaaacuaagaagacaucugugugugcuaaggcgucagucuagcaagggcagggcacaaacccagagagagaauugggcuguuguuucacuuccaauaaaaaugggauauacaugggagguagaguuauaauucuacucaggauugacuuuauacaugcaauuggaugggucacugauugacuuugaggcaaucagggaugagugaaacugaucuuggggaggguggcaagacauguugacagguaagauguguuuuaauguauaacagugcgugguguguauuaaucaguuggaguugauugacugcguuuuauuguuuggaacauuccugcccaagggucagguaaauauacaaaauauacaaauaauacagauuuuuaauacauaaauaucaauuaaguagcauaauuaaauaauacauuguuauaguuguacuuaauguguauguaaauauauacaaauaauacagauuuuuaauauauaaauaucaauuaaauagcagaauuaauaauacguuguuauagauguacuucaugcauauguaauuaaauuauuaauguauaauauauaaauacauauuuuaauauacaaauaaaauggucuuaaaucagaguuaauuuaagaccguuuauauuaguacauaucuuaauauacaaaugaauggucuuaaguuaaugucauugaguauaagucacauuuacagauaugacauguguuuccagauaaagucaauggacagacagcuuccaacacuggaaaacauucaaaauauaugcaauuaauuuuauauuugaguuaaggcaaucauuuauuaaggaaagcaaucagauguuugugagggcuuaaacuuucgcuucauaaccaaagcaguuuccuuacaugaaaguugacuucuuaaaaagagaaguuuauuuuuuaugauggaggauuguugugaugugcagauaccuuccgucauuucauacucaucuaaaagcagccaaaugaucuuuucaccuuuggccggaauccuuuuauugcuaccgaguccugcacucauuaaaccagaugacagugcaugcucugagagguguaaaucucuaguccugguggccaguuaaauuccucaguaaauguuugguagaugcugccuaauaaaccaguccagguugccacugggaggauuaaaagaaguaaacguguauacaugaacagagagacagugccuuuucaugcuaaaugugguuccccacaucuccucugauuagaggugugcucugaacaagccgagacggggccgugccgagcaaugaucucccgcugguacuuugaugugacugaagggaagugugccccauucuuuuacggcggauguggcggcaaccggaacaacuuugacacagaagaguacugcauggccguguguggcagcgccaguaaguggacccuucuucgagccuggccaccuuucgucucucucgccacugacucugcuuuuuguaacagauugauuuuccugguucuugggaaugggccuguugcuaccacuaaccacauuucuguccacuucucuaauugcucagagucuccgcaguauguucaaucaugagcacaccucuccgucuuucccugauaaagcauggccauggauguguucucuuccuagcuguagcacauaugucuugcaauccagagggacuuuugagugcuucucuuuuaaacaaagcuggaguggcuguuuugucuucugcagccagccguuucugcaaaugcauacuuauguguuuguccguguacauauguguucauguuuaugcaugugcacuaccugugcagauacugucuaccacuggaagccuggcugaugcagcuugaguugcauugauaagguguauggcugugaugaauaccuuuaaguugguucauaacaugucuuuuauugugcugaugagggaaugugauugaauugagcucaugcaucucaaaugccggaggguagaagugcccgucuugcccccuccgagcucagcacacagacauuugccaggucaaacuucugcuucuucucuugaaaguagaagaaaacuuuugacuuaacgugagaaacuuucaaugacauaaggcucgaggaacauaauuuuauuuuuuuuguuuuuuuaaagacagggucucauucugucucacaggcuggagugcaauggcgugaucuuggcucacugcaaccuccgccucccggguucaagugauucuccugccucagccuccccagcagcuaggaucacaggcacaugccacugcgcccggcuaauuuuuuguauuuuugguagagacaaggcuucaccauguugaccaggcuggucucgaacuccugaccucaagugauccaccugccuuggccauccaaagugcugggauuacaggcgugagccacugcaccccgccagaacauaauuuucaaagucuuucucuugaacauuaagcuuuucauaauuccgggggauaaaaauaugaagucaugaugacuuaagugcaugaugaaauuuuccccaaagagguaauucucaggagguccaguaccagaugugagacuuccaugucguuaacagacuuccaagugaaauucccaauugugcuuauuuauuuauuuauuuauuuauuuguuguuguuguucaugaguaggaaguaugaacuacucaagaaguaauuauucagcucagcuugauaacuaaaaaugaaacucaauaacuguguauuacuuuuuugagagacuccugccuaauucuccgcuguguugcaaggguggcagccacauuuccugccugagauuccuagggauuauauaaauuguuuugcagcaagaucuuaggauuaagcaaaacaacagaagggccugcaccauuaauacccccacuguaaaggagcccaggaucuaagaggaauguaauggaaaagcuccuguuggucuccugccaucgccagugaaugagaugacugcuucagucccaugugugaacagguguaggaacugauaaccucaagggcuuuuuuuuuuuuuuuuucuggcucugauuggaugauugcagcuucuggaucaaaggacucccuucuucaguuucaaacaaagcagucaauuaggucagguauugcgaacacaauggagaauucuguugccugcagccuuuggaacaaaggccuuuuguuacagugauucucacugguuuagccggugggagagguuuccuggcagauuugcaacuuuuuucucccuuucccuggguggauucauuuucugaaauaucauguauaguuuuugguaauaagagauuuauuugguuuuaauuauuagcagugaugaauuugcuucaagagauuaaaauucucuccaccucaccccaguacugccaucccuucaccuaacacucucucccuuugaucaguuugggcugggagugaccagugggcaccuguccagguguccuggguggcacacaguuugcugaggguuuugcaaaaggucgaugcucccaacagagauguauuagaugaggcuagcuaugccugauuuuagaggggaaaggugacagaauaauguaugaagaaggcaaaggcugaagaucaguuagauggguggacaagaauaaguagagaguauaagccucagcaaacagccagagccgagagccacaugcuguccuaugaaugagugaaauaaauggaguuuuugugaaaaaaugcaucgaagggaauuggggauauuuggcacaaaaggagcaagaaauccucuucuguuaagaaaccuguuguuacucggauauacuaucagagacaaaauauccagcauucucaaauguuaacuucuuacgaaaauagaucuuauguuuauauguucauuuugguuuuguuggagggaccaaaccuaagugagugauuuuguuuguuagguuguuuuuuugucaguggacucgugcauuucagccaucauucccauguuucucuuuuuguuuuuaguuauguucucuuauuuuuuccauagugucccaaaguuuacucaagacuacccaggaaccucuugcccgagauccuguuaaacguacguugucauucaccugagggaagggaagaggggaggaggaugcugcuugguucacauaacuccagcaucaucaccuucuuugcaugguuuuguguuucuugaacaccugucuuaguaaaauguuucuucccauuaccuugcuuguaauuacaucugauuuugccagacagcuugagauguugggcuaagagcaucauugacuaaguuucuucuauuucugaccaauuuccuuuuuauuuagucugguuuuauugaauauuauauggacaacaucauuguauuguauuugccauuacuauuuuauuuccuaaaagcuaucaguguaacugagagcaggcuuagccucucacugcuuuugcagaacugaagaacaagggcuaggugcaguggaaggaaagugacuuuacuuagcaaagcuagcaauggggaaaugguccaggcuccugccucaaagcaaccaucucaaauuuuggauuaaaaaacaaaggcuuaaaaaggggagcuuggaaugcagggcaugaaggaggggugaggaggugcugcuauacaggacuuguuccaaagacuugaguuauuauccaguucgguaagugggcuggcgcaucccgcacaaucggguuguaaauuaacugcagccuugaggugaucuccugaugagggagaauucugaaggugccuaagucagucaguggaacuucuaagcaagcauuaauaauuuuaauaauaauuauaagcguaauuagauaauggaagcgcugugcagggagugccuggugggaagaaagagagcaaagguuaccauuucauuacuaaaacuggaaggaaaagaaaggaagaaagaucuuuaaaauagaguacucgguuacaucaagaugccaugauuuaacaagagacuauaauacauaaguaacuuguuuccucagaaaaaguacuuaauauucaugguauuguaguacauggacuaauucguacacgcagauuucaauuuauguguguuauaagacccgguuucaacuuuagacaugaagggucacuuuuagacauuaggaaccccucuuucuccucucccagaaggcauaaugguagguuagaggugcucaccuuuugacuaggaaguagagaaagagccuccuauaaagaaaugcauuguccagccacugcaggccuuacuuacagugucuuauguuuuguuuuuauuucaguuguaauaucagacgaguuuaguuuuaaaaugugguuuuaguacucauauuugaauuuggauuccauccagaaauagauuuauccaguguuagguuagggaugauauaugccauuuaugcuuaugauugcuggaagaagaggcacaauuucaguuguaacuuagauauuuuauaauuagcauuuguguacauuauccugaaaaaaaaaaacccucaucucaaaacugaugaagccaguuaucuuuuuuaaagaugauaaauuauagaugaaggauuagguauuuuaaaaaagacugcauccuaaacuauaaaguuuuuuaauggccuccauaaaauauucagaauaauucacauuauguauaacuuuugaaggaugugguuuguacugcugcaacauaaacguuucuuuugcuguugugaaaaaagcauuuuucucuaaaaacacuguaaguacagcaaguggguugacagacuaggaaaaagcucuagcuauuccacuauaguguugacauagguacgcauguugaguugcauuguaccgagcauuuucacagaucauuuaauuuuucuucagaacacuuugugggcauuuuccucauuccuuuuguacauacgagaaaaaaugaggcuucaagagcuuagugacuugucccaagccaucgaacauggcaggaccaggcuuugaaacccaaaaugacguuuuggccgcacuccacaccaaauggcuaagcauugguucugacauuguuuugccgguuagugaaaucacauuugcgauucagaagcacauuuuaagaauacagaaaacagugaaaagaggaugaagaauguuaacauuuuuuccuaaaugccaugaauagagcacgcaucaguaaauuaaaugucuuucccauucuuuuauaaaacagugauuauuuuucucuuguuucauuuuagcauuuauaagaauucuauuuuuccauuuuuaauaacugauggaaacaagcaucauugucugauaaauuuauuuucaugcuguacacguaacuaccacuuucaucauccacuguuccaaacagauacugaaagucucuuuuguaauuuucuccuucccaguaauuuucuccaucuacuugcaguguauuugggauccugacaccuuuccauucuaggaggaugaagugcuuugggcagcuauauuuucuugucugccuacagagacuauucaaucacagcaagugaaggguuuugcagugcuaguacaaacagacaaggaaaaaaacauauaauuucuaguuauuuauagccugugcagcuauguggucuuauuuauagcaaacugcacauuugauuugaaaaagucauggucaucuggaggucaaauucagauggcagacucaauucagagaaaaggagcugaacuagaagguaagcaagccuguuagacugggcaacuuggacuugacuuugcuccuucaacaaucuagagccaguuggaugauauuucugcacaaaggugguugguuuuacagguugcucagucuaagcugcuucuagucaaauaacaaaugugaaaggagauagaaaaagcucuucaguugaacugauaaaagauuacacuuagggagaaaauguaugaugguuugcauuauaaaaacaauaauuugccauaaaucaggcauuucuagguuucaaacuuuugucauaaaaaccaauuuugagcauugcaauuuuagggacauauuuuauuguuguuauuuuaaauaaaaaucuaaaccacaaauauaaggcugagagcuuucauuuuauucgugaacauaggaauucaaaucauuaaaaaaaaacccuuucucauuugggauaaagaaucuuacgagagcugaguuaauuucugacauuaguuuugcaccugcccauuuggguuuaggacagugcaaaagguuucacauuuaaucuucaaaauauaguauuuguagacaauaaaauuauauaaauauuuguggauucauuuauauuuuaaauaugagagugugaccauuuuuuccuggugcugucuccaucagacugcaucccaaaaggcaaacagaccaacuccuuaauggcauuuaaucucucaaagagcaucaugccaauuuuuagucagcagauugcaccaugugaucuggccaaagugugucccaucucaggcuccuucauuugcgcugacaugugguacaaacaacuaaaccaagguuucucaaccucagcacuauuaacauuuugauucaaauaauuaauuuuuaggagucuguccuaggcauauggguguuuagcaguaccccugaccccuacccacuaaaugccauuaacacaacuccagcugugauaacuaaaaaugucucuagacauugcuaaaugugcccagggggucacauucugguugagaauccuguucuagaguaguaguuuccccacaucugacucagagauagaacucuccugguguaaacacguguacuuuccacaaauuugggggcauguugaaauguuagaaugucagcaucauccaauucucgacagauguuugaaauugaauuuguuagacuauuguccaagcucucaauauuugcaagguaaaguggaaguugcuguugcuguccugacuauaguauugaaggucucguaguuuuccugcucuaauguaagcuacuguggcagcagaagagaaaccagcaaaucccuuaguuugaagucauugguucaccuaugcaccaccccuuucuccucucuguuucaucuuaguuuccuagaaucccaggauaugcuggaggacaaccaucuguagagauguccuauagucuugcuacacagguuauuuguacuuuaggauuauguuugauggccuuauaguuugugcagagguguaggccugaccccaugcaggauugagggagggaaaaagauugauuucuaggcacaucagaaugguccagaugacaugaaacagacugguacacuuacagagaauaugaaaagaauuggaacuuaacaagucaggccccaaguuccauccccagguuccaaguuuguugccgcagaagcucauaauuuucaaaucguagaaaacucacaccacgcagccuuucaauggaauaugccaccuuaaccccagggucguuguaaagacaggagccauaagacagaagucugaaugccuaggccauuuaaucuuuggccaaauuugaacuauuguucuuaaucacacuauucuuguucuuuucacugugcaguagcaaauguuaguucccauuagcacauucugcaauaccauuggaacuaaaacugccaaauuagauuaggcaaccugggauuacacuuugcuccccaaccaaccuagggagggagaacaauuuuaaagcauuaaaagaugugauggugaauuaaacuaccugucacgucagugccaguauauucuaucagauuaacaagugugaaaagcuaaaucuuugguaucuggaaaugcuuagauaggaagaauggcuuuuucuucaaagccauaauaauuagagaugacccuaaaauugaaaggaacuggauugcuuagcaacucagcauuuuuuaaaaagaagggccaucuacuuugaauacagguuaaauaucucuucucuaaaaugggaccagaagugcuucagauuuuggauuucggaauauugauguauucaugaugaaauaacaugaaauucauuuauguuucauguacaccuuauacaaaagucugaagauaauuuuauacaauuuuuuuuuuuuuuugagauggagucucgcucuguugcccaggcuggagugcaguggcgugaucucggcucacugcaaccucugccuccuggguucaagagaucccccugucucagccucccaaguagcuggaaugaaugacaggcgccugccaccacacacagcuaauuuuuguguuuuuuaguagagauaggguuucaccauguuggccaggcuggucuugaacuccugaccugaagugauccaccagcuucggccucccgaaguacuucgauuacacgugugagccaccacgcuuggccuauacaguauuuuugauaauuuuguucaugaaacaaaguuucuguacguugcacugugagagaacaaagguguugcuaucccagccaccaugaugucaugucagugcucaaaaauuaucagauuuuggagcauuucagauucucagauuagagauguucuaccugugguaaaagaauguucauuaugucucugcucuguuguuuagcuauuugccaaaagaggguaaguggaucguuuaauaaaguggucagcaaauauuuuucauacaaggccagauuauagauauuuuaggcuuuguagaucaugcaguuugucauaacuacuuaacuaugcagugguagcaugaaagcaacaauagacaauaaguaaacaaauagacaaggcuguguuccgauaauacuacuuuuauaaaaguagccagcagcugggugcaguggcucacgccuguaaucccagcacuuugggaggccgaggcgggcagaucaccugaggucaggaauucgagaccagccuggccaacauggcgaaaccccaucucugcuaaaaacacaaaaacuagcugggcguggugaugggcgccuguaaucccaccuacucaggaggcugaggcaggagaaucacuugaacccgggaggcagagguugcagugagcugagaucacaccaucgcacuccagccugggggacaagagcgagacuucaucucaagggggaaaaaaaagguagccagcaagcugauccuugguuuaauacagcagguuuuuuuauuuuuauuuuuauuuuuuuuccaauagcuuuggggauacaagugguuuuaguuacggggaugaaguguauaguggugaugucugagaguuuaguguccccauuucacugaguaguguacauuguacccaauacguaguuuuuuaucccucuccuccuucccacucuuccucauucugagucuccaauguccauuaugccacucuaugccuuugcauaaucauagcuuagcucccaauuuauaagggaauacauacuguauuuccauuccugauuacuucacuuagaauaauggccuccaccuccauccaaguugcugcaaaagacuuuuauuuugugguuuuucuggccuacuaguauuccgugguauauauacaccacauuuucuuuaucccucauugguugaugggcacuuagguugguuccguaucuuugcaguugugaacugugcagcaguuauuuuugaccccaggaugugcgaggccagguauuuugagagacaccagcaaaggaaucugaguacuggcuaucaauaccugauaauuuuauuaaugaguugagacccagauaugccguagagguaaauaaccauauaaaggaaauauagaaguguaggagaagauugcucuggaaggcugggguaaaaugaaaucagcuuuauccuuaagaccuccauagagguuaacuguaccaucuccuuuuacugcuacaguuuauaugaaacuggacaauauugaagauuuugacuuuucgaacucaucuauugaguguugagcagcuaugacagguuauuucuuuaugugccuccauuaacgaagucaagaauagcuucugacaaauugacaaaaaacaauaaccuaagguuaacccauucuggacgccaguuauugcuauugcuucacauauauuuuuuagauucaaacuugagguugcuuuuaaguuuuagugugaugugcugaauagagaauagauguuaauaaaaaaauaaugccagcauucguuccuucacauucaguucauauauuugaaaaaauucccaugucaguauguguccauggacauaaaaaagaaauguagcuugacuagaguaaacacaucauagauuauauuuuuauuaccuuauguccaugugaugcauugauaguguucuccaccaacuaugauugcacugacuauaaaauuguaauacaagggcauauuagggggagaaugccuuuguuuuuucuuuuguuguuauuuuguuuuuaagagagucugguauuacacuggaggaucacaaacuguauuuucuuguuauaaauggcuccucuaucuuggacuuaaugguuaggauaaauauuugaauguagaaugcguuaggaguuuuaacuauuuuugaaauuaggaaaauggagagacacuuuuuuuuuuuuuagagacacuuuuuuuuuaaguuauaauaagcauggcacucggaaagcucugccauguuucaagauuaaaguuucacaugaacgcuaacaaguuuauauuucacucauauauaaaugauccuccuugucuccuuuccuaaauuauagccaucucaaaugacaacauugcugggucgguaucaaauagcauuuucaaugauaaggcaaugauuuauauaggucuuaauuuguuuuaaucuucuguuaccaaggcuguagagauaaauugcuuuucugcugaugaaaggagacuaacccaauuuucuuguuagaaucuaauauuaauauaucgacugaaugccauucauaagccuugguuuagggaaacauucagccuucuggccuguuggagauggccacggucauugcuguuugaaggugggucauuucuucuuuuguguccugaguccauugugacuguaaaauuaugggucaccccagaagccugaggaaacaaaugcauaucaaaaugauaggggcaaucuuucacagugccuuuaauuuugaccccacauucuuauaugaaugugaaguaccacauuaguaugaauaugaaauggagugcuccgcaaugauuacaaaaucagaacuaaaaugagggaaaucagugcauguacaguucaacuuaauggauuauccucuaaggagucuucagacaggcuaggagagugacgucugccucauccugaagauauuagcagguuuuccccuguuuuaaaguaacuucccuucaaaugcuaacaguuuucucagaggaaacacagguauggaaaauguuucguuggugucuuggccccagugauggaggagcauuuugugauaggaacguugggugcagcaucgccauuuaugaauaaacugaaagcuaaccuguguuacuucaccccagaaaacagagcucuggcagguauugagaauagaucacagugugaaguggcaguauugugacaagcaugcguguaucaguauuaaaauugaaaugagcccucacgcacaugugaaagcaguuucucccguuuucauauucaguucccugagguaauacagcauuuuggugugagagaaagaagggaaucugacccuucucgugugggaagggggcugagggcaacaaccuccugugacagccacccugguccaagccaccuucaucuuugucuccuuuuuuuuuuuuuuuuuuuuugagacagaguuucgcuguuaucacccaggcuggggugcaauggcacaaucuuggcucaccacaacuuccgccucccggguucaagcaauucuccugccucagccucccgaguagcugggauuacaggcgccugccaccacgcccagcuaauuuuaguauuuuuaguagagacagaguuucuccauguuggucaggcuggucucaaacuccugaccucaggugaucugcccgccucagacucccaaagugcugggauuacaggcgugagccacugcacccagccugucuuuuccucuuaaaagaucuuccuucuacuuuugucccauagcagccagagugauccuucaacaaaacgccccaucacauauacucccccucaaacagcccacgcuggucccucagaauccuuacuguggcuuuaaggcuguacaugaugucccccauuucuucccugccucucccacuacuuccucucuugcuucuuuagcucuggccaugcgggucucguggaauuugccagccagcuucaacucuuagggcuuccgugcuaguuuugucaucugccugccauguccuuccagcagccagcugggaagaucugaaugucaccuccucacuuaagacucugccuggucgcucacuuacugcggucuaccuuuccccucuccccucagcucucccgauccuucugaacucugcucuguuuuucuuuuuccucuuuuucuccauaauacaaaucacauauuaacaauaugacuuacuggcuuuuaaaaaauucuugugguaauuguuucuuucccuagaauauaauuccaccaggaucagggccuucauguuuuucucauugguuucucccaugugccucacauauaauaagggcugcaauguuggugggcuggaggaauaaaagaaugaacaggcgcacuaaaggcaggauaguuuguccaugucagagcugcugucucagcugcuuugauaccucugacuucccaggguggcaaagaauaaggauguggcuuauguagaaggcguuagucauccaaaaugccacuguauauuuggaagcaaauauucaccuugaagcagugauguacuaggaauuagaacugcuuuucuguuacauuuuuucauuuguuaugaguguuuagauacacaugaucacuauuaaaaggaagggagguaauagccuauauauccuaccaugccccucaaggcucuguuaggagacuaaaauacaaaggucauuuaaaaaguuaaaagcuuaugcaugugauguugguauugcugcuaaugacuaggcaucuagaggucaaaaccuagagcuaaggauauugaacccuguguuuugucucguuuuaagucuagguuuuuguggaggggggaacauaccuagccagcuugcuugcagaaggcaugagugagcaggcugaaggagggacccaaggccagaacguccuccauauucuagcuccaugggcucuuucacuugaucccugcuuuaugacccaacuucuguugaaggauuugccagauaguguuuggggcaggaacagcuguuucauagaaaacaagccaacggacaucauaacaaagcauaugguuguuuugccaaguugugcugcucauuaacaaaacaaaacaacaaaaacccuuuacagugccccagcauguggauggauuggcccuuuacuacucuaaaaauuagcuuuacagccuuuuuauggcuuacccaaucuuaacagacuuuauuuguguguguuuagggaugcaaauggguauguuaaaugauaguguuuugccucuacgcaauaaaauaggguaauuuuuucuucccauguauuaaacgagaacacagaacaugccuagcauggugggcucugaugaaaagaggcuguuaucauuuggccaacauggaaauccuagccuuuauuuauuuauuuauuugagacggagugccaacauggaaauccuagccuuuauuuauuuguuuguuuguuuguuugagacggaguuucgcucuuguagcccagacuggggugcacuggcaugaucucggcucaccgcaaccuccgccucccagguucaagcgauucuccugccucagccucccaaguagcugggauuacaggcaugcgccaccacacccugcuaauuuuuuuauuuuauuuuauuuuaguagagacgggguuucuccauguugaucaggcuggucucaaacuuccguccaccucggccucccaaagugcugggauuacaggugugagccaccccauccggccgaaauccuagccuuuaucagagguuccguggaaucucagaggucugugagcaggauaaacugcuuuaugguaguuuaaaaugcaaaaccagaaauaaacccuccuaaagccaguuuguuuccacuuucuaagugguuacagugaccuguguuuuaaguaccuuaaauauaucagugaccugcugauauacagcuuccuguuuccucuguguccugugacauauccugacauuccuugagccccacucccuucccaaaaggaaguaccuugaugggugaggacauagggcacacgugucucuggccuucuguggacauaaucacaaaaugguagucaguccuaugaauuuaaucucuuuaggauauaaggauauucacgaaauagaaguugagcucucuggacauacuccaccuuaaaauugcucucuccuuccgggauccucaccagcugcagagcaguaguaaugaacuauuaaauucauuuaacaauaucagcauaugcuauccuucucugcuugacuagacaguaaucuggcuugcugguugguaugaauauaggauaauuucacucacacuaauugagauggggaguuuguaugaauggcugaaaaauuugaguuaaagauaaaaagagacacagcuuccucaacuaugggaaauaacugggacuguuaacaaagauuuacuugaagagaaauuguauugcucaggguucuccagagaaacaggaccaauaggauauauauguauaggaagagauugauucugcagaauugacucacacaacaauuauggaggcuaagucccacaaucuguugucugcaaguuggagacccaggagagcuggugguaugauuuaguccaaaucuaaaggccugagaaccagggaagacaaugguguaaauuucaguccagggagaagagaagaccaauauccugacucaggcagccaggaaauaaaaagggugaacugcuccauccucugcccuuuuguuuucagacccucagcagaucgggugauuccugcccauguugaggagggugauuuacuuuacugagugcaccaauuccgaugcuaaucucauccagaagcacccucacaaagacacucagaaacaauguuuaaucugggcaccuugcggcccaaucaaguuggcacagaaaauuaauuaccacagaaauauuucuggauucaauggauuaaguugguaauauaguauucauauucauuuccacgugccuaaaaagaagguuuuuauccuuuuuaauauccucaguccuauuaaacauaccucacauucauguuccaugguuauucucuuauuauguugcuaagugcauuucuacuuaggccaaucugauuauagugauucagauuauaguguuuaucuucuuuccuuuauacaguagacaguguucgcaaaccauaggagcugaaaaaauuuccuucuuauauaguaaguuuuaugauuccaguuuuccaaaggggugcuuauguuaugguuauaacaguuacagccagaugacuaucuucaucagcagguauaaccccaaauauuuauacauuuucauuuguuucaaacauaaaauaugguuugccuaaacaugucauucugccagauuggacuaugcaaaagaauguuacuguuuuauuuucugcuuuuacuuuaacuuguucucauuugagcucuaccaguuaagaugagaagaugacuaaagcuagggaagcacauuuuaaaugcuaaauaccauguucauuucaaguugggaacuugaaaugcaaguauuuuuaacuuaaucauuaaguuaaagucaguaagaacgugguauuuagcauuuauucauuuuaacuuaaugauuaaguuaaaaauacuugcauauugguuugcuugaagcuauggagaaaaacauuuaccuuuuuuccaaaaaggucuuaauauucaaaauuauuguuucaaucuuacaaauuaacaauuuacuuauuuuugauacuuucggccuuuuuuaugugggcuacaccuaacauuuuuugaaaaauacauacugcuuuuccuguagguugcacuuugugauccuguguguaauucauuuucagugguucuauuuuauuuauuuuuuguuaguuuguauuuucuuuuguuucuuuuucucaauuuuuaaaauuuuaaaacuuguccuuuucuuuuuuuucuuuauuauugcacucuucuaccaaaacauuuucaguggcuuugaauaaaaguaucagaacuuucccgugguuagcauuagcucugagauuugaacaggauguauuaagcagaggaggagggaaggccacuaacauguaugagcuccacugugugucacccucucugccggaugacuuacaugugguaugguaucucauuuucccagcucuccuaucauguccugcggcauguuaucaccacuugauaaaaaaauugaaacauggagugcuuaaguuuccugccccaggucacagcugaucugaaaaagaaaugggauucaaauccaaaugugcuuaauugcaaauccccacaugacucuuuccuuccuuccuuccuucccccguugcugccaauguaagaaggaacaccacucccucauuugcuacagagaagacaggggcagcuguguaaaggcaccaggaauaugcccugccuccuuccuuccacuugaaagcaacaucuggauagacacucaacugcuuuuauuuuuugaaaaaugauuauuaaucaggauugaaguggagggaaaaaaucaaaacgaauguuucuuuuuaaaaugaaagauacuguuuaauuauuuaacagccuuccgguuuuaguuaauaucuuugaagacuuuggauuaagauuccagacauuuucuugaaggauguagaaaacguauuuaacuucaaguuuaguuucaaaaugacuuagcuaucaauucuucucauugaaguccucuuugagauauuauaucccaaauguaauacacagguaauaauucaauaggaauacuuggaacauuggugauauuugaauaaccuuuugaaugaaacaauugauuugaucucaaaagauagugaaaacgucucauuuuguuuuuuauguuaaauaugcuuccucuuaagucaaaauucuuuuuucuuuuugcuuuuaagcucauaaauacucugaauucucacuaaucuuuuggaaaauugcuuguauagguauuauaauucacuuggcucaugaguuacauaauauagcaguauauguugcaauucaaauauugcuuagcaguauuaguugaauucaaaauagaaaucacuuucuuuuugacaacuagcauaaugaauucauugacuauugucaaauuuaugaagacagaaaaguccuuuugugauucaaaaauguguuuauugauguuuauauaucuuuugucguguuuccauacugucucaugaagguugucuucguaauucaguuaucuaaauacaucauacauuuaccuuuucccuggggugccguuauucuacaacaggcuaauuacagauaucugugguuucugcaggagucuuaguguaugauauugaugauaucaucauuuacuuucaaaauugcaaaauaguaauuuaggaaagcauggggauuuggaaaaacaugucuucagcaccaacuguuuuugcucuuugcaugcuuguuucguaaagaacucuaaugcuauaauugcaaaauggaccauuuuaaagauuuuuccuucauucuguacuugggaguggugaaagacauccuuacugugcugcacagugucucaugguguucucuuaaacagcauuaacgucuuguaugcgcugcuuuacuaaauucucuguucugagaaauaacugaaaauacggcuuucuauuaaacgaguggauuauucuguuguuguuggcuuuuuuuucucaaaccuccuucucuucuacuuuauaguuccuacaacagcagccaguaccccugaugccguugacaaguaucucgagacaccuggggaugagaaugaacaugcccauuuccagaaagccaaagagaggcuugaggccaagcaccgagagagaaugucccagguaagucuggcucuuccaucauucagcccuacgauauugggaaaccugagcuugccucugccucagucuccccacaggccugcuggcuuuaucaagaucuuuaaagauguaaaguucuaauuuuaaauguuuacugugugggcacaguuuguggguuuuuugcauccuccgugaacaugcugccuaggaaggauccagguauaguuggauuuuguaagcacaaauuaaaugaugucuguaacauucucucuggcgaagaaagguacuuggcauuauuauucuguguauauguaguaccuguaaucaacauguuguaaauuaaaauccaucaaaaugcucuuuaguaaagaugagguuuuguauuaaaucccagacuguuauaauugugaaccuacgauuguuuacagucuguaaaaucauagagacuuaaaacugagcugaaccauagugauuauuucaucuagucuccuaagugauacauaguggaauagagguucgagagaguggcuucccauuuuagcacaaagcaaaaucagugagccagagacaacauuuagaauccaggccuuucuugcuccuaguacaguacuccuuucauuauacuuugcugaaaaaaaaaaaaaaaaaaaaaaccuguuuugguuugguuuguuuuuuuuuagcagguccuuaauuaagcaaauuaaaaaauaacuuaugucuaaaacauggcuaauccauauauacuaucaacuacaauugaagcuaugucugcuaccaggcacuggauguuguauuggaguuugauaauauggaggauuuuagcccuugcucagauuccucauucauucauucauucaaucaacaaauauggacuuauuauuuuccagucacuuuucugauuuguagucuacaaaccuaggagugaauguggggggaaaagaaguaggacauaaaagugaaugaauaaagaucucagguuaaaguaagccauucauuuuuaguguuaauauucuguggcaaauaucagaagauaggagaaauuuuugucuuagcacagaugcuuaaucucuugagagacauuaaaugcaauuuaugaauuagacugcugcguauuuucuaagaucacagucagucuuuaguagacaauuaaucuuuccuguaauuucugaucugggucccugcugaccccaggaagauuccucccucccagggccaaaugaauggccccugagcaugucuuucccaugcaaaccagucaaucaaaagcuccuuacucccaaccaccuucuuauacucugggccacuauucaccugcucuaaucaccccaggaccagguaccagaccacuagggacaaccucaugccccaucaccauuauuugaacuaaucaguccuaaacccgccuacccugcuucgcucauucuuuccaugaaaaccacaauaaaaggcucuugcucauguuuuccccuccugaccaacccuggugcuucccauaugacccugcauguaguggcauguaccggcuucuugggagcugaguaacaaacugucuuuuccaugauaaucaucuccugaccucuuggccucaccugaauaauaagaaaaucuacccuugaaaacauaaaacuaauaguuuaucuagaaagguacaacacagguacuguuuuuuguuuguuuguuuuguuuuuuguuuguuuguuuugccuuaagaugaauaacaauacuuggaucuacuuugguauaauaacauaaagaggaaaaaagccuuauaaucacaguacuuuuggcucuggaauauaaugugcaguucuaguggcugcccacgaugaaaaccuaacagcuaauugaacuagaaagcuagccacagggaauuauuaaguuuucaccugaugccaagaaaaucagaucuuuccuuaggaaagacacaggcacuguucggaaagcauuggaggacuaugaaucauacuuauugccacugaaauguccucauuugaauuuacauccuaucucccuucuuuaugaagcuuucagaggcuuccugugcccucacaaauccacuucugggcacaugaagucguaaaaaaagaacaaugacaaaaauaaacaccgaaugcucagcuugucauuuucagcgccuaccacuguacccugacucuggucuuccuaccaccucuuccuucucaacugcuacccuugcuuucuguacagcguuaagcugcuguucugaucaggccacucugcucaucgucuguucaucucaucuugggcuucccuuugcccuuggcauugaguucuucuggaaaugcccucccacucuucuucacgcugacacaucucacccauuccuuacaccccacuucauacucagaaugagacaggcagucauugcucuuaccuuucauuuaauucuaaauauuugcuccccgguuuuguuagugauuucuggacacaccugcauuaucuuuccaagcuggauagaaaccuugagaccucaagucaugaagccugcuaccugcauucaucguggacccacuguagcauuuuuuuuaauguguguuuuuuuaauccuggauuuuuucuccuaguauaucuuguucauuuuugaccuuauuaagaaaacuuauuucaaauucucuguuaguuuuagaugugacaggucuucuuuaaaauaauaauuuaacuuuuagcacaucuguguaacuugugacuuaguucaugauuuuguagauuuuguucaucuuuuagucaucagauauaucugauauaaccuaagagauguugucccagagcagagaauguugucuacuagauuccaguggucauaggaaugugagacaccugaaaucaauauguaucuucauagucuguggugcugaaaucuagggacuuuucaacuuuaaacuugccugccucuuaaaucucuacuuaguaguagucauuuucucugcaugaaacagccaagucuuugaagauugauaaauccaaaugaaauugauaccuuugugccugcaguggaaaauugcuuuauaagaauccauagagccacugcaagggccagguccugagaauuuuaaauuuuaaaaauugugcgguuuuuuaaauuaaguuuuauuguaguuuuuguuauauguuuucuuacaaauacagaggauuuuggaauuuuuucauauuuugguuuguuguugccauuguggaguauaacucuaaaccuguagauuuuuguugcuaaaccuguagauuuuuguugcuauaugucgugacuagcaucuagucaaauagaaaucuacagcugaaccaugugugagcacuuuuauuacuuauaaacuuacuacuuuuaguauaugcuuaaaaugaaguccuucaaauugaaagcugacccaacucauagguuuuuauuucuuaucuuuuuuggagauggagucuugcucugucacccagcuggagugcaguggcacaaucuagacucacugcaaccuccaacucccugguucaagcgauucuccugccucagccuccccaguaacugggauuacaggcacgugccaccacgccgagcuaauuuuuguauuuuuaguagagacaggguuucaccauguuggccaggauggucucgaucuccugaccuugugauccacccgccugggccucccaaagugcugggauuauaggcaugagccacugugccuggccuagguuuuuauuuuuaagauaagcagcaacauuuuaagagcgccccuuucuccugucacuaaauauaaauaaacuuagcucaccuaaugaauuuuuuauuuuauaauaaaaaauuggguaccacaggguacaaaaacaugaucuuuagagccacagagaucuugguuuauauucuucccucucccuuuuuuaccugcauagccucgagcugguaccuuaaccugguucguaaaaugggauggcccuggcuaaucucacaagcuguugugaggaaucaauuaaauuagauagauuuuguaaagcucuuaauacagggucagcaguaaugcuacuuguuaucagucccacagugaaauucacuguucacagggagauggucagccuacauauaguguguauucauuugcaguagagucuuagugggauggugcaggugauuuguuuauuuguggggguauaggauauuguuaaauuguucugaaaaucaaaaugugaguuaauuucuauaguaaugcuuauuugcaacucauuagcuaaauaaaucucuuuaauuauuucauggauucccccagcuuaaagcuuaaaguccaguuucuuaaaguguaugagguaaaauggaaaaaauguaaauguaauaugggaaaucaguucucacauugcaguagaacauugaacuucuaucucaaacuaauuuugagauuccuugcuugaagaauuguugguagaguaccaccacugugaacauucccaaagcaggaaauugaaauauuuauauugcaaggcuuaucucaucuauaaagcaaagauggucuuccauuucccccuugcccacagguucccuuuauuaacgugguagaagcaccaaagcagaugggacaauauguuucuuuucuuccauguucuauucuuguucauugcagcagggcauuugucccaauuuugcugugaaccuugagauuauuuuugauaugcuuuucaaguguaaugaaauauuuauuccaucuuguuuccuccaugguuuuacaaaaacaacaagaagaagcuaauugccuaucauauacaaagaaugaaugccaauggacaauaaaaucuguaauuaggaacccacauggugauuugauauaguauugucucauagaagucuucuaucuauaguuauuuauuccaagccucuuuuucuuucccaucuugaaguauguuagaagagucuauuccuuaaggcuaaguaccuacaaaaaacaggcucuuauaauacaguaaucaaguuuucucaugcuuugggaguacacagaguaugcaaguacacaucuggcaccaaaccaauauuuuguuuccuugaucuuucuucauuuuaccuaguucagaguugcacuucaaacaaauucuacuugucauacacuugaaaaggcagcuguaggugguaggaaguuaauauuuucuuugaacaacauacagaggugcagacuuuuacuuuuuguaucagguuaaugagugaacuucucucagggaaauccaggugaacaucaaaguugagagcaggaagcauugauuuccuacaaaacacauucaccugauaucuuagucaguuuguguugcuauaauagaauaccccagccuggauaaucuguaaagaaaaagaaguuuaaaauucggcucucaguuuugcagguggggaaguccaagaacauggugcuggcaucuguugaggacuuccuugcuguaucauauaugguggaaggaagaagggcaagaggagggcaaaacugaguuuuauaacaacccacuucucacaauaacaaacccacuccccccauaaugauacuaauuuacucaugaggacagagacugaaucaccucuuacaggacuuaccccucaacauuguugcacuggggauuaaguuuccaacacaugcuuuuuagggguuacauucaaaccauagcaguugguuacuaaauuagugcuacuuguaaaaaaauacauguuugcugcauucagaauauuacauguuuucuuggaguuuuuggaaggacuuagcguaauccuugcuguucaugacuuagguuggcaagcucaaagggccuuaauuccccaucaguucuuuaaagggggauaggucuuaggauauuagacagcagaagucuucuuuuucuucccccauuauguacugcuuuuuggcauuguauucaugacacacacacacauaaaaugucauauuuucuuuaaagucaaaauauacaguuuaaaaugguuucaguugcuuucauaagagaguaaaacuuagguguucaguuuaauauuggaagaccuuguucaguuaaugugugccuuccaugaauaguugguauuuguucacaucaaaucaaaugacugucaguucucgggguaaaaaaagaccaaccuugacucaaaaagcuauauuccugcaauaaauaugaacauuuauguuuaauauacugcugugauuaauuauuuauauccuagugggaggucaaauauucuucagauaggaagggguauguaauaaauuuuuuaaauaucuaaaaugacaaaaauagaggaaaaacauaaucauccauccuauuaagucuguauucaaaggaugaacugaugauuuuaaauucaaauguuuccuuaauuuauaggucaugagagaaugggaagaggcagaacgucaagcaaagaacuugccuaaagcugauaagaaggcaguuauccagguaaaaccugaacccauuuccuaccaaacaucacaugccagcagucuuuuuaaugagugucugcagguuuaccuuuaucugccagcaccucacgugugauuguucauagucccaugaacuucagcuguucuuaaucauugucuaguaauugaguuguuuaaauccugccuuauauuugcucccaauuauuucaaguuauaauucauugccauaaaacucacauuguaacuugcaaucuacuuuuuauuaauaauacaucuuuucagucaccacaaucuucugcugcuucucccuccagcaaaaauuaugagaauuugaauuuuugauggaaaccagucucaaaauuaccuuaaguaaaccaacaguuuauuauggucaauuacuugagguacuguuaguaagagagggauuuuuuuuuaauauguaauauaagaguuucaagagugcauauauuuauccaaaguuauuagucaaaucagccuucagagagccuaugaaauacugauuuucaaugagaaaguagguuugaugaggguuggagagugcaagaaagugaaguaagcuauaaaacguagaauuagucaauguuggaaugacuaugcagucuuuaggauacuuuuuagcacuagaagaaaauggaauaggaugucuuuuuuagaagacuugaaauugcugcuucauccuacuuauucaguccccauggacauauguguuuaugauggcagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggguaggucucgcugcagccgaguucacacuucaggucacagcacagacaguaaggguggggcacugggaacuggaagccauacaaaaagaaugaggagaaaugccuugagcacuguuauucagagguucaaccccuguccauuccaucuugaaggucaaagggucacagggcagcuaccuccacaaggucaucucuacacagcagguacucacacuuccccacagagcagccagacaggacucccagggacucacauugcaagcccugacuugauuuaauauuccugagguggugacaauugauggcauaguucaaguucgaacacaaaagcuggaaggaugucuuccagucccuucaggcugcuguaacagaauaccauagacuggguaccuuaucagcaacagaaguuuauuucucacaguugcagaggcugagaaguccaagaucaagacaucagcauacuugguugucuggugaaaguuugcuuccugguucauagaacuuaaauuuuguuuaucuuuuauuuauuuuauuuuuguuuuuguuuguauuuugcuguauccucauaugguggaaugggcaagagagcucucugggcccucuuuuauaaggguacuaaugucaaucuugaaggcucugcccucaugccuaauugucucccaaagcuuucacccucaaauagcaucacacuguggcuuagguuucaacauaugaauugggggugggagagacacaaacauucagaccauggcaaaggauuuuagaaguaaccuugcccagcccccucaucauguaaguauaauaauauaacuaaggucaaggaaaguugagauuuggcugaguuguaagaauuuuuaguggaccagaaagaauuagaacucaaauuuccaucucagagcaguggccauauucucuguggggaagcauuugucagucaugacauuagcaaugaugagacuuauucaugguuuucagugaucauugccccaaaaaggcauguugagugguacaggcauagauguguucaccggcauucugugggagagcuuacuuggaauggaaggaacuuucugagcaugaguguguaacuuauguccacuuguucuuuuuuuuuuuuuuuuuuuuuaaaugagauggagucucacucugucacccaggcuggagugcaguggugcaaucucagcucacugcaacuucugucuccuggguuuaagcaauucucaugccucagccucccaaguaccuaggauuacaggugagccacgacacccagcuaauuuuuguauuuuaguagagacaggguuucaacauguuggccaggcugaucucgaacuccugaccucaggugauccacccaccucggccucccacagugcugggauuacaggcgugaaccaccaugcccagccauuuguucuuucuguuugucauugagcaagggauauugaaagcucugccugugauuguggaccgggccauuuuucuaaacagugcuaucaguuuuuauuuuguauaguuugaggcuguguuuuuaggcguguaaauguuccaggcuguuaggcccuccuugagccucuucuuaugaaaugaucuuuuuauccuuuguaauguuuugcuccaaaaucuacuuuaauauuaauaaagcuauuccagcuuucuuuugauuaauauuaauguggugcauuuuuccauccuuauacucuuauugaccuuguuugucuuuauauuugaaguguauuuuuuguaggcagcauguaauugggucuugcguuuuccuuuggauugggaagaccauguacacugaaugagguuauggauaugguugucacugaaucugucaucuugauauuuguuugcuauuuguccagucuguuccuuguucuucuuuuuuccucuuuuuuuuuuggauuaauuagaaauuuuuuaugauucuauuuuaucucuuuuguugguuuguaaguuacaacuaguuuguuauuuuacugguuuaucuccuuuguggguuuauaaguuauaacuaguuuguuauuuuacugguugcuuuaggcuuauagaaaacauucuaaacuugucacgaugauguuaugucaguucaaaugauauuauaccacuccacagacaguacuuuacaaaaguacuuccauuuuucaucucucucucucucuguaagcgguuguugucauacuuuuuccuuacuacauuguugauguuuuucuuuaaacaguuauuuuuuaaugaguuguaaauuuaaaaaaaaaacaacauguuuacccaugaagucaucauuuugggugcuguaaacucuuugcgcagauccagcugguaucauuuuccuucugccugagagauuuccuuuaaaaugucuuagagacugggcuugguggcuuguaccugcaaucccagcaacucaggagguugagauaggagaucacuugaacccaggaguucgagacugcagugagcugugauugcaugacuguacucccaucugggugacaaagggcauccugucucuuuaaaaaaaaaaguuugagugcacauaaguuggugaugaaaucuuuguuuggcuuugaccaaaaaugucccuuuuauaccuuugguuuugaaaaauauuuuugcuggguaaaaaauacuggauugagguuucucuuucacugccugaaagaugauacucugcugucuuauuuguguugauaucuuuaucuuuauuucucuaaaaauaacaugucuuuuuuuucuguuuuuacaguuuucucuauaucacugguuuuuaacaauuuaauuuugauaugccaugguaucauucagucugcccuuaauuccaucuggccguuuuucaucuuaucaccucacauacuguaguuguuguauauagaaauuuaaccugggcuacccccaacacccauaauaucgucuguaucuuaacuuuugaaccuauggaauacaguuauuauaugaaaacuguuuaaauauccauguuugcuaauucuaacaucucugucaacuuugaaucaauuuugauugcuuauuauuacauguggcauuucccuguaucauuuuaugccucauaauuuuuuauuaaaugucggacgcugaauuuaaaccuguugaaugcuagguguuuuuguaauauucuugagcuuuuuucugucacauaguugaguuacuuggaaacaguuugauccuuuugagcuuugcauuuuuagauuuguuaggugggauagaagcaguuaucagccuaggacuaguuauuccuuacuagugaggcaagacccuucucagucaucuaccaugaauguuaaguuuucucaccugacucgugggaagaggcauuauuccugucccugugugaacaccaagcacuguuaaugcuaauucuuuuuggugauuuucccccuggcuucaguuucuuucacaugcauguacccaucauuacucagcuauauucucagggaucacucugcacaucucuggauucucuuuuggagcaacucucuccucaccaauacccuguccugugaauuacaacuaccuugaucucuccacacacuucauguccuccacuccacgaguccucuaggcucuguguggguuuccccaccugaaaccaugaccuggaaauucagggccaugaguuuggcagcuguaaguccucauuuguuuccccuuuucaggaaucaguguccuucaccugaugucuaaugucuugcagaaauguuguuuaugccaggugugguggcucacgccuguaaucccagcacuuugggaggccaaggcgggcggaucacgaggucaagagaucaagaccauccuggccaacauggugaaccccgucucuacuaaaaauacaaaaaauuagccaggugugguggcgcacaccuguagucccagcuacucaggaggcugaggcaggagaaucaccugaaccugggaggcagagguugcagugagccgagauugugccacugcacuccaguguggugacagagcaagacuccaucucaaaaaaaaaaaagaaacgcuguuuguauaugaauauauuguccaguuauuggugguucaggcaggaggguaaauccaguucuucucacucaaucuuggcuggaauuguuugugcauuuuaugcaacuuaaccagaaagucacccauuugcaccgauuuuccucaccauuuugauuuuucuuucuauggauaaaguuacagugcacagaaagccaugaggagccguuaaagagcucguggcauucuuccaagacguaagauacuauuuacccuguucuaccgaugauaucacugcaaccucgggagauggagcggcugguucagggugacacugcugggaagggagaggguagagccgcgagucacuguggugccuucucacuagaacgagcuuccucucuaaacaaagagcuuuugaaaaagaauauucauauuagcguuuucauuuucuauuugccaaaauucucuaucuuagcaaggcacuugucaggaaauuuuuuuuuauaucucugcagaacaaaaguuccuugguuccucucuuuuuuggagaacacgcuuucaggagaggagccgugugaucauuugccagagaaggauaggcuggugggugcugagaccagaaucuuuauagcagaaacuugugaagcguuccagcugaaaguccaaucucuaaaguaagaucuuugcuaaauggacauugaugggacuaaaaauaagcugagggcugaauggaggcuuuaacaaauguacauuuaaacucucaguuuagucucaucagccaucacaggaaaggcaguggcaagaauguuugccgaagugucaucuuuuaucaaaggggauaauuuuagagugguuguaaucgugcuuauugugggccuccgcauugcuucauauggaauuaggcaacauguucauuugaaaaaaaaauuaaaaacuggauuaggaagaaauauuuuacugucaaaaaucagaucacuguuguugauugaucuaaggauuccuguuaaauucuuaacucggauuuauuuauuuauuuauuuauuuucucucucucucucucuuucucuguuucucuuucucuccugccuuccuuccuucccucccucccuccuuccuucuucccuuccuuuccuuuccuuuccuuuucucuuccccuccccucuucucuucucuaaucuucucuuuucuuuucucuuuucuuuucuuuucuuuuguuuucuuuucuuuucuuuucagggucuugcucuuucacccaggcuggcaugcagugguccagucguagcucacugcagccccaaccuccugggcucaagcaauccuuuugccucagccucaugagaguugggucuacagaagcuccaccauguguggcuaauuuuuaaaaaauuuuuguaaagacagggucucgcuguguuacccaggcuagucuugaacuucuggccucaagcgauccuuucaccucggcuuuuuaaagugcugauauuacaggcaugagccaccaugacucaccuuuaaaucuuuccuuuguaauaaaauguggcuggguggucacaggccuggagucuagggggcauuacuugccauuuuuguuaaguuaccaucuuuagguguucauuuaaguuuuaauguuguauggcuugaccuggcacuuaggucugcacuuuggcaggcacaagaaaauuguaaauaccuucuuuuuuuuuuuuuuuuuuuuuuuuuugagacagagucuugcuuugucgcccaggcuggagugcaguggcgugaucuuggcucacugcaagcuccgccuucuggguucacaccauucuccagccucagccucucaaguagcugggacuacaggcacccgccaccaugccuggcuaauguuuuuuuuuuuuuguauuuuuaguagagacgggcuuucaccguguuagccagguuggucuggaucuccugaccucgugauccgccagccuccgccucccaaagugcugagauugcaggcguaauuaaaugccuucuugaggacuuuuauaccuuccucuugaagacauaaauccagagcuuacuggugguugucugaaaaagaucacaucuuguaauaggagucauacauaaauauuucugagaucucccucauacuuaaccaccgugccuggaaaaugcagacaacuguauucaguaaaugguauuugaauauaaguaaaucaaaagugucguuuccauagauucuguagauguuaccacuuagaauaauuaccugucuaacccuuaacaaauucuaccguauauucucagacuuugcaaacacgggauuccaaaacaauguggauuguuuucaguuucuuugaagcucagauuuaaaucauacuuuuacucaguuuuuaaaccuaaacguggaaguguuaugagauguuguuuuugugcagcuagaauuccuuguucuacuaaugaauuucauuuccugagucccugugucugaguauacuguauguuucaaauuucugauuuaguuauguaccuauaggcaaauacacugaauggucaaccuaaaaaugcauuguuugacucauauuuagagucauacauauauaggcacauguauuuaaaauaaauacuuuaggcuagaugugguggcucacagcuguaaucccagcauuuugggaggcugaggugggaggaucccuugagcccaggaauuugagaccacccuaggcaacauagaaaggcccuaucucuacaaaaaaaaaaaaaaaaaaagauuuuuuuaauuagccaggcaugauggugcgcgccuguagucgcagcuacucuggaggcugaggugugagugugaaccaggaagucaaggcugcagugagcugugauggugccacugcacuccagccuggaugacaaagcaagacgcuguuccaaaauuaaaaguuaaaaaaugagauaaauacuugaaauauuacaauuauuaaaauaguuguuuuccccaugggaaaaaaaaguugagcagagcugugucuuugcacucagaaaaaacucuuacucuguugaaggcuagugacucuucuaaacaccaaccccuucaccuuuuuacuuuccuuagacuuucuuuggaaaaucaaggaguuagcacuuuuucccccuggaagaauuaaaugccucuccagaacugcagcacaggagguuaacuucuaccaccuuuggaggccugcaagcuaccagauuaaauacuuaaagcuaagcauucaucauuucuuaaccugcccucuacagucaugcacuuccugcuuuuuacuuugucagggcucguacucaaacuauucauagcuucaugaaacaggaacuaaaugcugucugagccuuuccccuuguaacucucagcguucugcuuauccuucauagacagaagaugaugauauguccugacuguugaagagaaauuagacuuaaugugauccuguacaguuaaaccaaaggccagauagggauuuuuuauuucaaucaacuuucuauuguaggccuagguuuggaaaaccuuagcacccccuaauuuguaagacuugaacuguuuuaaagauaagggauacacagccaaagcuuucuuuguaauucugagauuuuugguguuuuuacagauacuuagucuaaaucuuucaucagacaguuaucaugauuauuauucugacuucaacaacugcauuuucuaaagggaagugagaauuaggaaacauuuuccuguacaucuguuuaucuaucccaguuguguuguuuggauuuuuucagugucuuaacgauugaaaccaucuuauccauacugaaauucauuucaugcuucuaucugcugcuucacauucaggcuaucaguuuaauugagcaaaaaaaaaauguuggcaguuucuauagcaucggcauccuucuuugguuucucauuuuugaaugguucagccacauguuaaauuuugcugagaucucuggaaacuucuucacauaauucuuugauagaacaugaauucugugagacucuucauuaaagagcacgguuucaucacuaaguugagauuuugcucaaggcuauuugguaaauuccagcagaagagcaauaaauguucaacaagaaacagccgucauuggagauaacaaggguagacauuaaugggagguuugucacagguaaacaggugauggcaugagaagguuuaaaccaccucauaaauaaauuuuucgccacuauaugauguggauuacaacuaaaccaaacuuuaaccaauguggguguugguguaccuuucuuuucuaaagcaaaaaagaaauugugguacuaaacuugagcuuuuauaugauaccgcuaauugcccuucacccaacaaaccaauuauuucuacccaucacuuuucguugcaaaagaaauuaucuuauaaaauauauguauauagcauauaucuccaaagcaaauaugggacaucuguaccucaauguaacugauaguaaguuaaaaauuauuugcugaguucuugguauguggacagaugaauauuauaauguuuaaggcauuccaccagcagguuuugaauuuaaccaaaauuuuaugaagcuaaucagaauggaauuaaaaguugaaagacugccaggccaaaaagaucaucuuucagaaaaguaaauaauugcucuauacuuacauauuuauuauuuauuuguucaccauccguuuauuuuuaguugaguucuguauacauuggugagcaaagggggacucauuagcuugggcacuccuaagggcaaacccaauaacagauagugaaugggaaggaaaaugagagaauuagcauuuagugaacaaaaucuuauaaacuaugcugaaugguauacaugcucuuucaguaaagccacucaguacuauuacuucccuaccuucugaauguuuaccaaguucgauaaaaucuugcuacauacaaaugggaaguauguaacaagagauacuagugguuucuggguuuaauuaaguuacauagaacauuaagaaguauguugggaaggcauuagcuuaaaagcugucuuuugccacugaggccauauucaucacccagauucccuccacaguggagcacugcucagucacugccuucagaaugcaaauaggucuucacaggaugcuauuaaaacccauagcaccguaugguuuuacgcucugcuuucuuccagcaaaccuacguauuuuaauguuaauauauauguucauuuuaucuuugagaaugaaaauguauuaugaaaauauaaauauuuaguuuuuguagacaaauagcacauuuaaagauccaguaguuauucaccugccugguaugacugauagagaacagauggguagcaaagaauccucacccuggaaacauguacgcauacacacgcaaacacaaucucgcauaagcuuuaagggguucauucauuuugugaagguugaccauggauaccaguuuaaagaugccaggugauguuuggcuuuuaaguaucaucaccuugaguuuccuuauauaaauguuuuaauaucaacaaaaaacucagaauuucuaauaggucauaacacugccuagguaugggaagaggagaggguaaaauuaaaagaaaugcaaauguacuuuucuuugaauaggcuaaccaguuagaggauguaugaagcaggaccaccauaguccaaguaugaauaugcaaaauuaaagcagauugcuguaaaucucucuuaaaaagucaagaauaugucacaguuggcauuuuucggaugaucagaccguuugacaaaucucugcaaggguccgaguuagucgaacauaucuuuugcuuaugauuucagcaacacugugcgcuuugccuucuggguuguauuacuaauucuguucaucauuaaguguacacauguuucacuguuugacuaaacaaagcuugaagacauacaaguccaaacauuuucuguccuuucuguauucccaggucagaagaucuuagcucuuuauccauucugugcuagaguuugucugaaagcaugaaucaugggguuguguugggugcuaaauuucaguucuauaugcugccuucacuaauuuaugacuguggucugaacaaccaaaauaaauuauuucugagaacuagcaaaauacccuggaaaaaauuuaugaaaccuaccagauuuguaaaaaggucagccaggcgugguggcucaugccuguaaucccagcacuuugggaggccaaggcggguggaucaccugaggucgggaguucaagaccagccggaccaacauggagaaacccugucucuacuaaaaauacaaaauuagcugggcaugguggcgcaugccuguaaucccagcuacucgggaggcugaggcaggagaaucgcuugaacccggguugcagugaggggagaucaccccauuguacuccagccuguauaacaagagugaaacuccgucucagaaaaaaaaaaaaaaaaaagaaaagaaaaaaggucacuaagugaugagagaauuaaaaccacuccuauuuucuaccuuuuauaacauaaacucuugucuuuacuucccagguuugccaucuuuauaaccuguaacuaggagcaagugauuuaauaaagggauuccuccuauuccgucugcaaauuggaguuaauuuuucuccucuuucugcaauuucuguuguuuuagcuuuuguuagccauaauuagaaaaucaaaaggauucauugaaaguugagacaaaauugugaaguaggaagaugucuuccuccguaagaggagaaagauuguuagaggaaguacauggaggcuuuggugacacaucccuaugaggaagugaucugcuuccacgggaaggagagaacagaugauagaugacuccuagaugcuccugcgucauguucaguacaaaaucagagccgcaucagcaaaccggauacccugggaaggaacauugggauaacuccuuggccauaaacaaaaguuuugcucuggccuuaugacuaaguggauuaauagagauuaguuguucaauauccuuccaucuaauggauccauauuguuaaaacuuaagaaacaccaaagggggagagugugagaaucuacugccauuuucuccauugcuucauucaagacuucuguguccaccuuggcaugggauuaucauuugcccuuuuauacucaccuuaaacuacaaagaucauuuguuugccuuucugaagaaaggaagguggauaaauuuugcaggagacuuuaaaaauucagcucaacuccuggcauuaaagacaauaaagguggugauucagagguccccauggcaguuuccccaaauauuacguuuaacuaagaucaucucaagcacagagagacuuaacucucuaaagugugauuuuuaaaccugcacacggaaauuuucuacauuuuauaugcucaagauuucuugaaauccaggguguaaaacugugaaaauaauaguucugaaccuauuuaugaaagcaggagagaauugcuuuguucaguuuuggaaaccaccagggugcaauuuaaugcuccaggagaggguuuucugugaccuggaaagguuggggugauucccguacagugagucauuuacuuccuucuuggcaggauuaugcccagggcuuuuaaacgcucuugacacuucacugccuuccauaagaaacggguuuagggcacaagugucuauuaugauaagaugccagauuucuagaucaagcauaaagcuguggagugggacaauaggacuuaauaauuuuaauacacuucccacgugaacugucaaguaauaagcuacauauucagacgugacuggcauugagucauccugccauuagucaaauguaugagacuuuucccaagucccagcaacaccaaauuugagaaaucguauaaaagaaaaaugaaaaaguaaauacgucuaagaaauggggaaaucaauaaaaaauguacuagcaccaggggcgguggcucacgccuguaaucccagcacuuugggaggccgaggcagguggaucaccugaggucaggaguuugagaccagccuauccaacauagugaaacccuucucuacuaaaaauacaaaaauuaggucggugugagggugcacgccuguaaucccagcugaacucaagaggcuggggcaagagaauugcuugaacccaggagguggagguugcagugaguugagguggaggugcaccacugcacuccagccugggcgacagagugagacuccaucuccaaaaccguguuagcuuuuaucaggaaaggccauuaaauuuucuucaauauuaccuacaucaauuugacaucaaacuauaagaacacaauaugugagauguuuugaaauuaaugaaaugaaucuucucuuugagacgaguuugugcacgcuaugaaguccauuaaauauuuucugggaagaguucccaguuaaaacuacuuucuaaaguacccaagcacacuauauagauacaucaaguagguuuauuaaugucaguauuucggugaaaauugggaaggccacuauucugaguagagagguguuuguuuucuacuugaagacuaugaaggauauucugcacuacugggccuauuucugaaauuguaucuagcugcaaguuacucauuaauuuaauuaacaaauauuuauuagcaaccaaauuguggcaggaacugugccuagagguagaaauacauuacgcucuuguuuccagagaggaaaaugaguaauguucuaaaauguaaaucuuauguuucucuuuccucuugcuguaaaugaugucuaagccauuucgguggugccuguucuuaauccuuuaauaaauuauuuugaaugauuuuuuaaaaggcagugugauugugaggugaguuuaguacaaauuaaaaaaugucacaucaguugcaaacagacagcacauaauuaugagcuaaacacuguuucagaaacaguagugacaauaaauaggauucgguauaauuaguccuccugggacagaucucuuccucuguucuuugccauauauuuuaauaaugagauuagccaucuaaugccaauauaaccagacuguaguauuaauacacagaaaaauuauugcuaguaacagaagauuuaaagacaugagggugauccggauuauaugccugcagguuaaaaaaaaaaaauguuucuuaaacucucuuuaucaauauccuuuucgugagccacugaauucuuuuguuuuucugaucauaugaauaacccgucuuaaguaugaauauugugacaauaguaauagcaauuacuuuaagagaauauguuucuauagagauaacagagggguuuuucccuaccauuccuguaugaagguuucuguguuuuuaauuaaaauuuuaagaaauucaucuuugucuuagcauaauaaaauaaaccucacuagacaaucaggacaccuuguuauucuuagauacauuauuauagcucaagaaauaacaaauguuaagccuggaggauuuguauuuuggccaaaaguugugagggcaauuauuuauuuauuugagugaaauaugcaggaaucauauaucaaaaggagggaggucuuuuuuuuaaccucaacaaaaauauaaaaguauagggaacuguuaucuaugugaacccagcaaaucugagacaggucucaguuaauuuagaaaguuuauuuugcccugguugaggaugcaccugugacacggccucaggaaguccugaugacaugugcccaaagugguuggggcacagcuuaguguuaugcauuuuuagggagacaugaggcaucagucaauacauauaagaaguacauugguuuggucuggaaaggcgagacagcuugaaacaaaaagcaggaagacucgaaguggggaggggccuucuaggucagagauaggugagaugaacaguugcauucuuuugaguuucugauuagccucuccaggguagacaaucagggugauuggcucuaagcaguucccagcuagacuuuucccuuuagcuuagugauuugggggccccaagaauuauuuucuuuuuacaccuguguuuuuucuuucuuaacuaaaaauaguauuuguuucugagggauagagauaacuaccauuuuauuugguaugauuuauuugccuaccguccaacaaagaagguaaucugauuuuguuuucauuuccaagcaugauuccuagagauguguuuagguggccaaaucaaugaagcagaacccugcaaauucauuuauugggagauauccuaaggucuuccugaauuaucugauguucccaggcuuugcuuauccaauaggcauuaggaagaaaaggcuuguguuuauguagaugcacacaaaaugcgcaucucagcuuacauaaacagugaagggguuucccaggucucauuaucccuggaggagcugaggccuggggaguccucagagccuccuuugcuacucuguuauuguggcaggccaaaucucacuaaugcaggccuccguaacagcuguuuccguacugacugagugguucaguuaaauacuaaaagcuaaaaaaaagccagcgcccuuauacagaggcuggaauguaacaaaagcccaccaagaguuuugccuaggccuuuccuggcaaaaccaaggaauucuuaacaggacccauuuaggauuaacaaguuuuacugggagucugaagaaacucuacaggccuccaagaacaaguuuacuggaggucugcaggaacuccucaaaccucccugauuuagcaggagacaagauaagaguaaucaccccagcaccuagacccauuuagauuaaguaaauuuacugagacuccagaggaaggucuucaggacucagaccuuaguuauggauuaaagaaguuaaucacuucugucaugagaugaaugcacacuuacacguagacauacagcuuagaaggcauauaaguucuggaaacuuuguaauuuugaguuggucuggcacuaauuuccaggccaucucccuguaaaagguuacaaaaauaaaaacucucuuccucccaguucaucugcaucucguuauugggcugugagguauaguagcccaacccucaguucaguccgggaacauuauuaucaaacucuggggauuuucaggauaaguuaggaauauauuuugaaggagaauggcaguauuaaaugagaucagcaauugaaaacaugugaauacauucaccauuuaauuacccaucucaauagaagauaaggaugaauuuagcacuagaaaccaugaaugucacaaaagccuaacuuuaauaccuugaaucacuuuccaguaauccuaauccuuuauccacauggauagaggacauuccuaucuugcucuuucuucuccccacacauuagcuuaauaauuagcuaaauaauuucaugcauuagcuaaggaauaauggaacuccagaaaccuaggacaguaauugagagacugaacaagcuaaaucugaaccuucugcacaauuaaaggagcugauguuagcauggcccacagaauauuaccugcacuuguaaaaacuagaaagucaggcaaguacuccuggaacagacugucuuuucuaaccaugcacuuauuucuuuguuuuuaacuuuguuuuuguuuguuuguuuuugagacggagucucguccugucgcccaggcuguagugcagugguggaaucucaggucacugcaagcuccgccucccagguucaaacaauucuccugccucagccucccgaguagcugggacuacaggcgcccaccaccaugccuugcuaauuuuuguauuuuuaguagagaugggguuucaccauguuggccaggcuggucuggaacuccugaccucgugaccugcccgccucggccucccaaagugcugggauuacaggcgugagccacggcgccuggccuguuuuuaacuucguaaguugcuuuguagaacuaucuuaaacuuggucuauuuuagauucuccuugaagggccagaucacaaagugauuaggagaaggaggcucuggagccaagacagugagacuaacccauucuucaaaucuaacacuaacuagcuguguaaccauugggccagggauguagccuauguaaccacaaucuccuuugugcuucaugccucaccaauaagguggggagagcugcuaugacucugucauagggcugagacgaagauuugaugaguuaccagcaaaaagcauuuaauauacugucucauucagaagcagucaauacacauugaacucuuauuacuuagaggaaagaaaggggucgaugauuuauagauaaggccugagugaaagaaauaaauguguauugaguaucagcaauggacuacgcaucauucuggguaacuaucacugaacacauuuaaucugcaaauacuaucugaaagauacugccaucugaauugcauaggugggaaaagucaaggcuuuugugcuuauuuuuaaauguauguuaacaugaauaauuaauuggccgugcacuggucgcacgccuguaauccuagcacuuugggaggccaaggcgggcagaucacgaggucaggagauggagaccauccuggcuaacauggcgaaaccccgucucuacuaaaaauacaaaaaaauuagcugagcaugguggcacgugccuguagucccagcuacucaggagacugaggcaggagaaucacuugaacccaggaggcggagguugcagugagccaagaucacgccacugcacuccagccugggagacagggcgagauuccaucucaaagaauaauaauaauaauaauuagugggaauauaugcuguuuguugugauaggagaagaaaaggggagauccagauguuggucaucagaaaugaccugcaucuucucuaaauugaaauuuagcuugaaguaguaaugccaaggccagccuggggccauggcauccugguguaccugcuuguuggugacaguccuuuuaggacaaaauaucuuacaaaaacauucauagaugacuaacuggaaaaaaagaaguuaugaugaaaagcaauucuuacuguuuuuguuuuuuguuuuuuguuuuuuuuaauuaaaagacaggcaguuauucucuuucccaggcuugaguacagucgugcaaucagggcucacuacagccucaaccuccuggguucaaauaauccuccugaccaagcuucccaaguagcuggaacugcaggcaugugucacugcaccuagcuaauuuuuaaaauuuucuuguagagacagguucuuguaauguuguccaggcuggucucaaacucuuggcugcaagugauccuccugccucagacucccaaagcaauccuuacuuuuuuaauugaagugcuuuuuuuuuuucuuauuuaaacucuuaaaaauucaucccauuuucuucaaaacaauaaauccuuuacaagggagaaaaaugaaauagagcaacuaagaaagcauccaugaaggccaggaaggaacaucaugguuaaaugcgauuagucacagccccuucugucuccagucuuggaugaauaaugguaacagaacuagagagauuucuaagaccuuggugcuuaauaacaagcaagcaucgagggugguugugcaagauccugaucacacaacucugcauaucaaauauccuucacaaucaacaagagucagccuuuaaucucugauguuuucaaauguucuuuuuuuuuaauucacauguauaaccuauccucuuuucaauauauagagauauagcuuaucagucauuaccucuuuuacuacuuuucuucugagauuuaaaaggucauccucugauuuguaaauucaaccagauuucacaguucagaugagaguuguaauaaguugccaagaacuguugcaagcugugauggcugucuuucuggggauuauagagaagcacauuucuuuuaggaaaaaagaaggcagaugagcccaaguuguuuuauuuuuauuguguauauguauuuguuuucucaaguacaguagcauggccucuguggcaggcauucaccaagcaaauacagagcacccucugggucaagcacuguguuauugggguuccaaauaaagaaaaaagaccaaauccagcccuguggaucucacauuaaagaggggaguaagaaucauagauaauuuaaugaguuagguacauuaauggggauuugcacaguauuucauaggagcacagaaaaaggguaccucguuccaccugagauggcagggagauggcuccuaaguuaacuaagcaaaaggggaaggagaggcacaucccauaggauauggauaacacaacaaaagcuccauuaccacccgccccaccaccacacacaccaucucuggaauaaauuuuguaccuuccaacugguuuucaggguacucaugacacauggguuaauaauagcuagguuugcccaaaugaccaaaauucuauucccaacaugaauuuucacaacugguuuuuuuguuuguuuguuuuaaugaagaagaaauguuguguuuuuggaaaucaucuuacaaaaucauguaguggaaugcauauagugaugaaauuguugaagaccagggaaucuuuguccuuaguuuuuauuaggauggauguuuucagguaaaacuaaaauaaaaaugaaauggaaccaauuagaaagaaaauaggagcacuuaagacgaaauguaauuguugcugaaagaauuagaaucugauagcuuagaaagaacuuaauuaaauuucagaguaaaauaaauacaguuuagcaauggccuuucuccuagaaaaauauaaugucucuuacaguucaguuacuccuuggcuuacaaaauagugguuaaauuuccuguuuuucucauuuugauuucguauguuacauguuacuggugaugggauuaucugugugacauuaccucuggucuucaaaauguacacguagcaauguagucucacauaugccccuugggugcgaaaagagaaggaccuaacuuaaccugacagaccucaaaucuguucucuuucuauagcagaguacuccuauuuaaaaagaaaauguugaguaaggaggacagucaucauauaugucgagaauguuaaaugcucuuguggaagugaaaagcagccgaucuaaguaauuacccauuaagaaaggaguaggagaaauguuuagaaggcagaccugcaaaaaggugacucacaguacguucacaugaccggaugcauuaguggaaccucuaacccaucgccaauggaagaagcaguguuuugcacaaacuugaaaaagaguuuuucauuuuccucccacagccucgucacguguucaauaugcuaaagaaguauguccgcgcagaacagaaggacagacagcacacccuaaagcauuucgagcaugugcgcaugguggaucccaagaaagccgcucagauccggucccagguaagcgugggguauaaucaucuucugcagcuuugacaauccaggauucuugcuucuuggguuggugacaggaucccacgcauucuccgagcaccuauagguguuuucccuauggcaagagcucuuuaacuucugguaaauucuaaaagcuugucuuagagcaauaugugguuuggcauuuucugaguuaugaaaauaacaaauguaaaaaucuuagucuacugcuaacugauugcuaaggaacugauuaaaaccaaugacuaaaaugagaaaaacaaaaguuguauaaacuaaaaucuugaaaacugguucaacugaaguauggcaggcaaucauaaaccuacuggaauguugagauuucaugugagccuaaaugaagcccaguaauaauguauuuuauacuccccgguucccaaaggcugaaaacugggaucuaccuuaggaaaugugaaauuuuacauuuucuugaaugaaagaguuaaauauauauagcaugaaauagccaaucaaauugaaauacguuguuuucuagggggaaauuugcaaagaaauguauuuaggcaugaggguccuguuaagagagccucaguauuaggaaucagagguggcagagguagccuuuuuaauuggcuguuauaagcauacaagauaaugguaaguuucaagaucaagucuuaaaccugagcucaaaaaguuagagaacagaaauaggagaacaagaaaaauaaaguugcccuuucaguucaaccuuuuuaacaguagcaguguuuugucaguuuucuuuuggaaguuuguaucuaccugcagugcuugguaagaaaaauaaccugggcgacagagcgagacuccgucucaaaaaaaaaagaaaaaaagaaagaaaaagaaccauuccuacccccagacauuguugaccuggaguugucauccuuugaugcagguuaugacacaccuccgugugauuuaugagcgcaugaaucagucucucucccugcucuacaacgugccugcaguggccgaggagauucaggaugaaguugguaaguaagcuguucuuuugaugcugcacauggacauguauuuucccccagaggaaaauugaggaagugaguuaucuguuugaggaauauggaaguuaauagaacagcuugccuuuuacgaugaaacugucaggcuggaacuagcuuacuagccuuagcaauugaaucaguucuuaccucuccauacuuguaagacuggaggaaugucgccugacuuaggguauaguuuuguaauaauuggacacuuguuauugaauuauacguggcagcauuuuuucuaauuugcccaaucuuguuauggcucucaaauuaugaugcuuugguacuuuacaauuaauggggaaaaaaacucauucuucaucuuuugagugucacgauuguuccaucuuacaaaugaaaaagcucaaacuuaaaauuugaguaacuuacuggccugugucacaugcauuauaaguagcacagccaaaacacauaacugugacuugugacuuugagguuauuguuauauucaguaagucacaauucucuuugauggcugagcagggaagccaugaguguucucugaaccacaucauuguuuaaacuuaaaagauagugggcuauuaaacuuauauucugaaauaauuguacucucacaagaacuuggaaaaauaguacagagaggucucaugcauccaucacccacaugccucaccagugacaucuuacguaacuauaguccauuaucaaaaccaggaaacugaccuugugugcccacugucuuuuaugucccuaguuuuccuaaugacuaaugauuucauuuaagaucucucauuucuguuucucuuggaaagagaaucaaauaccacaugagucucugucagcugccaaaaugcccauaacuguuuaacuuacuucacaaagguacauagaugacgauuauguuggugcaucuuucaauauaagcauauguaccuauacuggagauuuaguguguagucuaccaacauauaagcaauauguaucuggcauauccuuccccauaaagaauccuacccuuuguuaauuggguuggaaauagauacagguuaucaucuggaaucagagcacccaggauguuguagauggauguacccauuacaguaaguccgacuuugaagugccugaaacaccgcucaagggaacagcuggcccucacuuuuucccauuuuaugccaguguuauucugcucauucuuuccugauuuauguggccuuguaaauauuguuuguauugcugugaaauauuuggcaugugucaagugaugauguucuguucaguacugcacauuaauggacggaaucugaaauuauacuuugagcuacauaacuugcagaagaaacuucauaugucagggaggugcagugucccagaacuuugggaggccaaggugagcagaucaccugaggccaggaguucgaaaccagccuggccaacauggugaaacccccucucuaauuuaaaaaagaagagaaaaaaagcaacuucauagugugccaagcuuuuguucagaaggagcaacucaguguugagcaagaauuuaugaagauaguggagguggaguuuuuagucuacaccaugaauugagaacagagaucuccaauuaauuuuucacuguaucaaguuucuuuagcaaacaaauauacuuuucagguauacuuggagaauagacaucaguaaggaaccuuuaaaauacuauguauuaaauaaguguaaagaaguucuccaaaaaguuguagaagguacaaaaugaaauaauuuaucagucuuaaugaacugaagcuaaaaucuucuagaaaacaugguuuguuuguuuguuuguuuguuuuuuacagcuaucuuaagccuguuuucacaugugacuucaguugaaguggcauagguaauaacuauagggaaauaagccauuacaaaggacuaaaaaguugaugaccaauauuccacccucacccagcaauuauuguugacucuuuauaauuaaauuauuagaacuuuuuauuuggcacuauacuacugaaaacauuagccacuaauuagucacacuuccacagaacagauggugguucagauaucuugaauauuacgaaaugcccaagaauagggcagcacaauaaacuucaaaucucaguaccagggaggauauuuagauaacuaguaucauggaaucuuuuucuguaaaaagaaaaaaaaaaacagccauuagguuggauuaagaacauauuagggggugcagcacaccaacauggcacauguauacauauguaacagaccugcacguugugcacauguacccucaaacuuaaaguauaauaaaaauaaagaacauauuacguaugugcucuuaauguguguguguguguguguguguguguguguguguauguauguaauaugcucucaauccacccauuaguuggguuuuuuuaaguaaugacauauauaucauucuaaauauaccagaugccacauucugaaagauaaucuuuuuuaaaaaccuuucauuuggaauccugggugcuuccauuuuuaaaugacuguucucuauagaaagagaaguuugcaauaacgaacccuguacacuaucugagcugcuagugucaaagcuacagaagugguuugcuggggagaauagcuuuucuggguugaaccuaguugucaucuauaguccuuuuucauuugaaggaacauuuaaaacaauacgucccuuuuuaguaggaauauaguugaaacuucaagauuggccaggggugcuaauugcuuaagccaaauguuauuagagguuccucauguuauucuuuuuacuuuuguauguguuuaaaauuucucauaauaaaaaguguugcuuuuagcuuacuuucuaaauagguucuucauagauuuuuuuuccagguuaugucuuguagucguucuaauauucucugauuaaaugcuuugucauuagucugaguugcauuuauuugcuauuucuguauauaaucaaauuuuagauuuggagucaguucaguacaaauagcauacuaaaauucagagacacuggcaaaaggagaaaauuuuaaagucccuaaaaaugcaugccuuuuguauagaaguuugugcuuauaaauacaagcaauuaggaugugcuuaaugcagucaaacaucuguagagagauacaaugguuuaauuaaauaaugguaacaguugcuuuauggauaagagguuuucaccagucuggggaacugccaguaucuuuagugggagagguauaucugcuucaguaaauuaugcuuccaauuagaauucucuuuuaugggugaaaaugaggaagaauggagucaugcugagaagaaggaaugcuaucggugaaggggaaaauugacauuaaauuugugagcaguaaacugugaccagagcauaggguucaucaugcuugugaguucuggcccuggccuuguaucuuccauugugcuucccugaggcauccugucuguucaugcuacuuucccacuaacuucagugaaucccaaauucaugggucuagccacagccagcguacugaaucccagugccauauuccagaccccaaauaucccaugugccucugaaccugcaaucaauguguauaacacucauguccuucuggaaauuuacuuguuuuacacacucuauucugaguucucuugguuggccuaaacuauccaugaugccuuccucucccucacccauuauuucuuauuaguugcaaguucuguauauuuggccuucuguguucaugugaaaucucugcacauccccuacuuaccugagauccuguccucucaucagugucauuagacucccagccagucacccuaccucuuaucucacauuggcccccucccacuucaauuccuccuuuucggaacuaugcaaguucccuuaaaaacaaaagacaaaacaaaaaaaacagcugcaggccggcggcaguggaucaccugaggucaggaguucaagaccagcguggccaacauggugaaaccccaucucuacuaaaaauagaaagauuagccaggcaugguggcaggcaccuguaauucccaguuacucaggaggcugaggcaggagaaucacuugaacucgggaggcagagguugcagugagccaagauugcacuauugcacuccagccugggcgucaagagcaaaacuccgucuccaaaaaaaaaaaaaaagaaaaaaaaaaagcugcuugugguuuuuccuugcuugaaaaguugcaccuuucaagauucaaguaaaaugcccaaguccuauaaacccuuucuaauuugcauagagaacggagaaaagagcuggcauuugagugacaaccauguaaccaacuaaugagugccucuuugugauaaugcugauggucacauucuuucuuuaugaauguuccccguugagguacaggaccgccauauagagauguggcaguggcaggugguuuaggguaagaguggagacugauaauuuuauucuacaucccacucaaggagccaagcccucuggcauugugcacacccacuggaagugggcuguucuugcauuucacacaaaggcagcauaugggcuagugaagauacucggaaauucagugauagcauccccaguuuacaguugaagaaauugaacuuugaaccuaagagaguuugccaacuugcccagcccagauaguaaagugaugaaagugggguggaagccaagaccugccagaaguccaaaaucuguguucuuucugcugccuauuuuccucucugaaguggaauuuuccccuacuuaaccucaaugugaaagcacuggguauccaccuccaauaccauacucuaacuuggaguaaauuauuuguuuauaucucuacuaacccuccauccugugaacucuuccagauauauguuggucauccuugccuccucaagauccagcaaggacccugguacuuuuuagauauuaguaauuauaaauauaagguugaagccaguccccaggauaaaaaggcagaugcuccuuaacuuggacugaugaagugggcuccuccguaacccuaaagaccugaccaaaacuccuuccuugacaucuagcguaagcaccacacaaaacaaauuucuuuccuaggccacagcauccucuaaagcugugauugaucaagcuaacuaaauggaugugguuggccaagauaacaaagcauaaaucaggguucugaggaccuuuauuaauaaaauuuuacaacaugguccuucuuuguaccaugacccucugcuauuuggucaucuacuugauuuaauugugcuguccuguuugaccgccaaccacagucugaagcuauucccaugacaaauaagugugaauuuucaaguguccuguuguguuauaaaaggcccguguuuuauuuuauaauuucauauuuuuuucauucaauuuuaauuauuaugugcaaguucccaggcucagucauuuauuaauguuuuuauuuuuuaaaaaguuauuuucaggcagauuaugaagauuucuugcaaagaauggccucaggcauuguuuguauagagauaaaaucuccucuuuuaaaucacuauguaggucuucauuaauauuuuuucauucaacaaacgauggaaucauuauuucagugaaacuauggcuccucuucaguguucauauucugcuuuaauuauuuauuaauccuucaaaagggcagaaucccuucauccuuucaaccuuugcuuugucaaauuguuacuuaaaaaugaugguguuuucuuuguccuuuguaaucuuccuuaaaucucugcuaaaaggauucuauucuacucuuuguauuggcacugagguuauuuaucaaagugugcuucucuuugcagcuaccucaaggcuaaaaauguagcucuuuucagagauggcuguuuuacagaaugcuauaauaaccaauuuaugagaaaggcaguaggaaauaaagagggaacaaaggcauaauuguuucauacccauuuuuuuucuucuagcauucaaaauuaauaaaaacaugaauuauuauaaaccagaugcgggaaagaucucuggcugaauaaauccauagugaauggggcaggauugaaagauauggcggggaaucaagaaauucgcaauaaugaaaggaugcuuauuuuuuauuacaauuuuacuguggccucuugauaaaauguuccacucuucaggaaaaaugcagcaugguuauuucaaagacaguguuuccauauucuguuucuaauaagccuguugauuuggggguuuaguggguccaaaguagacuagguuuaaaauagaauauuuauagcacuucccagcccaacaaaauagaaauuuaauguuauugagaauuucaaguauccuuauguguaauuguuagucaaggaugaacaucaaaaaaaaaaaaucauaacagcaaauagagagcugucacuuuguucuuauaagaacauaggugugacuuuguuuuucauaagaaaugacuuuuaaauguauauagauuuaaugguuuacagcugacuuaaguauuuggacauaagaacuuuuuuuuuuuuuuuuuuuuugagauggagucuugcucagucacccaggcuggagugcaguggcgugaucucggcucacugcaaccuccgccucccggguucaagugauucuccugccucagccucccaaguagcugagacuacagacgugugccaccacaccuggcuaauuuuuuuguauuuuuaguagagacaggguuucaccauguuggccaagcuggucucgaacuccugaucucagguggucugcccaucuuggccccccaaaaugcugggaauacaggcgugagcccccacaucuggccaagaacauuuauacauauuaucaacaaccaaagccuuguucccccauugguuucauaauagucucagagcuccuuauucauauuuucccuaguguuauuaaguaacagacaugaggccuguaaguuuagcugccugugucuaaauguauaucuuugacccaagacaauuucucuuucaaaauagaaccacucauuuauaaaugaaaaugcuuugucaaaugaauggcaaaguacgguauacuauuaagacagccuccuaguuuucugacauuuggacugccauguugaaaugucuccacacagcaagauacaaaugugugaaugccaguacacuucauaccuuagguccccaacuggucugucugcagacuugagguuacagaccugcaggugucgaacucaccccauaguggugguuaguagagugcuuuguauacguuuagcucucuaugccuuuuuugguugugauauuagguaagcucucuuuuucuugcuuuggagcuuaauuauggaaucuguaaauauagugcauaugucauccagaugaucuguggaagucauugauaaugaccuuuaaaaauucacauguaauacagcauccguuuuccugaaugauuuuuauaguuuuaccauuggcaaacagauacuuucuuuuauguauuucuacuccauaauuuuaggaaaaaguaaauccuuuuagcuacauuaaaaagaauacacuuucuaggaauaaugaauguaaaaaaaguuuccuuuuuuaaaaaaauauugcgcucucuaccauucuggcagacaaauuguugaccuuaauauguauaauucagugcaguauauugaucuuguuuauugugcuccaaauggacgcuggcagaaauuugaggaauuaaauaucaaccacaguguuuucuucaugcgauugcaaugguuuguuauggauuauuuuguucaguucaaauaaaugauguacguucagauucuuugcccaauuuuuuaauuggguuguuuaccuuacuuucuuaauuuuauuuuuauuuuuauuuuuauuuuuauuuuuggagacagagucccgcucugucacccgggcugaagugaagcggcaugaucucaguucacugcaaccuccgccuuacggauucaagcgauucucgugccucagccuccccaguaguugggauuacaggcacaugccaccacauccagcuaauuuuuguauuuuuaguagagacaggguuuuaccauguuucccaggcuggucucaaacuccugagcucaggcaaccugcccaccucggccuuccaaagugcuaggauuacaggcgugagccacugcacucggccugcuguuauuauugaguuguaagaauuuuuauauauucuggauacuauuaaauucuuaucaaauacauuauuuggaaauauuuuacccauucuguagguuguauuuucacuuccuuaauaggauccuuuugacacacaaaaauuuucaauuuagaagucuauuuuaucaguuuuuucuuuuguggcaguuacuaugguaugguaucuaggaaaccauuguccgaaacaagguuacaacgauuuauaccuguuaccuucuaagaguuuuguaguuuuagcucuuacaguuaaaucuuugauucauuuuaauuuucauauauggugugagguagagguuugacuuuauucuuuugcauauaaauauccagugucccagcaccauuuguugaaaaagacuauucuugccaggugcaguggcucaugccuguaauuccagcauuuugggaggccaaggugggcagaugacuugagcccagaaguucaagaccagaaugggaaacauggcaagaccacauuucuacaaaaaaauuauccaggcaugauaacaucuauuuguagucccagcuacucaggaggcuguggugggaggaucuccugagccugggguggcugaggcugcagugagccuugaucacgccaccugggcaauagagcaagacccugucucaaaaaaaggaagaaaaagacuauuauuucccccauugaauggucuuggcacuauuacacaaaaucaauuguccauagauaauauggguuuauuucuuaauucuuaguucuuuucuuugaucugugugccugugcuuacuguaguaccacacuguuuugauuauuguagcuuuguaguaaauuuugaaaucagcaagugugaguccguuaucuuuguucuucuuuuucaauauuacuuugaguauccggagucucuugcauuacaacaugaauuuuaagaucuuccucacccccugcccccacuaccauuucugcaaaaaaaaaaaaaaaaaaaaaagugcggauugcauuggaucuguagaucauuuuggggaauauuuauauauaauguuaaugagguuuuaaacaacacuuuuaucuacuagaacugauauuugccucgaaaugauuccaccuugagccccauucaggaacguuaguauuuuagaaguagcaagagaacugauuuagcaugcuaucaucuuuuacuccaaauuuuggugagauuccagagaaauuauuugugagcuuuuccuuaagccaugaugacugacaugucaguaguuuuugucuguuuuuaugccauucuuuuauuuuugugcaugugugggcaccucaaccaaauggauggagccugaggcauggucucccacgccaaagucugccguuucuuuugaugauccaaugcaguuccaaagcuauuuucucaacucaccagcucguuuguauggcccuguaauuugaaacaaaaucuaaaaagaaauccaaauuaaaaugauugggaagugaagucagaccacagugguggcuguggaacuacuuccuggcauggaacacuagagcagauguguccugcuuuuuuuguagagucuugggaacaaccaaugauuuuagacuggaacaagggcugguuauucuguuuuucacaagcaucugccuucaagguucauuuuuuaaaagaggaggggaaaaaaaucagugauguuugccacccugaguauggagaugaauccaaauugagauuaauuuugaaauauguuucccgaauuuugagauuaauuuugaaauauguuuccacaaacacuaacugggaaugacaugaguuuguuucaugugagacggaguuuggaagacauguuaauuugcuuguugguguucaacucagaaacaaauuuugcauguauuuucugaguaagugccauuauuaguuaacaguuuuccugccguaugcacuaugggcugcuuuagaaaguaaaucauagaagguuaguuauaauaucucaucaaaaauaguggauccaucuauuaaccgguuccaaguuaugagacguguccaaaggaauguugacuuggugugcaccuaaacacuauuugugaagaggcuuuggacuucgagcaugaaacggggucagagggucaaggccagggcguuacuuaauuucagcuccuguugauggauucauugacuucagauagugcguuuaaaaaagccuguuuaauguguuugucuuuugauaauuauuauguauuuacauaugcuccuaaaagcaugaguuaaaucuuauuucuuugaaacagugcuuggcaacaacuuguauugucuuguacaugccuuuugugucuuugcuuuugguugggggggggcauugaaauuugucugcccauccccugagggcagauacugagguguggaccuaugucuucagcuuccuguauagcauugaaguugcuauagcugcauguucucuaaaauuuuuauacaugcgauuuaauuguuaaagcuuaugauuuuuaaguauaguauucugauagcaaauagauuuugucaaauaaaaacuaacuuuaucaucaccacugagauaucacuagguauauggcuuaguucucagucaccacuuuuauuuguaaggaagucuuagaaguuuucacaaguguauaugugauagacugggcacaguggcucacgccuguaaucccagcacuuugggaggccgagucaggcaggaguucgagaccagccuggccaacauggcaaaacccugucucuacuaaaaauaaaaaaauuagccgggcaugguggcacaugccuguaaucccagcuacucgggaggcugagguuggagaauugaaccuaggaggcagaggcuguagugagcugagauccugccacuucacccuagccagggcaacagaacgagacuccaucucaaaagagaaaaaaaaaaaaaagcugggugcggugcucacgccuguaaucccagcacuuugggaggccgaggugggcagaucaccugaggucaggaguucgagaucagccucaacauggagaaaccccgucucuacuaaaaauacaaaauuauccaggcgugguggugcaugccuguaaucccagcuacuuaggaggcugaggcaggagaauugcuugaaccugggaggcagagguuguggugagcugagaucgcgccauugcaguccagccugggcaacaagagcgaaacuccaucucaaaaaaaaagaaguauauauaugaugcuugcuuuagcagcacauauacuaaaauuagaaugauuaaagagauuaaccuggccccugcacaaggaugacaugcaaauuuuguaaaguguuuuauauggaacuuuacuuacaugagguaccuaggguaguaaauucauagauacagaaaguagaaugcugauugccaggggcugagaggaugagggacuguggaguuaguguuuaaagggcacagagguucaauuuggcaauauugaaaauaguucaguggggaagauggauggccgugaugcaucguccaucacauugcacagcaucgugaaauauacuuaauacccugagcguuacacuuaaaaugguuaaaacaguaagauuuauguuauauauauuuaccaugauaggauauauauauguauauucauaucauucgccauugugaauagcaaggagauugaagaaauaaggacacaggaucuucaauaaauauguauuaaaugcuucccauguuccacauucuuugucauugccagacacgucacagguauaagggcccaaucuuuguuacucaaauaauuuagaauaauuuagaauuugcuuggggagacuuuggauaaacaguuaagaagcuguauccauuagguaaagggacauugcuugcugcgucucguagcauuugguagucucguuagacagccguucuuacuccuaucguuugcugaaauuuauuagcaaaggaaagaaucuuaguuuucagcucguucagccgcaugauuucauaggcucaggaaaaccauguaauaugcccaaggucagacgugaugaauaagacuaaagacugaaucuauuccagugucucuguguccagugauacuuacuuacugcuguugccaaguuaaacaaaacuggguuugcagagcuguuuauucaccuucagcaucuuuucauugaaaaugcgguagauagaagaaaugucccucuuuuagcauuuguaccucaguaauaagaugcuucccaagcucaaagacuccacacccuuaaauauguaagucaguguuaagauauuuaaagagaacaugaauaucagcuacauugugcauguugcaggaauuuuauauuauuuuguaucuucugcuuagaagucauaagccagcccaugaaccaugccaacaaacauaccuucuuccaugugauuauugcagccagauuuuucagugcaggacaagcaaaguuuucucugaaagcaugagauaauaauucucagccaggucuucgccauuugcaagggaucagacauaagaguuuuuagcucuguugauguuaauagcuagagccccuguuagcagauggcauguuaguggccuguugcugcuggcuauuaaaucauacacauuggccaggcacggucggucacaccaguaaucccagcacuuugggaggcugaggcgcacagaucacaaggucaggaguuugagagcagccugaccaacauggugaaaccccaucucuacuaaaaauaaaaaacuaggcaggcauggcggcacaugccuauaaucccagcuacucaggaggcugaagcaggagaaucacuugagcccgggaggcgaagguugcagugagccgagaucacgccacugcacuccagccugggcgacagagcgagacuccgucucaaaaauaaauaaauaaaaauauuaaaaguaaaugauacacaucaugagaucaucucccaaggcagcagagaauuuugcguauuuuuuucuuaguuuauauuguugcaacagaguaauucuucuugaucacagacuuugcuuuuuuuguuguuauuguuucuaaguuucacuugauccucaaaauaaccugagacagacaaaacagauagguuuucccauuaaucuccuucaugagucugacuuugccagccaggcugaucuuauauccauagcccuggaugcauuuauuuauguuauuccaucugccuauaaugcccauccccaaucuuggccuauuacaugugucuaacauuacuuugauguguacaugucagugaauuaccacuuaacugauuguuagcuuuuugagaguauguaucaaaucucaugugcauuuguguguccugaaacaaauuauuagguauaaaguauguauugcaaauaccaugcccagggaauauuucagagcugugguucuccaagugugguccuuagucuagcaacaucagcaucgccuggcaucaccugggaacuuguuggaaaagcacauuccaugaucccaccccugaccuccugaaucagcaaagcuagggauggggcugagcaaucuguauuuuaucaagcuguccaggugacauugauaaaugcuaaacuuugcgaauuacugauuuagagacuaaucaacucauuaaaaaguuaauaaauaggugagaauccauuguagcaccccagucaccuaugcuauuaucuucuaaauucacauuauacaaauuguaugccacaaaaauguuuaaggugaaaacccaaaggaauugaugcauuggauuaauucacaaaaauuuaacagcugcaauucauagaaaaaaaaugcaugcauaucugauaauuaguuguagauuaaaaggugaacaacuucuuauuauuaauacccaaugaaaauguaauuuuuuaaaaauuauggccaauugguaguuuuuuaaaaaucuguuaugccuugucaugauaaggauaggugaaaaggaacuuucauaaacuauugcuaaguauaugggugaaaccuuuuagacuauuugggucuaccuaauaaauuaaaauguucagucuuuucuaauuuuagcaccguauuucuacagauacacuggcauaucuguggagaggggcacuucugcuugucaccugauaucccuuacuacuacuaauauuuuuauaagcauuauuaccuuuaaaaucauguuaaaggguaaaugaugugcaacagacucaguuuccccuucucugacuccuguuuaguuuacaucucuuuucucucucucauuugggggcucaauacccuuaagauuauagagaaauugcaguagguaauguuggcuggaaaugcuaacuuguaagaaacuuggguggaaaugguuuaagccaucagccuaaacgaucagugaaaaugucagacauucuccgcuuucuucuuccaagauacuauacucuacuguggccuuagaguucuuaauuccuauauaauucugauuaaaaaggaaggagaugcuccuaauauaccuugcuguuguccccuccuguucauuaggguagcugaugucagucaaaauaaagucuagaaauucuugaguacuuuuuuuuuuuguaauauacugagaaugcuugaagcaaacuaaccaaauuuaaguguuuuaaggauauuaacaguaacaggagagccccucgauuuucugcuaagaaucaaccugaacaguuuccagacugcugguuggcaaugucaguaucaugagaaaaacugaaaaaauaagaaacuuuagagaaaaagaggaaucagugcaggcuaggggaaugaacuugguaauccaguagucuuucccugccagcauuuugauugauaagcuaagugucugcuuuuucucaucccuuauuuuuuggcaggaaaccaguauuuugauacuugaaugccuucuuucuaucuuaagggagaagccuucuuaaacuucaagugugaaguagauccuuuagguauaggaugaaaaauuaagugggacuauuugugaauuacuaaaucgcaaccauuaaagaaacuaaugcccuaauuagccugucuuuugacagacauggcauccauauguaagucuaauauuguaugcaaaugugagacagguuuugcuuucuagaucucuuugaugugaaaggaaaagcuggcuuccuggcuuccuucccauguucuguauggaccugccuucauccugcugccaacagcuccucaagggaacaugaaaguggaauuaaacccuccugguuuucagauucagaauccugggugauuaaguggcuugaucaaaaucagaaacugugaaagugcuaaaaauggucaaggcccaaggaguuccucauguguggucaaaagccuuucagaaaucaaagugugucuuuaaauaccuggggugcaaaaaucagauguuuuuuauuuaaagaaaaauagguauauuagagcagaacugggggcccucuguaggagccugagucuggguguuuacugucgucuaaggccuuguuaaugugggcuugaggcuucggaauccacgaacaggggaagcuagcgucucucgcugacuccaguccuagcucgagcuuuccauacugcccuacgugacuucugcacuuuugugccaucagccaguagacugagaaaaguaucugguauuugucggugucuucgguuuagcugcuuuaaguccuuggauggaaaaggcugauugucauccugaaaucauugucuccuaauguguaauuggggccaagugaagcacaguaauuuagaggaauucuaguuaaaaauacagauucuugggcucuaccucagaccuacagagaucugcauuuuucuuauucccccaggugauccuuuaaacauucagagguuuuuaaaacucaugcuuauaugcaauaacaaaaauauaaggauucuuagaaacuuguuauauuugucuugaacaugggaugacagacauugucauuuucauugaaaaaaaaaaugaagcagagacucagaauguauuuagagacaacucuaaauacauucuggcagagccuaacuacuggauugcagagauccucccugcuucccccaguccccaucuauaaacuggccaugugaauuucuagugguguucacuuccaaaguggugauuuuauaaaauauuacaaugaagcauuauuaaccucaagaaguucagaugcauagagaguuuauuuggguguggcagcauuaguggcuagguuuuauuuauccaagauaagacuucuuauuagcuaugaaaagggauuggcauaaacugcuuauuaauguccauuaacuguaucuaaagggaauaaacaguauaaaaggccaggcaugguggcucacaccuguaauccuagcccuaugggaggcugaggcaggaggaucauuugagcccaggaguuuaagaccagccugggcaacauggggagacccuguuucuacaaaaagucaaaaaaauaauaagcuggguuuagggguacacaccuguaaucccagcuagucaggaggcugugguuggaggaucacuugagcccaggaguuggagguugcagugaggccuggcggcaccacuacacuccaggcugggugacagagggacgaccuuaucucaaaacaaacaaaaacaaaaaacuguauaagcauaagaugggcuugagucacaaaauucugccuuucauaacuuucccccauuugcuguuugauuugcuguuucagaaauugugaaccuacuucucuacuuauagaacauuuaccucccucuuagauucuucccuuucuaucauugauacugacauucugcuuaaagaauuauccauuuaggcucucuucaaauccaaagugauauuauuuuauuuuaauaagagaugaaagggaaaauugacaaaaugugccuggaguugucagcauuguaaaugauggacuguaaaagcuucgucuuggaagauugucagagagccuagugccagcucaaaaaguguggucuuuuuagagaauugacagaaauguuacaaagaaaacaugugcugaauaccaacuccaggugcgaauccugagaagcaacucacucuauucugcaguaggagaugaauuuugcagguuauacagcagagcaauuuaaacucccuuguuucuuaaaguauauccuauagugacuugggauggaagucauauacuauccccuuuuuuguuccuucaaaguaaauacaccacagagcuggagaugucccagacacagggggaagcuguuuggauuuuucccacugccuguaaugaagcaagauagggaggaagaacuugggaacuugcguggcaaauggucaaguaaagaaaaagaaaagcuuuuucuuuacuugaccauuugucacaugugcuuucaaauccugaacugagucacaucugaaauaaaucacuuccuugucauuuccaugaaaggggcaguacaagaaauuccuugcacaucccuggugagccccuuguuacucucagauucagcuauugccuucaggaaaaaaagaaaaagaagccgaagaaagaaagaaaacagaauccucuagaaaaagcuauucugaccugugcucuuucuuuugucugagugugacuagauaaaugcauuagucugcuagggcugccauaacaaaauaccaaaauaccacagacugaauccuucaacaacagaaauuauuuuucucaugcuucuggaggcuggaaguccaagaucaagguaccagcaggucgguuucugaggaggccucucuuccuugauuuacaaauggccaccuacgcaucauguccucacauggucuuucucagagagaaagagaggugucucuuccucuucuucuuuuguuuuguugagacagaguuucgcucuuguugcccaggcuggagugcaauggcacgaucuuggcucacugcaaccuccaccuccuggguucaagcgauucucgugccucagccucccgaguagcugagauuacaggcaugccuggcuaauuuuguauuuuuaguagagacaggguuucuccauguuggucaggcuggucucgaacucucgaccucaggugauccaccugccuugcccucccaaaguucugggauuacaggcgugagccccgcacccggccuccuccuuuucuuauaaggacaccuguccuauuggaucagagucacacccccaugaccucauuuaaccuuaauuaucucuuuaaaggucugaucuccaaaggucccuugaggguuagggcuuugauacaugaauuuucaggggcacacaguucgauccauagcaguuggcuuauucauacuuuggguagauccucuucaucguuccucagcuacugucuauuuagugcacagcuucuuuauccuaaagcuagucaggggaggcauggaagguauuauuucuccuguuucugcaccuaaggcauuaaaacgagguuguggucuggcagccuaaacucggccuugaugaacuucaaauccuagaccuccuugguaugugaagugcauacacuuguauggagggauuugacagguuuuuuuuuuuuuuuuuuuuuugagacagagucucacucuguugcccaggcuggaaugcaguggcacgaucucggcucacuacagccuccgccucccgguuucaaaugauucuccugccucagccuccugaguagcugggauuauaggcgcgcaccaccacacccagcuaauuuuuguauuuuuaguagagacgggguuucaguauguugaucgggcuggucucgaauuccugaccuuguaauccacucgccucggccucgcaaaguguugggauuacaggugugagccaccgcgcccagcccagauuuuuuuaaauuaguuuuuaguguauccacacuguuaaagcagguggauacugcuggauaguauaacaaaguauagugugacaaacccauaaccaagcauuguuagcuauauuuucucaugucuugagccaaaaggucacaguuaaccuaauguugcuacuaaacacucauaccauaaaacauucuauuccagucuuccagauuuuacacaagaauaaaaugaaaacuuuuagacuacuggagauuuuuuuuuaaauacacaauuuguugaaugugaacgcuaaauugaaauugacaugcuaaguuuuauagauuacuucagcugcccugacuucaguaaauuuaguugugacacagguacaacagcugacuucuuucuggcauuagagguggugauguuucgucacucuggaguuaguaaaaccugaaacccgccaggcauuugacacacaguuugcugccagggacagcucagcuucuggcuuauuggagaggaaaugaccuaaccucuguguuuacaaaguguuugaaacugaggcccuuccacuuccuugcugaguguaaggguugaccuggcauccaaaauccccaugaucuucucaggauaagucaugcagccauugguggucaagaaaggauuuguucccuguggaagggcauuggaagaggaacagagcugaaacacacggguguucagagggaaaacaucucugcacuuaagagggcuagauuagacuauuagacuauuaucauagagcucgugauucaucuccuuuguuuaauuccagccuugaguaaaggacucacuaagaaaccacauucggccggguguuguggcucacgccuguaaucccaacacuuugggagaccgaggcagauggaucacaaggucaggaguucaagaccagccuggccaauauggugaaaccccgucucaacuaaaaauacaaaaauuagucggggaugguugcgggcgccuguagucucagcuacucgggaggcugaggcaggagaauugcuugaaccugggaggaagagguuacagugagccgagaucacgcuacugcauuccagccuggugacuggagcgagacuccaucucaaaaaaaaagaaaccacauucuauuccaguauauuuauuauaaccagaaauucuugucuuaucagcaaauagcuaauauucacuuacaugggcaguguauuagauuccuagggcugcuggaaccaguuaccacaaaccgcauggccgaaaccaacagaaauauacucucauuaucucauuauucuagagguuagaaguccuaaagcaagguguugccagggccacacugccucuuacagcucuaggggagaaucuguuucaugccuuucgcuugcucuagugcugcugccagcccuugauauuccuuugguugguacaugcaccccuccaaucuccaccucugucuucacaugguguuacuccccaugucucuguuucugugucuucucuaauaugauuaagggcccacccuucuccauugugaccucaaucuuauaucugcaaagacccuguuuccaaguaaggcuguauucuuagguguaggcauuaggacuucaacauauauuuugggggaaaauucaacccauaaugcgguuauguuuuuauuuuccuugacuuuuaagaaugugaacuauugucaaauuuuuucaaccacuaucaaauuuaaaucuaagaacuacaugucuuaaauuuaugaccucuucauuaaaaaaaaaauaauaacauuuaauugguaccaaaacgugaaagaguuuaaugcuuugcauuugcuugaggcugauuaaugaguaaaugugucaacuguggcuguuuuaauuagccaggguuaauuaauguuuaccacacuuggaagaugaaaaggcauguauaaaugcucuauaaugugaaucauuuuuuaauuuguuguugaagcuuauaguguagccaaguaaggauugcuuacaucauacuuacaaagggagguucauuaauggauacaaauacacaguuugauagaagaagcaagaccuaguauuuaauuaucagcaaggugacuaauuuacaguaaucuacuguauauuuaaaaauagcuaggagaaccuaauuugaaaguuucuagcguaaagaagacaggcugggcacgauggcuuacaccuauagucccagcacuugggaaggccgaggugggaaaaucacuugaccccagcaauucaagacuagccagggcaucauagugagaccccaucucuacaaaacaaauauuuaaaaauuagccaggugugauggugcaugccuguagacccagcugcucuggaggcugaggugagaagaucacuugagcccagcaguucaagguucaagugagcuaugaucacaucacugcacuccagccugagugacagagagagacccuuccucaaagcaaaaagaaaagaaaaacauuuaagugauggauaucccauuauacugauuugaucuuuccaaauuauaugaauauauuaaguuuucucauauaaucugaaaauaugcacaucuauuauguaucaauaaaaaauaaaauuuuaaaaauguaaaaaacgauguuggagcacuaugguacuuaacguagaggcucugacuuuugagguacauucauuaccuguuacugaaguugaguaugcuuuaauauuguauguuuagaaaagguaguuacauuuuuaaaucugauuguguaagaagaaaagaguagaaauguuuggggccaagucaauaauuauuuaguauaucauaauuugagaugaaauguguuuuuuuuuuucuuuuuuaguuucaaguugaaacauuuuaagaacagauaaggaaaggcuaacugugcugagaugaaaauaacauuuuuaaaguaacuaucuuaaagaaaauacauuucuagaauuuuguguaaauuuucaacaaagacucagaagccuggaugaggucuugugccaagacuggaaaguguggggauuagaaaaaguuugaagagauuguugugagauccucucguaugaggccugaagcuguacauccauggaaagcaguuaccccaggcgggaaaacagguuauccauucucgagugaguggccgggugggaaauaguccaucaugucgaauggaucguacuuuccagcaccaagauuugugguucucuaggugaauaagaugacaccccuucacuucacuucacuucaccauugucugcauggaguacguaucuaaaaacaaauuagcaaaaagguugggucuacuuuacuuuucaucuccuacacuauuuucuucuuuguucucggcaggaaaagaugaaguugcauuuuauuauuaucucauaggauucuuauucuaaaaugauuugauuuaaaacccauugcacuuuauuuggauaaaaaaugcuucacucucuaguucuuaacaauaacaccagccugauuuuauuacguuaagcacugcaauuagacaauacaaagaauuugcagcaacaacauguuauuuuaucauggguggaacuguucauugucuagcagaauuuauuaccagauaaaucccuuuuggggaaucuaauguggauguuuuuuucaaagcgccuguggaguucugcuaguauugggaacguuuccauuuucauucugaugcuucccugugggcuguuucagcauagaagugagcucucuggguccauguuuccauuggcuccacccaauauucugaaagauugcaacucaacauguguaaacagaaccuuucucccccauauuuucucuuuucguagauuaaacucaggucaagaauuagaaguuuauccuccaccccgauagcaucucgcccuaucccaaauaccgccaccaaaaugcccacuguuuuuccuugggccaguuccugaaauaucuuucuggcuguaucacucuugugugcauccuuaucggcuaugcuuuuggccauuuuuuacugcugacuuugucugguuagucuuuuauaaucuccaggcuucuccuccauccuuuuuuuacaguuuaccuguucaugaagcgcaggucacuugacccguagaauucccauaggcugggauuuugcuaauugcauacucaugguauaggucaguguauuccucugcccucuguaucccacaaacugaaagccucuuggcuaagcugcuucccuuuucacuucccuuguaccacagcagccagaagagucacagauccugggcagcuuguccucugugccucgguacaugcacuuguaucugcuaggacaaugaucucuuucccuggggccccacuguaauaucacuagucacaucccuaaagcccaggcuuguuucuuugucauucugucgguaucccuaccauaacacuuguaauaguaauuauuuuuaugcccaucuuuucuucugaaccaugagcccuucaagugaaaagaaauugaugaaguuauuucuagcacuccccuggaaaaaggaaggcaggcagggagggaggggcucacuaguuuaugauaaagugguuugauuuucuugguugcagauuauuucuuuuaaagugacucuuuucagcuucucucacuccugugcaucgugaaugcucuccugaagacagacgcuuuccauucauuuccaagccccccaugugaagugcuuucuguugccaggcuugguuuccccacacguuguuaaagaaguuaaagaagcuugugaauaagcuaaagcagaggagaaagaaccauugcuauaucuagaauuguucaccagaaagcaaguuuuguguuaaagaaaacacgaguaggccacugugcagaagugcuuacaggguuugugugcuuuuuaaaaucugcauaaauaaacauuucaaaugagcuaucauauauacaaggaugaugugcugucugugggaaaaggacccaauccuguguugugauuuuacauauauauauauauauaauuugugcuauuacacacuugccugauccccuuauaauuaucugcauaagucuuuuuaggcucuuugaaugaaauucacuauguauggauguugaaaaucauccuuucuaccaugagcucaucagacuugcuaaccaauucuuugcauccuuugaaguauaaaauuccaucaauucagcauguaucaacaugaaucaauuagaaugcacuuucuucacagcauggcggaguuuuugcuggcugccgggagcggcacuguuucccaauucauucauuugcuugggcccgccccaggauccuucuuaucccggucagauagacuucucucaugagcuugagagacggggcuggucacacaggacacggcuuuagggacacgacucacugaaacuacaaaaugagugcugcucuuagaguuguacccacagccugcacagcuguuauggcaaugcugugggcaagucuugcuacggcccauucuccucccucccuuguccuguuggaagguucagguuggagcugaaauucaguccagcacgcagcuggacaagccaugucuccuguaugugacucacuccccagagaaagcaucauguggacuaguaagggcuuggcuuuaucagaagcaaaggagagguuuacaucucuucuugcucucucuuaguggguucagagcuccagcagaaaaaaugggacacuguggauugaucuccagaaaaccccaaaaccagcacugaaggcuccaggagauuaugccuuuagauuguauacaggcaccagaaugacuuuugccuuuauaaaaaugcgugcaagagcaugaaaacuaauauuugaggaauuuuuuuuucucacuguacuuucugguccucacugaaagcauuggcaguuuuaaaaaaugaaaugugauacuguuauagacguagcaaaccucacguuucauuuuuuccaauucauucuauaucuaggaacuuacuuagaaggagaaacaaacuguacccagaaaaaggaaugaaacuggagaauucuuccucaugauuccucuguguccucaggccuaauuauccucauuccaaagacucuccauugccucaauaacuucgaaaaauuuacucuccuuaagcauagucauaaaaauugcauaguaaagugauaaagagacgaaaauaaugcuguaagaauaaaaccauuaaaaaaaaaccacuacucuugauuauuucugcuguuagaauuguaaaugaauucucauuccuuuuuucuacauuuuuggcaugaaauuuauguuacucuuauaauuaguaaaaacauuauauuuuauuaauaaaagaagacucacagugaagucauaacauaugcugcagagguuagacucuucaagucagauuugaagagagaauuucacguaacaaucaccuugaaaugucuucaggucagccaucaaaguacacaucucucaaccagccaggcagccaguuuuuccuccagcaugugaagagugaagagauagcuguuucuuggcuuaaagaccauaugaaauaauugacuuauguuuaaaagauaugagggaucaggccgggugcaguggcucaugccuguaaucccagcacuuugggaggccgaggcggguggaucacaagguuagaagaucgagaccaucccggccaacauggugaaacccugucucuacuaaaaauacaaaaacuagccgggcguagugaugcgcgccuguaaucccagcuacucaggaggccgagguugccaugagccgagauuacgccucugcaguccaaccuggugacagagcaagacucugucuccaguuaaaaaaaaaaaaaaggcaucaaaauuacauucacuucuauuuuuauuuuuguuuguagaagacaugcaguuuguaucacauuaaugggcauaugauguaauuucacuauaaaucgaaccagaggaagacauccaaauauguauaaauuaaagcugacaaugccuacaguacuaaacuuuuuguuuuaguauaauuggagacuuagaaaaguucuaaaaauauauuuaaaaauuuuuaaaggaaguugcagacauaauggcccuuuacaccuaaauacuucacuguacguuuccucaaaacaagaagauauguguguguguguuuguguguguguguuguaaucuuaauacagcaucuuucagagauuauuucuguaguauauaaacuugguuuuuuuguuuguuuguuuguuuguuuguuuguuuugagauggagucucgcucugucgcccaggcuggagugcaguggcacaaucuuggcucgcugcaagcuccgccucccagguucacaccauucuccugccucagccuccugaguagcugggacuacaggcgccugcaccaugcccggcuaauuuuuguauuuuuaguagagacgcgauuucaccucguuagccaggauggugucgaucuccugaccucgugaaccgcccaccucagccucccaaaaugcugggauuacaggcgugagccaccgcgccuggccauaaaguuguuuuuuagucucuacuuuaaguuccugacaacccaggcaggaccaagacucccuaauguaguuggaaaucagaucagcacauuggcacaaguucuacagguaaacgggaaaaaggagcccuacaaucugcuuuuagaugccagggagccuggcuggucuuuaucuugauuacugacugaugccacugguaggucuaaguucuuugaucuaugauguuugaaagccaaaaggaaauguguuuuaaaggaaaagggacuucuucuguacccucagucuaagccagacaagugauauuucaggaaaaugucccuagcaauaaggaauauuuucacaaaugaugugaagcuuuguuugugucccuuccagggcaguuuguuaccauaaggggacaaagcaugcuucauuuaaacauguguggccaggaaacuguuauuuuuaaacaaaaauaaaccccgauuuagacauguagucugaguuuuaacucugggagauuuucaagauugauaguguagcuaaaaauaacugaccuaauuuucuggaggucaagauaaaaacuggauuuaugguacagcauuuacuuugugauaauauguguauaaauucuuccccaaguuggaaaauguggccgcgucauacagggcuguaucucucuugaccauugaagugccuaggucgcuacacuacaauuugacuuagaguuggugaaacuucuggccauucacguagccaucguauucauccugagaaagggaaaccuaaagacuugggagaguguucugggaggaaagugcuauugagaaugggcuguccaagcaaagugacaggcaggccucacuuagcuagaagagggagcuuuucagcccugcuccaccaucaggaaucuccgugaccuuggacuacugcuuuaaucucuuuuauccuggcuucuaaaagauaccgucgaauucauucuuuuucaaaccuaucaaaaauuugaaauguaugaaaaagagggugcuugugaugauagauggguuuaugcuuccuuuuuuuuuuuuuuuuuuuuuuuuuugagacggagucucacucuguugcccagacuggagugcaguggcgcgaucucggcucacugcaagcuccgccuccgggguucacaccauucuccugccucagccucccgaguagcugggacuacagugccaccaccacaucuggcuaauuuuuuuuguauuuucaguaaagaugggguuucaccauguuagccaggaugcucucgaucuccugaccucaugauuccaaagugcugggauuacaggcgugauaugcuucuuuaauauuaguuucuaauccaaguaauauagccauguccucuauaaaauggaacuuuucauggaacagugagaagguugcauuaggaauugggauacuuggguucagauuucaguucugccacuugcuaguuuuaaguauacuucucaggauggaugucaguuuguucaacugucagugggaguagugaucccacuaaggaagauuauugugguuaucaaaucagcagauggguaugaaaaggccaugagugcaguucucaugguuaugaaggugucauaacuggcauagucccaucacaguauggcuuuggcaucgcagauggcuguagcauauaugcuaaucagaacaucccuaccguccuuaaagaucucauggguucucucccaaaucagcugcuccaccgaccuacaaguaaguccaugcuucuuuaguauauuuacucacuagugaaggcccgucugcuaaaagugucuucaguaggggagagcugcucuuuucugggaaacccagcaaugaaguuuguccugugaugcccucuacacuuacugaccuguuuccugagaacuucccguaacaaaugguccagggaagaaggaagucugugaccagucuuuccuuuccuguggcuuucugguucagaaaugugacccugaugauaagaaacuucaaggcaugacucugguguuuuggcaauauuccccuggcaguauuguuucuuggcucacacucaucucaugccuugcuuuguuugcuuuguuuuugagaauuguuuuuuuguuuguuguuuguuuuugguuuuggcuugugagacagagccuugcucuguugcccaggauggcgugcaguuggcacaaucucggcucacugcagccuccaccucccggguucaagcaauucuccugccucagccuccugaauaauggggauuacaggcacacaccaccgugccuggcuaauuuuuguauuuuuuuaguagagacggguuucaccauguuggccaggcuggucuugaacuccugaccucaagugaaccacccaccucggccucccaaagugcugggguuacaggcgugagccaccacgcccagccauuauguuuguuuuucuuucaugaagggauaaccgaggcuguugugugguggugucuugguacagcucguggcuguggucagugugguggaggguaggucuucucagaugguaacaugcaugagagucaccuggggaucacauuaacaugcagauucugauucccuggaucugggugggaccugagguucugcaugucuaacaaacucccagagaacacccauguagcaagaguacagacaaaaggauucaaagcgaagggacugcaagaaccauggaaccagccucccacgauuuugcggaugacgaacccgagccuuggggaguuucagaggccauggagagaugaaguauaauaaacagcauagcaguuguauguugagccaagaaucagacaugcacagaacugcugauuggaaaauuaaaucuguuucucauagcccugguguggcaaaaugccuagcuggaagugggugaccgcuugauuuacagugggccuccuggguagggaaaauuaguccaucccauuuacagcuacuuccaaugcagcugugucaggggagagagaagaaaggacauggaagagagcguagagguaugaucuucaguccuuucaggcaggcacauaaguaaauuuuuauuuaaaagauaagaauuggucauaugcgaaucuccuguuagauaagauuaaaaacaaauuuccauuuuguggagaaguugcagauaaauauuuuuccaugggauccaaaagaaucaaaaaggaaagaaaauaguaauagcaguggagguucgauccuagacagaagaaaauccagcaagccgagggacuucauauucucacugguguccaaaucagagcuuuuuuuuuuuuucuuuguuuacuuuaaguucugggauacaugugcugagcaugcagguuuguuacauagguauacaugugccuuggugguuugcugcacccaucaacccgucaucuagguuuuaacuccgcaugcauuagguauuuguccuaaugcucucccuccccuuucaccccaccccuggacaggcccugguguaugaugucccccucccuguguccauguguucucauuguucagcucccacuuaugagugagaacaugaguguuuggguuucugguccuauguuaguuugcugaggaugauggccuccagcuucauccauggcccugcaaaggacaugaacucaaccuuuuuuuuuuuccuuuuuuuuuuuuuuuuguauuugcaaauucaaaucuuuuuuuuuuuuuauuauacuuuaaguuuuaggguacaugugacauugugcagcuuaguuacauauguauacaugugccaugcuggcgcugcacccacuaacucgucaucuagcauuagguauaucucccaaugcuaucccuccccccuccccccaccccaccacaguccccagagugugauauuccccuuccuguguccaugugaucuccauuguucaauucccaccuaugagugagaauaugcgguguuugguuuuuuguucuugcgauaguuuacugagaaugaugguuuccaguuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaauugcgacacugacuuccacaaugguugaacuaguuuacagucccaccaacaguguaaaaguguuccuauuucuccacauccucuccagcaccuguuguuuccugacuuuuuaaugaucgccauucuaacuggugugagaugauaucucauagugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuuguccauuuuggcuuuuguugccauugcuuuugguguuuuggacgugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagguaugcggcguuauuucugagggcucuguucuguuccauugaucuauaucucuguuuugguaccaguaccaugcuguuucgguuacuguagccuuguaguauaguuugaagucagguagugugaugccuccagcuucguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcaguugguuuguaguucuccuuuaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcguaucagcuuaaggagauuuugggcugagacaaugggguuuucuagauaaacaaucaugucgucugcaaacagggacaauuugacuuccucuuuuccuaauugaauaccuuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuaccuuuauugauuugcguauauugaaccaagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaaccaucugguccuggacucuuuuugguugguaaacuauugauuauugccacaauuucagcuccuguuauuggucuauucagagauucaacuucuuccugguuuagucuugggagaguguaugugucgaggaauguauccauuucuucuagauuuucuaguuuauuuguguagagguuuuuguaguauucucugaugguaguuuguauuucugugggaucgguggugauauccccuuuaucauuuuuuaucgugucuauuugauucuccucuuuuucuuuauuagucuugcuagcggucuaucaauuuuguugauccuuucaaaaaaccagcuccuggauucauugauuuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccaguagucauucaggagcagguuguucaguuuccauguaguugagcggcuuugagugagauuauuaauccugaguucuaguuugauugcacuguggucggagagauaguuuguuauaauuucuguucuuuuacauuugcugaggagaguuuuacuuccaacuauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauguuuaggauaguuagcuccucuuguugaauugaucccuuuaccauuauguaauggccuucuuugucucuuuugaucuuuguugguuuaacgucuguuuuaucagagacuaggauugcaaccccugccuuuuuuuguuuuccauuugcuugguagaucuuccuccauccuuuuauuuugagccugugugugucucugcacaugagauggguuuccugaauacagcacacugaugggucuugacucuuuauccaacuugccagucugugucuuuuaauugcagaauuuaguccauuuacauuuaaaguuaauacuguuaugugugaauuugauccugucauuaugauguuagcuggugauuuugcucauuaguugaugcaguuucuuccuagucuugauggucuuuacauuuuggcaugauuuugcagcggcugguaccgguuguuccuuugcauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacaauuacgugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccgcaucacuuucagguacaccaaucagacguagauuuggucuuuucacauagucccauauuucuuggaggcuuugcucauuucuuuuuauucguuuuucucuaaacuucccuucucgcuucauuucauucauuucaucuuccauugcugauacccuuucuuccaguugaucgcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuguuccguugcuggugaggaacugcguucuuuggaggaggagaggcacucugcguuuuagaguuuccaguuuuucuguucuguuuuuuccccaucuuugugguuuuaucuacuuuuggucuuugaugauggugauguacagauggguuuucgguguggauguccuuucuguuuguuaguuuuccuucuaacagacaggacccucagcugcaggucuguuggaauacccugcagugugaggugucagugugccccugcugggggugccucccaguuaggcugcucgggggucaggggucagggaccacuugaggaggcagucugccguucucagaucuccagcugcgugcugggagaaccacugcucucuucaaagcugucagacagggacauuuaagucugcagagguuacugcugucuuuuuguuugucugugcccugcccccagagguggagccuacagaggcaagcaggccuccuugagcuguggugggcuccacccaguucgagcuucccggcugcuuuguuuaccuaagcaagccugggcaauggcgggcuccccucccccagccucgcugccgccuugcaguuugaucucagacugcugugcuagcaaucagcgcgauuccgugggcguaggacccuccgagccaggugugggauauagucucguggugcgccguuucuuaagccggucugaaaagcgcaauauucgggugggagugacccgauuuuccaggugcgucugucaccccuuucuuugacucagaaagggaacucccugaccccuugcgcuucccaggugaggcaaugccucgcccugcuucggcucgcgcacggugcacgcacccacuggccugcgcccacugucuggcacucccuagugagaugaacccgguaucucagauggaaaugcggaaaucacccgucuucugcgucgcucacgcugggagcuguagaccggagcuguuccuauucggccaucuuggcucccaccucccgaacucauccuuuuuuauggcugcauaguauuccaugguguauaugugccacauuuucuuuauccagucuaucguugauggacauuuugguugguuccaagucuuugcuauuguaaauagugcuacaguaaacauaugugugcaugugucuuuacaguagaaugauuuauaauccuuuggguauauucccaguaaugggauugcugggucaaaugguauuucuaguucuauauccuugcagaaucuccucacugucuuccacaacgguugaacuaacacucucaccaacaguguaaaagcgugccuauuucuccgcauccucgccagcaucuguuguugccagacuuuuuaaugaucaccaucccaacuggugugagaugguaucucauugugguuuugauuugcauuucucuaaugaccagugaugaugagcuuuuuuuuuuuuuuucauauguuuguuggccacauacaugucuuguuuugagaagugucuguucauauccuuugcccacuuuuugaugggguuguuuuucuuuuuuuucugguaaauuuguuuaaguuccuuguagauucuggauauuagaccuuugucagauggauagauucagaucagagcuuuaacagccagacuuuacagggaaaaggcugaguggcaccuccuuuauaugaagaaaauguucuucuccaacccacuuguguucaguggauggaagaagcuguucaguaauuauaacugacacuuguaacacauaacugauugauuuaaugcccauaaauuuuauuuucuuuaaucguaagaugugaccguuaaauucuuagaagacauuuggcuaguggauuaauaauuaaaagaauauuggaugaauucaucugcuuccuauucagcaguucuuuuauuuauaaggcuauuuuucucaaaaugaaugaucaugaauaucuaagaaaaaacaaaauauuuagcuguuugaagaugaaauuauuaucuuuugauguuguuuucuuuaaaguguuuacaaugauaacuaagugguagggcuucuucccucuguuacucuaaguaugccucguauacauccucaaagcauuuuuuuuuuuuuuuuuuuuggagacagagucuuacucgguugccuaggcuggagugcaguggcaugaucucagcucacugcaaccucugucucccagguuuaagcaauucucccgccuuagccucccaaguaggugggauuacaggcguccgccaccaugcacggcuaauuuuuguauuuuuaguagagacgggguuucaccaaguuagccaggcugcucuugaacuccugaccucgugauccacccaccucggccucccaaagugcuagauuacagacgugagccaccacgccuggccaccucgaagcauuuguaaaagagcaaggugaugggguucauuagguguuugguauuugaaauuaaauaccucuguuauugaugaagccauauuuuaaauauuaucaccacuaaacucaguuaaauauuuccacuguuaacuacaagguucaaaugcuuggauauuauagaagauauuugacuucaaagauaaacgcuacaauuuugggucauaacaaauagcuuuuagaaggggaaaaaauaagucuugggaggaaaauaagcagucucuuaguuuaauauagcgguuggcaaauauagaugcuuaaaaguucugaaaauccccauugcaggccaucagaguguuguaauuaaguauuaaauuaauucagauaaaaggauaauccaucagggccacuaauguaguggaagugugguuucggugugauuagucucaccauggaagucaaagaaagucccacucagaaugaacaaugaaagaaucauauuugucucuggguauuuugucauaggcucaauugcccagugccaguguguaagccacugguaaaauccugagcccuuagucaugucuacagguagcuggcugccuuagacauuuuaugaugacgaaauugaauuccacuucugauaaugguaauccaucaugucuaccucuuuuuuucucuuaaaacuacacugacggccaggcgcaguggcucccgccucaucccagcacuuugggaggccaaggcaggcagaucgccugaggucaggaguuugagaccagccuggccaacauggagaaacucugucucuacuaaaaacauaaaaacuauccggucaugguagugugugccuguaaucacaguacucgggacugaggcaggagaaucgcuugaacccaggaggcagagguucguuguucugaaugacauagccaggggugguuauuucuaaauuuucuguguugaauuaagauaggaauguggauuucuuccuauuuugaacaacgaccaaaaaaaaaaaacgaaggcuaaguguguuucacucugcuaaaaauguaccuuuucuugaaucugucacuuuuucacuuacauuuucugaaaaugaauauaauuaaccaccauggggcucagcaugcugguggccauuuggaggaacuuuucuaccaacaguguaacagagaaaagagaaaaggguacuacagcguaccucaaccuccccugacuguucugugaaguacaaguguaagauuucucacugugaucuuuugcuccucugccuuuuuacugccaagggcuaagaugggcacagggcccuuuccagcugccccugccugagaaaugcuuauuugaugaccaaaagcaauaaccauuccauaggacuaacggugauuaagucagcuuacaaauccacaaggguggaagagacugcuaaagauauuggaacagacaugcuuaauaaugccuaauuucuacagcuacuuuugugauaauacgagaggcugaaauagauaggggcugaacaugggaaggcugguguuaugaagcccaggacuuggauuucagcacuggugcuuacuggccauugggucuugaagagauugguuccuuucucccagccucagucuccuugucccaucagauuaauaaugccugccuugggagaggagagucauacaggagagggcauuugagcugggcucuaaagaguucaaauaacguagaugagcagagaugggcuuccaagauagcaggaauagaaaacaaaagugucagaauggguaugcauggucuuuugugggaauaccccaagcuauuuagccugagagagaggugugguguagacagcuggagcugugaguuccauggcuagaaauacggggugggcccagaccacagagggccuucagcaucuggcaaaggaguuggaauuaauucgguagaaaaugaagacccacugaaacaaagagggagccauucuugugugucaggaacuaagauuucaggaaccaaacguaaaauaaaaaccagcagggagaccauugucucagucgguuugugcuguuaucaugauaccagagacuggguaauuuauaaacaaacaauagaaauacuacaauucuggaggcugagaagcccaggaucaagccgggugcaguggcucacgccuguaaucccagcacuuugggaagccgaggcgggcggaucacgaagucaggagauggagaccauccuggcuaacacggugaaaccccgucucuacuaaaacuacaaaaaauuagccgggcgugguggcgggcgccuguagucccagcuacucgggaggcugaggcaggagaauggcgucaacccgggaggcggagcuugcagugagccgagauugcgccacugcacuccagccugggcgacagagcaagacuccgucucaaaaaaaaaaaaaaaaaaaaaaggcgccuuguggcugcauccuccagaggcagcaaaaacuguucucacauggcagaugcacauaaaggggccugugcugguuuccucuagcccuuuuagaaggcaguaguccauucgggggcacgggguggaacugucaugacuugauuuccagaagaccccaucucucacuacuaccacaguggagauuuaaguuucaacacaugacuuugggggacauucagaccauagcaagcagugaggagacuaucguaauuauccaggcgaaaaguaaucauauuccuaggggcggugagggugguguggaaaagcaagcaggaaauggcugagagaauucagaaauagaaugcaaaaggauuugucgguagugugaguacuggacacgaagaaauacagggaguccuggauggcucugaaggauucaagccugugacugggagggagaaugguucugccaugauuagaaaacaggaaagguggaagggaaagccagggaccuugaguacaguuguguaccuaccaagugcauggaucaggagggagcccuaaguugguaucuccagcaaacuguuggaaauauacaaauuugagugggagggagaagucaaagcuggggaaguacauuucagauucacccaaagguaggagaucuuuagaguuucaagagucgaugggauuuccaaaggggagaauuguagaaagagauggaaagagauacaagaagaaaaugacagggaugaagagaggagaaaaaaagaguaaaaagaguuauucagagaugucacagggaagaagauaaguacuguguaugcgaaacagugagaacauuuccaaauaaaggacaugguaagugauaguagauaccacagacccaagaacagcguagccccuggggaguucaagagcuuucucgcuggcaaagguuauuuccugucaagaugaauguguaugcaccaauaauuauuaguauuccagaauauccucucuuuagcauaguaagugcuuaacagucacaagcaaaagauuuauauaaaagaaaugcucauuuaauuuauuuaaucagacauuggcuaaguuauuagccgcuaccuauggcuuuguaaaacaugaaaaaguuggaggaaaucuaaugagggucuuuuaucuguaagggaaaggucaucaugggcaucaaguauugaauuuuagaaacggugccacagugaauagggauauauuauaacucagauuagacuucaaaaggacuaauuugcuugggacuuccaucauuuaaaaucacuugcaauaaaacugacuacaugaaaagauauuaaucacaagcuuuaaugcuauuccaucaaauuauuuuaauggguauauuugaacagaauuuuaauuuuucagauacauuuuuugucaauagaaaagagaauuugaaagaugauuguaaaauguuacaaaucaaauuuaaauccugaucuuauuuucauuuucucuagcaauaaaacuaaccagugaugugucugaaauauauacuacagcaaacucuugacacagcuaugauuggaaaaugagacauuuugguuaaucaaauauuauuguuaauagugcagugcugucugucggucucuaauuuguaaaaaucagagaaaaacauggugaaucuuuggugacauaagagaagacucacaaaucuucauauccuggggucaguuuuuaaagcaguaauuacacaugauacaagauuauauucuaagcucucuuuuuccaguaagaaaagauaagucaaugauguuccauaaagcugauucuuguuuaaucaauuuuuaaaguggggggguaggcggcacugacagcauucuuuggaaagggaagcaacagaggagaaaggcaggauauuuggugucugcucacauugggaaauacggggagccaggggugguuaaguccagagaaggcuggaugucugucugcagggcuacaucuggaagggcaagggaacaguuuccuuguugccucagagcauaggucaugcagcacaagaggagcauuuaggaaaugcagauuuuuuuucaaggcaagacagugaaaacuauucaagaagguagcaaacuacuggcccuuuaaugcuuuucuuauccuugcaagugugcaaggcaagacaggagauugucuguugucuuucagcuugaaugagauugugccucacuuacugccgccacaccaaagccuggcguuuauuccugugcgaucauuguauacuagggacgucuaacugugucaggaggaaauggcagcugagccccuguggccuuucaccucuagcagugccacgcugcagcacauuggccggcugccaugcuccugccugcaguccugccagcagcucuugugagcugcgacuuugcauaaguagcuugaaugccaugugccucaguuuucacaucuguaaaagggagaugauaaugguaccuaugucauggcucuaaacgcgaucaugcacgugaaagcaguugaagucuugccuggcagaaguaaaugguggcugcugcugcugcugcuguugugauuguuguuacucaccaaagagaugguuuuguuugguuuagaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaagguaagaguccccugagccagcaagggcguucugggagguauauauacacauacauaacgugugugcaagagagagaguuaucuuuuguauguucuugaguggugaauuuuuuuugauguagucauaaauauuuucauuauaauuuuacuuuaaaaaguaaauacuaggaguuacuaugucauuaaaauaauauaucuguguaaauuauucuuuauauuuuuuaugcugcaaagcauguaaacugccaauuguuggaaaagacaacaacuccauuguauagguggcaaaacaaaaugguaaugauuuacauaacauuugcagguaaagggccucuuguuucgcacauguccagguuugcauucuagggaauauuauccuucgagugaacacucccggacgaaggggagccacaguguauuauugaagaggcaguucuucacaaggaaaauguguggcaauaacauucuucuaauuuuuauuuuccaguuccucuucuuaauauaaaaugguacauuauauaacaaaaguggauacauaaagagcauguacuguauaucauauuauuauguuuaugacuuuuucaaaugaggaaauggaggcaccaggagacuaaguucuuaagugaugacuuuugguaggaauuuuuuagaaauguuuuuuaacugugagguauauuguucccucuggaauggaagcacaaaauucaacuuguguuuaugacguaaugaccuagaaugccaccuuccaaaaaagcagauagauagugaaauaaggaaaaauuacaguuuaccaacagagaggaguuuugagggccugcagagaugcagauuugacaggcaccaaaguagucuucacuggcuacuuauucuuacaugaaauuucagauugaauuaaauguuaaaggcaaagauagagaacuacauauaaauaaaauuuaauuuugcuuaagacuuaauuuguguuuagaaaauuaaauuuaaggcagcugccaaaauuaaggagcacauugcucuaaauguuuuuuccuuugguaccucagagaaguaagauucuucucuaucaacaaauuugagcaguagauggcauccuuuuucacagggauuucuuagcagaaacaccuguucaggcaagaauaucuuucagcuucuuuuaucuuuuucuacauguucagaaguauacaauuacacacaaacaccuugauuucuagauacaaauaacauguuuuuuaagaacacaacagcacuuuaccugauuuucuuuaucaaagcagcaaauguugauggagauuucauauuuauaauauaccuuauaggccaggcaucgugggucacgccuguaaucgcaggacuuagggaggcugaggugggcagaucgcaaggucaggagaucgagaccauccuggcuaacauggugaaaccccgucuguacuaaaaauacaaaaaaaaguuagccgggcgugguggcgggcaccuguagucccagcuacucgggaggcugaggcaggagaauggcaugaacccgggaggcggacguggccagugagcugagaucacaccacugcacuccagccugggugacagagcgagacuuuaaauuuaaaaaaaauaaauaaauaaaguaaaaaauauauauaccuuauaacaugcaauuaguacuaaaucuaaauauaauauuagaccuuaaguguacuggacaaguuuuuucuaaagaaccauugcagaaaauauauagacuauuuucacaaugugaaucaucaccccaaauuuguuuccuuaauuugaaaaagggcaccuuacaguaauagcaaacagcauguuacugacaauguaaaaauaauuaaaacuuuaccauuuaugaaaauaauucuuaaucacauagaagaaaacaauuuuagggacaguucauuaucaaagaccuggaaaacuguccuguuaaauguauugagugcagauuguuuuguuucuuuacagguagauagauuuuggucauugaagguccucuucauucagucucuaaugagaauuuuuagugaaaaauguccgaucucauuuuguaaauugaaugcacgcuaaauuugcucuuuuacuaacagcauaccuuguugcaucagccuuaggagaaaaucugcgugcacacgugugaauguacacacacacacauacacugugaacccuugguaauugccaggauguccauuugagcaaagcccuugauuaaguacuucuggauacuugacaaacacgcagcuauuacauugccuaggucucaugaaaagagcugauauucuuguuggaugauucuguuugaacaguagaaucugguauaacaauuuugggaggcaauagaacuugcagugucagagucuugaguugcaguacucuucauuaucagucccaacauugacauauauauauugauuauagcaaacaauuuaaaaagccacuuaagcaauuuuuuuuuuuuuuuuuuuuuuugagacggagucucgcucugucgcccaggcuggcuggagugcaguggcgcgaucucagcucacugcaaacucugccucccagguucaugccauuuucuugcuucagccucccgaguagcugggacuauagguacccgccaccacgcccggcuaauuuuuuguauuuuuacuagagauaggguuucaccguguuagccaggauggucucgaucuccugaccucgugauccgcccgccucagccucccaaagugcugggauuacaggcaugagccacggcgcccggccccaauugguuuuuaaauaaaauagacggccaucaucucauaggauauuaaauacuaccccauaccccugaacuccugaaugauacagacccgaguuuaaauuccagcccugcuaugugcuucugagcaaguuacuuagccucucuggcugcuuccucgucuguaaaauaagguugacaauaauuccuaacucagagguauaguaugagcauuaaauaagaaggcauaaaaaagcucuuagcaaaauuccuggaacguaguaaaugucagugguagcuuuuuuuuuuuuuaauggagccaggaucuuauuagagagacuuuaucagccugucucaagaugaaucaccuuauggccucaacaauguauccuuaaaauaaugaauauaauaagccauauaaugagauacaguccuaaagccgucucucuucuaacaccgucucccaccucuccccagaaacuuguuagucuuucuuuguacagacaugugcacacacacacacauacacccaacuacugaaaauaucuaaaauucucaaaggauuuccuuuuguucuucaugcaguccucauuaucauaguuucaaaugcuuaccaaaaauuuguuguuuuucuuaagaacaaucagugaaauccagaggagguucugaugcccauuuuuuaaauuuacauugaagaaaauaagcauaucagaguuuuccaaugugcugugauuugccuuaacaauuuuuuauucuuugguuuucacauccacaaaaccuaaaugaauggcuaggcugaaaugaagcuguuguuacagaauugugcucacagaucgugaaaugaucuggcuggaagcauuagcguugaugacauuuguguuuguucuacuuuuuccugacugccugagaagggcagccacaaagagcagcauagcaugcagugacugccagcaagucuuuguggccaacagucugccucuuuguagauaauaccuagauauaauauguagauaaaauaauauuuuuaaagagacaaagcaggucuuauaagacuuguauggauguauuugcaaaaugugaagcugccuucuaguauauuuuuaacuagcuuuauagaggcaaugaggaagccaauuuaaauguugaaauuuagauuaaauaaauauuucauuaaacuuacaaaccaguucuugucagccucuuaucuauauguaaaacugguguacugcugauuccucauuaccuuuggccugguagagaguuuguacaaggcagcacgguuaauaguugagguuuauuacaaagaauaccagaaguaacagacucaaaaaucccagaggucugaccauucuguuucucuccucuuacagcaaaggauuugauucaaagcuacugagagcaagagaauaacucauuucugcuuacauuuuauuuuaacucuauuaaaaguuaaagcuaagauaauguauuucuuguuuuuaaauuacuaaacagccaauguaagauguuuuuuagcacuucauugaugaaguuacugucugguuaaguaaaggucaauuggaaaaauuggaaaguauuugcaguggauugggaaauaacacacuacuuuguuuuguugguguguauucuuuuuuuucggcaaugauaucauaauugccuuuuaaaaaacuuuuaaugucugcucccugagcuacuuauuuuuugagcauuaauuuauacuaaaucagcuucaaucuuuuaaagcagauuaggguuuaugucacugaaacuaguuuuguuuaaucuuccuaaaaaauaggguuaggguuuuauuauuguuuuuaaauaauacaugccuauuuaaaaaaauagaagaagaagaagaagagcggggagaggcagagaaacuuauaggacaauaucauuuguaaguuucuuucacauaaguauacgcauuugaacccuggaaaaaccauuuacuuugugacacaacugaaguucagaaagaaugugauuagccccagaucacagagaaaguaaguggugacauuagcaguggcccgugggacuaccagcuccucagccugcauuuaaaccacagguacacuuaacuuacugccccgaguugcauauacauuuucuaauaacguaacuauugauguaugugcucaccaccacuucaagguacgcguuugcccucgugcauguggucuguuguguucuuaacugcaguugaagcacuauugggucccucaucaucaggaaauucucacaaaguacaaugaccuuucaacuaacugcauuuuacaaggaguaauacaguuacucauuacagguugcugcaaauaggaaaaaaaaugaaguauagaaaaaccaaaccucauugucgaaauguauuugggaguugcagaaggaagugaacuaugucuuccucuaaugcacuagugaaauacuagagaauagucacucucgcaucaguaguuacuauggaauauuuaaucauaggauauuuaaucagugcaguucuguaguaucugguagggucucaaacaggcuuuaaagguuacuuauuuguuccucaccauaauuagaagaugcagauguuaacauuucuguuuccauauggagaaacagccacagaaguggcgcaucccaaggccacagacauuguaaauguugggcccaggccugggauuagaugccucacccuccuuuugacuccaccaugcugccagucucuacaugagaaaggaccaaauuuuuauuucauccaaauauccuagugcucccggaaauauuuucuuauauuuuggagacuuggcuuacugccacuuuuuuucucccucacuguuucuauuaacauguggcauccaaaaucgauuuggacugagaaucccaccuuugaaugccuggccugugugcaucaguaagcuggaugguuuugcugaaauuguuagaagccauuucaucgagcacaccgugucuccuucagcaccugugcucacuuugucuuaccuuuuucccuuuacacuugccaccuuaccaaagcagcuucccccugcaccuaccuccguggcuucauuuacccuaugaccauuauuaauccuaaaaacuucacuuuuguccccauuccuuguuucuucaaacgccagcguaaaacaaggaaguauuuucugagcaucagaagugcuuuggaaaggucagaugauggugaggaauaucaugcuguccacacugcuuucuuugggucggacccagaacacauaaaaagggaaaauugugaacaauggcaaauauaaaaugaaauauccucauuucacacguuucagcuguaugucaucugucaaauggaagccagccuuuuugaaaaagugagaaaaagacugcgguuucccucuucugcccucauacuaaggacaaauuugauucacucacuaaauggcagauuauauaguaaaacuuugcucuccugauaaauucauauuugcacuuccccuggaaauuuaacagaguccuuuuguaguuaauuaacuguaaaauaagauaagauugggcaguuguaaaaggaaguaucuuuaagguuuucugcuaggcugggaauauuuuauuucuaaucaaaagccaagaaacuaucucuaaacuagcucagagggaaauccacccuccccaccccucuucuuugauguugcugcguauccuggugagggcuuuuauuagaaaacuaaggagcaggacuggcacaucaauagcgauaagccauuuaaaguggugccccuccugguccucgaugcucgggauuaacucacugugguucuuuucuggcugcuccuuuuuuguaacuuguuuauugcauaugcuuuuuucccugcucgacuauguuugggagccacgacuuaccaucuugauuugucuuguuugcuuucugugucccuugcuuccugugcccaguugagccuguugaugcccgcccugcugccgaccgaggacugaccacucgaccagguaucagaaccgcuugacuugugccucuccgcaucuugggccuaagcucgagcagacguugucuccuuucugcauuuuaagccucucucaauuguacuuacugcagaguagaauuugaagugaccuuagaaaccaaacuuuuaaaaauuccccuugacuauuccuuacucuucauuucccaaguuccgagugaaaugauuuuuuuuguuucugagcuuucccuuugaaaccuaaaagagagcccuuccaaauuuggguuuuuuuuuuucuuuuuucuuuaaaacaaacaaaacaaaacaaaaacagagacgauuauauacagccuguccuuaaaaacagaagcccagauagauguagacucucaggugaugacuuggauaccagugugaacaucucuccuuucuuguuugguguccagauggguaauuuucuaacugaacugggcucaaacuucaaucaguuacugaaguagacaugauuuccugaaaauaccagaauugguuucuuuccagagcccaaaauacaucuucuguuuuguggguuguauguacuuauucucaaugaguggcuaaaguaacacaacagauguggaugcauaauuuugcacauaagcccuuuuuuuauguauuacuuaaaaaucccauuaacacugaaauagacacuucuuuuuuuacaguuucacaaacauuaagaagaaacacauuuuuauuuuaugaauaaugucauagcacagcagaagcauauaugugccuggugucuacucuaugaacaaccucacccaacugauaguagccagugcuuucagugaaucaaaaagaggaagaaaguuauugaauugacaaauuuguguauuccagggagauuuuaaucccaaauaacacauacuuuuccauauuuauuuucuucuuuauccucauaauguccccaggcgauagucaaagaacagggaauuaacuuucuuugaagauauuaauacacagaggucaaccuuugcugccugguucagauacagucagcagcagaccaggagacccacccugucccucacacuuccaccacaggcucgagccaugacugccuccaagcacggucacugaugaagacugagagucugccuguggcaucuucaugccuuuaugcugugauuaacaguggcagcagagacaguagugugacacgucuugacagcuggucucguugauuuaugaauuucugucuguaggcuuuuaaggggaacuuaaauuauagugagucagagacaguuucaguucuucuaauguccuccuuauugucaaugucauguaagggaaucucaaggagccaggaguugacauuccuguucugcucagccaacuuguaaggccucgggcugagggucaguucaguucuaauugcaaccacagccagcucagguuggucauuugccuugggacuuuuuucauggugcuucucuuuaaaagacaugcucuucaucuacaagcauaaaauguaacuuagaaagcgcucauucgacucauucaauuuuaucaaauuucuacauugggccaggagagccuauauguuacuauugaaacauccaggaccaggugacacuaccagucaauguuuuuuucuuuuuuaaaaaaauuguuuuuugauuuuuuuuuuuuuuuuuugagauggagucucgcugugucccccaggcuggaguggaguggcacgaucucaacucacugcaaccucugccucggggguucaagcaauucuugugccccagccucucaaguagcugggacuacagaugcgccccaccaugcccagcuaauuuuuuuguauuuucaguagagacgggauuucaccauguuggccaggcuggucucgaacuacugaccucaggugauccacccaccucggcaucccaaagugcugggauuacaggcauaagcaccaugcccggccuauucuuuuaaaaaaaauuuuuuuuaaucuaaaucuaacaaaaaggacaccuccaaacgcugucaaacaaaaacaguguguuuuaaaggaagagcuagagaauaguuaaugguauuacacuggugggagaaaaccauccaaaaccuuucucauaacaguaagaauaugaugucacuuggggauuucacaaagaucaauccacuaaauucuuucuagguuugaaagaaauuaaacgguagggucccugcucucaggagcuugagguauaauagaaggaauuuugcauauuuggaaacaugagauggaauuuggaagacaaggaaauacaaagcaacauuaagugcuaacaagaauguucugugaugggaggagauggaguacuaacccaggggcauguuaaguagagaacuuacuggagaugggcuuccagagagguuaugaaagauuugaggcaccuggauuggcaaagaagaagggaacaauucuauucagaagagaggguggccuaagccaagcuuccuuucauacacagcguaggcuuggguugcccaguaagauggcuaaaguugagaaagaaugcucagauaugaagugaggaagauucuaguuaagguuugucuaugaauagcaguauuuacugcacauguauuaagccaugcguguguucuguuuuugugcuuguaguaaguuuaucaaacauuugggcuaauuuccccguguuuuguagcauagcuuugguucuucuucacauuuuagagaccacccacuugagucuaaugugccgaauuauaucuuuagccuuuccaaacuuagaaagccuucccaagauugucaugccguucaagugauggcauuguuuuugaauaaucacuguuguccucagaaacaaguuaaaaaaagguuuuuguuuuucccccacccagugcuuuauaaucaugacugaggaaaauggcuucuccuuaacucucauaucuaaaaaaacagaauaugguagcuuccagcaugcagugucaaguagggaccauuguaauaacaguggugauuugggggcauaguggccauuauagcuccuccuccuggcuuacuuccaaagaaaaaauagacucugaaggacuaauuauacaguuugaccagaauaaaaaagaaaaacacauuagcgagcucuucacauaggguagaaagcuacccuuucuguuacaauucaucaccacccuucugcaguccaaauaaagggaaaccagguccuugacccgagccaugcaagaggugucaugaaggacauaccucccuuagcccccacaugaacaaaaggcucuguccacucaucaugacuuacaggaagagagagcuggagucaccagggcuuagggugaaaucagcacaacucaagaaagaccucuaaguaagccugcaaaccaaggucccugccauuuauuugaaacuacucaucacauuuuauuacaugcauuaucaccuuauuaugaauauuucccuaugugccagcuuacugauuuugucuuuuaguaagauuugcuuaauguaaaaagucuucccuagaugacuauucaugcuaaacaaacaugaacuauuauagcaagagcucuucugccaagagcuucucaaacuauugagcuguaaacaugaauuuaucugucaugcugacuugauaauaugaauuuuuuuuuuuggaccaccaaaaguauucacaguaucauuucaaaaguagugugggcuuguaaaguuuuuaguggagagcucuugguuuuguuuuuuuuuuuuuuuuuuuuuuaaaacaggauuugucucuguuuccaggcuggagaacaguggcaugauaccagcucacugcaacccccauuuccugggcuaaagcuauccucccaccuaaguuucccaugcagcugggauuacagggaugugccaccacaccuggcucauuuuuguauuuuuaguagagacagaguuuugccauauuggcuaggcuggucucgaacuccugaguucaaacuguuugcccgccucagccucccaaaggcugggauuacaggcaugagucacugcaccuggccgagagcucauucuuuuuuuuuuuuuuuuugagauggagucucacucugucgcccaggcuggagugcaguggcacgaaucucggcucacugcaagcucugccuccuggguucacaccauucuccugccuaagccucuaguagcugggacuacaggugccugccaccacguccggcuaauuuuuuguauuuuuaguagagacgggguuucaccauggucuugaucucuugaccucgugauccucccgccucggccucccaaagugcugggauuacaggugugagccacugugcccggccagagcucauucuuuacuuuuauuuuucaguauaaauauuuggcuccaaaaucuaaaagggaagacucuucaaacuguucaagaaaguuuucuuaaaaaucucagaaauauaguucuaaccuauuguguugcuagaucuuuuauuuauuuauuuauuuuuggagacagagucucauucugucacccaggcuggagugcaguggcacaaucucagcucacugcaaccuccaccugccggguucaagcgauucuuaugccucagccuucuggaguagcugggauuacaggcacccgccaccacaccuggcuaauuuuuuuuuuuuuuuuuuuuuuuuuuuuuuuguauuuuuaguagagacaggguuucaccauguugaccaggcuggucucaaacuccugaccucaagugauccacccagcuuggccucccaaagugcugggauuacaggcgugagccaccgugcuuggcacguugccagaucuuaauaacagaaaaggagugagcucuaaagaaaucacugguuauauaaggaucucagauuuaaaagggcuauagaaagauuaaaauauacagccagugagaauuaagagaguuuuagcaucacuacccuauaaaaauaagugucagaaagguucguuucagcagaaugaguugaaacuuaaccaaaaaauacuuaacaauauuaaaguaagaaaauaaauaagaauagagaacucugugggucucguagcaagaaguuggggguugaggguuaggucauugagaggaccagaguuaaagaaugagaaagggaaacugucccacuuccauugugccuuuuaugucuauauuaaagagaaugaacuucugaugaaaggaaauuaaagcccgagauagaucaacaugagaaaagaaagcccuagcccauuaguuaccuauugcuacguagcaaauaacgcgagaauuuagcagcuuaaaacaacaagcauuaguuucuuacaguuuuuauaggucaggauuugggaugugguuuagcuggaugguucuggcacaguguccgucaugugguugcaguuaagacacugccugagcuaaagucaucugaagguuugauuggaccuggugggucuguuuccaacguggcucacucacgucacuguuacuaagagaccucaguaucuuaccaugugaacucuguaaugcugcuugagcgucccuacaacauggcaucucgcaccccugcaccaagagguccaggaaagagauuaaggaaguuuuagugccuuuuuuggcccagucucagaagucauacaccaucacuucuaucaugcucuguucacuagagcaagucacuacaucccgaccacauucgaaggaagggaaucaaguucucccucuugaaggaaggaguaucagcaaauuuguggauauauuuuaaacuaugacaucuugcuacccaaguccaaguucuuaugacccagaccaacugcaggcuaagagaacuugaaggggaaguagcaccauugccuguggucuuuguggaaagcugggaagguagggauaggaaaaugaaguucugaauagcaaaaaggagagaagauagcuucacaaucuguaagccagguauagagugacauugauugugggucucuuuucaaauagguuaucaaguggaagcuuuuugaacaauuggaugaggaaauggugcuaggucacaaccagcguggauuuccuagguuuugucagauuauccuuaccuucuccuuguauaggcugugcucuuagacuggcacaucauaugcuguggacauugugcuuuucagugucagcaagaugugucacaaguuucccagaaucucguagacaagauugaaagagugauuaggccaagagcaggaagugaauuccccugggagccaaaggaauugggaauguguagcccaaguaagacaagaaccagcaggaacaugccucuccuuagggucgugauaccuguucaagguuuuaauguggaagggaggauuaggcuugcucuguguugaaucaggcucaaaggauggaaguuacagggaagcugauucuggcuucauguaaaaaaaggacaguuugggcaggcaaaucuaucaaaaaauggagggaaauugauacauuccucuauguucaaacaggaacugacaaucugccccugggugggaacacgguagagaagaugacuucaaaagcccuuuucauccuaaaauucugauguuugauaauuaaauguuauagcauggacacugacauuuacauuuuuuacuuauguuuuugguuuuuaaaugacucugcauuuuguuuuaagcuucaaauuauuauuugaauaaugaaauucaucagaacaauuaguguuaagaaucauauagcaauuuauagaaaaggaagaguucguagguuauaaauucuguuaguugcuaagaagcauuuuuaaaauuauguacuauagcucuuuauucagcagacgaaccaauuacaaucuguguaacuagaacacuugacuaaaauuauauaauuuuuacaacgcuucacugcauagauacaugaacauaauuuauuuguaauuggaacaaagccccaaaguagcaguuuuguucuaccagguaauuaaugcucauuuuuaaagccuuuuauuauuauuucugaaguaaugagugcacauggaaaaagacacauaauaggcuaaacaauaagcccguaagccaagccaacauauuccaggaacaaauccuugccaaccucucaaccaggauuuaacuucugcuuuucccccauuuucaaaaauuauagcauguauuuaaaggcagcagaagccuuacuuucagguuucccuuacccuuucauuucuuuuuguucaaaauagguaguaauugaaguuuuaaauauaggguaucauuuuucuuuaagagucauuuaucaauuuucuucuaacuucaggccuagaaagaaguuuuggguaggcuuugucuuacaguguuauuauuuaugaguaaaacuaauugguuguccugcauacuuuaauuaugauguaauacagguucuggguugacaaauaucaagacggaggagaucucugaagugaagauggaugcagaauuccgacaugacucaggauaugaaguucaucaucaaaaauugguacguaaaauaauuuaccucuuuccacuacuguuugucuugccaaaugaccuauuaacucugguucauccugugcuagaaaucaaauuaaggaaaagauaaaaauacaaugcuugccuauaggauuaccaugaaaacaugaagaaaauaaauaggcuaggcugagcgcaguggcucaagccuguaaucccagcacuuugggaggccaaggcggguggaucacgaggucagaaauucgagaccagccuggccaauauggugaaaccccaucucuacuaaaaauacaaaaaagauuagcugggugugguggcaaacaccuguagucccagcugcuggggaggcugacgcaggagacuugcuugaacccaggagguggagguugcagugagcugagaucgugccuaggcgacagagcgagacuccaucccaaaaaaaaaaaagaaaagaaagaggcuguauguauaguucuuucagacuacaaggcagcaaaguucgugcaugacucgggacuuaaaguggaauuaauuucaauauagcagccacuuugacuuccacuguguuuucugggaaaauagguuuacaauagguuuauuugaaggaucaaacacaugcauacacugcuugguuuuacagaacacuuuauguggcuuaaauucacauccggaacugucuuccuuuacccauucauuucucccccagcucuuucuuuucauucccuccccuaccucccaugauuuaacuucucuugcaagaguaagaucauggagugagcaggaccccaugauguucccgauaguguuauucaucaaaagguuugugcaaagaagacagcagcuuccuuuucagaugaaaucacuuuuccccccuaauguuagaauuggaguaaaucaaaaagccacaucuccuuuguggucagcucuaguaguuauauaaaauccuuuaccaaaagcuuagaaauggagauaaaucaaaucguggauuauguuaggguuccaucuuaucaguaggugcaguaagaggguuaaauuaaugaagacgacaauuuuaucacauucagugguggacagaaaaaugguaagaaaauuuccauagcaauaauacuuaaaguuaucucaggcacuucuuuuguuuuguuuugugugugugugugugugaguguuacuuuuuuccaagcagaaaaugucuuuucaauauucauaaaguugauaaauccuaguauuaaucucuaaaagaaacaccuccaaauuauuauuuaugccuuacuugacuccaaauaauuguagcaaauaaaaaacugacuugggauuuggauuugcauucuuaacucccauaguucuuuuuuuguagaaagacauuuagcuuuuugaagcaugguuuucauuggcaagauaaucuaguaucaguuguuauaagaucaggguuucucuugaugaggcuguugcugaagagguuaauaaaaacuggggaaccacuaaagaguugaagaguuggugggguagaaagcugacgauuaauguacagauuugcauuugucggggccuggggccugugucauauaagcccauccccacaauuacacuaacgccuauaaugcgacagugacuaauggcagcggcagcaauuaggagaaucagcucccucuacuggacuaguuaagauaauguauuauaauuagugcaaugaauauuacaaaauuacaguauuuucuuaaaggcacaggcauauguccagacuuguauuuauuccugauuaccucacacuaguauauuagcuaauuaaugauuugcuuuucauaaaaauguugagcuagcauauuuguuuaguaaagggaauaauuaugaacaauuucucauuuuguuauaaaccacgaguaaaacacuuuuagaaguugcuucauuugcuauauuuuauauugccuuuccagauugcuaguauguuaguuucagcuuagaaaaaucagucauuugacuaccuugaggcuaaauugaaagaauuuuuuagggagguacaggcauaccuuggaaauuucagaacaccacaauaaaacaaauuuugcaacaaaaugucacacaaauuuuuuggcuucccaguacauauaaaaguuauguuggccaggcacgguggcucaugccuguaaucccagcacuuugggaggccaaggcagguggaucacaaggucaggaggucgagagcauccuggccaacauggugaaaugccaucucuacuaaaaauacaaaaauuagcugcauaugguggcaugugccuguagucccagcuacucgggaggcugaggcaagagaaucucuugaucccaggaggcagagguugcagugagccgagaucgcacuccagccugggcaacaagagcaagacucugucucaaaaaaaaaaaaaaguuuguauuuacacuauacucuagucuguuacaugugcaauagcauuaugucuaaaaaaaaaaaaagccauguauauacuuuacuuuuauuaguaaaauauuuuauuacuaaaaaugcuaaugaucaucugagucuucagcaaguccuaaucuuuuugcucguggagaaucuugccuugauguucacugcugcaggcuaauccaggugguggcugcugagguuugugguggcuguggcaauuuccuaaaauaagacaauaaugaaguuugcugcaucgauugacucuuccuuucacaaaaagaugucucuguagcaugugaugcuguuugauagcauuuugcucacaguagaacagcuuucaaaauuggagucagucuucgcaaaucuagccacugcuucaucgaguuuaugugauauccuaaauccuuuguugucauuucaacaguguucauagcaucuucaccaagaguagauuccauugcaagaaaccacuuucuuugcucauccauaagagguaacuccucauccauucaaguuugaucaugagaugguagcaguucagucaugucuuuaggcuccacuucuaauucuaguucucuuguuauuuccaccacaucugcugugacauccuuuacugaagucuugaacuccucaaagucacccaugagaguuggaaucauugucuuccaaacucccguuauugcugauguuuugaucucccauggaucacagauguucuuaauggcaucuggaauggugaauccuuuuuagaagguuugcaguuuacuuugcccagauccauuagaggaaucgcuaucuauggcagugaauagcccuacaaaauauauuugaaauauauuuugaaauaauaagaggcugaaauaauaagacuugaaaguugauccacaggcugcagaauggauguuguguuagcaggcaugaaaacaacaguaaucucccuguaccuguccuucagagcucuugggugacuaggugcuuuguuagugagcaguaauauuuugaaaugagucuuuucugagcaguaggucucaacaguggguuuaaaauauucaguaaaccaugcuguuaagagaugugcugucaucccaguuuuguuccauuuauagagcaugggcacaguagauuuagaauaauucuuaagcgcccuaggacuuuuacaauggucagucuuggcuucaaaaacaaagucgccagcugcauuagccccuaacaagagagucagcuuguucuuugaagcuuugaaggcaggacuucucucuagugaugaaaguccuagauggcauuuucuuccaaauaagucuguuucaucuccacugaaaaucuguuauuuaguguagccaccuucaucaggagucuuaucuagaucuucuggauaacuuauugcagcuucuacaucagcacuugcugcuucaccuugcacuucuguguuauggagauggcuucuucccuuaaaccucaugaaaucaaccucucccaacuuuuuuuucuucugcagcuucuucaccucucucauccuucauagaauugaagacaguugugggccuuguucuugauuaggcuuuggccuaagagaauguugugguugguuugaucuuccauccagacaacuaaaaguuuucuccguaucagcaauaaggcuguuuugcuuuaucauuugugugcucacuggaguagcacuuuuaaucuccuucaagagcuuuucuuugcauucacaacuuggcuaacuggcacaagaaucuuggcuuucaauaugccuugcccacuaagcuuaauuauuucuagcuuuugcuuuaaagugagagaccugugacucuuccuuucacuugaauacuuaagaggccacuguaggguuauuuacuggcccacuuucaauauuguugucucucaagggauagggagccugggaguugaggggguggaguggccaguuuggggggcagacagaacacacacaacauuuauugauuuaguuugcugucuuuaugggcauguuucaugacacuccaaaacaauuaaaauaguaacaucaaaggccacugaucacagaucaccaaacagauauaauaauuuuuaauguuugaauauuuaaauaauuaccaaaaugugacacagacaugaagugaaccuguguucacuguuggaaaaauggcaccaauagacuuguucgaugcaggguuaccagaaaccuuuuuguuuuuuuuuuuuaaauacuaucuguaagcacuacuguacaauaaagcuauguaugccuguauuuucauuaaguugcagagcaaacgugguaauauuuagcuuuaguuuuacuucaucuggcauaagaucaacuccuuauauaacaagaugauaaaaguuguggugugcuucuauaauuucauucaaguagauaaaguugaaaaauaaugacuugcuuuuauaaacaguaugaagcaauguagugcaguaaaugaaauuuuauuccuucuuuacaauguucucaaaauuauuuuuauguuuaauccaaauaaagagcaagaauaaagcaacauuucagauuuugguuucuggagacaauaguuagaaagcaugaguuaugagugacuuaaaauucuuguugccuguacuucacuuugaaauaacauuaugcuuuaaaaagcauuacacugcuaaagguuaauuagaauucugcagaauuacuauagcuaaaaguagguaacaagauaucuuuuuuucuauuguuuaacuccuuuguuucagaaugccuauuccugugcauuaaaagugucccuccaaggaaauuaggacaucugcagaguugaaaaacaccuaagucucagucacuuagagucacacaucagggcucagagugcuaugacuaggaaaaugcugaccuccuuucauuaguaugaucgugccuuuccagcuuuugauagauccaagcgcuaucuucccaccacucaccaaauguuccaccugucaaaggguuucaggucccugcagacuucgguuuugaccuguggggaaaguagacuuccucgaacuggggaagccacauguuguacauccuucuauaaacuaugauuaucauucuuaguaggaaaauaugugauuucuuuuuuuuuuuuuuuuuuuaaaguaagcaucaaauauuugaccaaccaguugggcagagaauauacugaaacuuuuuauauaaccucauccaaauguccccugcauuuaagaaaugaaauucuucuaauugcguuuauaaauuguaaauuauauugcauuuagaaauuaaaauucuuuuucuuaauuuguuuucaagguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguagguaaacuugacugcauguuuccaagugggaauuaagacuaugagagaauuaggcuuagcuuuuugcuaagaacuagcuaaguaucucuuuuaaaaaacgaaucagugugcuuccaugaugcuuggguuacaguuguucuuucuuguuuugguuuucauucauugcaacuuaccgugaauauucugcucaagguauugagaguguguguuguuaucucaacuuacaauuuguguugaaguuaucaaaauaauacaaaugauaaugcaugacuuuaaaaaagcaugauuacucuuagacuuuuuuuuuucaaacacaagcaacaaaaaccaguacaagaaguuaaaaauaaaaauagaaguaggaaguugcuuuuuccaaaaaaacuaaacauguuuauucuuggauuucuuuugucuuaaauagucuggccucucaauacaaccagguaauaguaaauaaugugacuuuucagugcagacucuuaccuuuaaaguuucucaggaaaucacacuauaccaaauggcccaccaaaacauacaugauuguuauuugagaguucugcaaccuauuacccugcacuuccaccugaaauaucuuaguuucaaggugcuauacuaaaacaagaaagagagaaagaaaauuuacgaauaaguuauuuuuaugcauuugaaaugccauuuggaugggggaaaaaguguuaaaaucucacaguauaugcaacuuuuuaggaaacugucuugcagagaguauaguguaaacauaacuuuuauaugcacagggaaacugaaaaauuugugugacauuuaauugcgauauuuuaagaguuauggaauuuuuagagcugaaagauuuauugaugaugaccaaucaaauugaucuucucaucuuguagaugagggaacugaggccgagacagaaggguucaaauuaugcaaggucaagcucagaguccagauuuccccucauauuccccauugcuuuuuuuuuuuuuuuuugagacagucucgcgcuguugcccaggcuggaucuuggcucacugcaaccucugccuccuggguucaagcaauucucuugucucagcuuccugaguagcugggacuaugggcacacgccaccaugcccggcuaauuuuuguuuuuaguagagacaggguuucaccauauuggucaggcuggucucgaacuccugaccucaggugauccacccgccuuggcuucccaaagugcugggauuacaggcgugagccaccgcgucuggcccccauugcuuuuuccaucagagaaaaguccagguguuucuagggaguugaagauuccacuauccccaaggaaaugggcucuaaaccauucuugauuagaagaggacaggcagaguuuaaauaaaugaaauuuguggugaagccagaaauuucauuuugcucagcaauuaaaaccucugcagacuacaacagaagcugcugauggaaauugggguggagccucauuuccccauucauacugacguggaugagcagugugaggaaggaaaccaagagaacagcaggcagcaggguggaaaggaacggacugacccauagaucagagugugagcacauaaaagcaaugaccccacugucauguuuggccauugcaccuuuugugauaguaucuaagcuuaugucccucaaaacaguguaagauagguuuucauuaguaucagcuuauuucauuucugcucaaauuaauuuuuaaaaaaauuuaauuccauauuugagcaaauaaagaugucuucauacuugaguaauucaagaccccuuuuuugcugcuguuguuguuuugguuuuuuucaugguuuuguuguuuucuuuuguuguuguuguuucuuuguuuuuugagauggagucuugcucuuucacccaggcuggagugcaguggcaugaucuccgcucacugcaaccuccaccucccagguucaagcgauucuccuaccucacucucagccuccugaguaacugggauuacaggggcauaccaccacgccuggcuaauuuuuguauuuuuaguagagacaggguuuugccauguuggccaggcuggucuugaauuccuggccucaagugauccgcccuccccaaccucccaaggugcugggauuacaggcaugagccaccaugccuggccuucaagagcacuuuuuaguuuauuuaauauaauucucuuuguugccggucuguccguugaaguugccuucuuugaugccagaggccaaagacuuggcuuccucgggcuuccauaacaaaguaacacagauggguggauuaagcaacagaaauuuacccucucacauuucuggaguguaagaucaagguaucagccagguugguuccuccccaggcaucucuccuugguuugcagaugccugucugcucccuguaucuucacaugaccuucacucuguuuuucugcuguguccuaaccucuuccuacaaggacaccagucauaguggauuaggaucaacccugaugaccuuguuuaacuuuaauaaccucuucgacccuaucugcaaauacagucacagguggagguacuggcagcuuaggacuucaacauaugaauucuagggggacacguuuuagcccguaacagaccccagugaugcugagcauaaaagcaaggccuccaccuggagcuccuuccccuggcugugcgugagaccagguccuaccucagaccuaaggaaaaagaauccccaaauaggaggcugcgaaucugaguguugaaaauuuccccaaaugaaugagaugugcagucggauuugagaaucccugacacaucauuuuaacacuccuuccuuuuaguucuccgcgcaagccucagggaguggaaaaugguaucucucaccucccagauaaccgguugccuuuuaagugcucuuccagcugccugaauuaaaacgcucuuuuuuuagucaguuuaccaagcagugucucauuggacuuaaaaugucagaggagaaguugacacuuugacccagauucugacauuaauuuuuaagccaggagguauccuugcaggagcaaaaucgggaaggauggcuguucagcucuucucuccucauuuugcugucuacuggagagcaacuggaagccuuucuagaugaggggcuccaccucauucguguuuguuuuguuuauuuccucucagcuccuuccccucaagaccuuugugacuguccuuccugaaagcagcccucugugcagccccauagugugucuguacagcaauguugaaauagaccacauuccgcuuuucuguccucaaaaaagauguaguuuagcugggaugguagaaccugaacacagggaguugcaacccagccuagggauguucccaggugagagagcacggugggcuuucagagcaccauuuuucuuagcauuccagcgucugcacccacagaagugaugcuucugcaacauccucuuccuaccuuaacaggcacucucacccucaaguacauggaaauaccuuuauuuccggcucuggcuaaccuucauuaaucaguaacccuacuucaguaagaacaaaaaugaguacaucaauauuuccaguuggacucaccucagucacucaggacagaauaccauuguacuuacauaccaucgugccugaagaagucaugaugaaagcuuugguuuccaggagauuuuuuguuuuuagagugaaaaaugcccgcagaagaucacagagauaggaacccuaggaaaaaaacuccugagaacaaauguauaaaugaaacaagccuagaacagucacauaccacuucacacuggagagaacguucugagaaauguggcauggggcgguuugaucgcugugcaaacaucauaaaguacauguacauaaaucuagaugguauagccugcuacacaccugggcuacacaccuacaacuauugcuccuaggcuccacaccugugcagcauauugcugcacugaauacuauagacaguuguaacacacuggcagggauuugcguaucuaaacaaacuagaaaagguacaguaaaaaauacgguauuauggggccaccaucauauguuuggucugucguggacuaaaaugucauuauguggcccauaacuguauuuuuauugguagaguuguuagcauuuggaaaugagcacuugcuaguuguuguuuuuuuuuuuuuuuuuuuuuuucaaauaagcaggaaauauugacuuacugaauuuacuuagccauaaggccagagagucacucugugagccauuggccacgcuuucccaaggagguaacugugccuuauuggugcuucaagcagugaagcaauagcccuuuauuauuaccacuccccaaaugugcccuccaugucagaauagcccucugguggcuggaaaucucagcacuagcugaauuaaccaccuugcuccuguuuuaggacguuccugcaaagcccacuaaucccaggaucuguuuaguagcaagcgguacuuuucuacauucacauacauagacacuggauauuuaaaaauacguauuguagcucuuucugcuacucuccccagacaugucaccuuuaauaaggagaaguugggggcacagcuucucuuuauuauaggaugugaaaaaguuuuccucucacagaucugaucacuugaacaccagaagucuccccgcccccaccuccugguuaucucauuaaugaucuaaauaagaagagaguuccuuuuauuuggcuuuuauggagguauggcauaugacuuuuucuaaguaauaugcugucacacuggugacuguauaaaaagauguccuuagagguccuuucuucccggccagaagcugacccaccaggauacagacgcacugacguuggcauuguagaguaguuggagagaguggucagguugaauggaaagccacgauaaggaaaagugagggggggugcagaaccuaggaguggcuuacagugagcagcaggaagagaaauuggaagaucaaaggaaagcaucaaaaaugaucacaggccaggcgugguggcucacaccuguaaucccagcauuuggggaggccaaggcagguggaucacuugaggcuaggaguucgaguccagccuggccaacauggugagacccugucucuaauaaaaauacaaaaaauuagccaggcgugguggcaugcgccuguagucgcagcuacucaggaggcugaggcaggagaaucgcuugaacccaggagauggaggcugcagugagccaaaaucacgccacugcacuccagccugggugacagagcaagacugucuuaaaaaaaaaaaaaauuaugaagggauagcaaaggaguuccugaaccugccugaagaauugcuugauguuggccauaaacauagucaacugccuucuaguuauauauaacuauagagagauggcaucaaaauuaggaaaacaagcaucuauacaacuagguagcaggcaguuacugggagguuacgagggauaagucacuagcuugaaaacuuccuauuuucuuugcuuuuauuuuuuuuuuccgcagacuuguggcuccuuugaugugucacacuauuguuguauuguucgccuuaguucccuuacccuccuuuacucgucugguccaucucaaugacaggauucugucguuuggccugacucagucccuuguauaaaaggacaucuauuaauccacauccugcugguuacuguacauaauaaaauguaaacgugguguuuccugccucuccuccaagcucacacacccgcauguaaauacucuaggggcaauaggaggagaccuagaaacuaaggucacccaaauagaaucuugucccugcaggcggauagcugagcucuaaauuacucuggauacagugaaggacuaaaugguuccaaugaaucaaguucagggagaaaagggucaggggguauggagguuagccaaagagugucaaacguucuccucaaagcuauuuuagaacaaggcuggucaggcuauuugggcucagcucuuuucagcgugugucauaggcagcagccaguugaagccaugccaccaugcagugcagggguccaggucucaggaaggugcagcguaccgagagucacaugaagaccucagaucauuuccugcugcuguguaauccaggcagucugggaagagaaugaauauucagugguuguauguaugugugucuucaucccagcaagugacagauguuccugcccaguuggaaaauggaaauucugacuucauugucuuaucauuccuuccagaacaagcaccaugggcucaaacccucccuggcucugcuuuaagggaaauaauauugugucugugcagaggcccugucugcacagggucgugguagggcuggccuucacaugguggcccaugccacugcuguagcuuagccaugaggaagagauuggugagccugcuggagaggaaggcuacccuuacuuggugcuccuccuuuauccauagacaugaguacucagauuuucgcaucuagcuuucaaggggcuggagauuaaagauccaauccauacuccuuggaugcccuuuugucaagauaaucccuucuucuguagcuccuaagcccucuaaggucugagggccaagcugccccauggcaggaauggcaaaauguagcuguccucucaguggcaaaagguaauaggauuaucaaguagcaaaacagaagccaagaaaagacaggagaguuagaggucuggauugugcaccagccuuggagccucgcaucucuagcagggcacucuuaagcguuaggcuuuggaguuugaagaggagauaaaccuaucaaauugccagguguuccccugcccuugaugcaugcaaaugauuguugacagccagugugaugguagaugugccuccuggaagaaauaaaaguauaauauuccaacaaucaagcagcauuguggcuuuuuucuacaaucagaaacauagcagcuuugugcuugaucuccuaagcaagauaauuuuuuuuaaccugggcauucuuugaguucucaguuucgaggugauggggagcaaaaaugaugcccaaguucaaauggcguacugcugcagauaggcugucuccuggcacacagauuuacagagugaaugaaaucucucauucauuggugcuaaucuuuaaccaugguuuuuaacuuacaaguuggaggcuaauuacacaguuaccaguuaaagccaggugaccucauuuguugacaacagugcacagcaaaggaaagaggagaggauaaggaaaauaucugugauuugcucccagaaggacagugaagcugagcauccauuugagcagaguccucugaguacuggccuuggucagagcuuguuggugggagugugcuaaggggagaugccuaggucugucauuggaguaagcugaggguuuggaugcaggggaacucaggcagcucugagccacagggugguagaugggagggauucacaguggcgcacagucucuuccauaaauggaaacguaagaaucggggcacauggccauggcggcucaugccuguaguccuagugcuacuuuaggaggccgagguaggcggaucaccugaggucaguuugagaccagcauggccaacauggugaaaccccaucucuacuaaaaauacaaaaauuagccaggcguaguggcgggugccuguaaucccagcuacucgggaggcugaggcaggagaaucacuugaaccugggaggcagagguugcagugagccgagauugccugggcaacaagagcaagacuccaacucaaaaaaaaugggcacauaauggauggaacauucugucccaagggaugagggagcuguauaucuaccuauuccagcugccuugggauuagccacugguagucauuccaccucacucccagacugaaaagagucaaucacuucaugaaguggggcuauccgaagggaccacaggggaccugauuauacugacagauuuauuuuuauuuauuuacuuuuuuugagacagagucucccucuguugcccaggccggagugcaguggcacgaucuuggcucacugcagccucagccuccuggguucaagcaguucuucugccucagccucuggaguagcugggacuacaggcacgugcuacugugccuggcuaaauuuuuuuguauuuuuguuaaagaugggguuucacuauguuggccaggcgugucucaaacucccgaccucgugauccacccgccuuggccucccaaaagggcugggauuuugagccaccucaccuggccuuuuuuuucuuggagauggagucucacucugucucccaggcuggagugcaguggcacaaucuuggcucacugcaaacuccaccccccaaguucaagccauucuccugccuccgccuguggagcagcugggauuacaggcgugcaccaccacgccuggcuaauuuuuguauuuuuaguagagacaagguuucaccauguuggccaggcuggucucaaacuccugaccucaagugacgcacccaccucaggcucccaaagugcugggauuacaggagugagccacugcacccggccauauugacagaucuuuuagucugaauuguuaucagccaguguggucuagucaugacauaucuagcuccaucucgagaccucaugucuuacugcugacacuacauccucgcugguacuuuuucuuccuuggcuucaggggcauugcuguguaggcucagauccaugccagaugggguguguagggggaaaagcugcauaagggaggaaugucacuuggcaacacucaacaagggggaaugggccugcaguauucucccagagaugaaugagcagcccauucuaggaaauaucccuuugaaggaauaucuucucuaugguacauccaaacuuuucucuggaaaacaugccucuucauucugaugacuuucuauuuauucucuucaucuuaccaugguuuuacaaaagaggaauuuuaacauacucauucagcagaguuaaggaccuccucucuucugcgaacggggagagguauaacaaauauaguaaaacaagaacagccacugcccacguuguagggguaaguacccugcccaaccugcagacaguaaaugccacacacagcucuaacagugacagggggagaaaaacgucuucaguuacuggccugaccuuagagguaaagcaacauauuaacagagagggucugauuuuaaacuuugagcugaacauacuucuauaguaucuuaauucucaguuuuuaaaaaauuacaucaucuagaauggcgucguccuugcucuuccuuuuuucuugugccaaauaauagcccccuuugguauauguuauuguuuuaauugauucucaaaccucuccuuaacauuuuaacaaacauaaaauuugauagaaaugggcuagacuaaauucagcaguccaggaaaucgaguauuuuucuacacagauuugagugucacccaagauacaguauacuuugcugaaucucccuccaugauacucuugugguuuuaucuauuuuaccaaaacacuuccacguaaaacaggcuuccguugacucuguuuguccuuuauggacccaacaggggaggaaaaaauaccauugcacuggguuuauccacuuacuguggaguuggggaaccagaaacaaccacuggacacguugcaagcgcgucaagguuuccaccgccaccugguggcuagauggagcacagcaucuguguaacuggugggcaaaggcguucugcuccaagaugucaaagugggggagaaaauuauggguguucugcaaucuuggcaaaagaagaguacuguacuccuuaucuuuuuacugcuucuccauguucacccuuaaaagauugauuuuuauuuuuuacucagcucuccucuuguuuuucagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgggcaagacuuuucuuugaaggaugacuacagacauuaaauaaucgaaguaauuuuggguggggagaagaggcagauucaauuuucuuuaaccagucugaaguuucauuuaugauacaaaagaagaugaaaauggaaguggcaauauaaggggaugaggaaggcaugccuggacaaacccuucuuuuaagaugugucuucaauuuguauaaaaugguguuuucauguaaauaaauacauucuuggaggagcaccauugugcuggugugaaugauuccauaguaacaaucuugaccauuuacugacguacagaccagugagaagucuucgcauguuggguacccacaccuguugugucuuaauugcaagucugaguaggaaguuggggccaacaugugucucccagugcugggaaaauauuucauagaccuaauuuacagucuuuacuugaucuaaaacauuuugcugccauauuuuggcccucaaguuugucccaaaugagagacaaagggaaaaguuccagggaaauaaaaauuaagacagcugauuaucuguaaagcaugguuucucauccugaacgcuacuaacauuuugcagggaauaauuccuuguugaagggaguuguccugaccaguguaggauauuuauuuauuuuauuuauguuuuuugagagucucgcucugucacccaggcuggagugcaguggcacaaucucggcucacugcacuccagccugggagacagacgagacuccgucucaauaaauaaauaaauaaauaaauaaauaaauaaaaggagggccuggcacgaaugacaugcagggaaggcagugagcagguggaggucccuguacucguuguggugccuuaucuaccaggcgguugaguugacgucuuuguggacagaauucgauuacaaagguguccgaaagucuccaggugggggagaguuuuguagcgggcauaauuuggguuguaaauugacuguugucuccugagcagucuccuggugagggagaguuucacuggagcuuugaaacacauguuagacagccuugcccuguagggagugucucgugaaggagagguaaacaauuauaauugcauuucuaaagggcuaaguaggacaugggaaacuggaaaauggagaaaagaagagaaaaaaauaguaacucauucucuuuuucuuagaaaaaugaggauacuuggucacauccucacauggugaagaauaagauggucucuucauuucccuucaacacuagucccaucgugaggcucugcccucaugaccuaaucuaauccuaacugccucccaaaggucccaccuccacaucccauuauuggggauuaggguuucaacauagggauuugggggaaacacaaacacucaguucauagugauaucugacugcgauuccaaaggucugaggacacauuggcccuguuguuuuugcuguguuguccuuggccucaggugaacauuuuagcuuuagauugcaacauuuuaagcuaaaaacacuaagcuagaaaauuaaacuuaucucgucacauucugcauggugaacaaacucaaaacucaccugaguguaucuuguuuucaugagaaaaaaugaccggucaucucccuugcccuguuagggacaguuagacaugacugcuguaugaagauauguacauguuaacaauucauauguacaagcuacuguuccauuuugccuggcccaaggggagguagcuagcuaguugggguagcagggcgaauuaacccuaauauaauaguacauuucuaaugccaccaaugaaaugaaaaccagcucucaaacauggcacuauaugggauggcauuccaaggccaacucaguuacaguaacuacagcuuuaacuuugaucauuuuguuaccagaaaggggucccaauccagaccccaagacaggguucuuggaucucaugcaagaaagaauucaaggcggguccauagaggaaaaggaaaugaaguuuuaaagaaaguaggaaaauaaagagugguugcuccauaggcagagugaaccuaagggcugcugguugcccauuuuauuguuauuucuuaauuauuuacuaaacaagggcugaauuauucaugccuccccuugguagaccauauaggguaacuuccugauguugccauggcauuuguaaaccgucauggcucuagugggaguguagcagugaggacaaccagaggucacucucauugcuaucuugguuuugguggguuuugaccggcuucuuuacugcaacuuguuuuaugagcaaggucuuuaugaccuguaucuuaugcagaccuacaaucucauccugugacuuagaaugacuuaacccucugggaaugcagcccaguaggucccagccuuauuuuacccagccccuauucaaaauggaguugcucugguucagacgccucugacaauuuuaaagcuaaugaaaaaaaugucuagccaaauguauauauacauacauauauaauuaugaaaagauaaugccuuauaaucuugauucuuaaauugagguauauugauaguauucucccaauggucuggggauuaaucaauagguaauuuauacaaaacugaagugcugccaaauagaauuauaggaguagcugcugcgcaaaaaagauuaaugagauuuggggagacuuugcuguggcuaauaugaugggucaggaagaguacaaucucaguacaauuuuaaguuguauuuaucuuaugaauaauugggcuauucuuucauaugcccaagggccauuuuauagcucuauauuucuuuuguguucuguuuggggcuugaagucucuacuucuguaucgggauugcaaugccugcugucuuacuguuuccauuugucugguaaauuuucguucauuccuuuauuuuuagcuauuuca

SEQ ID NO: 18154 - RNA, 2580 nt, Homo sapiens
gagugguagaguagauguguuucauuguaagaaaacuccacauaaaauaaucaacaugcagacccaauauauuaggaaccaauuucacaaaggaaaagauuauuugcuuuuugagugaauuuacaacaggauuuuuuuuagcauggguuacacuuugguacucuuuuuauucuuguuuauuauuuauuuaauaagaccacgauguuauauaauagagguuuauacgaacaacuggaauggaaacuaauugggaaauaagauguagcagucuccacuggugaacagauaccagagaauuaaugccuucuggcuuaauucguguauccagaaauugugcgcauuccagguagauccccagcucacuccuaccucccuuacagauggaaguuuaucucacauggaccugccuuauccuagaaauucugacucucuugguucacuuucagaguaacaauccugggaagagaagaaauuauccccugcagccacuaagaaucagaacuuacagucauuagagauuucuccuugaaugucuuuuugcuuuucugggauuugcuaaauuugcacaaaucuagauuagcauaaaguucugagagcauccacuagugauaaaugaaggaugaauaauucaagacauaaagguagacaaugaaaauauuacagacuguauuuugaccuuaugggagucauuuccguuucuuagagacaaaggauuuuucuuuugaaaacacagaaggaauaaaaaaugagguuaucaaauagguagcuggacuucaaauuauuugguuuguuuucuuaaacucagcaagcucuuaaaccuccaaaacacauuuuuacauaaaaaacauuuuauucuacaguggauccaaauauacuauuuuauaagaggcauaaaauaauacuaaaucuucagugguauuuucugucuaacagcuauaaagcuaugauacaaugguuaagcuaagcuagaucagauuucucaaccccagcacuauugauguuuuggacugccuaauucuuggggguggcgggugguuauccuguugacuguaggauguuuagcagaaucucuggccucugggcacuaucagaugccaguaacaccacucccucaagcuguaauaacaaaaaaugucuccagacauguuccggugagggacaggggaucaaaauugacucaagugaagcacuaugagcuagauaaaggagccuaauucuaguuagccuaagacugaucuugccacaaauaaaccuauauaaauuuauuaggaaaccuaucaaggggacacagcagcugugaagguggucuuaccacacagugaccuuuucaugcuaaguaucuuacaucuuuuauuggcuuagccaaaagcagagguuaaccaagugcucggucagacucacccuguggaaaaaucaagaugguaggcauggccugcugaauauaaaacuggaugguauaacugagaaacugaauucuaacuggagcuuucaggcugguauaaaaaagcuacuucacuguucuaccacuguauucacuaauagauaacaggggaaaaggcuaaauuauuaaaaaauuguauaugacaaaagaaaacaacaggugcauaaaaauaaucugaaggguaaacuuuaaaguuauaacuauuagagauuauauuuuuaaguuauaaggcauggcacagacaacuuauauuuuuaaguugcgaaacacggcacaggcacauaaugaaucuaguucaacuggcccuauuuuugacuuuuuaaaaauauucauggauggggaggcugcgcauguguggggacaggggguacacgggaacucuauuuucuguucgauuuugcugugaaccuaaaaucacucuaaaaacuaaaaucuggguuacggauaguagcacuggguuuuuuucuuaaauaacuuaucaacauagcuguugccucaaaauaccccuaaaaugccauuaagcacguccccaggaaaucuucacuuugcaauaagaaagaauuuaugggcugguaccucuuuggcgacggugugccagugaagaugaguuucgcaaacauccauccucuccugguguaagaauuugcacuugucaggaacgagaagggcaucacuuacaaacucaccaacugaaagaaaggaaaaccacuucccgucauuccaucuguaucacaguguucuuaccgcagaagacaucaaggaaagauagacuucaagacaaguuaaacagccuuuuaaugccuaagcaacccaaucaagacccuacuaccuuuagaauguuacgucuggccuccuuaagcaacuccguuucuugccacuucaaguuugaugguuaaaauaaugccuaaaugcugcaagugaaauugucccuuaauuaaucugaauuucuugcuucaaaauuaauccuaaaaaagcugcuuaacuagagaaccaauuaccauucuacuacaacaggggaguaaaauauaaauauugacauugucuagguaagcauuugagcagaaucaauauaaaucccuacuuuucuuucuuggacauuuuaaucugcuuguaaguaacagaaauuuuagcauuuuucu

SEQ ID NO: 18155 - RNA, 9582 nt, Homo sapiens
cuugcacucgcuggaaagcggcuccgagccaggggcuauugcaaagccagggugcgcuaccggacggagaggggagagcccugagcagagugagcaacaucgcagccaaggcggaggccgaagaggggcgccaggcaccaaucuccgcguugccucagccccggaggcgccccagagcgcuucuugucccagcagagccacucugccugcgccugccucucagugucuccaacuuugcgcuggaagaaaaacuucccgcgcgccggcagaacugcagcgccuccuuuuagugacuccgggagcuucggcuguagccggcucugcgcgcccuuccaacgaauaauagaaauuguuaauuuuaacaauccagagcaggccaacgaggcuuugcucucccgacccgaacuaaaggucccucgcuccgugcgcugcuacgagcggugucuccuggggcuccaaugcagcgagcugugcccgagggguucggaaggcgcaagcugggcagcgacauggggaacgcggagcgggcuccggggucucggagcuuugggccaguacccacgcugcugcugcucgccgcggcgcuacuggccgugucggacgcacucgggcgccccuccgaggaggacgaggagcuaguggugccggagcuggagcgcgccccgggacacgggaccacgcgccuccgccugcacgccuuugaccagcagcuggaucuggagcugcggcccgacagcagcuuuuuggcgcccggcuucacgcuccagaacguggggcgcaaauccggguccgagacgccgcuuccggaaaccgaccuggcgcacugcuucuacuccggcaccgugaauggcgaucccagcucggcugccgcccucagccucugcgagggcgugcgcggcgccuucuaccugcugggggaggcguauuucauccagccgcugcccgccgccagcgagcgccucgccaccgccgccccaggggagaagccgccggcaccacuacaguuccaccuccugcggcggaaucggcagggcgacgucggcggcacgugcggggucguggacgacgagccccggccgacugggaaagcggagaccgaagacgaggacgaagggacugagggcgaggacgaaggggcucaguggucgccgcaggacccggcacugcaaggcguaggacagcccacagguagaagaauugcucucguuugucuguccauucauccuccucuccucacuuuaucuaucccacgcgacuucaggguagacuccugcuggcaggcaggaucauaaguccgcggacagaacggaggccuggaguggaggaaugugguuugagguuuggauuggugaacucagcuagaaaacauacuugcauuugcccgaauaaugaauaaccaagaaaaaaacugacaaacgauuuucugcaaacuaaagcaaagcauuuaggccggggagggagaguuuguaaccugacuccuuccaccuuuagcgaguuggagcuugugcgaguucuuuccacucuguguauuucuuuuuaaugauuuugugugcgccuuuugugcggguugcaacguugcgcugaguuuuguaaccgcugccugugcgugcauccugcgcucacgggagggcggauguggagagggcagaggagcaauggugaccugggaagguacccugagcggcuacgcuaggaucucuguucugcagacuucuguccccuuucccccuuauaaggcugacccaggcgggcugaaggcgguggggccccuucgcagaaccugcuugggaggucuuucccggguuugccccgccucccaguuugcacucccucucgcggccauaauucugcucucaagcacuguugaaagucacugccgguccuuccugcuacggccuucucucugugcagugcuuauucuccaguucuuuuuguuucaucacuuuggugccuuuuuccuucuuuaacucucucgcgugucauuuuuuaaagaauucuccccuuuuccccugcuccucugcuccugggagcaaaguggucgcagcccaguuuaggacuuucugcagggguugggucucaguccggaguggaaggcucuguuccaaauaaucaaucaugccuggaagcuggaacuuauuucgcuggggcagugggaguggggccagaggcugcugggcagagugggugguccuugugcccggaauuggcaagagcggagcaccccagggaccccuggaaugagacagcagagcugugcagucugagauuccuuaaggcccggccccuuggcagcagcccaggcccuacccgaggccuuccacguggagccugaugaucucauucaggauuugagcccucgccugugaaagagugacucagggccucugccugccgcucuugcuccaagauuuuacuacaauuggguaggauuaugugcgaaauugccuuguucagacugugggauuucaaagagaacagaagaaauccugcucacacacagaaagauccugaccaugcaaaggagcgcguggucuuuuuauuuaaaggagaggagagaacuuuaaaaauaacacuuggagugaagauaugcaaauauuuuuguuauuguuguucuggguauauuuuugcuuuguuugcuuugacugguuaggcuuuccuaauauaugcuaggaagguaacuauucuuggacagccugaccauaagcaaacuuuuuuuuuucuuuacaggaacuggaagcauaagaaagaagcgauuuguguccagucaccgcuauguggaaaccaugcuuguggcagaccagucgauggcagaauuccacggcaguggucuaaagcauuaccuucucacguuguuuucgguggcagccagauuguacaaacaccccagcauucguaauucaguuagccuggugguggugaagaucuuggucauccacgaugaacagaaggggccggaagugaccuccaaugcugcccucacucugcggaacuuuugcaacuggcagaagcagcacaacccacccagugaccgggaugcagagcacuaugacacagcaauucuuuucaccagacagguaagaggaagaugguaccagcugugagacuguccucuuaggagucuacguuguaccaaaaagauauauacaaggcauuucaccaguguuuuugcaguuaaccuuuuuuaauuggcuagcaugguuuaucuuacucauuucuacuguaauuuaaauaucucaaguuucacaguucuauuuuaaaagcauuagaaaaaagcuugauuaaagucacaugaagucuucuuaugucaacaauaaugaauguagaugcuccaaagcauaugugaaggcacacccugccaaaaaaguuagaucccaagggucaugcuccccuuauuaauaaguauuuaccuuugcuuuuuguaggacuugugugggucccagacaugugauacucuugggauggcugauguuggaacugugugugauccgagcagaagcugcuccgucauagaagaugaugguuuacaagcugccuucaccacagcccaugaauuagguaagucugcuucaaaguagaaguuaagcucaauucagaaauguaaacugguaaaacaauauaagaaggagagucuguagguuauauugcuauuuuagguccuagugcaucuuagaaacuauagaaaauauuuugucacuauuucaaacauggucauuuuuauuaaaguaaaaaauaagauaguaguagcucuggacauuuggaaauguguauguuuguuuacacccugugaaaaguagacauggucugcaaaagagccaaucuccuaaauauauuucuuucucuagaaauguuauuuugggacaaaugaaugaaucccuguugggaaaaaagaaccugcugcauaucauccauauuuuauuuuauuauuauuuuuuuugagauggagucucacucugucucccaggcuggaguggaguggcacaaucucggcucacugcaacuucugccuccuggguucaagcgauucugcugccucagcaugcccaguagcugggauuacaggugcaugccaccacacccggcuaauuuuuguauuuuuaguagagacgggguuucacuauguuggccaugcuggucuugaacuccugaccucaagugauccacccgccucggcuucuggaauuacaggugugagccaccgcacccagccaugauccauacuuuaauguggguucuggauugcuuccuaggccacguguuuaacaugccacaugaugaugcaaagcagugugccagccuuaauggugugaaccaggauucccacaugauggcgucaaugcuuuccaaccuggaccacagccagccuuggucuccuugcagugccuacaugauuacaucauuucuggauaauggucauggugagauauuccagcuacucucucuagauggcauccaaccuuucacgcauaaaguuuaguuaaaugaacucuuuccuuuuuguucuuuuuauuuuccccacuucaaaauuacuuuuccucugucaagauccuaacuguugagaucuuaauuccaaauaaaaaauagugcuuccgguugaguagcucccaaagcccauucauucacauuguucgcagaucaauaacuuccugucauuguuaauauagaaauaccccauugaggauaagaucuuaauaguaaucuaaaucucuucagcauuucccucccccagcuuuacaguuuucagaucacuuugcugucuauuuucucauaugauaaauauuuucugaaaugggaucuaccccuucaugcccucacuaacucuguauugauauugguuggcauuuccuuugcaggggaauguuugauggacaagccucagaaucccauacagcucccaggcgaucucccuggcaccucguacgaugccaaccggcagugccaguuuacauuuggggaggacuccaaacacugccccgaugcagccagcacauguagcaccuugugguguaccggcaccucugguggggugcuggugugucaaaccaaacacuucccgugggcggauggcaccagcuguggagaagggaaaugguguaucaacggcaagugugugaacaaaaccgacagaaagcauuuugaugugaguuuuucuacugaaacacauucagaauugaaaagaacaaagugaugguaaaagauaugauaccaaguuaaacauccccauccguguccucuagcaggaaugcgagauagcuuauuuuuagaacugauucuuugucccauguggcuuucuuugauacccuaaaaguucucuuuagauaauucuaaugcugaugauuuaugucuccauuuagacgccuuuucauggaagcuggggaaugugggggccuuggggagacuguucgagaacgugcgguggaggaguccaguacacgaugagggaaugugacaacccagucccaaagaauggagggaaguacugugaaggcaaacgagugcgcuacagauccuguaaccuugaggacuguccagacaauaauggugaggagcaacggacucugguuuuaagaaacuggauuaaaaaaagauguacccacaaacagguggcucaagauuggaaacugauaauguuaucauauuauucucuuuccaggaaaaaccuuuagagaggaacaaugugaagcacacaacgaguuuucaaaagcuuccuuugggagugggccugcgguggaauggauucccaaguacgcuggcgucucaccaaaggacaggugcaagcucaucugccaagccaaaggcauuggcuacuucuucguuuugcagcccaagguaguucguuuuuaccuuauuuuuaccuaaaaaucaaggccugggcuugcuaccuuuucaaacaauuuuuguuauacuuucuuugcuuuccauauuaacauaucuucaauuucaaauuugaacuccuuuucuuuuacauuaauuggcaacugccugcuuugaguuuaguguuuucaguuaugaaugaagcuuaaaucuaacacuucacaugcuugcaauugcucgcuauuacucuuuuauaugcaaagaaaagcuuuuuggacagucaagcgcuccucugugcgacuaggcuucacauacagcucauaguuagauacauuuuauauucacacaguaaccaguaguuuuggaaaauagucuaugcaugguccaaaauacuuguuacuggguaacuagcaguagcaggugcaaacagaauaauagaagugguagucugaguauugauuauuuuuauguuugaaaacacauauugaacuaggaaaagcaucauuucuuuugcuguuuugcuaagggaauacaucuggaucugagacagaaaauggaauuuaaugugauugagaugaucgugugucauuagcaccauaggcuaugaaaauauucccaaguugcagauucaauauucagcaagugauuucugaagcacuuacucuugccagauacuaauuauucuaggcucugaagauacagcaguaaacaaagugacaaacagcucuacuuucauugaccuuagcuggaggagacauaggucaauagauaaauaauuuuuaaaaauaucuaauuucuucagaugucuauacguaguacugaaaaauaugccaaagugaaggguaaaugcaugaaaugcauaauguguagaggguacuguguuuaauuagcauggucaggaaaguagagagaaaauguuuacacuuaucauugcagcaucuccuuccuuugcuuguauguaacacuagacauguguccuuuuuucagguuguagaugguacuccauguagcccagauuccaccucugucugugugcaaggacaguguguaaaagcugguugugaucgcaucauagacuccaaaaagaaguuugauaaaugugguguuugcgggggaaauggaucuacuuguaaaaaaauaucaggaucaguuacuagugcaaaguaaguuuuaaaacaccuauuugcagaccuuauaauuuaaaugggccuuucaacaggucugggaaaaaaauaugucucauaaaagauuaauguguuuuuaagcuaaauaaucuaauuagccaaugaaucagagauuuaugccuguuuuugucaccugcagaccuggauaucaugauaucaucacaauuccaacuggagccaccaacaucgaagugaaacagcggaaccagaggggauccaggaacaauggcagcuuucuugccaucaaagcugcugauggcacauauauucuuaauggugacuacacuuuguccaccuuagagcaagacauuauguacaaagguguugucuugagguacagcggcuccucugcggcauuggaaagaauucgcagcuuuagcccucucaaagagcccuugaccauccagguucuuacugugggcaaugcccuucgaccuaaaauuaaauacaccuacuucguaaagaagaagaaggaaucuuucaaugcuauccccacuuuuucagcaugggucauugaagaguggggcgaauguucuaagucaugugaauuggguuggcagagaagacugguagaaugccgagacauuaauggacagccugcuuccgagugugcaaaggaagugaagccagccagcaccagaccuugugcagaccaucccugcccccaguggcagcugggggaguggucaucauguucuaagaccugugggaaggguuacaaaaaaagaagcuugaagugucugucccaugauggagggguguuaucucaugagagcugugauccuuuaaagaaaccuaaacauuucauagacuuuugcacaauggcagaaugcaguuaagugguuuaagugguguuagcuuugagggcaaggcaaagugaggaagggcuggugcagggaaagcaagaaggcuggagggauccagcguaucuugccaguaaccagugagguguaucaguaaggugggauuauggggguagauagaaaaggaguugaaucaucagaguaaacugccaguugcaaauuugauaggauaguuagugaggauuauuaaccucugagcagugauauagcauaauaaagccccgggcauuauuauuauuauuucuuuuguuacaucuauuacaaguuuagaaaaaacaaagcaauugucaaaaaaaguuagaacuauuacaaccccuguuuccugguacuuaucaaauacuuaguaucauggggguugggaaaugaaaaguaggagaaaagugagauuuuacuaagaccuguuuuacuuuaccucacuaacaauggggggagaaaggaguacaaauaggaucuuugaccagcacuguuuauggcugcuaugguuucagagaauguuuauacauuauuucuaccgagaauuaaaacuucagauuguucaacaugagagaaaggcucagcaacgugaaauaacgcaaauggcuuccucuuuccuuuuuuggaccaucucagucuuuauuuguguaauucauuuugaggaaaaaacaacuccauguauuuauucaagugcauuaaagucuacaauggaaaaaaagcagugaagcauuagaugcugguaaaagcuagaggagacacaaugagcuuaguaccuccaacuuccuuucuuuccuaccauguaacccugcuuugggaauauggauguaaagaaguaacuugugucucaugaaaaucaguacaaucacacaaggaggaugaaacgccggaacaaaaaugagguguguagaacagggucccacagguuuggggacauugagaucacuugucuugugguggggaggcugcugagggguagcagguccaucuccagcagcugguccaacagucguauccuggugaaugucuguucagcucuucugugagaauaugauuuuuuccauauguauauaguaaaauauguuacuauaaauuacauguacuuuauaaguauugguuuggguguuccuuccaagaaggacuauaguuaguaauaaaugccuauaauaacauauuuauuuuuauacauuuauuucuaaugaaaaaaacuuuuaaauuauaucgcuuuuguggaagugcauauaaaauagaguauuuauacaauauauguuacuagaaauaaaagaacacuuuuggaaugugugugucuguuuuuugaagugggaauucauuccuaggaaggaaaccugaggcacaaauauugaaucugaagaccgaauuauuuucuuaaauuauuuggcaauaagauuuuguucuagaggaaggugaagcaagacggcugaauagaagauuuuuuucuaaugagauguauuucuuauauccuugguauacaugauugcuaaaaagaaagaaauuuaugaugucauuuguuacuaauguaucuaauaauauacaucagugguuggcaaacuucuuuuguaaaaagccaaaugguaaauauuugcaacuuugucaauccugucaauaacuauccugucaauaccaucuaugucacaacugcucaacugugcuguuguagcacaaaacuagccauaaagaaugaguaagugaauggacauggcuguguucuaaaaaaacuacuugcaaaaacaaau

SEQ ID NO: 18156 - RNA, 19411 nt, Homo sapiens
aauacaugccagaagaaaucauguuuauuuaaauauugaagggaaaaauaccuaaaaauguacaaagguuuuauauugucauagugguuuuuauuccugcuuuguuucuggaaaggaaauccugaauuacuuaaguacuuuguguuuaauauaucugggugauggaucacaacacaucaauaaacugacuuacccuaaaaucuuguuuuauuacugggaagauuuuaacuucuauugacuuauccuacuagguaacacuuuaaaaaauauuucaucagacuggcuaaugaagcuucauuacaaguguguuaauuuuuuuuuuuuuuuuuuuuuuuuuuuuuugagacggagucuugcucugucgcccaggcuggagugcaguggugcgaucucagcuuacugcaagcucugccuccuagguucacgccauucuccugucucagccucccgagcagcugggacuacaggcgcccgccaccacgcccagcuaauuauuuguauuuuuaguagagacaggguuucaccguguuagccaggauggucucgaucuccugaccucgugauccaccugccuuggccucccaaagugcugggauuacaggcuugagccaccgcgcugggccauacaaguguguuaauuuuauaagcaucuauauugacagcagaauauaaaugggagcaauguuucuuuauaagccuucugaugccauagugugcauaagcugggguauacaaggccuuacucuguauuugcucugugccaguggucaacugauuuuggacagauguaagacaaaccagucucacuccuaugaguauaauuggguaccaaaccccuuaauaccagcauaccagagaaagccugugaacugucccaagucagccacuguuugaguuacaugcaacacaaagagcuuagggacaccaagcgucucugaacuucuugaaagguucucugaggacaacuucgacauacgaugaacauuucuaacuugcuguggcaguaaugagaguuguaucauuccuaacaaacaccuguugaguuuauguaauacccagucagucauacugcuucuaaaaucucuuggaaagaauacuaaaaacaggcuggugcgguggcuuaugcuuguaaucccaggacucugggaggucaaggcaguaggaaacguugagcccaggaguuugagaccagccuggguaacauagugagacccuaucucuacaaaaaacuuaaaaauuagccaaaugugguaguguuugccuguguccccagcuuuucaggaggcggagguggguggauugccugagcccaacagcagagguugcagugagcugagauuuuaccacugccugugcgacagagcaacacccugucucaagaaauacauacacacacaauuucaaacaguauuaaggaccuuacauaaccaacacauauaguagcacauguccuauaaaauucaguaugauuauuuauaauaauuuauuuauaauguucuuggcuuuuucaacacuccuuacugauuuuaacaaaauagaaucugcuuuaugaaaacugacuuaauuuuguaugucaguuuaucuauuuucuaagcauuuuuuuuguacuuugcuaagucgagugucuucaacaaauuauuaauugcuauugaaacaagucaccuugagucaggaauuccagagcugugacaaaaacacuggaaaucuaguccagguguuggcagcacuuuccuguagagggccagauaguaaauauuuuaggcuuuguaggcccauuuggucucugucaaaaauaaagauacuuaacucugccacucccuuguuagaaagcaacugcagacaauauguaaugguaugagcauggcuguguuccaauaacuuauuuacacaaacaggcaguaggccagauauacauggguaauaggccucuacuuacauaagugacuugccuuaagucccacagcuaaugugauuaacaagguugagaggaacacaagucauuuagagccaauaaccguggucauuagacaauaaggcuuugacaguaacaauauguuuauuauaacauccagccaagaauacaaacacaaaauaacucuuaauuuaaggagaauaagaaaacaucaggugauucuugaguacuacuacaaauacagccuucaccuacaguaaaaauuaagccaauuucaaucauuuuggucaucaucccagucuuucuucccacuuggaggcuugggcccaccagcugguuuugccaugaugaucugcauaaaaaagaaucacacaagaguaugcuuaucaacuuaaccuuuagaaugaaaagaaugcuucuauuagcaugauuuaagauuaagcagucuucuugguauaauuauguacugcauauaaaacacuacagcacagaguuugcuagcucccuuguuagaaauucaauuguaaacuuucagcgcaugagaaaguuuacugcuuuuauggauaaccgcaauaaaauccacagagauuagugaacauuccaagacaugcacuucaauaacucaaaaagcugaaagugaaaauaugugcaugcaucacugguguaagucggucaguuuggcaccugauuugcuauuuauauaugagaugugucuugccaaccaucucugucccaauuuccuugugguuuaggagcuuuaggcccaccugccagcuuugccauuauaaucuaaaguaguugauacauaaguauauacaaaguuuaacacugaaauuuucuaaaaccuguaaaugagaaucauucaagcagccaggaauuuucauaaacaaaaaucuaaguucccaacuuaaaaaaaaaagcgccacaaaccucaccuuacuuuaucuaaaauaaauagguuuuagcuuuuuuuuuuuuuuucuuuuugagacggagucuugcucuguugcccaggcuagagagugcaguggcgcgaucuuggcucaaugcaaccucugccuccuggguucaagcaauucuccugccucagccuccugaguaacugggauuacaggugcccaucaccaugcccggcuaaguuuuuacuuuuaguagagacgggguuucaccacguuggccaggcuggucucaaacuccugcaugauccacccgccucagccucccaaaguguugggauuauaggugugagccacugcgcucggcuggaaaacaucuuaauuaccaucugcaaaccugaacugggcaguggcucaugccuguaauccuagcacuuugggaggccaagguuugaggccaggaguuugagaccagccugggcaacaaagugagaccuagucuacaaaaacuaaaaauauauauauauauaaaauauauauauaacauuugauaauauauauaugauauauguaucauauauacgauacauauaucauacauauaucauauauaauauauaucauacauauauguaugauauauauaucauguauauguaugauaugagauauauaugauauauaugagauauguaugauauauacauauguaugauauauacauaugauaugugugauauauacauaucagauauauaugauauauaucucagccaaccaugacagcaccugccuacagucccagcuauucgggauguuaaggcagaagaaucacuggaacucaggauuuugaggcuguggugagcugauuaugauugugccacuguccuccagccugggugauagaguaagaccuuaucacaacaacaacaaaaaagauaccuaaaccugaaauucucagaauaacauguuaccaauugagaguaauuucagacugaauuaaaggcauuaagcauaauuuuagaaccuaagugcacauugauuuuaaaaaguaacuaaaagcugggugugguggcucaugccuguaaucccagcacuuugggaggccaaggcggacagaucacgaggucaagagaucgagaccauccuggccaacauggugaaaccccgucucuacuaaaaauacaaaaaaaaauuaggugggcaugguggcaugcgccuguagucccagcuacucgggaggcugaugcagcagaauugcuugaaccugggagguggcgguugcaguaagcugagaucacaccacugcacuccagccuggugacagagcaagacuccaucucaaagaaaaaaaagaaacaaacacuaaaacaaguaguucccaaacuuuagugggcaccauaaucaaaagugcucauuaaaacagacugcuaggccucuuccagcauuucugauauuggugggucuggagugacaucugagaaucuguauuucuucuuuuuuuuuuuuuuuugagauggagucuugcucugucgcccaggcuggaguacaguggugccaucucuacucacugcaggcuccaccucccagguucaugccaugcuccugccucagccucccgaguagcugggacuacaggcaucugccaccacgcccagcuaauuuuuuguuuuuuuuaguagagacgggauuucaccauguuagccaggauggucucaaccuccugaccucgugauccuccugccuuggccucccaaagugcugggauuacaggcgugagccaccgcgccuggccuccaagaaucuguauuucuuauuuauuuuuaguuuuuuaaaagauggagugucacucugucaaccaggcuggagugccaugaugugaucacagcucacugcagccuucaacuccugggcucaagugauccucccaccucagccuccugcguagcugggacuacaggugugagccaccauaccuggcugagaacugucauucuaacaaguucucaggugauguugauacuauuuugggaccauacuuugagaacuagugaaauagacauuccaacaaagauuaauccaguccguacuacacuauccaaugcuuaaagcuugaugugcaauuccuuuucuagaauauauacuauacaaauuuagguucauuauacuauacacuauauacacaaacugguuaauacaguuggauggguucuuuagauacauacuucacauagagugcaaagacugggggaacagaucaaccaacaacuuccccuaccauaagauaaagcagacuuccuaguuuaaagccaaaauucaaacugccuuugugaccaaggguggugguuauugucuugcuugaauaauugacauucaaaguuccuaacacaguuggaauuucugcguuccuuaugcugcagucuacuuagcuucuuccgucccugcuauuuuugguuuccccuuuuauucuuagccacauucuaauuucuagaauaaguauuuucuuagguuucuauuuaagaacucaaacauauucuuccauugaaaaucaccuaauaagcugacagagaaacccguuaaucugguacauaaacaucuaguuucugcuuauuuucaaugacuugaaacuaaauauccaguuccauuuuuggucaucucuugcuaucauaguucuuccaauaaauuuguuauaauuaccaccaacugguccuuacuguacuuaaaagcugaaaugucuuuccacugauuucuacuuaggacuuacuccaccuuuaauaugacauaugacuuuuaccuaauggauguauacugucccucuagcaaauuaaaauuuucuauuaaguacuuauaaauagucauugcuuauuaauuacuucuagaauuuuguggggaaauguauuuaauuaaguuugccagaaaauaccuuuuggaaaaauaauuaugauuucagguuuacuucuauauauagaacagucuaccacaauucuucaaaaaaaaaaaaaaaaggguagaaauaugauuuuaaacaccuuuaacaucuuuuaguaucucaagcuguaauuugucauagcagaaaaaauuuucaaugcccaguccucuuaucugcagacagcuagagacuccauuuuccuucaagcugguggucugcaaugucugcuugagagcuuuaugguccuuccaaauuccauguuaguauuauauauuaaauuuacucucuaaauuauuuguacaaauggguucuaaggcuaaaagguuugaaaguuauauauucaauacaauuuauaauagaagaaaaaaauuggaggggggcacauaguaucucuaauaggugaggacuaagaauccuuugaauuagaacuaugcuauguucuaguucugggaaaauauacuauuaaacaguaugcaaaugaguauuuuuaaagaucaaaauuucacuuugcucaccugauccacucuaaguacagugacugcagcauuaguagcgaguuugauagcccaauauuuucccagguaaguaucuagaauaccagcuuccagcauguccuuuacagcagggacuucagccugucaaacacaauuuucauccuuucauuuaaaauccuuuuaugugaaaauguuuacacccacaaaaagccucacauagcuccuuaaauaguacuggaaaguaaccaagcacaguccuaccuuauagagucauccuuuaguaugugaggauugguucuagcaccuccaaggaugccaaaaucuguggaugcucaaaucccuuacauaaaauggcaugguguuuggauauaaucuaugcacauccucucauauacuuuaaaucgucuccagauuaauuauauaacauaguguaaauaguuguuauaguguauuuuuaaaugucuuuaguuuuuccaaauauuuucaaucugugguugguugaaucaauggauacagaacugggcugacuacacacuacagaacaaaagacuaucaauaaaacagaaggaaaaugaaacguuccuccaucagacaaccuauguaaaaacuaagaaaauaaucugcucccaaaucagaacacuguuucucauugauauuucuuuuaaacucauacuauuuuuagguugugcauuccccaaauaaagcaauuuaaguucaguguuuuuucaaauaccucaauaucuaauccaacguuuuuauuuccuucuugauguacugcauaaaguuuagagauuacuucauuggccuuaacuccagaguuuucugccagugcgcggggaauagcuucaaaugccucagcaaacuucuuaauagcauacuguucaaguccaggacaugucuaaaacaaaaaugcguuaauuacugucuuuuauucaagcaauggaaagaaagucaauuuauacagaaaaagcuguaccucuccauaugaugugaucuguuuggcuaauucaauuucuguugcuccaccuccggguacaagacguuuauccuguauguagcgcccccaccaaaaaaaaaaugaacacaaaacaaauucacuaaaaaucaguuugcaguuuucuaaucuuuucacauuccaguaccccaccaaacaggaguuuuuaucagucauuguuacucaaauacauauuacaaauuugguaaaaaugaguggguggggcaaauuuucuuagugcacagugucugguguaugaaaaggaccaaagugaagaaugggaauaguaccguaucauuuuugcauauccacagauauagcacuaagaacugcuuuagcaacuaacaguacauuacaauggaaaacaacgauaaacaauuuuuuuuaaagcucuguuuugcuguuaacuccucuguacaaucuuuuuuggaaacuaucauauucacuaacaauggacacuuaagucuuagguaaaaacaaaaacaggugcuucauuucauauaaaccacucauucugaaguucucaugaugugcaagagucugcaaacuguacuuuuaagaccauacaaauuacucagaccuuacaaacuacuaagaauauugcugauacugacccuuguaagaacuuugaaaguauuaacaccaucgucuacugcccuuucuaugucauccaucagauugucuguagagccucgaaguacuaugguagaaauggcgccaucuuccuuuucuaucaaaaaauuaaauauauuuggugauuaaauacaagaagcuaaagcccuacacuuaaacauguuuuaccauuccuacauaccaugcuuaaaaaccaccaccugaguaucuccaacuucugagagguaaacacugucacagugucccauuucuucaaggacaggaggugucuguaagaaagugacuguuguaauaaaaauuccaucuuguucaacuaucuuuuaguguuuuccaaaauacauaccaaucuaggaagagcuguagcaccaacaguuuuacaaagucuucggagaucccauuuugaguuuagccuuuaaaaaacacaaagaccuuaauaaaaguuuuaaucaauuucagauagcauauaaaguucaaauuaaagaggaaccuguauaccagcccccaugucacauuccuuugacaauggauuuuaacucagaacaugucuggauugcaaugaacacuaaggccaggaagcugauuccugacucucugagugaguccagcuggccaauaguaccacaucuuaagccuguguuguauggcauuguucuagaauugggagaauggaagucacuuuaggaugucagugguuuauaguucuaaaacaccagagaaacccuuacaaaacucaacagcauauagaaaauuuuugcuuuacuuugugcaaucaauguucugugaacaagagugauuuauuuugcacauuuuauuagguacuagggauggugguagguagaaauggguuaaguugucuagugugcaccauaaauguguucauggauuaaaagggaucuuccugacuccauacucugauaggcaaugcaccaagcuugugucuagucucuuggacaaguuguuccuuuugccuggaaugcuuuucccucuucaauuaucugguaauugguucuucaagcucucagcuuaaauuuauguuuucucagagguguuuccugaccccuccccaaacuaaauccuucugcuauuugaccuaguaccuuuacuuucccuuuauuaacagucuucauggucuauuucguuuaguguuuucaccaccaaaaaaccauuuaugauauagguaaaaaaaaaaaucggcuuuuucuuaccucacuaacaugauauuauauuuauuugcauaaugaagagccaugucugccacuuugccaccuguuacuacgacauuugcaccaguaucagcaauagcuuugacuugugcauccaugagguuuucuucucccuuacuaaaauucaucaauucuucagcagucuuuaucaacacuguucccuggcaaaacaaguaaacauucccuuuaaaaucauuucacuacguugguguucaaagucauuagauaauaguugacugaagaaauaaagguuuggcaaaaaaauaugaagauauaugugcauauauuaugaagcagcagaauacuguaugugugaaauagaaacucagcuugcuucuagaacccccugucaaaacagaugcaucugcuuuugauaaguacuuagguggaaaaguacuuuuaucuauuuauuuauuuugagacagagucucacucugucaccaugcuggagugcaggcaggaucucggcucaccgcaaccucugacucccugguucaagcgauucuccugccucagccucccaaguagcugggauuacaggcaagcgccaccacgcccagcuaauuuuugcauuuuuaguagagacgggguuucaccauguuggccaggcuggucuugaacuccugaccucgugauuugccugccuuggccuaugcugggauuacaggcgugagauaccgugcccggccgagaagugcuuuuauuuuaaauaugucagguagguagguguccugguguuugucuuuugacaaaggcuaacuaguguucccaauacaacauugugguucucaaacuuuuucuaaaauguggacuaggccgggcgcgguggcucaugccuguaauccuagcacucugggaggccaaggcggguggaucacuugcagucaggaguuggagaccagucuggccaacauggugaaacuuugucucuauuaaaaauacaaaaauuagccagagaucacuugaacccaggaggcggagguugcagggagccaagauuguaccacuggacucaagccugggugacaaagcaagacucuaaaaaaaaaaaaaaaaaaaaaaaaaaagaauaaaauacaauaaaauaaaauauggaccaaaugaccagaccccccucaugcuacaaaauuuuaaaacuaucaacaacuuggauuucaagaauucuagagaugaagucagccacuauugacuauaaacacaaacuucaaacuuucuaacauguauuuuuagaaacauacuuaccauuuucaaauuacauuagcuuaucuuguuuuaggaugcuacagaaugucaacuuuauuuucgugaagagcacacaaaauacucacauucucauauucuuucacuugcugaauguauaagcucuacuagaagggcugugugucagauuauaaauaauacggccaccaucuuuauauuuccaguuuaauguucaguaguugaauuagauauuugaagacuauaaaucuggcauaaaaaaauagguaagauccugcaauguucaguuuuuuaagaaguacuuacugguuuaagagcuaacucaaacaaucugaaagugcaaccccaauuauuacuuuuaagguuugaagucuacauaccuuaguuucuguuaucaugccaucaaaaggacaagaguacacugcuauuuuugcaucuuugacagauguuacaucaccuucgguuuccuucuuaaaaaccaugccaugcaauacugaagaggaacugauaccagagcccuaaggaauugaauaccaaacucaucagcaaucuccugaaaauaacauuacggucaaacuguugauucuccauauaccaaaaauaucccuuucuaaaauaaagucauaaaccaaggcagugacuccugggauaagggguggagugguggacauacagcacacccuucugcucgaggcagaaaucacugagggaaugagcuacuuuuagggaggggagguccuuccauguacugggaagaaccaaaggcagagaacuggucuuagccauucaguuaccuaguacuuggugccaauauaccagccacagcugucaguacugcaaauacaacacagaacaaagcaaagauucuguucucacaagguugcauuuaaugggaaaagcuggcaguacguggagggagacagcaaacauagaacacgugaguaucuucagggaaagcacauguacuuauguuaugcuaaauucacauuaacaaucagaaugccaaugugcaaaaccaaaaccauuccacugauagguuuuacucuaucaagcacauuuuaucaaaaauauacuuuaauauuucaauacuaacauuaaagugugaauucuauuauugaagaggaauaggacgauuuccaccccacucaaaacugucuuauaagcuuauuauaauucagaguauuaugaagaacacaaaaaaauuaguauuuugcgcugggcgcgguggcucacaccuguaaucucagcacuuugggaggccaaggugggcagaucaugaggucaggaguucgagaccagccuggccaacauggugaaacccugccucuacuaaaaaaauacaaaaauuagcuggacaugguggcaugcaccuguaauccagcuacuugggagguugaggcaggaaaaccacuugaaccugggagguggagguugcagugagccgaggucgaggcacugcacuccaaccugggcaacagagccagacuccaucucaaaaaaaaaaaaaaaaaaaauuuaguauuuuguuuauacauuauucuuaaacccacaagacaucacagaaaaugacuuuauaaggagauaauaugucaauauccuuuuaaacuuaaauagguaguaguauuauuacaacuuagcaacaucaaaauguuacaaaauaaugccucaaaggccaggcacggugguucacgccuguuaaucccagcacuuugggaggccaaggcagguggaucaccugaggucgggaguucgagaccagccugaccaacacggagaaaccccaucucuacuaaaaauacaaaauuagccgggugugguggcgcaugccuguaaucccagcuacucgggaggcugggacuggagaaucacuugaaccgggaggcggagguugcggugagccgaggucaugucauugcacuccaaccugggcaacaagagcgagacuccgucucaaaaauaaauaaguacauaaauaaaaauaaugccucaaaaaaaguccuaaguguucaaaucaugaaguaacauuuagguuuagaugaacacauuuuuuuuuuuuugcacaaaaaaacaaaaaaagcacacaaaaaaacugaccuagauauguagcauuaaugcauuuucuacuuaccagaauuuuacaaacucugauguuaucaacauugaaauggccggaaucaggaaaaauagauacuguuaagaaaaugagacauaucaaaagauuauuuugggacaacagagaaaguaucuagucauguuaaagguauuuuuauuuuggaucuuuucauuuacugauauuuacuuaccgcaugccugagcaauaagcuuggccagaaauacuucauuaccauauuguuuacucauuauggagguacgaaguagagaugagacuucaucaauaucucgaagguuuuuugcagaacaacauaccaaauuaggaagaaucucaugagcuuuucugcaggcuauuucauaaccuucuaugaccuaaaacauaaacaacauuuccuauucugacaugacuuaaaguagcuuauuuugguaacccaaugcauauggauguuuauuuuugauacaaaaugacaaagaauauacuucggaauaaaacauauaguagacucuacuaguuaugaauggaggcuuagaugacagcccaaauuugaaucuuaacucuaccuaacucacuagcuaugagaucuugggcaagauuuuucuaauuuuagucucuuuucucaucuaaaauaaagugggaaaaaaaauagauaaaaugggauuauaaggccucacuaauaggguuuuugugagacuaaaaugauacagcaugugaagcauauguacuauaauggcugguacagagcaaacugcucagugcauguuagcuacuacuauaauaaugauuuuaguuuauguuuuaagcagguguauauguaagcaaaaauuuaguaggaguaaauuauaaaugaacacuugccucugaaacugacaggccaauccucagaaguucuucagcuaauuccaggagagcuccagcaaauaccagaacaaaguuugugccaucuccaacuucuugcucuugcauaugagaagccauuacaaucauuuuugcagcaggaugcuguaccuaguagaaaagguaauaucaaguuaaacaucugauccuuaaagcaacauaaaauuguucauuuccauuucuuaaauagacucaauuuucuuguagauuagguaacuccaucugaucacacugcuacacugcuauacgcuacuuauaguguggucacaagaaaaaauccaagucccuuuaugccgaucagcacaaauguaucacuauaaauaagaauuucaaagugcauccucuuuugguggccugcacauacagugccacacauauguuucaccauaucauauuucacuaaauuaaaaaacaaaguaauuacaaccaccaaaccuagauauuuuuuaaaagccuucaggagaacuaaaauagauaccacuuaacuuggucaugacucucaauaucuauuuuacuauauauucuuguuguaaggguuaucauuugugauuuaaagaaaagggggaguauaaaacuuuucuucaaauauaacauaauuuuauguggauuuuauucuuaggauuuaauuuuagauaccuuuacagaaacaagccaaggaguaagaacugagagcaacaagaaaacuauaaaaagucagcccugugauuuuauuauuuugacgguaucaccacuguacuuuaauaacuccugagaucaucagugugcaacauuaacauucacagugacaaacccuuguacaaguguuuuguggaguuaaaauuuaacuuuuaacuuaaguucuuuaagaauuuauauauauaauauguauuuuuuuuucuuuuuugagauggagucuugcucugucgcccaggcuggagugcaguggcgcgaucuuggcucauugcaaccuccgccucccagguucaagcaauucuccugcccuagccuacugaguagcuggaacuacaggugugugccaccacgcccggcugauuuuguuucuguauuuuuaguagagaugggguuucaccauguuggccaggcuagucucaaacuccugaccuuaggugauccgccugccuugaccucccaaaguggugggauuacaggcgugagccaccgcguccaaccaaaaauauauuauuuaagagguuagaaaaauguugauucuucuaucguuucauuuaaaacaaaagauuaaguucuagugcuuucaagggcuaagcuucaggaaaauucccugagguugaauauguuauccuuuaauuacaaggcgggaaugaggaauggcucucucugccuguucaggugccagaccuuccuuauaacccugcuggcaggcaguaucuauuuuauagauucuaauaguaaaacuaaagcugaacaaaguaaaaugccaucaacugauuguuuuuauuuucacaaaaccaaaugguuggaucuuuuuaaaaaccacuguuauauguauacguuuuugcacuguggaauaauucacuucagagucacccuauagaaugaagacaaugguaaucaauuucauaucguaauuagcaauguaucacaaccaaucccuccauaaauuaauaacuugagagauuuuuaagauuucaguggcuaaaacauucaaucuaaagaggacucuuuauaauuagaacaaucuguacaauaaauuuucaagcuggaaaaauagucccuuauccaaucugaaauaagagauuucuucuaguuaaaaucuacuuaauuuugaugucaccaaaauauuucuugacuuuuuaaagaaacaacuuacuucuaguucucuuaaaauaguugcugcaucguuugucacaaacaacuucuccaagugguugauaaccauuuuguucauuccucaaaaguaacaguuaaaaaaagaaaaagaaagccauuauuaaucaaauccuuccccaaauacccaggaaaaucuaguuaagaaauuauaaauuuguauauuaaaaaaagagcuuugcaagaaaacacauacuaucuauucuucaaguuuaucuuauagccccaugggcauucucugacugcagacccauauucuuucuucccuuucuaauguccuacaauauuuacuacguaagaugccaaaucucacauuuuugccaauuucuaucuucuguuugcaacaugacugucaugcagcaagugcucaacagaaauuaacauguaaaaaggccaaaauaaucuacuuaguauauuuaguuguauguuuauuccaugaaacuguaucauuuaaauuuaauuggugguagaaggcaagaggaaggagagaauuuucuuccuuaaacuaugucacuuuuauauuuaguguuugucagaaugaacauuagguacuaucuuacuagucaaaguguuauaauuuuucuauccucucaacaggauaaaaaguaauauauugacccccauuuuucuaaagagaugugaguugauugaaaauuagaaauaacuaaaaauuggaaaugaacuaucauugagcuaucaaauuaacuuccgaagucauaccauaacauccucagaacaagucugaaagaagacguaguacacaauauucuacuacuguaucuuuacaaauauuaauuuagaaauuaccauuugguccauaugcuguacgagugguuugggcaagcuccuugcaagcuuguauguuucuauacacagccucuucuaauccugaaaagugcuguuaaaaaaaacaaacaaaaaaccccgcuaauuagacaggacagugaaacaaaaauuucaaauacaagauaucuuugcuuauaucuugccucuaauaaagagggagcauagcuuagguauuuggcacaagagggcugguugcaaaucuuagcuuucuggcucuuuuuaaauuugggcaauuuucuuaacauuucuucauuauaaaaugaaguaauuauaauaguaccuaacucauaggauuguugagacaaucaaacaagauuuuuuaauguaaaacacagcauuugauauucauaaaugaugcauacauuuccucucuaguugaaugaauaaaguauaacauuuugggggaccgcagguaccuacuuacacaucaaaagacuuaaaauuuuuuuuauuaaaaguagugaaaaguacagggaaccaugcuaagacuaauuagagaaaggguaugagguacuucaaguagaauaccuuuccagaauuuaucaguauuuucuaacuaacuguugaaauguggaauauucuuauuguguuagaaucugggcuuuuguaaagccagaaguucuuuaaguaugugccacugaaguguuuagagacugaauacuuuuuuugaauugcaacauuaucccaauguauauguauugaaaagcgaacugcucacgguacuaaaaauucucacaaauucuacacuggacuuuuuuagaguugagguuuacuuggguccucagauauauuucacuaaucuacugugcaugagaacauuucuuuagagaagcgcugcccaauacaguagccacuagcuacauacauggggcuagugaaagcaaucaaaauaaacuuucaaguaauuaaaauuaaaaaauucaguuccucaauugcaggagccacaguucaaaugcccaguagcuacauguggguagugaauaucacacuggacagcgcugauacagcguauguccagcacugcaaaaaguucuauuuacauaguacugcuuuacaauacaagccaugauuuugugauccaaaaccaagguuaauagccauuacucuuuuuugagagagagagagucuccucuaucgcucaggcuggagugcagugagcugagaucguggcacgaucucagcucacugcaaccugggccucccggguucaagcaauucuggaggcucagccuccugaguagcugggauuagaggugcgcgccacaccagguugguuuuuuuuguauuuuuuugagaggcggaguuucaccauguuggccaggaacuccuggccucaagugauccacugaccucggccuccccaguguugggauuacaggugugagccaccaaccccugccaauagccacugcuuuaaaagcaucuucagcaauaagaacuguuauuccagcaauaacacuuaagucugaacuccuggcuuacacucuugcuucuuccccucacuccccauucugugagaaacuaccauuugaucagauccccucauucccauacuuaagacccuucaaugguuucccaaccagcuuaggauaaaaugcaaaucccuuuucaaggaaacaaggcccuacguaucccggcccuuguauggcuccuccucugaacuuaccauucuuccuuucuuugguaagcuucagcccuacaaccuguuguuguuguuguuguuuuaaaaaaaaaacaggucaaaaucauuccuuccucagggucuuuguacuaguuagucccugagccuggcauuucccccuaaguaagaggucgggggaaacagcccaggcucaggggcuucucucacuaagcacugagcuaagaguucuucccuaaacgucuaaguguucugucuauuccugauccuucuuuuacagacauuuuuaccuccugucauccucuacuauagugcaguuucuuucaucauuauuuggaauucuccuuuuauuuaaucauuauuucugccuuagaaggacauaaacucuacgacaaaugggacuuuugucuuucacugcaguuccuucaguaccuauuuauugaaagaaauagcucaguguucuguaaaaaacuacuagcacuggaaugacaaauaauguuuugugauacacgaguuuuccaaaacuguauuagugaaaaaaacccaaauuggaagcuauuaucucagccugauuuuuucaagggaaucagcccauaucauuuucaaaagauuauuccaccaacauuuaccuugaacccugacauuuacuuacuauaccgacauuauuugaaaagugcauccuacaaacaugaaccuaguucuauuaaacuguuaaugcuccccguaccucgcauaaaaccuuaaauucaaccacacugaucuauuucuugaauuaacaaaaucuggaggacacacagaggaaugcaauuugaauagcacaagagacaaauuuaucaauagugcaguaagauauuuuuuaaaacuaugcuaccgaacuaacguucaagaaaaggccauuaaacaaaaguguuaucugcaccccucuaucacuuauccugcagauuacacagaacucaaagacaccaccucuugguccaaucuccauaauuuaaagacgaaggaaacaaaacccaagaaaguuacauuuuagauuaagccagcuaacauaaguugggaccggaacucauuuggcuacaacgcauggcuucugucaacuaagcugaaagccguauguuucucacugggaagcaagcaaccaagacccggcccuuuuucccacucucuucucuggaucggcuaguucucguucuuccccauccuacaacucgcgagcuaugugauaaucgacgucgcaguucucaagacaauuucaucuacguuauucaauuucacccucacaaccuccuuuaagggugacgggccuuagccccauuuacggauggaggcaaaacgcacgcgcggcuucacauccguccaccuucaagguguacaaugucgaucgugccgccgaucccucggccuucucccggucgcggaagaagagaagugcccgcaggcuccgguggccgagcccuuccaaaaucaccucccuuucuggaaucuucucuucccccggccgcugagccagggcagcacgcucagcccguuaguaggcccuccuacuucgccgcggccgccgcagcccuaugcugacgcucccaccucauuccuuuccuucagcccuuacuuucgcucccuccuugagcaucugggcaaagcccggagccuugggaacgugaagcgccauggccagccugcaggaagcaguucacgcgaccgcucggaagaccgcggaggaagcgaggagcacgcacagccuucugggaaagcagcguggggccgccucacgcucuucc

SEQ ID NO: 18157 - RNA, 19411 nt, Homo sapiens
ggaagagcgugaggcggccccacgcugcuuucccagaaggcugugcgugcuccucgcuuccuccgcggucuuccgagcggucgcgugaacugcuuccugcaggcuggccauggcgcuucacguucccaaggcuccgggcuuugcccagaugcucaaggagggagcgaaaguaagggcugaaggaaaggaaugaggugggagcgucagcauagggcugcggcggccgcggcgaaguaggagggccuacuaacgggcugagcgugcugcccuggcucagcggccgggggaagagaagauuccagaaagggaggugauuuuggaagggcucggccaccggagccugcgggcacuucucuucuuccgcgaccgggagaaggccgagggaucggcggcacgaucgacauuguacaccuugaagguggacggaugugaagccgcgcgugcguuuugccuccauccguaaauggggcuaaggcccgucacccuuaaaggagguugugagggugaaauugaauaacguagaugaaauugucuugagaacugcgacgucgauuaucacauagcucgcgaguuguaggauggggaagaacgagaacuagccgauccagagaagagagugggaaaaagggccgggucuugguugcuugcuucccagugagaaacauacggcuuucagcuuaguugacagaagccaugcguuguagccaaaugaguuccggucccaacuuauguuagcuggcuuaaucuaaaauguaacuuucuuggguuuuguuuccuucgucuuuaaauuauggagauuggaccaagagguggugucuuugaguucuguguaaucugcaggauaagugauagaggggugcagauaacacuuuuguuuaauggccuuuucuugaacguuaguucgguagcauaguuuuaaaaaauaucuuacugcacuauugauaaauuugucucuugugcuauucaaauugcauuccucuguguguccuccagauuuuguuaauucaagaaauagaucagugugguugaauuuaagguuuuaugcgagguacggggagcauuaacaguuuaauagaacuagguucauguuuguaggaugcacuuuucaaauaaugucgguauaguaaguaaaugucaggguucaagguaaauguugguggaauaaucuuuugaaaaugauaugggcugauucccuugaaaaaaucaggcugagauaauagcuuccaauuuggguuuuuuucacuaauacaguuuuggaaaacucguguaucacaaaacauuauuugucauuccagugcuaguaguuuuuuacagaacacugagcuauuucuuucaauaaauagguacugaaggaacugcagugaaagacaaaagucccauuugucguagaguuuauguccuucuaaggcagaaauaaugauuaaauaaaaggagaauuccaaauaaugaugaaagaaacugcacuauaguagaggaugacaggagguaaaaaugucuguaaaagaaggaucaggaauagacagaacacuuagacguuuagggaagaacucuuagcucagugcuuagugagagaagccccugagccugggcuguuucccccgaccucuuacuuagggggaaaugccaggcucagggacuaacuaguacaaagacccugaggaaggaaugauuuugaccuguuuuuuuuuuaaaacaacaacaacaacaacagguuguagggcugaagcuuaccaaagaaaggaagaaugguaaguucagaggaggagccauacaagggccgggauacguagggccuuguuuccuugaaaagggauuugcauuuuauccuaagcugguugggaaaccauugaagggucuuaaguaugggaaugaggggaucugaucaaaugguaguuucucacagaauggggagugaggggaagaagcaagaguguaagccaggaguucagacuuaaguguuauugcuggaauaacaguucuuauugcugaagaugcuuuuaaagcaguggcuauuggcagggguugguggcucacaccuguaaucccaacacuggggaggccgaggucaguggaucacuugaggccaggaguuccuggccaacauggugaaacuccgccucucaaaaaaauacaaaaaaaaccaaccugguguggcgcgcaccucuaaucccagcuacucaggaggcugagccuccagaauugcuugaacccgggaggcccagguugcagugagcugagaucgugccacgaucucagcucacugcacuccagccugagcgauagaggagacucucucucucucaaaaaagaguaauggcuauuaaccuugguuuuggaucacaaaaucauggcuuguauuguaaagcaguacuauguaaauagaacuuuuugcagugcuggacauacgcuguaucagcgcuguccagugugauauucacuacccacauguagcuacugggcauuugaacuguggcuccugcaauugaggaacugaauuuuuuaauuuuaauuacuugaaaguuuauuuugauugcuuucacuagccccauguauguagcuaguggcuacuguauugggcagcgcuucucuaaagaaauguucucaugcacaguagauuagugaaauauaucugaggacccaaguaaaccucaacucuaaaaaaguccaguguagaauuugugagaauuuuuaguaccgugagcaguucgcuuuucaauacauauacauugggauaauguugcaauucaaaaaaaguauucagucucuaaacacuucaguggcacauacuuaaagaacuucuggcuuuacaaaagcccagauucuaacacaauaagaauauuccacauuucaacaguuaguuagaaaauacugauaaauucuggaaagguauucuacuugaaguaccucauacccuuucucuaauuagucuuagcaugguucccuguacuuuucacuacuuuuaauaaaaaaaauuuuaagucuuuugauguguaaguagguaccugcggucccccaaaauguuauacuuuauucauucaacuagagaggaaauguaugcaucauuuaugaauaucaaaugcuguguuuuacauuaaaaaaucuuguuugauugucucaacaauccuaugaguuagguacuauuauaauuacuucauuuuauaaugaagaaauguuaagaaaauugcccaaauuuaaaaagagccagaaagcuaagauuugcaaccagcccucuugugccaaauaccuaagcuaugcucccucuuuauuagaggcaagauauaagcaaagauaucuuguauuugaaauuuuuguuucacuguccugucuaauuagcgggguuuuuuguuuguuuuuuuuaacagcacuuuucaggauuagaagaggcuguguauagaaacauacaagcuugcaaggagcuugcccaaaccacucguacagcauauggaccaaaugguaauuucuaaauuaauauuuguaaagauacaguaguagaauauuguguacuacgucuucuuucagacuuguucugaggauguuaugguaugacuucggaaguuaauuugauagcucaaugauaguucauuuccaauuuuuaguuauuucuaauuuucaaucaacucacaucucuuuagaaaaaugggggucaauauauuacuuuuuauccuguugagaggauagaaaaauuauaacacuuugacuaguaagauaguaccuaauguucauucugacaaacacuaaauauaaaagugacauaguuuaaggaagaaaauucucuccuuccucuugccuucuaccaccaauuaaauuuaaaugauacaguuucauggaauaaacauacaacuaaauauacuaaguagauuauuuuggccuuuuuacauguuaauuucuguugagcacuugcugcaugacagucauguugcaaacagaagauagaaauuggcaaaaaugugagauuuggcaucuuacguaguaaauauuguaggacauuagaaagggaagaaagaauaugggucugcagucagagaaugcccauggggcuauaagauaaacuugaagaauagauaguauguguuuucuugcaaagcucuuuuuuuaauauacaaauuuauaauuucuuaacuagauuuuccuggguauuuggggaaggauuugauuaauaauggcuuucuuuuucuuuuuuuaacuguuacuuuugaggaaugaacaaaaugguuaucaaccacuuggagaaguuguuugugacaaacgaugcagcaacuauuuuaagagaacuagaaguaaguuguuucuuuaaaaagucaagaaauauuuuggugacaucaaaauuaaguagauuuuaacuagaagaaaucucuuauuucagauuggauaagggacuauuuuuccagcuugaaaauuuauuguacagauuguucuaauuauaaagaguccucuuuagauugaauguuuuagccacugaaaucuuaaaaaucucucaaguuauuaauuuauggagggauugguugugauacauugcuaauuacgauaugaaauugauuaccauugucuucauucuauagggugacucugaagugaauuauuccacagugcaaaaacguauacauauaacagugguuuuuaaaaagauccaaccauuugguuuugugaaaauaaaaacaaucaguugauggcauuuuacuuuguucagcuuuaguuuuacuauuagaaucuauaaaauagauacugccugccagcaggguuauaaggaaggucuggcaccugaacaggcagagagagccauuccucauucccgccuuguaauuaaaggauaacauauucaaccucagggaauuuuccugaagcuuagcccuugaaagcacuagaacuuaaucuuuuguuuuaaaugaaacgauagaagaaucaacauuuuucuaaccucuuaaauaauauauuuuugguuggacgcgguggcucacgccuguaaucccaccacuuugggaggucaaggcaggcggaucaccuaaggucaggaguuugagacuagccuggccaacauggugaaaccccaucucuacuaaaaauacagaaacaaaaucagccgggcgugguggcacacaccuguaguuccagcuacucaguaggcuagggcaggagaauugcuugaaccugggaggcggagguugcaaugagccaagaucgcgccacugcacuccagccugggcgacagagcaagacuccaucucaaaaaagaaaaaaaaauacauauuauauauauaaauucuuaaagaacuuaaguuaaaaguuaaauuuuaacuccacaaaacacuuguacaaggguuugucacugugaauguuaauguugcacacugaugaucucaggaguuauuaaaguacaguggugauaccgucaaaauaauaaaaucacagggcugacuuuuuauaguuuucuuguugcucucaguucuuacuccuuggcuuguuucuguaaagguaucuaaaauuaaauccuaagaauaaaauccacauaaaauuauguuauauuugaagaaaaguuuuauacucccccuuuucuuuaaaucacaaaugauaacccuuacaacaagaauauauaguaaaauagauauugagagucaugaccaaguuaagugguaucuauuuuaguucuccugaaggcuuuuaaaaaauaucuagguuuggugguuguaauuacuuuguuuuuuaauuuagugaaauaugauauggugaaacauauguguggcacuguaugugcaggccaccaaaagaggaugcacuuugaaauucuuauuuauagugauacauuugugcugaucggcauaaagggacuuggauuuuuucuugugaccacacuauaaguagcguauagcaguguagcagugugaucagauggaguuaccuaaucuacaagaaaauugagucuauuuaagaaauggaaaugaacaauuuuauguugcuuuaaggaucagauguuuaacuugauauuaccuuuucuacuagguacagcauccugcugcaaaaaugauuguaauggcuucucauaugcaagagcaagaaguuggagauggcacaaacuuuguucugguauuugcuggagcucuccuggaauuagcugaagaacuucugaggauuggccugucaguuucagaggcaaguguucauuuauaauuuacuccuacuaaauuuuugcuuacauauacaccugcuuaaaacauaaacuaaaaucauuauuauaguaguagcuaacaugcacugagcaguuugcucuguaccagccauuauaguacauaugcuucacaugcuguaucauuuuagucucacaaaaacccuauuagugaggccuuauaaucccauuuuaucuauuuuuuuucccacuuuauuuuagaugagaaaagagacuaaaauuagaaaaaucuugcccaagaucucauagcuagugaguuagguagaguuaagauucaaauuugggcugucaucuaagccuccauucauaacuaguagagucuacuauauguuuuauuccgaaguauauucuuugucauuuuguaucaaaaauaaacauccauaugcauuggguuaccaaaauaagcuacuuuaagucaugucagaauaggaaauguuguuuauguuuuaggucauagaagguuaugaaauagccugcagaaaagcucaugagauucuuccuaauuugguauguuguucugcaaaaaaccuucgagauauugaugaagucucaucucuacuucguaccuccauaaugaguaaacaauaugguaaugaaguauuucuggccaagcuuauugcucaggcaugcgguaaguaaauaucaguaaaugaaaagauccaaaauaaaaauaccuuuaacaugacuagauacuuucucuguugucccaaaauaaucuuuugauaugucucauuuucuuaacaguaucuauuuuuccugauuccggccauuucaauguugauaacaucagaguuuguaaaauucugguaaguagaaaaugcauuaaugcuacauaucuaggucaguuuuuuugugugcuuuuuuuguuuuuuugugcaaaaaaaaaaaaauguguucaucuaaaccuaaauguuacuucaugauuugaacacuuaggacuuuuuuugaggcauuauuuuuauuuauguacuuauuuauuuuugagacggagucucgcucuuguugcccagguuggagugcaaugacaugaccucggcucaccgcaaccuccgccucccgguucaagugauucuccagucccagccucccgaguagcugggauuacaggcaugcgccaccacacccggcuaauuuuguauuuuuaguagagaugggguuucuccguguuggucaggcuggucucgaacucccgaccucaggugauccaccugccuuggccucccaaagugcugggauuaacaggcgugaaccaccgugccuggccuuugaggcauuauuuuguaacauuuugauguugcuaaguuguaauaauacuacuaccuauuuaaguuuaaaaggauauugacauauuaucuccuuauaaagucauuuucugugaugucuuguggguuuaagaauaauguauaaacaaaauacuaaauuuuuuuuuuuuuuuuuuuugagauggagucuggcucuguugcccagguuggagugcagugccucgaccucggcucacugcaaccuccaccucccagguucaagugguuuuccugccucaaccucccaaguagcuggauuacaggugcaugccaccauguccagcuaauuuuuguauuuuuuuaguagaggcaggguuucaccauguuggccaggcuggucucgaacuccugaccucaugaucugcccaccuuggccucccaaagugcugagauuacaggugugagccaccgcgcccagcgcaaaauacuaauuuuuuuguguucuucauaauacucugaauuauaauaagcuuauaagacaguuuugagugggguggaaaucguccuauuccucuucaauaauagaauucacacuuuaauguuaguauugaaauauuaaaguauauuuuugauaaaaugugcuugauagaguaaaaccuaucaguggaaugguuuugguuuugcacauuggcauucugauuguuaaugugaauuuagcauaacauaaguacaugugcuuucccugaagauacucacguguucuauguuugcugucucccuccacguacugccagcuuuucccauuaaaugcaaccuugugagaacagaaucuuugcuuuguucuguguuguauuugcaguacugacagcuguggcugguauauuggcaccaaguacuagguaacugaauggcuaagaccaguucucugccuuugguucuucccaguacauggaaggaccuccccucccuaaaaguagcucauucccucagugauuucugccucgagcagaagggugugcuguauguccaccacuccaccccuuaucccaggagucacugccuugguuuaugacuuuauuuuagaaagggauauuuuugguauauggagaaucaacaguuugaccguaauguuauuuucaggagauugcugaugaguuugguauucaauuccuuagggcucugguaucaguuccucuucaguauugcauggcaugguuuuuaagaaggaaaccgaaggugauguaacaucugucaaagaugcaaaaauagcaguguacucuuguccuuuugauggcaugauaacagaaacuaagguauguagacuucaaaccuuaaaaguaauaauugggguugcacuuucagauuguuugaguuagcucuuaaaccaguaaguacuucuuaaaaaacugaacauugcaggaucuuaccuauuuuuuuaugccagauuuauagucuucaaauaucuaauucaacuacugaacauuaaacuggaaauauaaagaugguggccguauuauuuauaaucugacacacagcccuucuaguagagcuuauacauucagcaagugaaagaauaugagaaugugaguauuuugugugcucuucacgaaaauaaaguugacauucuguagcauccuaaaacaagauaagcuaauguaauuugaaaaugguaaguauguuucuaaaaauacauguuagaaaguuugaaguuuguguuuauagucaauaguggcugacuucaucucuagaauucuugaaauccaaguuguugauaguuuuaaaauuuuguagcaugaggggggucuggucauuugguccauauuuuauuuuauuguauuuuauucuuuuuuuuuuuuuuuuuuuuuuuuuuuagagucuugcuuugucacccaggcuugaguccagugguacaaucuuggcucccugcaaccuccgccuccuggguucaagugaucucuggcuaauuuuuguauuuuuaauagagacaaaguuucaccauguuggccagacuggucuccaacuccugacugcaagugauccacccgccuuggccucccagagugcuaggauuacaggcaugagccaccgcgcccggccuaguccacauuuuagaaaaaguuugagaaccacaauguuguauugggaacacuaguuagccuuugucaaaagacaaacaccaggacaccuaccuaccugacauauuuaaaauaaaagcacuucucggccgggcacgguaucucacgccuguaaucccagcauaggccaaggcaggcaaaucacgaggucaggaguucaagaccagccuggccaacauggugaaaccccgucucuacuaaaaaugcaaaaauuagcugggcgugguggcgcuugccuguaaucccagcuacuugggaggcugaggcaggagaaucgcuugaaccagggagucagagguugcggugagccgagauccugccugcacuccagcauggugacagagugagacucugucucaaaauaaauaaauagauaaaaguacuuuuccaccuaaguacuuaucaaaagcagaugcaucuguuuugacaggggguucuagaagcaagcugaguuucuauuucacacauacaguauucugcugcuucauaauauaugcacauauaucuucauauuuuuuugccaaaccuuuauuucuucagucaacuauuaucuaaugacuuugaacaccaacguagugaaaugauuuuaaagggaauguuuacuuguuuugccagggaacaguguugauaaagacugcugaagaauugaugaauuuuaguaagggagaagaaaaccucauggaugcacaagucaaagcuauugcugauacuggugcaaaugucguaguaacagguggcaaaguggcagacauggcucuucauuaugcaaauaaauauaauaucauguuagugagguaagaaaaagccgauuuuuuuuuuuaccuauaucauaaaugguuuuuugguggugaaaacacuaaacgaaauagaccaugaagacuguuaauaaagggaaaguaaagguacuaggucaaauagcagaaggauuuaguuuggggaggggucaggaaacaccucugagaaaacauaaauuuaagcugagagcuugaagaaccaauuaccagauaauugaagagggaaaagcauuccaggcaaaaggaacaacuuguccaagagacuagacacaagcuuggugcauugccuaucagaguauggagucaggaagaucccuuuuaauccaugaacacauuuauggugcacacuagacaacuuaacccauuucuaccuaccaccaucccuaguaccuaauaaaaugugcaaaauaaaucacucuuguucacagaacauugauugcacaaaguaaagcaaaaauuuucuauaugcuguugaguuuuguaaggguuucucugguguuuuagaacuauaaaccacugacauccuaaagugacuuccauucucccaauucuagaacaaugccauacaacacaggcuuaagaugugguacuauuggccagcuggacucacucagagagucaggaaucagcuuccuggccuuaguguucauugcaauccagacauguucugaguuaaaauccauugucaaaggaaugugacaugggggcugguauacagguuccucuuuaauuugaacuuuauaugcuaucugaaauugauuaaaacuuuuauuaaggucuuuguguuuuuuaaaggcuaaacucaaaaugggaucuccgaagacuuuguaaaacuguuggugcuacagcucuuccuagauugguauguauuuuggaaaacacuaaaagauaguugaacaagauggaauuuuuauuacaacagucacuuucuuacagacaccuccuguccuugaagaaaugggacacugugacaguguuuaccucucagaaguuggagauacucagguggugguuuuuaagcaugguauguaggaaugguaaaacauguuuaaguguagggcuuuagcuucuuguauuuaaucaccaaauauauuuaauuuuuugauagaaaaggaagauggcgccauuucuaccauaguacuucgaggcucuacagacaaucugauggaugacauagaaagggcaguagacgaugguguuaauacuuucaaaguucuuacaagggucaguaucagcaauauucuuaguaguuuguaaggucugaguaauuuguauggucuuaaaaguacaguuugcagacucuugcacaucaugagaacuucagaaugagugguuuauaugaaaugaagcaccuguuuuuguuuuuaccuaagacuuaaguguccauuguuagugaauaugauaguuuccaaaaaagauuguacagaggaguuaacagcaaaacagagcuuuaaaaaaaauuguuuaucguuguuuuccauuguaauguacuguuaguugcuaaagcaguucuuagugcuauaucuguggauaugcaaaaaugauacgguacuauucccauucuucacuuugguccuuuucauacaccagacacugugcacuaagaaaauuugccccacccacucauuuuuaccaaauuuguaauauguauuugaguaacaaugacugauaaaaacuccuguuuggugggguacuggaaugugaaaagauuagaaaacugcaaacugauuuuuagugaauuuguuuuguguucauuuuuuuuuuggugggggcgcuacauacaggauaaacgucuuguacccggagguggagcaacagaaauugaauuagccaaacagaucacaucauauggagagguacagcuuuuucuguauaaauugacuuucuuuccauugcuugaauaaaagacaguaauuaacgcauuuuuguuuuagacauguccuggacuugaacaguaugcuauuaagaaguuugcugaggcauuugaagcuauuccccgcgcacuggcagaaaacucuggaguuaaggccaaugaaguaaucucuaaacuuuaugcaguacaucaagaaggaaauaaaaacguuggauuagauauugagguauuugaaaaaacacugaacuuaaauugcuuuauuuggggaaugcacaaccuaaaaauaguaugaguuuaaaagaaauaucaaugagaaacaguguucugauuugggagcagauuauuuucuuaguuuuuacauagguugucugauggaggaacguuucauuuuccuucuguuuuauugauagucuuuuguucuguaguguguagucagcccaguucuguauccauugauucaaccaaccacagauugaaaauauuuggaaaaacuaaagacauuuaaaaauacacuauaacaacuauuuacacuauguuauauaauuaaucuggagacgauuuaaaguauaugagaggaugugcauagauuauauccaaacaccaugccauuuuauguaagggauuugagcauccacagauuuuggcauccuuggaggugcuagaaccaauccucacauacuaaaggaugacucuauaagguaggacugugcuugguuacuuuccaguacuauuuaaggagcuaugugaggcuuuuuguggguguaaacauuuucacauaaaaggauuuuaaaugaaaggaugaaaauuguguuugacaggcugaagucccugcuguaaaggacaugcuggaagcugguauucuagauacuuaccugggaaaauauugggcuaucaaacucgcuacuaaugcugcagucacuguacuuagaguggaucaggugagcaaagugaaauuuugaucuuuaaaaauacucauuugcauacuguuuaauaguauauuuucccagaacuagaacauagcauaguucuaauucaaaggauucuuaguccucaccuauuagagauacuaugugccccccuccaauuuuuuucuucuauuauaaauuguauugaauauauaacuuucaaaccuuuuagccuuagaacccauuuguacaaauaauuuagagaguaaauuuaauauauaauacuaacauggaauuuggaaggaccauaaagcucucaagcagacauugcagaccaccagcuugaaggaaaauggagucucuagcugucugcagauaagaggacugggcauugaaaauuuuuucugcuaugacaaauuacagcuugagauacuaaaagauguuaaagguguuuaaaaucauauuucuacccuuuuuuuuuuuuuuuugaagaauugugguagacuguucuauauauagaaguaaaccugaaaucauaauuauuuuuccaaaagguauuuucuggcaaacuuaauuaaauacauuuccccacaaaauucuagaaguaauuaauaagcaaugacuauuuauaaguacuuaauagaaaauuuuaauuugcuagagggacaguauacauccauuagguaaaagucauaugucauauuaaagguggaguaaguccuaaguagaaaucaguggaaagacauuucagcuuuuaaguacaguaaggaccaguuggugguaauuauaacaaauuuauuggaagaacuaugauagcaagagaugaccaaaaauggaacuggauauuuaguuucaagucauugaaaauaagcagaaacuagauguuuauguaccagauuaacggguuucucugucagcuuauuaggugauuuucaauggaagaauauguuugaguucuuaaauagaaaccuaagaaaauacuuauucuagaaauuagaauguggcuaagaauaaaaggggaaaccaaaaauagcagggacggaagaagcuaaguagacugcagcauaaggaacgcagaaauuccaacuguguuaggaacuuugaaugucaauuauucaagcaagacaauaaccaccacccuuggucacaaaggcaguuugaauuuuggcuuuaaacuaggaagucugcuuuaucuuaugguaggggaaguuguugguugaucuguucccccagucuuugcacucuaugugaaguauguaucuaaagaacccauccaacuguauuaaccaguuuguguauauaguguauaguauaaugaaccuaaauuuguauaguauauauucuagaaaaggaauugcacaucaagcuuuaagcauuggauaguguaguacggacuggauuaaucuuuguuggaaugucuauuucacuaguucucaaaguauggucccaaaauaguaucaacaucaccugagaacuuguuagaaugacaguucucagccagguaugguggcucacaccuguagucccagcuacgcaggaggcugaggugggaggaucacuugagcccaggaguugaaggcugcagugagcugugaucacaucauggcacuccagccugguugacagagugacacuccaucuuuuaaaaaacuaaaaauaaauaagaaauacagauucuuggaggccaggcgcgguggcucacgccuguaaucccagcacuuugggaggccaaggcaggaggaucacgaggucaggagguugagaccauccuggcuaacauggugaaaucccgucucuacuaaaaaaaacaaaaaauuagcugggcgugguggcagaugccuguagucccagcuacucgggaggcugaggcaggagcauggcaugaaccugggagguggagccugcagugaguagagauggcaccacuguacuccagccugggcgacagagcaagacuccaucucaaaaaaaaaaaaaaaagaagaaauacagauucucagaugucacuccagacccaccaauaucagaaaugcuggaagaggccuagcagucuguuuuaaugagcacuuuugauuauggugcccacuaaaguuugggaacuacuuguuuuaguguuuguuucuuuuuuuucuuugagauggagucuugcucugucaccaggcuggagugcaguggugugaucucagcuuacugcaaccgccaccucccagguucaagcaauucugcugcaucagccucccgaguagcugggacuacaggcgcaugccaccaugcccaccuaauuuuuuuuuguauuuuuaguagagacgggguuucaccauguuggccaggauggucucgaucucuugaccucgugaucuguccgccuuggccucccaaagugcugggauuacaggcaugagccaccacacccagcuuuuaguuacuuuuuaaaaucaaugugcacuuagguucuaaaauuaugcuuaaugccuuuaauucagucugaaauuacucucaauugguaacauguuauucugagaauuucagguuuagguaucuuuuuuguuguuguugugauaaggucuuacucuaucacccaggcuggaggacaguggcacaaucauaaucagcucaccacagccucaaaauccugaguuccagugauucuucugccuuaacaucccgaauagcugggacuguaggcaggugcugucaugguuggcugagauauauaucauauauaucugauauguauauaucacacauaucauauguauauaucauacauauguauauaucauacauaucucauauauaucauauauaucucauaucauacauauacaugauauauauaucauacauauauguaugauauauauuauauaugauauauguaugauauauguaucguauauaugauacauauaucauauauauauuaucaaauguuauauauauauuuuauauauauauauauuuuuaguuuuuguagacuaggucucacuuuguugcccaggcuggucucaaacuccuggccucaaaccuuggccucccaaagugcuaggauuacaggcaugagccacugcccaguucagguuugcagaugguaauuaagauguuuuccagccgagcgcaguggcucacaccuauaaucccaacacuuugggaggcugaggcggguggaucaugcaggaguuugagaccagccuggccaacguggugaaaccccgucucuacuaaaaguaaaaacuuagccgggcauggugaugggcaccuguaaucccaguuacucaggaggcugaggcaggagaauugcuugaacccaggaggcagagguugcauugagccaagaucgcgccacugcacucucuagccugggcaacagagcaagacuccgucucaaaaagaaaaaaaaaaaaaaagcuaaaaccuauuuauuuuagauaaaguaaggugagguuuguggcgcuuuuuuuuuuaaguugggaacuuagauuuuuguuuaugaaaauuccuggcugcuugaaugauucucauuuacagguuuuagaaaauuucaguguuaaacuuuguauauacuuauguaucaacuacuuuagauuauaauggcaaagcuggcaggugggccuaaagcuccuaaaccacaaggaaauugggacagagaugguuggcaagacacaucucauauauaaauagcaaaucaggugccaaacugaccgacuuacaccagugaugcaugcacauauuuucacuuucagcuuuuugaguuauugaagugcaugucuuggaauguucacuaaucucuguggauuuuauugcgguuauccauaaaagcaguaaacuuucucaugcgcugaaaguuuacaauugaauuucuaacaagggagcuagcaaacucugugcuguaguguuuuauaugcaguacauaauuauaccaagaagacugcuuaaucuuaaaucaugcuaauagaagcauucuuuucauucuaaagguuaaguugauaagcauacucuugugugauucuuuuuuaugcagaucaucauggcaaaaccagcuggugggcccaagccuccaagugggaagaaagacugggaugaugaccaaaaugauugaaauuggcuuaauuuuuacuguaggugaaggcuguauuuguaguaguacucaagaaucaccugauguuuucuuauucuccuuaaauuaagaguuauuuuguguuuguauucuuggcuggauguuauaauaaacauauuguuacugucaaagccuuauugucuaaugaccacgguuauuggcucuaaaugacuuguguuccucucaaccuuguuaaucacauuagcugugggacuuaaggcaagucacuuauguaaguagaggccuauuacccauguauaucuggccuacugccuguuuguguaaauaaguuauuggaacacagccaugcucauaccauuacauauugucugcaguugcuuucuaacaagggaguggcagaguuaaguaucuuuauuuuugacagagaccaaaugggccuacaaagccuaaaauauuuacuaucuggcccucuacaggaaagugcugccaacaccuggacuagauuuccaguguuuuugucacagcucuggaauuccugacucaaggugacuuguuucaauagcaauuaauaauuuguugaagacacucgacuuagcaaaguacaaaaaaaaugcuuagaaaauagauaaacugacauacaaaauuaagucaguuuucauaaagcagauucuauuuuguuaaaaucaguaaggaguguugaaaaagccaagaacauuauaaauaaauuauuauaaauaaucauacugaauuuuauaggacaugugcuacuauauguguugguuauguaagguccuuaauacuguuugaaauuguguguguauguauuucuugagacaggguguugcucugucgcacaggcagugguaaaaucucagcucacugcaaccucugcuguugggcucaggcaauccacccaccuccgccuccugaaaagcuggggacacaggcaaacacuaccacauuuggcuaauuuuuaaguuuuuuguagagauagggucucacuauguuacccaggcuggucucaaacuccugggcucaacguuuccuacugccuugaccucccagaguccugggauuacaagcauaagccaccgcaccagccuguuuuuaguauucuuuccaagagauuuuagaagcaguaugacugacuggguauuacauaaacucaacagguguuuguuaggaaugauacaacucucauuacugccacagcaaguuagaaauguucaucguaugucgaaguuguccucagagaaccuuucaagaaguucagagacgcuuggugucccuaagcucuuuguguugcauguaacucaaacaguggcugacuugggacaguucacaggcuuucucugguaugcugguauuaagggguuugguacccaauuauacucauaggagugagacugguuugucuuacaucuguccaaaaucaguugaccacuggcacagagcaaauacagaguaaggccuuguauaccccagcuuaugcacacuauggcaucagaaggcuuauaaagaaacauugcucccauuuauauucugcugucaauauagaugcuuauaaaauuaacacacuuguauggcccagcgcgguggcucaagccuguaaucccagcacuuugggaggccaaggcagguggaucacgaggucaggagaucgagaccauccuggcuaacacggugaaacccugucucuacuaaaaauacaaauaauuagcugggcgugguggcgggcgccuguagucccagcugcucgggaggcugagacaggagaauggcgugaaccuaggaggcagagcuugcaguaagcugagaucgcaccacugcacuccagccugggcgacagagcaagacuccgucucaaaaaaaaaaaaaaaaaaaaaaaaaaaaaauuaacacacuuguaaugaagcuucauuagccagucugaugaaauauuuuuuaaaguguuaccuaguaggauaagucaauagaaguuaaaaucuucccaguaauaaaacaagauuuuaggguaagucaguuuauugauguguugugauccaucacccagauauauuaaacacaaaguacuuaaguaauucaggauuuccuuuccagaaacaaagcaggaauaaaaaccacuaugacaauauaaaaccuuuguacauuuuuagguauuuuucccuucaauauuuaaauaaacaugauuucuucuggcauguauu

SEQ ID NO: 18158 - RNA, 47322 nt, Homo sapiens
uucaauuagaagcaauuuuagagaauuuuauuuaacugucaacuuaucaccaacaucuaacauuuuuuaguucagguacauuuggguaagaacauuagggagaaauguaaauuaaauacuaugaaacuaugcuuuuaaugaaacauggucucaguaaaauauggacacaaaaguuuagugguuuuauugcauuguuagaaaauuauauuaugaaagauauaaaaaaaucaauguuuuucugcuucuuuuauaaucaguaugccaucuucuaccauuauggcuuuaauuuucauucuacccaacaaguuucaaagaauaguuuauuacaugccuuaauaaaacauuuaaaauauuuacagauucaaaauagauguuuuauaacugaaaaaaguucaccugagaauucaccguaacauugccauuuuuuucccaaguuguuaaugugacugaguguccacaugcaaccuguaucgucuacugcaucuaacauacuuauuuccuuauuuaaaauuaguuaagcaguaagcuauagcaaacuguuaaaaaaaauuacagauggagaaccaagacuguauccacauuuguuuugaauaugacaauuuaacgaauuauuugcuauaguuccagaauuugaauaagaaaaaaaauaagguaauguuauuuuacugaauucaacauaacagcuuuuaaaaaaucaucaaacauugagaaggccaguucauaaaauagugaacaaugaucaugugaauaugcaauauacaaacugaaaacauuucaaaauucugcaugaaggaaaaggcauacacuguauacucauaauccugucauuugucuucggcagccucaaaaaaaauauugccuugaaacauuuucuuagaaaaaacuucuuuagaaguuaauguuaaaauaggcauaaauguguaaugcuaugcaauauacagaaaacuuucccacuuauggccaaaagacaaacguaaaaucuuuuuuaucuguccaucugcauuacaacuugaaaaucauguagauaugagguaguguaguuacuuguauuacaugcuggcuauuuaaaguaaugcuaaauuuuaagaaauuacacuuggccaauaauucugugucauuaauagaaacccuuaaugcuaaacuguuuauagguagagagaaauuuaaaccaagugcuuuacaaauuauauuuaagcucuggagacaacuacauuuuaucauaaaauaguagguaaucuuucaaagcaaguacaguagcaauuaaagcaaaagauuauuugacauuugcacauacacaaacugauacaaccaauaguuggguguacacugagguaggaaaucaaggguuccauuggcuuaagauuuuacauuuuguaaaccagaaguucuuauauuauuuuauaucgugaagcugaaauuuaaaauuacaaguaucaaagaaauaccuauauggagagauauauauguauacauacacauacacacacacacacacacacacacacacacacacaaauucuuuugcaguaugggaugcacuaucagaauuauucucccugacaaauucuugaguguacuuauaaaagcuacuagaaaauaaacaaguccaacuaauuuucucuuacaaauaagucagugacagagagaacauacaaaccacugaaaauauacuagcaauauccucccccuacacccugaucaaaaaggguaacauuugacaaauuacuccaagacaugaagacugguccccauauacucucaagggcaaggccaacuugcuucagacuuguucauacacagugggugguggcugcccacauuagcuagacaagcccugcacuaggcucaggaugcagucuauagaagugucucuuucagcccucugauuuuggugaaaucaacacuauaaacuacuccucuguaccauuaaaacuggguucugccaauguuucugugaaugugaauauaugcauuuuuuuuaauugcugagaagauccauagcuuucauuugacucucaaacacaucuaaccccagcauggcuaaaagccaccgcaaaauguuaugcgauaggugcucaguuaucuauuuuguaacaggacugaacaaacacuaagacugaucuuuaaauguccaaguuaaaaugauuugugugucuuuauaccacaccaaauuuggagaagagagcaaggauucaaccugcuuuucaaaugcaaacccacaauagaaaaagauugaguuucauccuauuucacaaaccugcagaguugcugcagauacauuuuuuaucuguuacaaucauuuuuacaagugaauaauacgacuucaaaaacagggugaaaaaaaugaacugcacuccugguaaaaaguaagcaacauucuuuccccgugaugucugguuuucuggcauuggugacccacgguggaaaaaugaacagcuuuacauguugguaagcucuccagauucuagggagccugagauaaugcugccaguguaaucacucaugccacuguauucugaguccuauuucuucuuccaaagggacaaaaaugccaggaaauaggaaguccaugaugggaccagauaugguagagacugaagcggggggcagggagggaaagugacacuuaaaucuauucauguagccagacuuucuagaguccauacugaagaggagaagcagcccccgucuuaggccaaccacuugccuauuuacuaaaucuucccaauguagcuuaaagccugauuuuaggagccgaagaacaaagcccuaagauucagguaagaccaucuuuuuuucacaaugcagcucuacaaaaauauucccaguagcugacacccugcuucuaagaauagaacucuauuagcauugcuugggaagaaauuuucuuucaaacuaaaauauuagaaaaaagucaaauuauuaaacuucugcaggccacuucuuuuaguaggaacuaucuguagauguuucaagcuguuaaauugcugucugauaugcugcaguuuucauucuccuacuuauucugaauagcaggaagaguuauuacuagaguuauuauucuuuaaaacaugaguuuuaaagguuuacuacauuuucacauggauuuuucugauauccaggaggcaaaaucauuucuuugucucuuguagaaaucaaggagaaaucaugguugacuuaaaggaaauucccuuaugguaaacuacuaaaggaaaaaaacaguauuguugagcaacagauggucauauuaggcuuucaagacgcugccaaaacuucaggagaaaauuagaugguuugaaggaagugaaugcaaguuuacucaucaguaguacauuuaucagucaucugcugacagaaaucugagaucccaccacucugacgacacuguuccgcaggcccagcuugcucagagguggcuguggacaucugcugggacuccugcccucgcgcguagccaggcucacuguuuccucuggcacagggaggcagcacugcuggaggccggucagauaaacugaaaauugaugguaacgccaguucaccaucaggaguacuuuuaucuuuuucagaaauuaaaaaugaaagugggcaaucugcagcugaguacuuggcgaguaucuguauuuguucuugacucagagcugcuucuuuacaaacuuucuggcaaaguccaguuagguucugcuuugucucacccagaguugacaaaaugugaucucuuuccuucaacaagcucuccuuuucacuuugcugugaaguggggaaagagaacacaauggcuuguguuuauuagcucaaucaacauuuccaaggcgaucaaauaauauacaggggcuucucaucaaguaagaucacauggaguuuauccuuucaauuccauucaauuauacauuaaauacuaaaggcccagaaucucccacccaaaacucuuggggcagauguauuuuggcacaaagcauuuuucagguuuuggaaagacaguaugggugcacacauaauuucucuagcaggccuggggcagcacuucccuaucaacuaucuuuacauuucuagguaaacauuaaaauagcaaauaaugaagaaaguaggauaaagacuauguagucuaaugucaauuuggggcaguuuuucggucaaaagaguuugugacaaacauacgguuuuuggagcuuucuggauuuacagacuguacauaacagguauggauggcauuuuggaugggauacaagaaaaaaaguaaaaguacaguuagcauaacuuaauuacugagacucaaagcauugcaagauucaacuaaugaccagcauuuguugagcagauucucugacagauauugugcuaaauguuuuccaacaugcaaucucagcuauguaauccacacaacaccucucuugauuuaagcaacaucaaacccacugaagggaugggacugaauuuaagaugccuagagacagccggugggugaguuacuaaagugugaagaauucggggggguaauuuugugcuugcuaauuaccauuuuuguuauuauuauaauuuuaagauauuaccccuauaagaaagucuaccacagaauuuuucaaaaguuuuucugguuccugccuuccuguccaugucacuuaucacugcugacagcaugucuuuucuauuaucaucccauuucauccuucuuguucuaacaucuuauugcuucuaaucuauuaugagccaggaaaccaaauaaucaagguauuuauaagaaaagaguaaauaaacacuugcuagaaagucaaacguuuuucuuaugaaauuuaucacaacucucaacaagucaguguuguucuguuugcuuucuguucauugacagguucuggagaguugaggcugccaguuaaccuugagacaaguuaguucauagugcuaaucuauaagugccauccuuuagucuuuuaugacauaaaagucacuaaaaggguaaaacgaauuuugcuuuauacaaaaguauuguuaugguuuuauacaaaaguauuacuauaaaauuauguaugaauccaauuauuguuauuucuaaaauauuuuaaagccuuguaauauuuugagaaaauauacaauaaauacaaaauacuaaauuuuuauauggcaaaguauucuccaaucuguucagauuuuuauauacaaguucuuuuuuuuuuuuuuuuuaaauagauguaggucaagaaugugcguguuaaguauguguauguaagcaaaaucaauguuuggccaguacauuuucucuuaugcaaaguuuaucaguugcacucuucugauaaaaugagucugcagauacugaaagggcaagaacgguaccuacugcuuguucacaguaggaaccauuaaaugcaaucaacacccauuucuuuuuauggucucucagaagccaauccaaaggaggaugaaaacaaagcuuccagaagaaagugagaaagaaucuuucuucacucauggcaauauucagccauggacuccucuaccaaaguugggaugaaucuauucuaaacagcaauagaaaauuuucaacugcugguuggucuuuuaaauuaaauaugguucaacaaaauaaggaguacuugagcuuccucccagaaauuagaaccacuacuuaaccuacagauacuaugaagauuacaaauauuuuaugacuucuguaucuuaauauccacaugaucuuuaaauacucucacuccucccaccccacuaaauuagggaugacaucauucuuuaaguauacaagauggcuugcuucuucacaacaacuaaaacaaauaggcacagcccuagaacuccaccagaauuauuucuauaaauuaaauguucccaucuguuccccugcacuuuaacuccuacacagcuaagcuucuaagcaguuuccauuucacucuaaguuuaagacacauauuuacuauaauagcagucagcuuaauaacuaaaaguaaaauacaaguaauucaaguuaauuacuuaaugacaucaguauuuaagauaccucccaaagucacuacuuacagucaugagugggacucacuauuaguguccugcuaccuaucccuacaauauauuuccauuuuccuauaaaaacaacuguauaaaucacguuugaagugcugcaccuuuaauuagagcuauuucuuaaaaaggaauaaaauuggcauucugguaccauucuggauuuuauaccaacaaaaaaucuuuacaggcugggcacaguggcucacgccuguaaucccagcacuuugggaggcugaggugggcgggucaugugaggucaggaguucgagaccagcuuagccaacauggugaaacccugucucuaauaaaaauacaaaaaaauuagcugggcaugguggcacacaccuguaaaccuagcuaaaagggcaggcugaggcaggggaaucacuugagccugggagacggagguugcggugagccgagauugugccgcugcacuccagccugggugacagagcaagacucugucucaaaaaaaaaaaaaaaaaaaaaccuuugcaucuaaauccuuauuuugaauagcuagugcacaauauuuauucaaauauaauuuuuuuaaagaucauaaauauaacucacccaauaaagauauagaagaauuuggcaccaaaaguacaagugacaauuuuaugauaggguaaagaguacucacuguuagaaaauggucacuaauaguuccuuaguaaguaaaaccucugaacggcaguucagagaaaucugcaaauggcacugagaaauauaagcaaaaaugcucauuuucacucauaagauaaaaauaaaagcuaccacgagauaucaugguaucucacuaucagacuggaaaaaacccaaaagcugacaacaaaucuugacugaggguguggacagacacacacacauauacugcugcuggaaggccaaauaugacaauuccuaaggaggggaaucuguuaauaucuaauaaaauuauguauguauuuacccuugauccaacaaucccacuucuaggaauguguccuagagacacagcuccuuaaacaugaaacaguauacaguuauucacugcaggaucccaacuguccacccacagaagacugguuugaacuguauuacagucacuacugaguacuauggagcuggaaaacgaaugacaaccucucugaacuaagaaaaaauauuuccuauaaaucaauucuuaaguuuaaaaaguacagaaaaauguauauaaaauacuuccaugcagcaggauggauaauaagaguagacauaaaauguuaacacauuuuuagaaaagaaacacagggaaaaaaaaauccagaaacuaaugaaaaugguuaccuauaggaaguagcuaugaauaggguauaaggagaagaugagaucaagauuuggaguauauauuuuuuaaaauauaguuuuaauguuugaaccauauaaacguuuuacauucaaaauaaaacaaauuaaaaauguaggccaggcaugguggcucaugccuaaaaucucagcacuuugggaggccaaggcaggaggaucgauugagcccaggaguuuugagaggagccugggcaacacagcgaaaccucaccuucacaaaaaaauuacccgggcaugguggugcgcaccuguaguccuggcuacucagaaggcugauaugagaggauuugcuugaucccaagaagucaaggcugcagugagucaugacugugccacugcacucuagccugggugacagagugaaacccugucucaaaaaauguagaguaaaucccaguaauauaaauagaaaaaaaaauuaauuguaugccaaauugguaacacaaauauuucaaauaacuuuaaagcuucacacugggaaauauuuaagcauaaaaaagcaaauaaaucucaaauucugcucaauuuguuuacuguuaauaguaauacugauugucuaauuuucuuacuuuuuauacagugugcccucacuuaaaaucaucgacagguuuuuggaaacugacuuuaagagaaacaacgcacaccagguccucaauaaacauuuuguuccacauccuuucuuuuuuauuuuauuguuuauuuauauuauacuuuaaguucuaggguacaugugcacaacgugcagguuuguuacauauguauacaugugccauguuagugugcugcacccauuaacucguuuuuuuuguuuuuguuuuuguuuuuguuuuuguuuuaagacggaguuucgcucuuguagcccaggcuggagugcaauggcaugaucucagcucaccgcaaccuccaccucccagguucaagcgauucuccugccucagccucccgaguagcugggauuacagguuugcaccaccauguuggccaggcuagccucgaacuccugagccaccgcacccggcacauuagguauaucuccuaaugcuaucccuccccacucccccacccgacgacaggccccggugugugauguuccccacccuguguccaaguguucucauuuuuacaacauccuuucauuauaaaguugaugaggaaaaaaacugguuucauuauccaucauuucauguuaagugagaacuuacuguauauuauaaaggaaacaauacacuaauguaauuggagccaaaauuuuuccuguaaaugaugagagauuaaacauaaacacagaagugaagacaaaagcucuauacugcuaaauuuggacuggaaauacuacauaaacucaggauuucuaauguacuuuuuacuuucauuuacugaagccugauauauaugaauucaugauauaaugaacuuuauuuuauacacagaugcauauauuuccuagcucuguccacugaaaaaggcccagaaggaauaauacuccagcagcagguaggcuuuccaaaguccaauauaacugcuagaagaaaccaggaguuuuaaagaaaugggugauuccaaaucuugaaacaauagagguuaaaaagugagaccauggcaagugcuagaugguuaugucaacaggacaggagcuggcuugaacgggcucucccaggccaaauuugaaaaaugucaacaucaaaaagaauaaugacuauuacuuauccuaacaaauugaaucagaaaaaauuaauccaugaguccacugugauuccaaagagugggagggagggaaaagagaaaacaagaaaaggccaggcaugguggcucaugucuguaaucccagcacuuugggaggcugaggaaagcagaucacuugaagucagguguucgagaccaggcuggccaacacgaugaaaacccaucacuucuaaaaauacaaaaauuagcuaggugugguggugggcaccuguaguccuagcuauucgggaggcugaggcaggagaaucacaugaaccugggagguagagguugcagugagcugagaucacgccacugcacuccacacuccagccuaggcaacagagugagacucuguuucaaaaaaaaauaaaaaaauaaaagagaaagaaaggaagaacaauccuuuuuaaucaggaauaccaacuaaaauaauguaaauagaaugaaagauuuagaaaaaucaugauuuuguaaucaugguaaucacagugaaggucaucaacauauucuaaaggaugcaggaguauuggggaacgggauaauuauaaagugcccaaguaacacaucauagauaacuaagcaacacagguugaaaaaauauuacuuugaaaauggagcaaucuggcacuucccagcuacccagguacgacaauacugacacuggaccuccugccucccuaggcgacacaauauaaaggacaacaccagugaauguuuaaacucagucuccucaacucaaacauuuccaguuuacgggaaguaaagggauggagaaaugacuuaaagccauggggaagcaaucagacaaauaacuuaaaguaagacauuuaugagaaauccagccuggauacuucaaaaaguuauugucauuaaaacaaugagaguacuuguucuagauuaagagacuaaacagguuuaaucaaaugcauuauacgaugacuguauccucguuugaaaaaaaagcaucuaugaaagaugggaaaaucagaguaauuugaauaaaaacuagauauaauauuuaggauguguugaaauucucaggcauaauaaagguauuagucauaucuaagaaugccucuuuuuagaagaugcauguuuaaacauuuaaggaugaagugucauaauaugguagcuuucaaacaauucagaaaauaaaaggagaggaagagagccagagugaggaaugacagccagcaagacagcaggacaggaacaacagugacaccaaggggugagagaccaagaucaaccaagugggguuaaaaaaggaccaagauggauagacggagauagaggugcaaagacugacaaaccaacagguauagacagaugaucugagguggagagacaaaggcggaaagaucaagauagagaaauaaagcaaauguggcaaaaugucaaaaaucaaagaaucuacaugcagaguauaugguugcuuaugguacccauucauuuaacuuuucugaaagcuugaaauuuuuagaaugggguggggggugcugacaugaagcucaagaaaaaaugaacacacuugaacuugacucccuaugagacuguaaguaagugaggauucugucuuacucauuucugacauccugguaccaagcacaacauuuaacauguagggucaccagcaaauacuuauaggaagaauagagaaccacuuuuauuuaaaguacaacuaauacauauugagcccugaacacgugcugggcaguacaaacagcuuuucaucccugaucucaucagauccuugcaucaaccccgcuguggcuguuacucuuaucccacauuaguaacgggggaauguggguacuggagguuaagcaauugccccagaccacaaagcuacccaguggccaggcaggcuuuccagucauuugucuccaaagccuccgucugaccucagugcuaucaugcagugaguucucagaauuuaaaacguacaugacauuuaucuuggacuuguaucaaaugcaagguccagggccuuaacaacagcucugguauagacuaagaaauguccaccuuaaggggcaccccaagauaacuaugaugccaaugggacacacaccacauuucaagaaaugcugcucaacgacaacacggaaugacagagggcagguuccggaagggccacuggggugcgcuuugguugagcagccaguaaauugugacuaguugugaauaggacagguuuauuuuuaauaaaauauaaucuucaccacaaaaugcaaaucacuaaggacggaugaggucguuuuacuucugugccaucauaauggacaaaaguaaugaaauaaaauggugucugaacaccucaacccugagcgcaaguguuugugaauauucugauugcugaucacuuacaaguugauaucgaaaacaauauuugauacuuucuaaaagaaauacauuuugguaaauauuuuucugcaaaaagcgaggcucccuucauuucaggguaccucugagguuaaaaugguuaucagagauauguauauuuucuaacuucugaauuaaucuuccagaaaagaauaaacuuggaccuuguaaagaaagcuacauagacaagagcuucauaaguuaaacacugaacagaagcugaauccaaagacuuuauaauuguuaguuuuaaaagucggccgagcgcaguggcucacgccuauaaucccagcacuuugggaggccgaggcgggcggaucaagaggucaggagaucaagaccauccuggcuaacacagugaaaccccgucucuacuaaaaauauaaaaaaauuacccaggcaugguggccagcgccuguagucccagcuacucgggaggccgaggcaggugaauggugugaaccuaggaggcggagcuuacagugagccaagaccgaccuccagccugggcgaaaagagcgagacucugccucaaaaaaaaaaauaaaaaaaauaaaaaaaauaacaaaaaaaaccaaagucauguuacuggcuuaugcauuaugcgcauucaguucuuguaauaaaagcaaugcuaaauuaaugcuuaaccucuaacauacuauaaaauucaaaauaaaugcuaaagucaauaccauccauuuuuccaccaaauaaauaaacaccuuuucuucaaagguucuauuagacucugacagaacuucuuguugagaaauaccuuauuuacuaaaugcuaacucacaucucccuuugucccaacacacugagacuuuaauaaaaguguccuuuauuccuuuauacauaauuauaauacuaacccacuuugcaaacauuuuagaauaauuauucuauuguaaucaaaccccuuuuuaucacaugcugauccauccagaaucuauuaugccauugcccucaggacgaacugcaaaaaguuccaagauuucuuucuaggaaaacaaacagccaauagccuaagaccaaacuaacuagaauauagggcccucugcaugaauauuuuuagaccugagcaauaaauacugugaaucuauuaauauguuaaagccaaccagucauucacuaugugcaaauggcuguuuaauuauuaaacaagcaauuucccuuaaauagguuuguuauaaucuuuagacuauaaagacuaagaauacugcuuguuuauuggccauguuacuuucaaaaaguaacaucucaaugagauuaaaauauacacaaauaucuguucacauuccuuccucuuucucaacucuccaugcuacuaaguauaaaccucuggcuguaacccuccuaguuuucuguuuacaaaagacaagauccauaacaucacccaacaaccaggguccaaguaaacuucuuaccauaauaacuaucuuaaacgucaaauucuuuuccuucuagacgggccagcuuucuuauucguauuagcuaauaagcagcauauuuucuguuuauguuuaucugagaaagacaucuacgcaguacagaaauuuguaauguaccccucacgcugcaacuggaguuugccaguacaaaucacuagaacugagagcagugugaaggacugaguagagacuucaaggaagaugaaacacaaaugagucacucugauacaaaaauuccaacacaacuucucugggguuauuuuagaagucagacuggcgccuaucuaggugcaggagacacuaucagaugucugcugugccugcccagaaaggagggucuugacucuucuauuuuguucuugcucgcuagucacagaagaggauaccugagugaauucagccaguaagaugcucuccuugggaauucagaacugacuaaaacaguagucucugacuggauuagucccuggagagagugaaauuauucaggcauugugccacagccacccuucccaugugcacuuagugacacacaaagccacucucggauagagagcgaagcgggugcacagagaagucccuggguucccaggagucuuccacuucuguucccuguuauuuaugaggccuggcuccauugucuagcuucuaaaugagagguaccuaucucccuacaacaaauucauucauucauucauucauucuucaaucaaaagucuguuucuugaagccaaagaguccaaauuaauguaauaguuaaacaggauacugaccauucagauuuuggauuucauaaaaacuguugagaaacaaaauauuacuuuguauugaaaauuaaccaguaguuauucacugaccauaugaaaggaaccuuacuaugaugacagaagcaauauaccaaacacagaguuuacaguuuaggcagagacauuaggaagaaggucaauuaagaaagggaaaauggagaccggaugcaauggcucacaccuguaaucccagcacuuuggaaggcugaggcgggcggaucacgaggucaggagaucgagaccauccuggcuaacacggugaagccccuguucuccacuaaaaauacaaaaaauuaguugggugugguggcacgugccuguaaucccagcuacucaggaggcugaggcaggagaauugcuugaacccgggagacagagacaggagaaucgcuugaacccgggaagcggaaguugcagugagccgagaucaugccacugcauuccagccugggugacagagcaagacuccgucuaaaaauaaauaaauaaauaaaccaaauaaaauuuuuuaaaaaguagaaaauggaaaauaauaaaaaauacauaguauuuauugaguaguuacuacgugccaggcauuguucuaaguucuucagauggauuaacucaauuaauucccccaaauaagcaccuaaucuauaaaguaggaacuaguauuauccuauuuuuccgaugaaaaccccaagucacagagaaauuaaccugcccaaaguuacuaagcaucugauugagagcccacaauuuuaaccacuguaucugccaccucucuaagaaggaaaggcagagggagaagaaagcccaaagauagcaaggcuucuucauccuagauaucugaaauuuaguagcaauaucaauaaucuagcaaaccaaugucugauuuguaucaaaaaaauaaaacccuugagccaagaaauagaguaguucuaaaggauaauagcuacucucaaacauauuugcuuaguauccauuuauaaaauaaaguuacgaaauaaacuagaauagucuuguuucgcuuuuauuuuuauuuuuagaggaguaagaaaacuggauaaacucuaugaacuacuauaaauuauagcuggcagacgagaaagagcaagaaaaagaacuaagaagcauaacuaagaacuucaguaguacaauuuuauguagauuucauuccacuagcuucgcauaaccuaacaguguaaaaagcaucucuguauugcagcacagaauaaaaacugaagcucaaaaugcuauacuccuucuaaaggcagguaaggguuuaauucaaaacugaauaagaaagaacaccaguguuuauuaaagguauuacugauacacacucuaaaaguacuaaguacuauagaauugaaaacuuuuccuccuugguuuuaacaauuuuaacuauucagcaauaucaugucgguguuuggguuuuuuguuuuuuuuuuuaacaucucucaugccucuauuuguaaaacaucuaguuccucuauuuuuuauuuaguuaugcuucaucucuuuaauauaguuaugauuuuuuaucuuuuuacacaaaguauauguacaauauauaaauaauaauuuuuuauuuuucaacuucuccuggaggcacaauuuuuuucccuaaauuguugcuguuuaauugccauucauagcuagaauguucacgcuugaaaacuugccacaaucccaacuuuuaaacuuucaacaauuaauagacacaaaauugaauauucaagcaauguuuuuacuacuucuaggcuguuuccuugcuaucuuuuaccauaucuuagcuuuagcuggccuguacuaucagaguuguccucuuucauacaaugcuuccuuccaccaacggaaaaaagaaagaggaguaaacuaaucaauuuucaguuaauuugugucuugaugcuggaauagaaaauaagauucaggccaggcacgguggcucaugccugaaaucccuuugggaggccgagacaggcagaucacgaggucaggagaucgagaccauccuggcucacacagugaaaccccaucucuacuaaaaauacaaaaaauaaauuaaaaaaaaaauuagccaggcgcaguggcaggcgccuguagucccagcuacuccggaggcugaggcaggagaauggcaugaacccagcaggcagagcuugcagugagccgagaucgcaccacugcacuccagccugggcgacaaagcaagacuccaucucaaaaaagaaaaagaaaagauucaaaagcaagcauuguucucacuuaggaucccauuagauauuaauauuuucaauucauaucaccauaucuaucagaauuuuuuuccuuagaugaaagauccugguuggucugguuuugguaucaaccaaaacaaguuauucagguccacaguucauuuaaaugaacaccuggaauauuaacuucuauagacacaaaacagagaaccuaaagugcuuuauaauuucuugaaucuauucacaaccacuaaugauuagguagacaguaaagucauucuuaauuugaaaaccuucuuuuuaaaaagcacuuacauaucacagcauaucaugguaaaaaugauaaaaugguaauugauacauauuaaaauaaguaauugagcauuauaucugaccuagaaauuuaaaaacuauuuccuugacaaaaaagaaagugguggaauuuaaauaguaacaagaaacuuuuacacuuaccagcuucucaauuucugauucaagauucuguauacagucaaguuuucucuugcgacagcgcugugcagcaauucuguuuuuacuucuucuucgaauaucauggauacaauccagcuguucuggaguaagcuugugcauuuucaacaaggacugaaaaucauuucgagacagugaaauuauccguugugcauugaauggcaguuuuaccuagaauaugaaauaaauauuacuaauuauugcuguauuuuauaauuauagucaaaccuaggaagaugaagguauacaucuaaguuuuucagagaacuuauuuuacauuaaagaaaacauaggccucuaucccaauuucuauacaaucucaaaaggauaucugcacugaucuacacauauuuuuuuggagacagggucucugucaugcaggaguacgguggcacaaucauggcuuacugcagccucaaccuccuaggcucaagcgauccucucaccucagcuuccuaaguagcugggacuacuggcacaugccaccaugccuggcuaauuuuuguauuuuuuguagagaugggguuuuaccauguugcccaagcugaucucaaacuccugggcucaggcaaucuacccaccucagccucccaagguguugggauuacaggcaugagccacugugcccagucuguacuccccgccauauucguuaccgcauuauucacaauagccaugauauggaaacaaccuaaauguccauggauggaugaacggauaaagaaaacgugguguauauacacaaaggaauaccauucagccugauaaaaagaaggaaauccugccauuugccuacaauauggagaacuugggaggcaucaugcuaagugaaauaagccagacacagaggagaguaaauccaacaugauuucacuuauacgaaguagacagaacagucaaacucacagaaacagagaguagaauggugguugccaggggcuagggagagggaaaaaauggggaauugcaauuggauggguuaaguuucagucauaaaagaauaaguuauagagaucugcuguacaauauugugcuuauacuuaacaauacuguaucguacacuuaaaauuuuguuauaaggguagaucccauguuaaguauucuuacaaaaaacaaauaaagcccaagaaaggggaaaaaaugcaauggauaaaauagaaaaauaauuuuuaaaaagaauguaaauugugauuauaaagagaaaagccaacuauugaaaggcaaaaaaaaucauaaaauauaaaaacaaaaaaaagaaaaaauauuuuaauuaauauauuuuuggaaggaacuaacaggcccuugucauuauuggacuuauaaguaauauuuuacagaaaggaucuaucaaauacaaacagaauauacaaaucaagcuugcuuugauuaauaucauaccagcuacauguaacucaugcuaaauuaagacauucaucaauaguugaaauggccaaaggaaaauuuaaaaaucaauggccaugaaaaacuagauccaauaaacuuuacuccacuagaagucacauuccuacaacuaaucacuguuaaaccacugcucagggacaugucccaggucuagagguucuuguuggcaaugagcaagacugaauauaugcugcauuuuuccaggaguuaucaaauaaugagcauagaaucauuauucuuuuuugucuugcagcauggcauuugauuuaaacaauuaaauggccgaugugugaacacagccaaugugugaaccuacuuuaugguuaauauaucuacuggaaacgaaugaacagaaguccuucaaacuucaucucucucuuuugguauuuaucacacaguguuuuuaaaaaauuuuuugagacagucuugcucugucuccuaggcuggagugcaguggugcaaaccuggcucacugcaaccuccgccucccacauucaagcgcuucuccugccucagccucucgaguagcugggauuacaggcacccaccaccacacccagcuaauuuuuguagagacggagauucgccauguuggccaggcugaucucaaacuucugacuucaggugauccacccacaccucggcuucucaaagugcuggaauuaacaguugugggccacugcgcccagcccuaucacacagucuuacaauuaauuuuguaugaguuuccuccccacucccugaaccugauuauaucccuaaugaugcaaagggagcugauccacaguaaaucccaauuaaugguuauuaaaacaaugaauuaagaacauauuccugcucaccucacauucuuguucucuggcugaacaggauucacugucuccuucgguguccgucucagagucgucucccaagcuaaugacacaagcauaugggcaagguucuugcugggguucugaaacauaaucaucguuuccaauuuccaaauugcuugaacagccuucaguacucagaguacuuauaaaagggcaguugacagaacuuaauguugugaaaguccuuugaccugguucugggcucucacuaauccugauaccuaaccacggacacucagaccguuucugugagaucuguucugagccaucuuuggccacagcaggugauaacugcauuuggcaaggaguguccgugcugcaaaugucacuccagaagccuuuugcuagguguucugccacuucucgcuccacacuacuccuaucacuagaugcaacacuacuaucuucccuggugcccaagucggauuucaaagguaaauccugacuuucaccaaauguuuuuucuuggacgucuguaccugacaaaggcuuuucuguuaacacuguuguguuuugcauaccagcaaaauucaagucaccauauuggucauauguguguaaaagagacaaagaauaaaguccaugagggucuauggaagaauugugggggaaaggagucacuucugauuuuucaguugggcacugagaagcaggaucuuucuucguuucuucagguuccauugcuaauuuacuuucgucacauuuuaacaucaccugcaaaucucuacacuccgggacuccucccaggcauucauuuucagaccuuucauuuggcugaacagaagcaugaaugucuuugacacuagauuccccaguacggacucugucaguuccaaaugcuuuuuggaauuuucuguauuuggggcauaaagaaggcaaggccagagcagcauccuucucuaagcacauggacucauaugucugacuggcacugucuuguagaggaggugaggcuuuugcauuuccuugauaccugcggaguuuacacugaggagucugaacauuuuuauuuuccagaaauuccuccacuucaucaguuucuagaucccucugguccaaaagugaaaguuuaaggucuguuuucugacagugugaugaaaagcauuuuuuucuugggcauucuugcuggucugcaguggaguccaaaaacuuaaauuucagaaacugaaagcaggauuccucaauauuauguacacuuaaaaacuccacacauuugcacacuucauccacauucucuuuacuuaaaaucaguuuagcaguguaggcaaacugaauuaaagguucaaauccuuuaacugucaccuguugauacacaaaauaaaaacaaacacaucauuugaaagcugucuaguacauaaaaacaaaauaaguagaagaggaauagagagauauguaacuuauuugugauaauuauaaaauauguacuuuaauuugaagaaaacauauucuucuaagaaauguaaaagaaaaagauccuggaaaagcaugcuuuucacagggaccacacacuauuuuauagaguccucucuuaauugcacaugaauuaugguuuacucacauaaguuaaagauguaagacauuaccacaauuuucccaugauagugaaaaaaaaaaucaucuaugaauuagagcaggaugaacacuaccugccacacauagugagucuacugcuagcccagcuccacauggccacuguauuccaaacaacuccaacugcuacaagcuacaaaagcagaauuuuaaaggauauaaaacaguauuuguaaagcaguuacaaagucuugauccaugguaaaugcauacuaacugguaacuauuaacuuuacugucaaaaauuccuaacaguaaaaguuuuaaagauucagauuuuuaaaagugaucuaagagaaguuauaaaaaucaugccucgguacuguuucagcaaaaauucauggacucgaaguaacaaaacuuuuaaguagaaacuugcacauuuacauuaaaccugccucuuaaagugagaggcaaauggaaccaacuccaguacacagaaggcaucauccuggauuaaaagcacaaaauuaauuugaaaccacugaguucuuauaagaguggucaagauaauauuaauauuugugauuuuuuuuuuucuaagacggagucucgcucugucgcccaggcuggagugcaguggcgcgaucucggcucacugcaagcuccgccucucggguucacgccauucuccugccucagccucccgagcagcugggacuacaggugccugccaccaugcccggcuaauuuuucuguauuuuuaguagagacggggguuucaccacguuagccaggauggucucuauuuccugaccucgugauccacucgccuaggccucccaaagugcugggauuacaggcgugagccaccgcgcccggcugugaucuucuuaaaaacauaaacaugcuaaaccauguuuaggcuuuuuaaaggcuccaauaaaaagcagugauaccaucaaaugcuaaugagaaugccgauaaacuaaaucacucacauauugcuagugggaauguaaaaugguacagacacuuugaaaaaaacuuucuuauaaaacuaaacaugcaacuaccauauaacccagcaacugcacuccuggucuuuuaucccagagaaaugcaaauuuauguucacacaaaaaccaguacacaaauguuuacagcaauuuuauuugugauagccaaaaaccagaauuagccugauuuccuucaauagguaaaaagcuacacacacacacacacacacacacacacacacacacacacacacaagguacauccauacuacagaauauuacucagcaauaaaaaggaauaaauugcugauacacacaagcuggauaaucucagcuaagucaaacaacaucaauccuaagagguaauauacugcauaauuccauuuauauaacauuuuuagaaugacaaaacuuuagaaaaggaagaaagauuagugguugccauggauuaggcacggaggaagggggcaaggggaugagggcauggaguguaggcaggagaugucugugguuauaaaaggacaacacaagggaucuuuguguuggcaaguucaguuccuuuuuuuuuuuuuuuuuuuuugaggcagagucucucucugucacccaggcuagagugcagcggcacgaucuuggcucacugcaagugauucuccugccucagucucccgaguagcugggauuacaggugcccgccaccacgccuggcuaauuuuuguauuuuuaguagagaugugguuucaccauguuggccaggcuggucucgaacuccugaccucaggugaucugccugccucgcccucccaaagugcugggauuacaggcaugagccacugggcccggcuguuaucuuaacuauggugguggauacacaaaccuucgcaggggauaaaauuauauagaacuuaacccgcacacacacaugcuaguacaagcaaaauuguggcaaucugaacgcuaugggagauuguaucaauauccugguuguaauacuauacuacaauuuugcaaaauguuaucaauggcggacacuggacaaagugaaaaggaacucugcauuguuucuuacaucuguacaugaaaacaucagugugacaguuaauauuaaaugucaacuugauuggauugaaggcuguaaagucuuguuucugggugugucagugagggcguugcuagagaagacuaacauuugagucaguggacugggagaggaagacccacccucaauaugggugggcaccauccacucagcugccagcgaggcuggaacaaaacaggaggaaaaaggugggauaggugacuugcugagucuuccagcuuucaucuuucuccccugcuggaugccuccugcccuugacaucagacgccagguucuuuggccuuuggacucucagacuuacaccagcgguuugccgagggcucuugggccuuuggccacagacugaaggcucuacaguguuggcuucccuacuuuugaggccuuuggacucggacugggccacuacuagcuuccuuccuccucagcuugcagguggccuauaaugggccuucaccuugugaacaugugagccaauucuccuuaacaaacgccccuucauacauacauauauccuauuaguucugucccucuggagaacccuaauacacucgauaaaaauuucaauuaaaauuuuuaaauauguuaaaauaaucuaaaaaggucuuuaggauagugaguuauaagguauuuugacauugucacuauaaugaaacacuucaaauauuugaaaacuuaugauuuacacauuagaaagaaugaaugaaugcauacacacaugcauguaugcacauaccuuuccuccuaaauccacgaaucaaacuuugcuuuacuuguaaagucucauucaauaauuugaaaauaugaaccauaguuaauacaucuccauuauaaaauguguuguucuuuuuuuaaaacaauggcuaguucauagguuggccuuuuuuaccauuuucuugauauugcaccauugacucugaccucugcuacaaaacuaacagacaaccuguucccaaaaccguagcugcaguuucacagaaguaggcauggacagcaacaagcuaaacuguagacuuaguuuacaguuuauccaaccguauccaacugggaauaucccacauagaccugucauacucaaaugauuucuacauucuuucuccauauuccuccuaacuucuauuugugucccaaugccacagccuugauacucugcuaguagcaguuacuaacuaaagcaagggaugcugcuaggagucagcacagccagcacauccccacccaaaagagaauuccucugaaaggcaggacauuaacaaggacccaaauauuuguuagccugagcuccacaacagaccagagaaaaagauguauguaaaaauaaggcuauauaaaaaugacgcaacacuguuuauuuuuucuaaucaauacauaaagacuaagucaagaaagaaggggagacagaacacucauggagugccuccuuuucauaggagaugucuugggaaaacggacguuuuacagaacccuaaaccuagugauaugguuuggcuguguccccacccaaaucuuaucuugaauuguagcucccacaauugccacgucaugggagggacccaaugggaggucacugaaucacaggggcgggucuuuccagugcuauucuggugauagugaauaagucucacgagaugugaugguuuuauaagggggagcuucacugcacaaguucucucuugcccaccaccacguaagucccuuugcuuuuccuucgucuuccaccaugauugugaggucuccccagccaugugcaacugugagccgauuaaacuucuuuccuuuaaaaauuacccaguuucagguaugucuuuauuagcgccacgagaacagacuaacacacauagcuacaauugcugaucacuggaaagggccccuagaagagaaugucacacagcacagacucucaaaaccaugacuuuuccaauugccuacaauccacugggcguguccugauuuggucauuucaucaaaaauaacauaacaguggguguuauguuauauccaacugcucaguaauguuaaccaacauucaaaauuaaugauuuuacauuaaaaaaacuaaaaaaaaaaaaaaaagggguugcacagaaccugggaaaugcuccauagccaccugacaaggagacugugcuuuauuuucaacauuaugaaccauaaaaaacuuaaguaaaaguagauuaaaauugccaaaaacauggaucucucaccucuucuggaagaguaauguucagcucuccaucagccuggccuacgauucuugaguggaaguaacugcugcaugccgccagcacggaccggugagcgcggaaccgcugucccuccacaaagauggugacaucgcacagcacaucuuucuuccgcuggucauuaaggcugaguaaaacauuggugcuaugcacagaagauucauaggcaaaaaccgaguucucacucagagacauucugcauaacaaauguugucgggaaguucaguggaaagcaugcuucuaauuaucaucaaccugcaaacacacaugcaagauuucacuuaaauaacaucuuguuaaaaaaugacagugucaaauacaggcuaagauacauacucauuaaaacaaaaaugaaaauaaaaaaccuccagaggaacaaccuagaggcauuuauucaauauacuucauuuaaaauagguucuugauagcaguuuuucuaacuaauuuuacggaaaagauucuuggugugagggaacuuuuugaaccaaggauuucauggcucucugaaagugagacauuacacacugaguaaccaccuacucugagcaaacagaugggagcagggaauuucugguggcaucccaauccuauuguuuugagacaguugagagagagagagaaggcaggagagacagccagagagguaagaaggaagguccccagaggucacaccuugggaugagacugauaguaaaacaggcaugugcuguuccacauucuccacaccccauuccucaacaucugauagauggcaagugaauuuaguguuuuauaacaagggacacuguucuacaaaagguaaaguuccuccagcaccaagaagaaaaugacugaaaugugucaagccagaucuugguaguaagucuuuuuauacaguaagauuuacuucacacuacaaauacaggcaaguaaaacuaccucauuaauuacaugcagaaacuagguuuucucaaaaugcuaagaaaaaguuauaauuuuauauuuuuuuaaaauacauacuaacauauaauagccuccaaauauuuuuugaucacauacacacuacugccaaaaacaagaauacccccaauacguguaugcuuaucuauauuuuucagacaugugcuacuauucugauauauauguucugagaaacacagaaguucaaaguaacagguuaaaagagaaguucuaauauugucuuccagcacccuacggccggaaaggaugauacugugaggagcuuauuggccuuuauccgugugaugccucacgguaucaucccugcgucauucacuucuguucuccugacacaugggaagccuucaaauggucagugaaugaguaaaugguacugcuuucagauuugcuacacacuccaaacaaaaaugaaaggagaaauaaggacuacugaaguucagucccaagguuaaggaucacaacuuauuuacugauucagcauaccacacgaaaucacugguaacuucaaaauuaaacacuagaacuaacuccaguuuuggcccauacgagaauauaaauuuauuuuuagcaauuagucuuaauacuucaguuaucaacacaagaaauuaguguuaagaauaacagggaaaaccaucaaucaaagaaguuauauaucuuuuguggguggcaccacacacagaccacugcccucuucuuucuucaagacuauacccugcccagagcacacugcccucccaaccaagccggacuccauggcugaccaccugcccuacuaugucccuguacccacgcucccagccuccuuauucuuuccugguaucuaggaugcacacccuucaaaacuauacuaaucuuacuucuauagcucaucauucuuuugaacacagcacugccagaaaacacuguagaaauacacagacuggugucauuauaaauuuacaaugugcagucgcaggcucuugguacuguucaccaguuuucugguaugucccugucuccuguucucuauaauagcuuuccaccuugccacuuuucuccuccugauaucagcaucucuccuagcaaaucaccaugacugggacccaaccucagaaaaaacaguccuccuaccaccuccaucagguucccucuucuguugaaaacaaucuguaauguauucucuuaaucccgugccaugccugcuucucugggauccaauaccuucucuuaagacccugucucauagauauccaaccucucccucuaugcuggcuccuucccauaauguuuguuaaugaacacguuuaagucucuccagagacuauccuaaagauguuaacuaucaauggcaagauuauuaagcuguaauucuucaccaggcacugagcuaagugcuagauagaguuucucucguuuaugccucaaaacagcccugugaugcuccucuaucaucccaauuuuacagauguggaaaccaaggcucaguaagaaguaucuuggccaacaucaaaagaccaauaagacaaagauggagaauugccaccagacauuuuuuuuaacuacuccaucauucugucuccaguuaguacuagcugaacgcacaguauggagauucacugcagcaauguggggagcuggauaugacuaaaagguuaugcuugagaauacagauauggaccgcagagagagcaagaaaaaaaaaauuggaccugagcuucagaaagagaaugacucugggccuuagaaacggaaaucuaaagguucuuugaaucucaaggugacuccacacaaauaauuccuacaccuucacccuagagcugcuaguagucaacuacauacaucuguggcccaccgcuucucauccugccaccagcuggcugacuacucaccucaaauuccagagaauuaauuauuggcucaacaucuguuuaggcaguuuucaguaacacaucaucucauggguugagagcuagcuuacagauuugcugccccugggcgagaugccaaccccaaguccugucagcugcagcugagagaaacuagaaauucagguaguaaaacagccauccaggaggaccccucuaagaaggaucagucucccuucaaguggauugagcacagcaugcaccaugacugaugcuguucauacaagaaaucugggacucacuccucauuccuuccucagcugggcaccucuauccaaucucuuacugaguccugcugccucugccucuuagcacugggguccaccucucuccaucggcaucagcacaacucuaauccaagccaucaucagcuccugccuggaaaaaugcuguuuaaccuucuauaacagcucacaagcucacaaauguacaaguuuacuuacauaaaauaaaguuucacauaucaauauuuaugcuuauuacuugcaaguagucugauacuuucuacuccauucaauuuuuuuuuuaaaucccaguugcgauccacucaauuucaagacccacauaggcgcaucaccuacgcaaugaaaaauacaggcccaguggcaaacaccacaggauuuagagucucagaauuuacaaucuuacacugucuggguucaaaucccagcucugccacuacuagcuauaugaccuuggccaaguugcuuaaccucacugucucgguucccucaucuauaaaguagagaaaacaccaccucgcugagauguucugaaguuuauaugagaugaugugggaaaaggguucacagcacagugcuuggucuacagcaacaaauaauauuagcuguuauuaguggugauaauauuaacaaaagccuuauaccccuaaagccccucuugacccccuccaauguauucucuuccuaacaaaaacccuacgucaucuuccaaauaaauggcauaucacuucaaaauccuuaacacguccucaaguccuauguaguuggguuuuccauccauuaauccagacuuaucucaagccauugccccccuuucuugcuauucucuagccucacugucucuuccuuccugcuccacaggccccaagcuccuacugauuucagggccuccacauacacuguggccacuaucuggacuucuacucuucagccagcuaaugccucaccuuuuaguucucuguuuaaaugucacaacuuugucugauuuguucccugccauaacccaagcauaccuguuggaccugguccaacacagguacaugcugcugaauuaguaauuucuuauuuuuaauacagaaacaaaacagagaucaucuagaucagcagucuccaacuuuuuggcaccagggauggguuucauggaagacaaauuuuccccacaugggcgggugcaaugguuuuaggaugaaacuguuucagaccaucaggcauuagagucucauaaggacugcgcaaccuauaucccuugcaugcacaguuuaccauaggguucacacuccugugagaaucuaaugcuacugcugaucugacaggagguggagcucaagcaguaaugcucacuggacagccacucaccuccugcugugcaacccggagguuggggaccccaaucuagaucuucuuccaaacacagccuagucaccuauuccaacauauguggaacaaugccacugagccaagcauucagagaaaauuucuuggacagcuuuuccagcgacuugagggacaaaaaagaggccagcucaucccucuggaagucaaagacauaccugcaacaacaggccaaaaaagagcaaggacuggcaacuauaaacauggccaauauauaugaccuacagucaugaaaacaccuugccuuuugcuuucauuagcaugaggcacuacagaaguguucugaaaaucauuucuccuaauccuggaaaccaucuaaguggucagcaauccauuuuuacccaauaacuacguaacaacuacaucagacaagaacggcaccuucauguccucuaacauccaucaugcaccuucuaacauuucucaaaccuaaaaacacuccagccuuccagaaucuaaaauucuauuaacuuaauacuaaauuuggacuccuguguuacgccugcauuuuucuauauucuuagaaauaauacuauuguuaucauucaaaauaaaaguuugcugaccuuaggaaauugccaauucauucacuagugcugauaaaggaugaauaagcauuuuaaagcuuccuacaccucaauuuggaaauaacuucugcucucugcugaaugcacauaauuuaaguuuugauauaguuacuacuugacauuuuugcuuucaaaaucauacagaaaacaagaugcuguggcuuuaucacauuauauaauuuauuuaaaggaaaaaaaacucuuaaaaaccuaaggugaacaugugaucauggaaccaggucuacaauauuucaucuaacagaaagucagaagauaacuuuguauaaaguuccaugugugaaaaagagcuagaauuuuaucuaccucaaguuucaauagauuauauguuguguuuuaauucucaauguagaaggguacaauaaauaacaccucaaauuuuuuuuuuuaaaaaaaggcuaccauacauuuuuuaucuucauugaaaaaugacaaauguucuuccuacaaguguuagcugggccauaugaugcauuaagugccaagaaaacacaaauaaaagacugucccuucaagaacauaaccuagauauguucaaaaugagaaugaugccucaaguaaaaaagauaauaaugaucauuauaaucaauuuacacaggaauguggacaucuggaaagguauuuauuugaaguaagucuucaaacaaaaacuacuuuccuggucaauuuucauuuaaccauaauauucaauuaaugagaacaauuauuucacaaauaguucuguuagucaagggugugugugugugugguuggccacaagugguggccaguggacaucaggaacggugcauaugggcaagugccagccuuuuuauaaaagcagugcccugaucugcagcccaguccauuccucaaaaccugccuucucgcauuucuaguggcuauuuggaauuuccaccuuugccuccucacuguuucugccuaacaucaccuucaucaaccugucaauuacuuucaccucacucaauuucagggcaggguauucaauggcucagaagacagggaaauuccucuacuaugacaucuuucugagcucccuaagcuaagaaagcuaaccucccuaagcccaagcuucaaacuccccuaagccagucaguuccuguuacaauacaccuaagauacccaaaguuugaguguucuucugaaauuaggugaaccuuacauucaauuuuucaaguggauggcaaagauccaacaguauccugugucuacacccuuaacucuccuuuaagggccuuuauuuuaaaaaugauuuuaaauuuaagguggagauucccauaagaaaaauucuaaagacauggcuuuucaucauucuguaauucugaaaaaaacuuaacaucagaaagucuguggaaacuuaauucaggacaguaauuuaagacaacauucuucccaagguccuaagacccgacucaccugccaggagagccuggaagaguaacuccaugaccaagcuguuauuuucuuuaaccguuuacaggcuuaaauaucauaacuguuuaaacaucuguauuugauagucacauuuucuaaaguuauuucucucagccuuaagaaaauccuuaaguauuauuggauaagguacacugacaaauauauuuugaaaaggcugaaugaaaaugggaaacaaaaaaaaaaguuugaacuaagguaaguagcagaggagcuuacagcaacaccaaaaaugaugacauuguuagaggaguaaauaaccugguaauuuacauuagaacuguuauauaacuaaagaugccaccgcuuuuuuaaaaauggggugggagggaaucacuacaauuuuugcagcucaugauuauuacaacaucaugugaggucccauacaggcaagauuuuucauuuacuuuuccuaacauuaaaaacuauauaguuaagucauggaccuuuuguuauaguugcugggucuaaauccauauucgaaauuaugaaacuaaaguuaagcuuagaggagaagacugugaacuguuagggaaguuuguuaaaguuauagacuccucaaagcucaaaaauaaaugguguuuuacuucccaaaugaugaaaaccaacuuugauaauuccaggucauaagcuuagaagagcuuggaaguaaauacuggaacaaagaugagaaggaacacaggaaauccaagcuccagaaccaaaacaagacuaacagauuccacuguuauaccuucuuacuacaaagagcuuaagaaacaaugaagucuuuuauuugcuuaacauauuuggcugcuacuugauucugaauaggauuguuaucugcuaugaaaaugugaacuaguaacuagaauugguccacaucaauaaagcuuuuuuacugaauacauauuuucugucaugccuuugucagucacuauuuguuaagcaacuuugagguaugauuuauauagaauaaaccauaucuauuuaaagcaugcaauacaaugaccuuuaacaacuguauaugugcauaaaaccaccaccaccccccccaaccaagacaaaauuuccaucaguccucaaaauuucacacgccccuuccuccaagggcauugacauguacccuucccugugccugauuccagguaaccaauaauuugcuuuaugucacuauggauuaaugugcauuuucuuuuuauacaaauagaaucacauauuauguacucuuacuucggguuucuuucauuacucagaaacauuacuucuuaauguuucugagguucauucauguuguugcauacaucagauguuccuuuguauuacaaaauaacacuccauuacauggauaugccacaauuuguuuauccauuugacucugauggacuacuauaauaaagauguacccuugcauuguucugaauuugggauuauuguaauaaagcuuugaugaacauuugcauggacauauauuucguguaucacuuuucuuggguaaacaccuaggaguagaagagcugggucauauuauaggcacaugccuaacuuuuuagaaauuacugaauaguuuuccaaagugacuguaucauuuuaucuugcuaccagcaguguaugacaauuccaauguauggcaauuaauuagaaugcucuacguaagacguguccaucccuuugaacgugaggacuguuuuguuucaucggcgguggcagauagcaugaaaaucaugcauggaccuuuuuuuuuuccuagcuugucagcuaucguuaguguuaguguauuuuauuuguggcccaagacaauucuuccaaugcagcccaaggaagccaaaagguuggacagccgugcucuacauucucauuaacccuugguacugucaucuuuuuaauccugccuauccugauauguauggugguaucucacugugguuuuacuuugcauuucuugauaaguaauggauguugagccuccuuacaugugcuuauuagccauuuguauaccuucuuuugugaaaugucuaauucuucugggcuuuuuaauucuuauuaaauucuacuguaagagcuaguugaauucugauuaggaaugcaaugaaaauauagaucuauuuggggagaaccaacaucuaaaaaacugaguccuccaguauaugaauauggcaucucucuucauuuacuuaggcauucuuuaucucagcauuauuaugaucuuuuuaguagagggcuugugaagcuuuugcuauauuccucagcauuuaauguuuauaguuacugcauacagaguugguuuuuuuaaacuucauuuucucuuuuguuuuguuuuguugcuauuguguaaaaacaaaauuaucguuuuaaauaucaaccgugaauucugcaaccuuaauuugcuuacuaguucggauagcuguuuguggauuccauaggauuuucuaugcacacaaucaugucaucugcaaacagagaccauuuuacuucuuucccgucuuuaugcuuauuucuuuuucuucccuuauugcaaugaccgaauagugagaguggugacaguggguauccucaucucauucccauauaaggaaaguguuaaguauuucgccacuaaauauguuaacuguagauuuucuaagaugagcaacuaaugggcagagaggcgggugcaauuguuacuaucccaguuaaggcucccacaagaaagaggggaggggaaaaaagcaaagaaugaaaauucccccaacacguaaaauuucccaacucagccucuuccacgguuugucuacaccacuuucuaaaugcuuacaucucagauaccccuaaaaucccacaaucaggggcugaagaugaggacagaguuguuaucagggagcacaaguaaggacauaaagacuucuccagaaacugccaaacagcagcuagcgcugcucuagggauaccuauggguggacagcacaaaagauuaauagcacuuuauaacuugaggacuccacugucaguuaagcaugucacuuuacaucucugugacuuuuuucaacuuuuagaauagacaaauaaugagagacuuaauuauaacuauagcauagaauguaaauauuauuaaccuugacaaaauaaagcaggcugggagacagaaucaggaagaaugggaaugguauuuccauacaacuuacaaugugcagagucaaaaggcacugccucagauuaaugagacaagaaaaagaaauagaaaaaaaguguuuagagcuggaguugcagaggugaucaacaguagaaguggaauaauaagauuacaaauacauguggggggauaguagaguaaacgaaaucaucacccacaguaauaccaagucaacagauaauaucuuagguugauaaauaaacugagguguaaacauuuuagacagagguauccaccaaaaaaauuaaauagcagaaaccaguaaacauugcacauaacucugaagcagaauuagggggugaggugcagcagauaagguuguucucuguacuuaaaaaaacaaacaaacaaaaaccaacaaguauuacuuugacuaaaaacacaaacuuaaaauguuuaaauagauaguaaacaaaaguagcaaaauuuaguuaaauguaaaugguugaucacuugguugcaaguauuaauauaacuuuuuaggagagucuucaaauagaaaaggcauuugauagagaauauucugaacuaaaaagauuuuaacaaaacuaagagaaggaaagaaaaaaauacagaaagacaucuuguuuggguacgauguuacacauacuauuuaauacuggugaauauuaauuuaaaucaguuaaaauuuuaaggguauccuccagaaaaaugagcuguugaacugccaaaucacuagagcacugguucucugccuuacagaaucugaugaaaucuauugaacuuccaccagaaaaccacgcacauaauaaaauuuugcauuugccuuuaauggaacugaugaauaauggauccucucuuaaaauuuauugacccuccuuauaccccucgaucuauaauucuuugcucuccuguacugaauuuccaaaaggaaccauuuauacucacacugucucuucccucucuucccaauuucauuugaggccacucaaacaagccuuuuccccuccacuccguggaaaccauuuagugaagcucaacagcuuccacaucaccaaauggcaaauguucagucuucuuacacagcaucucagcaauaguuaacaaguugaucauuccuuuccugaaaccuugucuucacuuggcuuccaggauaccacaauccucugguuucuucuuugcacacacucccuaggugaacccaucuggacccacaauggagacacgaucacuucacugacuugcugaacacucucauauucguauuugguccaaucuugacuucucucuugaauuucauacucauauagccaacugcauacucaaauuacuaccuguaugucuaauaggcaucaccaauucaguauguccagaaaucuugguugccacccucaucaccaucaccaugccuuguuaggauauauaauuaaaauauuagcaugguaagaucuagguaauuuuuguuucugcauucaaauucuuaaccauaaauacauacuacuuuauaaucagaaaaauguuggaauaaauaacuauaaacaaacaaaaaaugugccuugguuaaaaagauaguucacaauuauuuugauugucgugaaaucucccaaagauugccaauuacauuuucccccuuuagaguagauauuuccuacagucaucagcagauaauugguuugucacuacaugauaaguugaugggcucuaaaacuuagcagauucuucacaauaaauuacuaaagaauaaauuaaauuuuauagaaaucuaaaauaaaaagaagacuugguguuuaaaaaaaaugagagaacccugcuauaggaaaaugaggaggaaagacccaucaagucaagucuagccaugugaacaagggcaaaugugcaugugugaaacugaauagauagccuaaguagguagcucccacccuaucugucucacgaagcccucugaaaaauaugaaguguuaaacacacagaauuauuagggacaacaggaaaucaaguuuuagguuauuuuaaggcuaccagcagcuguggauaaucagauuaacgcucuacugauaucaucaaccaugugaucuucuguaaauuaccuggcuuaacacuuccuauaauaaaaauucaguuaagcuuaauaaggaucucaagauaaaaugaaaauauuaaaauugcacaagucugcccaaaauaauggcuaauuucacagaccuaaagaauuuccaauuaaaaaagcacauucauccaggaugacccgcuucuguuacagauaaggaaacuaaaggcuugagaagggcaauaauuuaaagacugaaaaagucucugcucccagguccaaauauuacauuucaauucauguuacaugacucaagugguaugugggggaagaauagguaaaacugaggagggauggaagaacaaggaguucaagaaauaccccaaguauccugugugugaugagaaggaacacuauuacacaaacagauuaaaugggcauuuguggaacaacaaauuuccccuuauuaaucaauauuuggugaaucuuucuuuuuuuuuuuuuuuugagacagagucucacucugucacccaggcuggagugcaguggcacaaucuuggcucacuguaacaccugucccccagguucaagcaauucucaugccucagccucccaaguagcugggauugcaggcgagcaucaccacgcccagauaauuuucauauuuuuaguagagacaggguuucaccauguuggccaggcuggucucgaacuccugaccucaggugaucugccugccucgcccucccauagugcugggauuacaggcaugagccaccacacccgggucuggugaauuaauuucuaaauaacacucacuagaucauauaaccaaucucaugcaucacugaaaggaaccugacacuaaacugugcucaacuuaaaucaucaaggucuauaguuauacauacuacauauggacaacuagaagaagagaacacuaggaaguauuucacuacaaguuacuuucaauacagaggauuaagcauccauguucuauuuucauaaugaaauaaagauucuucauaugccaucuuguuuuuuaaacuguaaaaauuacaaccauaauucauauucuuuaggaggcgaaagcccuaaaacuaguugauggccaaaaugacccccugcagguuuaagaguugacacacauaguaugcauaguaaccgaaaagauaaaauaaacaaaaaaagugcucuucaaauuccuaacuauacaccaacucacaauaaaauuugagucaaaaaggggggugaggguggagggaggugcuuaagaguauaaaaaagaauguuaacaauuuuaauuaaauaaaacagaaguuaccguagggcaaucaguauaucauaugaaucacaaauuugaaacuguuuuauucaaguagagauacuaaacugaaaugucuuauuuaaaaacaaccuaauccacuaaucccuaacagccaccguagggccacaguuucucaauauacauagcuaaaacuaaaaacauaagucuauuuuuuacuauuuaacuugggagucaaaauaaucauuucuaaaaugaggauuuccaagcuacagauuugcaccagugaucucaguaacuacuuuucauuauaucauaaccacaagauucagccaaauaaggaacaauuugcagccuauaaauaaagcugaaauauagcucaguuuaaauagcaucugaggaacuacugaguagggaaauacuauugcauuuaucugagacaaaaauuauauugguaguacaagucuuucuaaauucuauccaaaaaacuaauaccaguucagaagccuacucuggccauuuaucacagucuauuuguuacucucaaaaagaaacaaccauugagcaauucucauuuuguaaauuuacaacacucaaguguuuaggauuuacauuauuugucugccuuucacagcacagaaagcacccagaccugcgauugagaaggaacaagaaugaaauacaaaagugcuuuuacacagugaucauacuuguaacaacauacacaggugucccccuuaucuacaggggauacauuccaagaaccccaguggauaccugaaacugcagauaguaacaaacccuauauauauacuaugcuuuuucaucaagcacaguaagagauuaacaauaauaaaauacaacaauuauaaccauauacuguaauaaaaguuaugugaaugugauguuugucucuuucucaaaauaucuauuguauuuaauauuuuuggacuucaucugaccacagguaacaaacugcugaaaguaaaacaguggguggggauccuacuguauuucaaaauugcuaagagaguagauuuaaagguucucaccacacacacacacacacacaaagguaagugagguaauggacauguuaauuagcuugauuuaaucuuucuacaauguacacauacagcaaaacagaaaaguuaggaguacuacaagaauacuguauaaacuuaagguggcauuaauuuuaaagucugaaaagaaugacgaauaagcuaacuacgggacagcuuucccuucgaggaggggaaugaguguguagaaaagggaagauguuccuguuuguacuccugauucaagaauuugcauucuaaagaauccugacccaucuagccaaugaacuaacaauucuaucugagccaggcuggccucagcacucagugcaagccauagagaccacaggugggugugcacuauggacugagggacagaguaguccucuuaguauacacauaaucagaaacuacaagauauaauuauauguucuccucucccugaaaggaauaagacaauggcagggaacuuuugaaauguuuaaagcauugaaaaaaaaaauuauuucuucuauauauauuuauugacaaaauuggcauuuucaauuuuuaaauaauuuuuaaauaaaccauugauuugauuugauuguaaaagugcuacuugaucauagaaggaaauggcauauaagaggaaaaaaagucaccuaaaauuccaaauccaaaggcaagcacauuuucuuuuucuccuccgaaguuuguaucuaaguguagugguggcagaacuaguagacaaggaugucacuguuaacugcacaacaccauucacccccucacuuucuaaccaaacccugacugugcucacguaucuacucucaacccgaggccaucaacuuccaaggaaguagaccccagccacaaccuaagaugaaucacgauccauuuaugccaaucacagcgguacuauuccccuugaccuugacucauuuaggcacuggcuugugugcaaugcugaccuaugaagagaggagagagggacaagguagcaucugcuaugaggcuuuagggaaaaauuuuucucacugauagcaacaaccuaggaaaaaaaaaaaaaaagugugucuucuuccaggaaacuuaagucauauuuucuugugacacuugaacuuguggcagccaucuugcaaccauaagaggaacuugccaaggacaaaacaaggacguugccugcaucuucaaccuuuuuccauugacuggauuuuuaaauacacacacacacacacacacacacacacacacacacacacacucuuccugacccaacuucucccuacuaaaaucuauuucucucuccucuuauucacagcuaagcuucucaaauugaguugauacaaguuguuuccuccacuaaccuaugcauucaucacuaaacaucccuaaggcuuucuugauuucccaaaacuuaggcuuuuaauagucugugguuccacagcacauuuuacauguugcuacuauagcaugcuaugggaauaguuugccugucuauuagacuguaacuucugaaaaguucauuauugccaauaucuggaaaaguuccuggcuuauaaaagccuaaacauuuguuucauaaguuaaauguaaaccaaaugccuaacauguaggaaugccacaaauauugacaugaauuuagcaacccuacuguccacauacacugaaaguuaaguaugcguucaugugaguugggggagaacagcagcaggaacagggagaaaagagaacacagugccuuagccuugaaacuuaaaaacacaguuuuuccucacucuucagagauuagagagcuguuccaagcuaauucaacaaaaaagaagaggcuguuuccacacuggcaucugagaagcagugguaggauagcucucuagaaucucagcuccucugcuauuugugaccacuguugccaaccugcucaaagaagaaaagguggcccagccuuucuggggucuggaaaaagacaaacuaguccaaagacaggaggcccucagagacaaaauauacuuuuuagaaaucuaaaaaaaaauaccuauaguuugaauagcacuugugacagucuuuuaccacaaagagacaacgaaguagggaaaguuaaucguaauuacaugcucauccccaagcagcauuuccuuugacuucucuggaugacaacugaaacugaaggcaugccagcaaagaauccgagugagcugggcaaaaugcucucuacuucaacagucuuuugcuaaugugaaagaaaaaaaaaaaaacaagauuacaaaagccaaaagcuuuuuuuuuucuuaccucuuuuaaccugaauuaugacucuuaccuaggggaguacccaaggccaggcugagauacaccucagaaaaacaguugauaaagagacaucagguacacuggaaauugaagaggccugggccaagaucagauaaccacuguacauuuuuuaaaauaauauuuaaauauaaaauacacauuaaugaaauuacaaccuaauaaauuuauucaaucuuuuauagccacauauuuuauaacaaaacugucugauggaugagcaacugcacuaauuuagcugacuucugaaagacgcuggcacacuuuagaaaaugaauaaggcaauaagcaugugaagauaucaguaaagaggaaguuggguggauaggucgcccuauuucuucaauaggacccucaggaguucaccuccuuaggacaaaaacaccucccuaggguccuggaggcagacaaaucaauaaaaagaagagauaacuggaaaaaagguguguagggggagggagggacauuucccuuacuauacuauuuacucuacagccuuagagguaggcuauuacuaauguccaggcuacaaaggaauugaaaaccuuuuuuaguguaauuccacuuuaaugagggauggggaaguagagugcaacuguccacugacugaucugaucuaaaaaaaugauaaauuuaaaaagugaaaaaaacuuuaccugaaagaaacugggaauaauuaggggccaggcacaguggcucacgccuguaaucucagcacuuugggaagccaaggcggguggauugcuugaggucaggaguucgagaccagccuggccaacauggugaaacccaucucuacuaaaacacaaaaauuagcugggcaugguggggggugccccauaauuccagcuacuacggaggcugaggcagaagaauugcuugaacccaagaggcggagguugcagugacccgagaucgcgccacugcacuccagccugagcgacagagugauacuccaucucaaaaaaaaaaaaaagaaaaaaaaaacugggaauaacuaguuuauuacaaaaauauuaguuugaacgaugacuuuccuaaggcacugcaaaaaguguuuacauuuauuuuucaaauaacaugaucugcacaaaauuucagcugcauuaauguaacauuuucuaaauugugcccguacugagaaggaaccagcugccagccaauuucacugcaugcccacuguguuucuacacuggucauuaacaaccaagauucuggcuaccacuauuucuucuuccucacguuugcuucagggcaguuuuuuauuauccuaugaauauuugaauauuuucuaaccugucccugauccuaaauaaaacaaagaaccuguucuagaggagugauauucaaaguauuagacauauaagacauuuaacaucuagaaaaccaaauuauauuuugcucaauucaauucuaauccaauuauggguaaaaauaagucacaagacaaguuuuaugucuaucuuaggagaugaacuagaauuacuuaauuccagcugccuucucaauaaucacaccaaugauaaaaacagaaaguagaaagcuaaauaaucaaaagaauuucaacucagugcacacuuacaagguaccacacacgauguucucuccuucaaucuguuaaacauucccaaguuucaaaaucacagaacuagaaugaacgcauaucauaccacccaguucagcaaccaacaguuuauuaaagaaacacagccaaggcacauucagagugccauaggagauaaaacagaaagacacagauucucaccaucaggaaacuuacaaucuggcugaaagaauggucaaaauaacacaaccuuucugaauuacuaacagguacaaaaagcuauacgauaaauauguccauuguauucauauccauuucauggauaauuuuucuguauuaguacaggcauaucaucuaaagaaaacauaauacuuagaagaaacuaauuagcuuacaaauuuacauucuaaauguuuccaacaaacuggauagggcccaggaauauguacugagaaacuaguucuguucugguauuaacaagaagggagggguggacagguuacuaaagcugccaggccacaaugucaacuacaacguggaaaagacuagccaaagaauggcaaguguuuuuauuucguaaaagccaguuucaauuaacugguuagugacuaccucaagcacuccgcugagacuguuaagauuccuuuaaguaaaaagcuauguccuguguucguugcccucagaaguuggauguauguuugagauggugcuacugacuuaacauaagaguguuccccggguuguuuuuccagucucacuugugaucaaugccggcaauucagcucucaacagcuauaaaacacuacuguguaacuaaguacuucccugauucugaacaacagauaauaacaccuaacacuugauguuucuuauaaagcuggcacuguucuaaccacuuaccccguauuaacgcauauaauccucacaacaaccucucugauacagauucuacuaucaccaccccuguuuuacagaggaaacaaugaggcacuaguuaccagguagaagagcuugcccaaggcuuuaaagugggugacacaaccagaaccugaccuuaagcagucuggcuccagaacuacuuuuuaaccauucugcuuacugcuucuuugucaacuguacagugaucaaacccagacuucaguuauguuagugcacuguguaagccaggugccugggcuucaggagaguguaagucaauguuuuagcugcaguccugaaauguuuacucccuccaaggggcacggauucuggcgaauugcacucaaauuacccauaccuuggccaucgguacauuaccucauuugacauauauuuuaaaucaaaacaaucucaaaaaucaucguuccaccacauaaaauaaacccucugucuagaaugcucagggaaugcagguuuuaggguuaagacaauucucucauuaacagaacauuagucagaaaauuagaagagagguggugauuccuaaaacguaagucauggagagaucagcacuaugaagagaaaaucugacaagugguaauuuuaacgggcuuugcaacuguuauucugagcaucaccucucacaguacagggguguagaaggcacauggcacaugagauuuaacugaaugguaaauacuaaccacccucaccgccgccacccgcccccagcacuaguaggagguugauauucugaauaaaugccacuucccaagggauuuacugaauaugucgucuuauuaaucuuaagagaacauaagcuuggcaaaaaacaaacaaaaaaaaacagacuucaaggaguaacaguacaaacuaauuuuuacauaugcuauacauauuacacuccaauguguagauuaucuucaaguauuuccacugcacccuuuuacacaucacugcacuucagaucacauacauuaaaccaaccgcugggcuugucuccaaauucaaaauacagguuaucaaaugaaauucuguauuuuuuguauuuccauccccaguaucaacaauguaacaagaaauuuacacucaagcuucuaaaguaaaacauacagacaauagaacuaccuauaaaauaaaacuuaaauggaauauuaacagucugaaagaacucuuaggaggaaaccguaaguuaaaagaaaaagcauuccgguuguugaaagaauguuacugacagugguuaacaggcuauguucccccagcaacaaagggguggaggacaugcacgcgcauuauauaauaugaauacacgauuguuagucugcaucuuuaagcuuaaugucuuucuuauauuaaaguuuuuaaaaguuuuaauauauuccuuccaaaugaaccuccuugcaccccaccuuggaggcccuaauacuuacaaaauucaugauuucuaaucuccucuagucccagacuuaaaggaacaaaauaaaucguuuuuccuaauacagaauauuuuaaaugaacuaccauuaauaggaaucaucauuuuuuucaccaaagggccaaauucccagcucuacauuucccauuccuaaacuuuguuugcaaugaggacucauauaaauauuuggguugugugcuccuuuuuaaagcaagaagcaaugacaccagguguaaaggcaguggugucauauaaucaagacaaugagacagguauuuacgguuggcuauuuauuaaacagcucuuucgagacuuaacccaaugagaccuauuaauuccacccauauggugcuuacccuccucugacuccugaaacuucuuguguaugcaugaaaagccaagggccaugagaaacagagcaagucccuucuguguacucauaaccaaauuuuuaugacgcacaaauuaagcucacugcuugaaacuuauagaccacguaacagaaaccacaaaaaggaaacuaaguccaguaagaguaguaaauauuuuuguuacaauauuuuuuauuggguuaccccuagcugcaaauuucuuccccaguuuuagcucucuccagcgcaaauuuauucucagacagcaggucacgaggcuccgucuuuaaacccgccucagugcuauuggccacugccuaagagugcucuuccacuucacccacugauaaccuguaucaaaacaaccccagcuggguccccuucagccuucugaagcaaccucucuagagcgcucuuuggccuuuuauaguggaggcaugugaugagaguauuugcaccagcuguuucuaauuaccucucaagcuggggcgaaugacucagcaacccaacuuuuuagagagucauccuaccuuguuaaccaaccaacauaccgaacaacaguaaaccacuugacagaaacauagguuaaacaacaauacaagaaucacuacgccaaagucacccuacuccaagcugacucaccgggagccuuucuucccuaagcuucuucaagauguccaaaggcagaaguggcaagugccuucaagcccagcccagcccuugcaccacuacccaaagaccaggaagaagcaagccgaccucuucccauuucucugcuugacuaugugaagcgcucaagugcucugccacuaacacaucugggauuuccacccuuuauccuucugaacugcauucaaugcagacccucugauguaaaggguguucaaauacaugaucaaauucccauagcaucauccauggguaacagucccuaccccuacacaauucuccaaaaagcaaagcauccuacaaaacauucuuuguuccuccaagcaugacauuguagcucguuuuccucauacacguucuuucacaauuacuacuacacuuuaccuggaaucagcacaaguuuaacgcagaagccucacuccauaaaagcauuccgcacaauucuacucaaugacaugaaacugccguguaagaaugagaaagcaacggcacucguguuacauuacacgagcacaaagcuggugucuccagaaucaacgcccacucucaccauauugugcgaggcuuaauuacaacgcgugggcaaaacuccaacaaagggaguccugggcucuccgguccccaaaaccagucuucgcuaaauccagcucagcacgguggccuucucuccccagccacaaacucggcuuuucuuacgcgauuccacgcgcgacagccaccgggcugaguagacgcgaggcugggcaugcggugggaggcggcggaggacaauacggggccccagccgcgagggcggugcugaugugucacagcccgggcgggccgcgggcgaggggccgggcuggcgcccgagggcagggagggggguggggcagggaccccgcggcccccagcccccgcccgccccggguaaaguacggcgcgcgcggguaaacaacagcuccggcagugcaggggguucggccgccgacgggacgccccuuccggcgucgcggccacuuccaggaucccggccgccggcgccccccgcgggccccgauacgugccccccgcgccccgcccagcccagaaagagccgcccccggcccgcccgcgccuucacuggaccuguccgccggccuccccucacaggcccgcggcccugaccgcgccaacccucccggagaagggccggcgggacggccgagccacucaccagagcugaggcgcggcgcggcccgacugacugaagcgagagcgcccggcgggcggcgagggcagcggucaggugacucacuccuuccgcgcggccagccgcccccucccuucugcgccgcucugcu

SEQ ID NO: 18159 - RNA, 1197 nt, Homo sapiens
acauuuuagaauagguauauguuuuauuguuauagaauaucaauuucaacuuuagauucuuaucagauaauacaugauggucaaaaaguaauaaguaguccaucauuguacacuugcuaaugauuauggguauacuugaauuuagaauaugaaaauuggagcagcgauuggguccaacaauagucaaugcauuuaauacaccugaagucagaauguccaaguaagucauuuucauuccuaccaccaguaacaaauugaaacuuucguaucaauguaaaucuagacauaaagcaaguucuccugccucacauacuuacaguuucuagcaggacuuuauaaaaaacauugaccauaguccauacuuggagccaaaaggaggcauuagacauaacugguggaggucuuacuaagcauugucguauuucuucgcuuaucuguguguggcacacgguagccaggcacuggauaucuguacccuugcuucuuucuguugcagcagcaaaauccacaaagcagacccccuccaaugaagaggacagcagcgcuugcccagccaaggaaaagugcugcucccagcucucguuucugaccuauguggauggcuggguuguagaaaucucugaugauuauauuggcuguccagcucaccggaaucagaacgaagaugcccgucaggaugaagaggacuccugaaguucccagaagguaugcuuuggcccucucguuagagccugugcacuggaccugcuucaugccacagaugccaauaagcagggcgaucaaggagagagcaacagccacacacaugagggcccgggcuguuuccagggcaggcgggagagccaacaaggagcuauagaacuugcauugcaaccggacccuggcuugucggaugcaauucauccagagcccuucccagagccucucaaagacaauaauguugcugccaacaaaagcugauacucuccacugaggcagaaggguuguggcaagaguccccaccaugccaaggaacccaagaaccagcccagcaauuugcaagggauaaaaugccauugccuuuacuuugaagacugguucaauucggagugguagaagaugcucaagauguagaacguggaagccuuuugagucuagagaagucuuugaugauguucuccuuggcugcugcccauaacguuuuaguccaaaucagua

SEQ ID NO: 18160 - RNA, 518 nt, Homo sapiens
agaacaaccuagaguaguuauacaugaauaugauuucaggugacggacuccgaaaguaaaaagacaacaaauauucacagaagcagcuuaaaucuauuuuaaagauuuaacauagcuaaauaucucuccauugaugcugaaggcaauagaauggauuuuuggaaugaaagcacgggacaggaccaaacacauuuggagguuucuccucugcuuccaauuucagcaauucauuuaauaaaagccagagaauccguauccuccauuguacgaugggcggcagcagccauauccauagccuccaaagccagagccauauccguagccuccaaagccagagccauauccguagcuuccaaagccagagccauauccguagccuccauagccacagccagaaccccgucugcagaagcugccacauccacagccauagccauagcccaggccaccgaagccuccacagcuguagcccaggccuccguaguagcugccguagugacucauggugucaggagugg

SEQ ID NO: 18161 - RNA, 723 nt, Homo sapiens
uuuaugcugaaggaaauagauuuauuaagagacugacagaaaauccccuuacuacccacacccaauuuguaauacauuaauguugauguagaagcuaauaauacaugagcagagcaaccaugggaggcaaacuacuuuuucacuguuaaaauucaaguaugaccaaaaaaaugcaucuugcuuccuuugucuguagaugaguaucaguucagcaccugaguccugggugacuuguccaacagcaucaaagacaaagaccacagcaagaagucagcaagaagauggaagauguaucacccaagcacaugggaagguaggaagacagucauugcucuucagguuguucugugcagagaauuaauugagaguccuguagucacuggagccauugguccaucaguaggugcuguagccaaagccagagccagagccccauggccuauagaagcuaccaccauagcagccgcccagguuguugauguugcuaccaccaaagcuguagcccagggagcuguagccauugcauccacagccauaguucaggggagagcccagaggcacaacacaguucaaggggguggcucugaaggucccauggaaguuggucccauagaauaggguauccugggaaguagcuuccacagcagaaguaacgagucaugguggcagcaauugagaaggauuuagauggauugugaaggguaaguuacccaaguguuaaug

SEQ ID NO: 18162 - RNA, 963 nt, Homo sapiens
augccuuuuauuuauuuauuuuuaaagauaucagcuauaaagaccuaguuauucauugucacccccuacgucuggaacaauuaacucaucugccugcagaauuuccuggaguucaggauaagcugaugaggcugaggaugcuggguucucagcauggcagcgguagaaucucaaucgcgaauuugccaauucguuaauuaucuuagagaaauaauaagcucuuugaagugcuccuuauuucuuuuauauuucuugaacauuccaaaucgugugcucucacggagggcggcugaagguuuccugagcagcucugcugggucugugcggguccaggguugagcaggaccugguccaggagccgucaggaguggcugugccuuaugcguaucccgcugcuacagagcccuggcuggacccagggcucuucuccacgugacccuggguuccuucuccacgugacgcuugucuucuuugcucucucuuucugcucccaaggauguuaaugcaggcgagggcagugaguuugcagacagugggauugaaggggccacuaccgacacggaccuccuguccaggcgaucuaaugccaccaacuccagcuacucacccaccacaggccgggccuuugugggcagcgacagcggcagcagcuccaccggggaugcggcucgucaggggguguacgagaacuuccggcgggagcuggagaugagcaccaccaacagcgagagccuggaggaggccggcucggcgcacagcgaugagcagagcagcggcacccugagcucuccgggccagucggacauccugcugaccgccgcacagggcacggugcgcaaggccggcgcccuggccgucaagaacuuccuggugcacaagaagaacaagaagguggagucagccacccggaggaaguggaagcacuacugggugucccugaaaggugagagcgggagggccccg

SEQ ID NO: 18163 - RNA, 5379 nt, Homo sapiens
uaauccagaauuaaacaaccaccaugucgagcaaaaaggcaaagaccaagaccaccaagaagcgcccucagcgugcaacauccaauguguuugccauguuugaccagucacagauucaggaguucaaagaggccuucaacaugauugaucagaacagagauggcuucaucgacaaggaagauuugcaugauaugcuugcuucucuagguagacuuuauauucuuuauuuguauuuucccuaaaauaauaauuugucucuuuaugaaucuuuuuuuugugcgauguacaaauauuucucuccuugucucaaaaggccucuggagagauuucugggugugggaggugcuauuuuggggcuuggccagucauauggagauaagccuacaagguuggggaccuggcagaugcugugcccggguaggcuaauguuccuguuagcuaaauuuuuuaggucucuagauggaaagccagggcauggcuaggcagcaaaauaccagaguuucaaacaaguguagcuaaauaauauacuuaauaaagguugaguacagguuauaaacaaggagugacaguaagugaugaugguuaucucugggaaggaggggcagugcgacuggaaaagggaacacagugaagaagacuuucacaauauuuuguaugauuuuuuuaauaacuaaaauguaaagauacaggauuuaaagcacacauaaacagccauuuguauguugguauauggguguuaauauuccuuguaugauuuuguuauuguuucuuaacaugcauccuacauguucuggccagagucagcaguuaauuuacaguugggagucaaggaacugcaggcaaaggagaccuugauaggccaaagcggagggggugaggcaggcugggagugggucagggauggccuacagugagacuuugcgcucuguccuccugcuuggcugacuggccaaaaaggcaaagaaagagguggggguuuuuuuuuucucucuuuuaaugccuacaaaaugaucagcuagcuuuuauucuucuaacuuuugauuuugauuauuucuccuaacacauugaaaguaaaguuuagguguguacuuauuccuauccaacauaugauuuugaaaacuuuuaagccuacaaaaaguggaaagaacauuauagugaacaccuauacaucuuuagcuauauucacugauuguuaacauuuuguaacuuuucuuuaucuagggugagaguagaaucaaagauuuuuaucugauuuguugacuuguaguuagauuauaaccuaguguuucucacauucagaaugucugaguauguucuugggcaagucaguacugaagaaggccucugaggaaaauugaggaauguagccaucuuccaaagauugaacucucaagucuauacucugcuuauaauagaugcucaauagauauuuguugaacgaacaagucaugguagagucagagguugucuuugagaccuucuguuuugcagaaacccauccuuuuaaagauacguguuaaaagaacaauuucagccuaauuaaauuuaauggaguuuaauugagcaaugaacaauuugcgaaucagguaaccccagaaucacagcagauucacagagacuccagugcagccacgugguagaagaagauuuauagacaaaaaaagggaaaugacguacaggaauuggaagugagguauggaauggcuugauugauuacagcucggcauaugccuuauuugaacaugguuugaacacucagcaguguaugaaugguugaaguauggcugcugagauuggccaaggcuuagcaguuguuacaggcucauacuccuaaguuagguuuucagucuugucugacuauuaagcuagguuauaauucauucacaaggacucaacuguagaaguacggagucuuucucaggccauauuuaguuugcuuuaacauauguauuuaccuuuuaggggaaccuucauacauuauugguaggaauguaaauaaguacagccacugugaaggacauuauggagguuccucagagaacuaaaaauaggagcucucccauaugauccagcaaucccacugcuagguauauacccccaaaaaaggaaaucaguaguaucauugaagagguaucugcacucccauguuuauuccagcacuauucacagcagccaugauuugaaaacaccguaaguguccgucaccagaugaacggauuuuaaaaaugugguacuuauguacaauggaauacuguucgaccauaaaaaaugagauccugucauugcagcaacauggauggaauggaagacauuauguuaagugaaauaagccaggcacagaaagacaaacuucacauguucucacacacuugugggagcuaaaaguuaaaauaauugaacucauggagauggaaaguagaaggaugguuaucagagacugggaagggcagggagaagagugggaacuguuaauagauacaaaaguauagauagaaugaauaagaucuaguauuggauagaauaacaaggugacugcagucagcaguaauuuguuguacauuuuaaaauaacucaguauaguuggaauguugguaacacaaagaaaugauaaaugcuugaagggauggcuaugccauuuaccuugaugugauuauuuugcauuauaugccuguaucaaaguaucucauguaccccauaaauauauacaccucuuguguacccaaagcaauuuaaauaaauaugaauuuuuaaaagauacguauuuaccuuucaaaucaacagauuacauuggaugucuugagcggguccauaagugcuuagccuaaaccaauucauuuuaaaucccuguaacuuuuuguacccuagcguucucuucacaccuuuugguuacaguuuuucuuccccccaaaaaaugcugcaagugaguuggguuaaaucuggagguagaaaaguagaucuuuuuagcuacuuuaacuuauucagugaaucuugaguuuaauuuugggcuaauuuugauauuggaacauugaguaaguguaaucagguaggacugcaaugcagugaaauagaugccaacaugauguuuacauuucacccaaauucccagaauuaaaacuuacauaugaacuauaaugguagcuuugauugucauucuagcuuugacuuaguuggguauaauuuugagaugguuccuuagauaugaauaucugacuaauagauguucuuuucauguaaaaucauauaaacuuaauguuggaagauaccuuugagauaccaacuuuaaccagucaauguuagacuuuuuuaaaaaaagaaguaaauucuacauaaggcagcacugaacgaaggaucuggaauacuggguuugaaugccaguucugccacuuccuccuauaucacacaaccagugguagaacugggauucaaacccaguauuccagauccuugguucagugcugcuuuucccacaccacggggccucaaaaacacucccaccaugucuggccauuccagggagauuucuuucagcuccuagggaaaggucaggggaguucccucaccacugcacuaaaagaaguguucacacuuggaauggagauuaagauuucccauuacaaacaauaccaaagaagaccacaguucaaugacauguguaaacaguguuugaagauaucuaacauuguucaaaauaagcugccaauucaaaaccaugcuaauaguuuaaacuuaaauggccaacuuauaaauacaacuuugaagcauaucaacuuaugggcaucuguaccacaacuggaagugugaauauuuagauuuuuuuguaugacugguauugaacugacuccccgauggaccauugauguuaucaacauucaggauguaggccgggcgcggugaugcacgccugcaaucccaucacuuugggaggccaaggcagguggaucacuugagcucaggaguucaagaccagccugggcaacauagugaaacccagucuuuacaaaaaacaaaaaauuagcagggcaugguggcacaugccuauaguccaaaaaaaaaaaaaaaaaaaaauuaagauguaauaauguggcacugccuggcuucagguuuuuguuuuguuuuuaaugaaaaauaaugaacagaaaguucacauaaacgaauaaauaaccuucaauauaagccuggaauacauuuuuauaaugauguauccaauauuuuuuaaguugucaaaaauaaucuuuuuaaaauguucuuaaaguuaauugaaaaauuaguuucaaaugauguacauuuuaaaaauauguuggggagcauaauaauagugaaauaacuauugaaauuaaauguuuuugucuuuaaauguuaaaauguguauucuuacagggaagaaucccacugaugcauaccuugaugccaugaugaaugaggccccagggcccaucaauuucaccauguuccugaccauguuuggugagaaguuaaauggcacagauccugaagaugucaucagaaacgccuuugcuugcuuugaugaagaagcaacaggugagugcuauuuguuuaugcccagccucauuccacacuauauaaaguacuucugugaaauagaagggguuuucuuuuuuuaccuuuagaaaauauuugcuuaagaauaauuuuguaagcauaugaucuguuucugagcuuuuaaaugauuugaucuaauauuaacacagaacucuaagaauaauuggaaaacauaaugauauaguucauauagccuuaguucacuaacuuacuuuguuuauagauauggauauucugaaauauuuuauacgauugacaagcuuuaggaaugaaccaucaaagugccaggaaguauugaugacugcuuucuucuuucuauugucuuccaggcaccauucaggaagauuaccuaagagagcugcugacaaccaugggggaucgguuuacagaugaggaaguggaugagcuguacagagaagcaccuauugacaaaaaggggaauuucaauuacaucgaguucacacgcauccugaaacauggagccaaagacaaagaugacugaaagaacuuuagcuaaaaucuuccaguuacauugucuuacucucuuuuacuucucagacacuucccccacccucauagaaccuguugcaugcaacuuaguuucacagcuuugccucuucuuuuugauguauuuauuccagaccuuucugccacuuagcacuuguauaaucagacuggaaauggggaugaggguguaaauuguauugaaaaagaucgcgaauaaaaaucaacaaaugugaaagcccagaaaaauauauucguauuucugguuuugcuggauuuuuacauuuuuauauaauaaaaauguuauuuugaaau

SEQ ID NO: 18164 - RNA, 3269 nt, Homo sapiens
agagcuaccaugcuacccauucuucucaaacugauguuuuagaagcacuucaaauccuuaaagcucuugccuauaauuauagcuccucuauaauucauggauuccauguuuuuucagugccccaaaugugccaaacacugugcuaggacugggauccagcagggaagauagauaagauuccggcuuccauggaaggcugcagugcaacaggcaacuucagccccgugucauacaggccugugaggggagcacaggggguggaagcacuggaaguggaaauguggcaucuaaccuugacaggguacaggaggcuucccggggucuguaagagcaguaguucagcaaugccuacugcauggaugccuuggcggccaagcugggaucugaagaaggguaggaauuagugaagugaagggaggggcuggggguugacguguucuggggaaagaaaagagacccagaguugggagcgcaaaaugagauuuuucugcuuagaaggaucauucugcaaaguggagaacagauuucagggggcaaggccugggacagaaggacgaugggagcccuuuacugagguccaggugagacaggaugggaggaauggguuugggagguuaacaaaaauggaugggagaggguuaagaagaaggaggaaucagggaugacuuucaauuuuccgguuuagguuuaucuuccacagcgugggcaauucuuuuuguuuucaacaagaucaccccgggagcgcagaccuucccagcucccggggcgaacacguguguauggaaucaagguguaaggaacauacaucccagccuuuguuguaaauggggaagucuagagcucuucaggagaggaggaagcuccggccucguguagggaaagguuucgcucgaggcuguaccgccagcgucuccguuuccgcguucuccacaaccuugcgagagguaaacugcaacuguaguuuccggauuuuacagaggagcccaggaggucugcgugaacccugcccgagucacuuacucugcccagcagguaagcguaaggcccaaaccccacgcuguuauuccaaguucgcuugcugggcacgguaagugaacccugggaguccuggacucuggugaaggccaccaugcccuaccuggaggcugcucagggucuaacauccucuagcauccacgggaagggauugcguuaggauuuuuuucucucguaaaaaaguuccugucucccccuagagccaggcacacgccucccgcgccagaccacuugucccaggcacaacauuuuuugacucuucgccucccccguuucgaucccccuuccucuccgccuuagguggcaggaaaauccuuuaccuccgaccaaucccaccgaugccgagccgcgcgcgcgcgccaacuagagcuccgucugugcacgccauuggccaccuccaccuaugcgagaugacaggcagcuucgcggaccuaucgccgagggaggcagaggccuccggcccucccaaagcugcuuuguuaggggcucccuggucgucccccggcccgccgcgccuccgcugccugcgggcgaucuccccgggccgcgcugacggagccucgcaggaaggcaucucuggagcgcgcgccgcccgcgccccuccagccgcgcgcuccgagccuggcugcggcgcggauacccggcgugcgcccauagucgcucuacagcccaacuccgaacgccccgcuccugcauccaccgccucggauuggcuggccggaggcggagcgauugucaggcggcccaaucggagcucgguuucccacgggcucccgcggcccggcccccgaggccgcaggcggaggggcccugacagcuccgauuggcagaccacgagcggguucgagcgcggccggcagagcagcgccgccgccgucgggcgcgcagcucugcagcuccgcggacgccuuggcgcccgcagccccaggggcacggcugccccgcaucgugcccggccccgucgcggagaucccggacgaccgucgcgggugaguaccgcgggccuggggugcgcgggcguccggccggagccgccccgggagacggcggcgaggaugcccggagccucggugcccgugccgggcacguucugacccccgucucccgcacacuggggcucccggcggguccuagcuccccccgaucgggcuuuccacguauuguuuucguguucacacacuugggagguggggagaugcggggaggagaggcaggaggaggcaucccucgcgcgaaggagggagacgagaccgugcagcccaggugccuucgcuggauggaaaugacagcguccggacgucggcauucgguccucucggcagcaggaggucagcgcugaccugcggcggccgcggcacuuuguauuuuaucggcugauuuuugucaacuucggggagggcgugcuugugcauccuugugucuauguuugcgucucggucccugacuuaggcaccuccgggccuggcuuuucggcgacgcguccugggcgcucaccuuggcgauccgugccgcccucggggccgggcucaccgggcggaaagcccgggggccggcgcacggagcuggggacccgcgacgaacccccggaggggggcauuaaaagcggaauccugcgggugcgcagacaaugccucauccgggcggucgggucccggggacugugcccuggguccccgcgcccuaucccguccccgccucgcccucucaccagcucugccgcugcgaugcugcugcgccgcgccccucgccacccggcuggggacccgcguggggcccgcuuuuguuuacagaccucgccauugggcgagagcagcgcgccgugcgccccccagccccggcggcugccgcuugcccccucgaaaccuggagaaguuguugcgcgcugucaggugacgcccccuccccccggccgcggggcgggaugcugcaggggaaagaugccgucucggcgccuucgcgcccagcccccgccgcgcacggcgccucuagguccccugcacccgggggcgcccgugucccagccugggguccaggcuggcggcccucggggcgccgacucggccacacucacccgguuccagucgucgcgucuccuggucuugcccccgggucagcccugguugacucggagccugccuuuucccgcgcgcuggcaggucuugaaggacgugcgcgagcccuuggggacacugugcagucugugcccgccucggugacacccgcgcggccccgca

SEQ ID NO: 18165 - RNA, 10827 nt, Homo sapiens
acacuauccaaguauuuauggccuugaaguuguuuugaauuacuuuuucaaacuccugguuucaguaugcugagcaguuaacuuugucuuugccuucauccucaggcgaagcugcuuuauuacucugguuuuuaaauaauacucagcagcaagaccuuugguuugauggggagaauauaucuagggcaauguccuuauauuccugccuuuagaaaaugagagaaaauuguuuuauauuuaucuguaaauuuaaauuauaaaacuuguccuuaauuuuacacuggcccacugagaaguuuuaaaguccuaacaaauggcuucuggaagaaaacgugauuacccaacauccagacuugaaggacuuacagccuguauuuccaauuuaaaguauugggaccauccuauaugcacauguaaaaacugguaguguaauuauauuugaaguuucaaaaggcauaagugagucucuaauugaguuauuccacauaggcaacaaacuacauuagggaaauguguuaaauacugcuuuuuaaaaauucucuacugagauuuaaagaaugguuguuuuaaccacuuacugugaacauacuguuguuuaccauaauuuuaaaacuuuggaaacacuacagauuugucuuccaauuuagcuuuuccucuccuaaaugaucucuccuacauuugauaaaguacauauuuaugaacaaacagcauuucacuuauuucugguuuaucagaaauaauauucuacaauuuccaauugaauaauuuagucaaaccugaguuagguuaacauugaaaagcauucucucagguacauaaauacauuaagagaaagugacucauuucacuaauucgguguguaaauuauuucucaacagccagaacccacagucaaacauuuccuugguuccaucuucuaaugcuacagauugcuuuaaagggcuaaucuguaaguagguugugccagcgucuacccuugaauguagaauuugugccauucuggcagguagauaaucuuacuagcuagcugaggcuguaacuugccuuucaaagcucacuaaaaaguuaucaaauggcucucuuacaucauaaugucuuuuuaaaaugaggagguacuuuaugaaucaaaaugcuaaaaugacuaagcaggaacauuucccuaaagcuuucaaaggacagccuauuugucuaagcagaguuguguuaguuuuagcuaaaagaccugcuguuuuaaaguaugcauuuugauggucucaaaacacuuucaaaauaaaaugcuaucacuguuaguauuacuaaaucuguuccacugaagcuguuuauauaaauaaguaucagagcuaauuuaguuugaauuuggauucuuuuaauagccucauaauaagugccauacaggguuuuuauucacaggcuugaaugacaaagaaauucugacaaguuuaauacccaucugugauuuaagucuggcaaaauacaggucauugaaacagacauuuuaacugaguuuuauaaaacuauacaaaucuuccaagugaucauaaaucaguuucucacuacagguacuuuaaagcaacucugaaaaagucacacaauuacacuuuuaagauuacaguguuuaauguuuaucaggauacauuucuacagcuagcaggauaacagaugaguuaaggggccucagacuacauccaagggaauguuuauugggcgaucccaauuacaccacaagccaaacgacuuccagcguuuccugucuuuguacuuucuucauuuccaccuuugcccaagucaucugcuuuuucauggaccuguaaaaaauuuuaagaagauaacuuugggcugucaaguaaucacuaccuccucccaacaauacccaaaagauguuuaagaaccucauaauauuagaaaaauaacauuaauccuaguagagagauauacuaauauuuaguaguuuaaaaguagaaacuacuacucaaagcuuuuucuugguguugcaaagacauuaccuuuaaacauuagguaaguguugcugucuaaaugaaauacuaaaacccaaauaacuauguuguagaccaccacacgcuacccuuaauccuccaugguaaguuacaguaaccuuaguuccgcagucacucuuacuuuggcaguuuuuuuaauugcuuuggaaaaaaaggaaagugaaagugaauaaaacucaaaauuucaugccaaaugaaugacgggccuauaaguaagguauaauccuaaaaaaucuuaauacuuuaagcaacaguauuuugaauuuuguucaacaaaccuuuauaaaugauuuuucugcuuuacaacuauggcucaagaaaaaccauaaaaauaaaggguuaacugaauggaagugacuacugaauguuaaugcccucaaggggagguaaaagagagccugucuacuugguguuuugcaagaaccagaugcaguuccccaggauaacuugggacaacagcuucccacaaguuaaacaagucaugauaaccugcaguccugaaugaacaugaaugaacaugaauacuuaaguccaucccagguuuuaaacuuaacaaaauguucuguuuaacaagugagaaacccaauccuggcaagaaaaucuggccauuuuaaaacuaaagacuacuucuguuuuccaaacucagaucuaauauggucaaauguaaccugcuuuuuacugcaucuuagcagaacaguguucuuaacugaccuagauaaaauaauucauuuucaccguaauuguccaauaaaauugcuuuuccuaauuugaacugcaaguacaguuuaucuggaucuuuagaaaccgcgacuaacaaucaaagugaaaagauacaugacuguauguuagaagaaguuuuaugcauauccuuuuaugaaaacuuaccaccagugugcggccaaugaugcaauggucuccugagagugagaucacagaaucuucaauagacacaucggccacaccaucuuugucagcagucacauugcccaagucuccaacaugccuaauaaugaaaaagcaucagauggauuagggcugaugccacuaaacaucaagguaguucaugagcuaaauuaaaacuugacugaguagacacaaauuugcaaacaaguagcuaggcauucuaaauacagcucuucaaacaaggcuucacgucuacacacuaaugcucugggaagaaagauggggcugcaccugauuucagaaguaccaaaggguaaacucucaguuacugaguuaugccuguuaauuacuggcauagcuaacaaagcuaugucccaaggccucugauauaaaaaucuuguccuuaaauuuaauauuuuucugaaaggcuuucagaaaacauacacauauaaauggagucucgacuaguuuucaguaucaauuuuuuuuuuuaucuacagaagcuuccuauguuucacaaugaugauugauuuugcuagugguugacaguacuguucaugacauuuccuguauuaguuccccuuuggcacuuguauuaguucuauauucaauaaaugcuacaaaaccaaaucguuuuaaguguccccauuugucaauuccuuuaagcccaggaaguaaaagcauuccagcauuugggagcagggguuuagaugagucagcaaguucaaaagcaaaggugggggaaacacggaauuaucuuagcacauauuuacaaguaguauaccauaugaacuccagaaagcuaucgccauuauuacaagaguuaagcaucuuguuaccucucuucauccuuuggcccaccguguuuucuggauagaggauuaaagugaggaccugcacugguacagccuauuuauaagaagaagaaaaaaaagcuaaauuaugaauuaaaguucccaaauacauucuaaaaagaaacacugcuaaaacuucccauggagaaagugcugaccugcaucacgacuucugggauaagcaacaccuugguacagccacagugagaagggaacagaaacaagucuauggccaggcaugguggcuaacaccuggaaccccagcacuuugggaagcugagguggcuggaucaucugaggucaggaguuugagaccagccuggccagcauagcaaaacccugucucuacugaaaaaauacaaaaauuagcuaggcgugguggugcgcaccuauagucccagcuacuuaguaggcugaggcaggagaaucgcuugaaccugggaggcagagguugcagugagcugagaucgcaccacugcacuccagccugggcaacagagcaagacuccaucucaaaaaaaaaaaaaaaaaaaccccaccaaguucuaacuacugucugacacuuguaaaguuaacacccuucucugggcuuuggcuucuucacuguaaaaauaagggaccagacugaucuucaacaguuuuucuauuauuaaaaucccaugguuaugauccaaauucuuaagaacguaguauacuuuacaaaaaacucaucuccccagcaacauaugccaagcaguucuaucugugcccuuuacuuggugcaggcagaauauucaacagcaucuuaugugcaagggccaaggcugcugccuuacacaacucgagggggcggcauuccaacuguauccuguguagaaggugcugcugugcaccaggggaugacauucacagagcacaaccucgacagcacaggaggcccuuucauaacacggcugucuucagccacgcucucacccgcaggagucccacacagggagaaaggcaggcaaguuacaggaagcagcagagcaaucaccucccagaccagaggcgguaaagccaaaaagcaacucgggggaauuucagcaauuacagaaauggaucaaaucugaucauuacaaaucacuauuugaaacuaaauuagcaagaugaauaaaguuaauuuaagaagaaaucuauaaacaaaaaaaucagauuauuacucaaauauggcaaaagaucacuaaaugcaacuuaacucauaaacuucuguuaacuugcuuccaaucccaaauuaagaaaauaaaauuuggcaguuucucugaaccuacucugguucagggguugccugauuuuuuaaaaauacuuuaaaaaaauuuuuuuuaagcauauuccaaaguaccaauaauccucugcauuccaucuucaguuuguaucauacuuuggucccacuaagaagccuguguuugggguguagagcuacucuuacauggcauuaugcaaauaaaugcagccccuuugcucgaggcacccacccucaacccccagcucaaacaccugggaucauuacaaaaguuaagagcccaaguuuuuauuuccuauuugccuucuuuaaaaaacacccucuucuggcugggugcgguggcucaugccuguaaucccagcacuuugggaggcugagacaggcggaucacgaggucaggagagagaccaucuuggcuaacacagugaaaccccgucucuacuaaaaauacaaaaaauuagccaggcgggguggcgggcaccuguagucccagcuacucagggggcugaggcaggagaauggcaugaacccgggaggcggagcuugcagugagccgagaucgcgccacugcacuccagccugggccacagaguaagacuccgucucaaaaaacaaacaaacaaaaaaacacccucuucuacaaugaugcuguaagacaaaacaucaacucuuucccuuucuuuuccacaccuagguaucaaagcccaguuuuguggcuaaucuuaagguugaucuucuucucuuuuuuugguuucuaaagacacacuacaccaaaucuuaagacaaagggcacuggaccuucagaagcagguccaccccagucuucacaaucuagugcaguuacuuuucuuguguguacucugcuggcauuauuacaaaaaucaggauauggucccaguuccugcaauuuuagcacagugcuuauauacaauaaaguugaccucuuuuuuaaaagaaaaguugaggguuuucccaggcacaguggcucacacauguaaucccagcacuuugggaggucgaggaggauagaccacuugagcccagcaguucaagaccagccugggcaacaugaugaaaccccaccucuagaaaaaaauacaaaaauuagccaggcguggugguguguaccuguagucccagcuacgggccaaggcaugaggaucaauggagccugggaggucaaggcuaaggucagccaugaucgcacagcgccacugcacuccagccugagcgacagagcaagacccuuucucaaaaacaaaaacaaguugagggguuuuaacguuuaggggcuacucuacuguuuaucuaacuagggugaacaaguaugggucaccagcacagcacaacacccaccugcuguauuaucuccaaacucaugaacauggaauccaugcaggccuucagucaguccuuuaaugcuuccccacaccuucacugguccauuacuuuccuuuaagaaaagugcaaaguuggagagaguuucugaacaaagaaaacagcugauuuaccuuuaccccucacagugaaguaaaaagcagccagacuugggaguggaaaaaucuguguccaaaucccaggcugaccacuuucuagccagugaaccuccagcaagcugcuuaacugcucuaggccuguguccucaaaagggagaugguaaucuuguucccacacucaaugcacaagcacccuguggccaggcuucaugauuaaauaacauaaaaagcaccuaauagaguggcaagcaaagugaguaccuacacaucaguguuagauacuucauaggcuuugacuauuacaguaaauagguaauguaaguaccuauuuauguaguaaauacuuuugaauagguuauauuuguacauguugaauauacauguacauguaaacguuuuuuauuuugagacaagagucucgcucugucgcccaggcuggagugcaguggcaugaucucagcucacugcaagcuccgccucccggguucacgccauucuccugccucagccuuuuuaacccaaaagguguaugucucauccuacacucuggagccccuugcuuuuucuccacgcacacccuuuuccauauggcauacucacuugacuuuaaaaaaaaaaaaagaaaaagucgcccuggaaauguccaacaggcuacccugggaccccugcucuccacuccccacucagugaguguuuuuaaguguccaucauaaguuuuuuucuuuuuuuuuuugagacgagucucgcucugucgcccaggcuggagugcagugacaugaucucggcucacugcaagcuccgccucccagguucaugccauucuccugccucagccuccugaguagcugggacuacaggcgcccaccaccacacccggcuaauuuuuuugcauuuuuaguagagacgggguuucaccguguuagccaggauggucuccaucugcugaccucgugauccacccgucucggccucccaaagugcugggauuacaggcguaagccaccacgcccggcuaucacagguauuuuuaauuagcagucagaaaauauuauauuccacugcccccaggagaggacugauucuagucuaaccagacguacuacugcuuucugaaaucuuuucaagcacugaaaccuagguaaccuuuccacucuaccaaaaugaaagcaagcaguauagccauucagguaauggugacagguaauggugcuccguggcuacauacagaaaucaaggaaguuacaacuagaucucaggacuaaaauaaacacaacauccacaccacaccgucauacaacaugucagugucucuuguuuuuagcuugguuuguuuucaaauacggccaacaguuaaggggcauuaacccuuaagaugugacuuuccacuggaaaauaucauugcucaaaugaaguauccuggcaauugcugccuuuuuaaauucuuuucuuuuugacaauagauacugugacucuucuacaaccuuuaauuuuggaaaaacucaaaugugaaaguugucccucaaacacucuguuaucaagagcacagggccaaaaacagcagguucuuugaaaccuccauuuaaccgguaauacauucaggacaucuaaguagcugugcucggguacaacccugcagggaccaggcuaugaacuuaagugaauaacacaggccugggaagcgaaaaaauauaugaacugcuacagcaguacuguccugggcuaaugaaggcucaguaugaagagaucuccaaaaauucuucaagagaagcuaggaaaacuggauuaauacgugaaaaauucugaucuguaaaaacuagcaaagaguccaagauuuuaaacacggaauaggccaagccaaguagcugauagccaauguauuaucucugcauaucuggaaagcuggaaugcuccacuauccaaggcucauucucagguacaacgggcaccaaacaaaacgaagucaggcgcuuaaaagaaggaacuaugcaagcugcucagggaagguggaaaaccuggguucaugcauggauucucaauggccagggagaagggauuccucagaggcgucuuaagaauagcacugguggccgggcgggguggcucacgccuguaaucccagcacuuugggaggccgaggcggguggaucacgacgucaacagaucgagaccauccuggccaacauggugaaacgccgucucuacuaaaauauaaaaaauuagccaggcguggcggcgcgcgccuguagucccagcuacccgggaggcugaggcaggagaauugcuugaaccugggaggcggagguugcagugagcugagaucgcgccacugcacuccagccugggcgacagagcgagacuuggucugaaaaacaaaacacuaguacuggugaauuauguggggagaaguaaagagggacaaaaagaagucugacaaaugaaacagcaaaauggagucaaaugccaaagaaccuuuuccagaaaaucuggagaccuauuaaagaaaaaggcuaaacucauuaucucccucacauauauuucagacauuuacacagacuaacuguuccuguccucucacguuucuguaaaccccuuuaaagacugaaucucauucguauaguaaauauucccucaugauuuuuaagccgagugcaagagaaaauuuuccaccaguugguaacuucacuaagguucuggggacaguguuaucacaagcaccuuccuugcaacacguuuuguaauuuuacugauaaaaguucugaaaauauuucuguauauuuuacaagagucguucagaaguuugucucugaccaucuuagcaaccugccuacuggcagagcaauuuuaaagccacuuuacgaaaauguggcuuaagaaaugcuccgacaacaguuauuaagugccaauucgguguaauggaaacuccaggucuucuaauuuccaaauacgaaacuccacccacuguccucaaacgacaguucucaaucguaggugcacaucaaaaucacuuuuggaaacuuucaaaaaacagcaauacucacccugcacuaggacagguuuugauguaauuggucggagguugggcucugguguauuuuuaguaagaucuucaaauaagcuaacugugcacccaaaguuaagaucacugcccucaaaaauccccaaaagggucaguuaaaccucuggcucccggagcuuaggaggaggaaaaggaccucuguucaaggcuaccuucucugcccuugcagcccaaucaugaccuagaacagaggccagcaaacuucccugcaaagugucacacaaacggucucuguugcguauuuuuguuuuccaaagccuuuuaaaaauauaaaaaccauuccuagccuuagagcuguacaaaagcgaagacucccugaccuagagcgcugaagccggaaagcggagagggaugcgaagacaccaggcgggcccaggcgcagucgccauccccgggcugggccuggcacugcgccacucgguguccgcgggacccucaggaacgagaacacggccaagcaagggacgagcacagccgcuccaggcaccacgacagacccgcggcggcggcccaaggaccacagagggcagcacgcccgcccccgccccuccccggcccgcggcaaucccuccccgcgcucccgccacgcgcaggcccagccccgcggcggccucggucccacgccccgcgcccgggcccgcccggugacucagcacuugggcaccgcaccgcugggggcgaaggcaccgaccgggcggcacgggccgggaccgggcgcuggaccagggcggccccgaggccuggcgggcgacccgcuccuagcaaaggugcgcggggggacgagcgggugggagcggccucgcaaacaagccuccgucccagcccuugccuucugcucgaaauugaugaugcccugcacugggccgucgcccuucagcacgcacacggccuucgucgccauaacucgcuaggccacgccgagguccugguuccgaggacugcaacggaaaccccagacgcugcaggagacuacgacgcaaaccagcaccccgucuccgcgacuacuuuauaggccagaccuccgcgccucgcccacucuggccccaaaccaaucgccucgcacgcgcucagcccgcccccugcggcagccucgggucgcgaguggccgggaaugacugggggcggggccaaggggccgcgugcgccggagacuccccccgccccgcagccgggaaacguccagaaccccgaaauguggagaaaacaaccuucuuuucacggg

SEQ ID NO: 18166 - RNA, 129023 nt, Homo sapiens
cgaguuugacuguggcgcgcggggaaggaggggcuacuagggauuugaaagugcacgggcugcggaguggagcucgcaucuguucccgccgcccgcgagcggauuaaauuucugcaaauucaaacugaauggggcuuucuucugcugccuuccagagggcgccggcagcccgccgcgcgcuucucuccggcgggagcggccgcccagcgcacggcuaggagcgaucgcgggagcccgacccaagcccgugcgggccagacggcggcggcgaggcggaggcugcggaggcacccgggcucccggacccaggcacccggaccccgggacccaggcgccgccggaccgcgccccaccccgcgcgcccgagcagggcgacugucauuagcuuccuggacgggacccggggcgggauccugguguccugaaaggggcccgggcgacccuaagaggaagaacuuuugggggcgggguccccggucccgcguccccugggcagccgcuauugucuacgcgccucgcugggcggcgcggggggcgugaucgcggcggccccgggcucugggugcggagacccaggcggggcugggcccagggcggcggcgggagaagccggggaagccgaagagccuggggaggaggagcugcgagcgcgggagacgagcaggagccgcgcgggccgcggcgagcgcgaugccggcggcggcgggggacgggcuccugggggagccggcggcgccugggggcggcggcggcgcggaggacgcggccaggcccgcggcggccugcgagggaaguuuccugccugccugggugagcggcgugccccgcgagcggcuccgcgacuuccagcaccacaagcgcgugggcaacuaccucaucggcagcaggaagcugggcgagggcuccuuugccaaggugcgcgaggggcugcacgugcugaccggggagaaggugagucucccgggcgccguggggcuggggcacaggggcgggagucggcggccaggaccccgcggggagcacugcacugggagucccagugugcagucccgggccaagcgccuucccccuccgcccggcuuuccuguuggguuaaaacgcgcgcucagcaucucgcagccuuucccgaaggcggccugcgguccgcugcccggggguugggggcuugggaggggacggccuugccccgggaagcgucccgcgcggccguucugcucguggaagggcgccgccuggcgacacuagcgcggggggcgggauggggccccucugcccuucaggccggcaggggcggcggauccguggcgaggcgggaaccagggcuagaggaggugggcucuuaugucggggggcggggggggcaggaaagcuaacagccagccucuggggggagcuuagagucugauccccguccugggcucucggaggaggugggagaaggcugagauccugcauuccuucccaccugugggcuccggcagcuagggaauguuuuuuggcagcuagggaauuuuucgugcucagaggaggguuuuugccuccgcccuccacuuguccaucccucaaccugugcuccucucuauccacucaacccucccaccccugcccccucaucacccaccauucucauccccgccauucucauccccuucucuccguucccccagcuccucugugcccuccagccucagggugggagcugcagugaagacccugcuacuggcaggaacagaacuacagauaccuccccccagagacugggagaugccuucuuaucuuucuagaagaggggaaaggaaaggggaccuccgcgagaccaaaaggggcaccucuccagccuuguuggaaguuagaugguugugaacccuugccaggcgaggggcagguaagauggaagguguaacuuagagcugugagaagaaacccaagagcuuggugacucgcuuuugaggccgggucaccccaggcuggagcugcccgagcucagagccaauccaggcuggagcugucccaagcuccugucaucucgggcucaagacugcccccaggcuggggguggcucaaaccuggagggggaccagcuccuuugugugguccgugggucagggaggcgucagccgcaaggagggaaggcggaguucacuucccaaccgagcagguggccugggagccgagcccucugccuuccgaccugggggccucugcccagccuggggcugcccugugaaaccccuggucacagggccaaccugcccuuccugccugucucuagccucaccccaccuguaguucccuccccaccccauuuccccucuuugucuuggagccuuuugccugugaaugcaggucuccgucacccuugucauuuucccuguguucccuacagccguuuugagugaggcaccgcuuuauuauggguauguggggauagagugaguaguuuuuagaagugccuccugccugaauucccaugcaaaaaaggagcguucaguaugaacuugaguaagucuucaaagaaaaaggaaaaaccuccaaaccucguucuaguccgcaggagcgaggcacacuuacacuccucgauucgauucgauucgauucguagugagcugucugacuuccacacugcggguccguucagggcgcgaggaugcggcuaauuagagugagcucucuucuccuggcccuguguaaauuccuguuggcacuggcgauggaaguuuauuuucauuggaaacguauaggauucaggcugguugugcauauuuccucucuaaacauaacggaaagaagcgagucuuuaugcucacaacgucauggcaaacacugcaaguacauucuucucgccugcccuggugcacagacuucuuuucuggcuucccuccaccuugcuguguugugcugugccucuggcucuguagcagcgcauuuuugcaccauaaaacucuuggcuuuggcugaacugccuggggguggauucagagcucagccagcgcuuggguucuggagcucugugcugggcccacugggaaccccgacaugcagggaauucuugcccaaauaggauucacaugaagagacucgcugcuuccccaggugcccacuccccuucccucccaucuuauguuucuuaaaugaugaaucucacuucauuguugcaaugacaggagauguuaauuggauguaaaauuauuccccuggacccauugguggacugcggguaaggauggugguucuuuggguggagaaggaggcaggggagagaugucuguguugaaaaacuugguuuucccgggaugcuccuccccagcggggagaaucagugcuccagggauugcgggcauugggagaaaucuggauuuuaguucacucaauugcuggcuuuaaagaaacaauggugucauucauaacauuuaucucccaaauccagcaccuuuaaugcuuaacuaauagauuuggguuuuagcagauuguggggauuaaaaugguuguguguguaugcuugacucugagaaagauugcuaaauuaaaaugaguccucauucccacucuaguuuuggguauugccuaacuaaggccaaaacaaagaugaccacagccucaggcuauuuacaaccugaaguucuuuuaaaaggugagcuacuaagaugauuuuggccuggggaaaguuuccuccagugagcagagcugaggaaaaggaggucauuaagccuccagugucccccacugugggugacccagggaggccucucucccucauuaauuccucuuuucuugggguguguacauuuuggauuuagaauuucacuuuucuccuguccuaucuauuuauuuuuuaaauuuuuuauaaagacaggggucucacuguguugcucaggcuggucuccaacuccuggccucaagugauccucccaccuuggccucccaaagugcuacaauuacagaugugagccacugcaccuggcccauccuuuuauaaaggauccauuccacauuaggaggggaaugaagucauuaauacuguagugagaaguacucccagcccacguggagcgaaaggauucagggcagcuugucuugggaaaucaguccaugaaaaagcugaaagagggcauagggaaacagaaguugagagggcaccccaaguuuggccugcuucauagcugcauucucaaacugugagaauuaguuuugggugauuugugcuaaaaucuagggcauugcuaguugaaggcauuugguauggggguguguguguguguguagcguguuguguuucgacuugguuacacuuccaaaaagcuuugggugaaauccuucaugguuugcugggaaucacugucugaguccagaugacaaagggagccaguuuuucccaacuuuccuuuuagguuucaauuugaucucaucaagaggcugcuuuugccaccacugccuguaggacaaucuuuugccugcuuuuccucugaaguuguuuguuuagaagccauuugaaucuagauggcucuuuuacugcuuguaaaggaaagauggcuugcggcugagaccuaauuguguccuccuuugaguuaaugcaaucucuguuaaucuggcuuuaaaaauaaauaguucacuuggccaugugaaacucuuaauagguaccuucacagucagggcugagugucuuugaccaaaguugaugauuagaccagggaaaaugaucacaaaaccagauucugaaaaguaccacucucuggcuuugagacgaagagcaaagcuguugagcaacaguaugggguaaugacuuugaaacaccuggagugguugugcuugcagagccugguauugauuugugauaccuaugagaggcguggucucuggcacauaacaagugccccccgcccuggcccccaaccagacagagugacuugggggcugcugcaugaucagauaauaucaucugucgacagaauaaggaaagugacuuacagaaaauugaagugagguccagaaacaggacagacgugguggcucaugccuguaaucccagcacuuugggaggccaagguggguggaucacuugaggucaggaguucuagaucagccuggccaacauggugaaacccugucucuaauaaaaaugcaaaaauuagccaggugugguggugcauaccuguaaucccagcuacuuuggaggcugcagcaggagaaucgcuugaaugugggagguggagguugcagugagccuagauugugccacugcacuccagccugggugacagaaugagacuccaucucaaaaaaaaaaaaaaaaaaaagaguuuaagauuuuaaauuuccauaaacguuaaacuuuaaaugaagcaacuuagaaaccacguauaauguuucuaauacagacauuauaaauaauguuuguaaggaaucaguaaaacaaugguccuuuaucaucagcaauauauuuggauaauuccuuagaaguuugguuuaguggcuggacgcgguggcucaugccuguaaucccagcacuuugggaggccgaaguggguggaucauuugaggucaggaguuugagaccagccuggccaacauggagaaaccccaucucuacuaaaaacacaaaaauuagcugggugugguggugcacaccuguagucccagcuacuuggguggcugacacaugagaauugcuugaacccuggugaugguucgugauaccuacaagaggcauggucucuggcacaugacagguuauuguguuuuguaaaaaauugauaaaaguugaaaaaauauaguuggaaaagcugaaucgagaaaagaguagguguaucucagguauugagccaguguuguaggcaggcaaacuacagaacaagaacagacaguccaugccacuguuaccuuuuuugugauugagucucacugagauacaaaguugaguacauaaaaugauugguuaagauguugaaauaucuuguucuaacccuugguuaaagaauaauaagccggcuugucacuuccaucagaacuauuuuuaggcuaagaguaaggguugccugcuuacuaaguugccaguaaucaugcuuagagcaugacagugccagauaccuggagugaaggaguuacuaaaaauacgauuuacuauguuuugcagagcaagaaauaugacuaauuuuagagguggccuuuuggcagaucuguuuuuagcaaguauuucugaaacaaacaggugcuaaauccuguauuuuugaagugcuagaaguuuagggguaaucgcucugaggaacaagaaaugcuuagagaacuggaaauuccuauuaauccuuggcagggacuucuuggcaagaaggaggcauuugcaaagcaccugcuuggugagcccugugugacaaggcagugccuguaauuucgaggauugcauucugcaguugcaggcggauucuuuugaacuuccugcccugccucaucuuuuugaaguacuugugaaugauggaaauuggcacguagggccugguuccuaguguucauugauacaggucccacggacuucaaagggugcuuugagucagcgcaacagugcagaaacggugcccacggagaggaguacaacccuacauuuucucugcagguguugagucacggcuauagcuacccgugcauaccaauccgacucaggucugugagacuauagaauucugcaugcugccagcuauuggaggucagcgcggcaaucaucugucccaggguuuaucugcccagaagggguggggaguggcagccaugugcccccgaagagagggacagguugggguguucuccaugggaaggaggcuugggcacaggguuaucauuugccuugggacauauauucccucugucgauuauuuaugguaacggagagaccugcucucuuggcuaauugaaacccguagauaauccccaggccuuauguuagcugaugggugaaacuucuuucucuacucagcccuggucuaaguacugaccugaauugaauuucacgcuuucugauaggaggugccacugggugguacgaugaccagcaggaaagagcuagaaacacagggacugaauaguccccgaggagggggaugccucugugaauucgagacagcuguucccucuccuccaucaccagcaccagcccagugcuacaguguuuuacgguuuuuuucagggugccccucccgugcacauucuuguuagaugccugcagcagcccugguggaggggguaacagccagcuugcugguguucuugccugccuugauuacguagaagggugcccugaguagaucuucucucugacauucucuaugaguuugcuaggaugguucuaacaaauuaccacacacuguguggcuucaacaacagaaauuuauucugucacaguucuggaggcuaggauccaaaaccaagguguuggcagggccaugcucccucugcagccacagggagaauccuuccuugccucuuacuagcuuccggugguggccagcacucuuuggcauuuucuggcuuaugacugcagcgcucugucucugcgucugucuucacacaguguuccucccucugagugucucuucugucucuuaaucuuuuccuaugucucuuuauaaggacaccagucaugggauguaggucuacccuaauccaguguugccucauuuuaacucgaugacaucuacaaagucccuauuuucaaagaagaucauauccacagguaccaacgggacuugaagguaucuuuugggggagcauaguucaagcuccagcaccuuuuuagacugucaguauuggguuguggcaagcggaucuugggaaggagaugaaugugcuuuuagggauuacucucagaacugaccucugcaagggaaggggcaaagcagcacugggcagagggagaagcugggcuccaauaccgcucucagccaaagccccugcccaugccguggugagugcuggagcugagcuggcccuucagagcugaccaacuuggguugagaggacugggauuuauauuuccgcaucggccaguccuugaugggggcugcccaggcaaggggcauggccucguacgggacaguugcugagggcgguuccuggggagagcucacagcugauagccugcagcugaggcagucaguucuucagcacugacggggaaucugggggugcagcccagcauuugcuguuuacugaaagagacagggucagaguccagggcuuuucaucugaguccauaccauauggaccguagacaacgugggcaucuuuuccaugcgcauuuuggauaugaguggucaucauuuccauguguugguaucaaguccucucaucucguuaccuugaaauauacaaaguauggccaggcgugguggcucacgcguguaaucccagcacuuugggaggccgagggaggcagaucaccugaggucaggaguuugagaccagccuggccaacauggugaaacccugucucuacuaaaaauacaaaaaaauuagccaaguguguguuccuguaaucccagcuacucgggaggcugaggcaggagagucgcuugaaccaaggagguggagguugcagugagccgagauugugccacugcacuccagccuggguaacaagagcaaaaacuccauaacaacagcagcagcaacaacaacaacaacaacaacaaagaaauauacaaauuauugcugcuaaauauaguccccguagcaaacauuagcauuuaguccuucuaucuauguauguuuguacccaugaaccagcuucucuucagccugcccuaccuugcugcucgacuguggucucucucccugcaaugagggagcagccggcguggcaucucauuagcagauucuaugugccacacgcugggggauuuucuggccucacauuucucuuagguuagaaucaucagggcucuguuguguuucucaguacuuacaagauugaaagcucacuuuauauguaugcucuauggguuuuuuccugagaacucuggggcaacugaguguugggccaaguugugggccagcaugccuacuucagagacgguggcacuuuccugggaagagacccccccucccccaucacucgugaguggugggaaaaguuguugaaggaguugugggaauuuggauuuuugaugaguagaguaacaguuugggacauucucauggacaaaaaaaacuacucaggguagagccaucuguuaacauccucuuagcacucuuacgguggccacugugcccuagcuaugcaacuucuaaucacuggguucuuuuugguuuuuaaucaucuuuguguuuucaagaugcauuugguuaaguuuuggaauugguaauacagacacauggucugaaauucaaagguucugagaggguuugcagugagagguaacugcuucuuaucugggcucuucaguuccuggaucuucucgugagaggucacuccuccuucuaguccuuguguaucccuccagagauacccuauaugcauagagacccacauacauauuuguaaaugcguaguuaggggcagauuuuucuucuuuauugauacauaauauuuuacauauuuaugggguacaugugaguguuccaugcauggaguguguaaugaucaagccagaguaucggcguguccaucaccuaaguauucauuuccacggguugguauuauaucaaguccucuguucuaguuaccuugaaauauacaaaguauugcuacuaaguauagucacccuaacagacauuagaauuuaguucuucuaucuauguauguuuguacccaugaaccagcuucucuucauccaucccucccacccaccagggcagauguauuuuuaaacuguacaugcuguucauuaucuugcuuuuucacuuagcaauaugucuugagcauucuuccccaugacuacuacagaauugccucacucuuuauguuaauuaguuauugcauaguagucauuguguggaaguaucauguugacuuaaccaucccuuguugauggacauuuagggaguacauaauuuuuuuuuuuuuguuauucucaaaccauacuucaguaaauauccaugaccauuugucacuuuguaaaugugaccccucaguguaucugagggguaaauuccuagucuuaggccaaaagguaugucuauuuuaacuguugauaaguauugccaaauugccugccauagagguuggcaauuuauaaucacauugauaacccuuauaauuuauaaggguucccaacuuauaaccacacccaucugguaugggaguguuugcuuuuccacaugucagccaacaggguacucauuuugaucuuugccaaucgaguguauuaaacaugguaucuugucuuauuuauuguuucucuuauuuacaugggaauugaguauauuuucauaccuucucaacuguuuguacuucauuucuguucauuguucauguccauucgccaauuuucuuuugggguuuuggccuuuuucuuauugauuuauaggagcucuuuauauauuaaggaaauuagucgucuuugagugauauauuuugcagugucuaccaccuucccucgcuccccauuauucuuucucuuuuucuuugugguucuugccauuugcagaaguuauuucuugggaguucaugaacuagagaaggauaauugauaaguuuuggaggucuauggagcccuaucaauugugugcauguaaacauauuucugaggagaggguccauggguuucgucauacucuaaauggaguuauuuaccucuaaaauauuaagagccacugcuuuguugcccacccuuguuggcucugcugacuaaauggaagucugcagauuacugggcugaggguuugggucaccuugguuuguuaacaccggugccaguugggcuacaguuguagauuauacacacucaggcuaggcagguugguucugcaaccaugacccuggaguaagcacccuugauucugccccgacccuuaccaugccuggauugcaagggagaggcaugauacugugugggauggucuuuggaaaucuuugacucuugcugguuuaaguaagacaacugugaguccaugucccaucaucucuucaugggaaaggugguaccauuuaugguggaugguugcuaugaucagaauguuugugucccccaaaauucuuuuguugaaauucaaaccuccagugugaugguauuuggagauggggccuuugggaggugaugagaucuacccucaugaaugggauuagugcccuuauaaaaggugccugacugagguugcagugaaaaaauaaaaaaauaaaaaaggccaggcaugguggcucacaccuguaaucccagacuuugggagggcgagguggguggaucacuugaggucaggagcuugacaccagccugaccaacauggugaaaccccaucucuacugaaaauacaaaaauuagccaggcgugguggugggcaccuguaaucccagcuacuugggaggcugaggcaggagaaucacuugaaccugggagguggagguugcagugagccaagaucaugacauugcacucuagccugggugacaagagcaaaacucugucucaaaaaaaaaauaaauaaauaaagggugccuaaaggagcuuguuuguccuuccaccauaugaggacucagugaaaaggugccauuucuaugagccagaaaacacgcccucaucagacacuggaucugcagguguguuaggcuuagacuucacagccuccagaacugugagaaagacacgucucuucuuuuuuuuuucuuuuuuuugauggagugucacucuuugucggccaggcuggggugcaguggcacccucuuggcucacugcaaccucugccuucugggucaagugauucuccugucucagccucccgaguagcugggacuacaggugcgugccaccacacccggcuaauuuuuguauuuuuaguagaaaugggguuuugccuuguuggucaggcuggucucgaacuccugaccugaggugauccacccgccucagccucccaaagugcugggauuacaggcacgagucaucgcgccuggccaaauugucuguucuuuauaaggcauccagucuaugguauuaugguacuauguuacaccagcccaagcugacuaagacagugguugagaagaaagagaaagggggaauaucgagggaaaugaaaaccuuucaaggagcaagagccauuacguaacuuggacauaaaaugcacuaagacagguauuaguacauuaaugcgugugugugacagugcaugcgccuuggcacucuucgaggggcucugucuauuugagaugcccucugaggagcagccuugguggggccgacaggcgggcccugcuguuggaauuccuguggccucggccugacgaccgucucugaaugcccuguccccugucacucucugccccuucacucugcuuugucccuccucaccaccuggagugguuugcuagagcugccauaagacagcaccacagacccgggggcuggaauagcaaggccuuacugucucucauucuggaggcuggaaguccaaaaucaagguguuggcaggguggguccuucugaggcuugugcaggauggaucuguuccaugccccuguccucggcuuauccauggcugucuucuuccugugucucuuuacaucgucugcccuccacgugugucugucucucuguccaaauguucccuuuuguauuuuuuuauuuuuuugauacagagacuugcucuguugcccaggcuguuguguaguggcacaaucuuggcucacugcaaucucugccucccagguucaagcgauuuuccugccucagccuccugaguagcugggaugacaggcacgcgccaccauacccaccuaauuuuuguauuuuuaguaaagaccauuucaccacguugaucaagcuggucuugaacuccugaccucgugauccacccgucucagccucccaaaaugcugggauuacagacuauagacgugagccaccacgcuuggccuauguucccuuuugauaaggacaccaguucaaauuggaucagggcccaccuuaaugaccucacuuuaacuugauuacuucucuaaagaccucauauucagggggcuaggcgcaguggcucacgccuauaaucuuagcucuuugggaagcugaggcaggcagaucaccugaggucaggaguuugagaccagucuggccaacacagugaaacccugucucuaugaaaaauacaaaaauuaucugggugugguggugcacaccuguaaauccagcuacucgggaagcugaggcaugagaaucacaugaaccuggcugggaggcggacguugcagcgagccgagauugcgccauuguacuccaaacugggagacagaaugagacugucucaaaaaaaaaaaaaaagaccccucauauucaaauaaaguacugagguacugggguuaggacuccaacagaugaauucuggggggacauaauuaaaccuuuaacaucaccugaucccauggaauauauuuagaguugauguguuugucuccccacuagaguguaagccccaugaggaagagaccacugcucuauuccccgugccaagaauaguuucugguacagagaauaugcucagaaaauacuuuuuuuuuuuuugagacaguuccgcucuuguugcccaggcuggaucuuggcucacugcaaccuccgccucccggguucaagcgauucuccugcuucagccucucgaguagcugagauuacaggugcacaccaccacgcccagcuaauuuuuguauuuuuaguagaaacggagucaggcuggucaggcuggucucgaacuccugaccucaggugauccaccugccuuggccucccaaagugcuggguggcaugagccaccgugcccggccagaaaauauuuuaugaauggauccaagcaugguuugaucuucccaagacauguggacagccuucuaggggguaauguccaaguuggcaggcucugguucugcaagcgcuguauguuucucucauuccuugcugcucugggugugccugucugggugaugacuauguugaauggguugucuggcuggugcucuguagaaaaauccuggccccugaacagcugugcuuucugcggggauuuaguuaggcaccuagguaucugagugacaggugacuaaccagaaccagacaguauuuugcagugucaggggauguuaacggacccucucucuuuccugagaaaauguagcaacacugcaacagaugggagaaguugcuauuugcaaacauacauuuuauuuuggauguuucccauggagauauauguagguuuggagucugucucuuugacuguaauuuuuuuauaaguuuauuagucuccuaagccacauuccugccaaaacauuuugcaauccugcuugcuucucuugcccauuuucugagccauuugauucauucugggcucccucccugcaucaccacugccauuuuaguccucuuuuugaguucuuguugucuuauguccaaccccaaggcuuuuugguaagucgucaggccaucuuucugccuuucuucagacgcucuuguaugugacgcuccucucuuugucaccgucggcucuuugccggggcucuguguguagcagcuugaaagcgugcagcaguagugggugacccgugaacacagagcguggugcuaagagauaaaggaacaguggauguuguaaccgccuucggggagccucgccagcucuguuuagggaugauagaaugaaguuuggauucuuagcgauucccuugucuaccuggagcagaacacggguaggcagguuaugauugcauaaccuuccaaaucaguaaaaaccugcaggaaagaaauggguacaugguuuuugcuuugaucaugaggaggucauacugaucacgaaaauaaugaacauuuguggaucucguaccaucugcugggccaugucuuggaugcuuugcugcaugagacaacuuacucuucauaguagccuuuugugguagguacuguuguccugauuuugcagauuaagaugaccagaaucuugguuugcccaggacucucuuaaguuuaauguaggaagucuuggauuugaggaagccccucagauaaugccaaaaccacauucacccaggaaaauauuucaucagaguguuuggaguccaaacugcagguuuccgaauaacaguauuaauaagcagccaaucaggucaugaaugagugaagaaguaaagcccaaagcccugggcguuacugggaugcuuuuguugguaauaauaaugucccugugugcucccagggacugagaggugcuuuucucacauauguaguacagaucuaccaucuuuauggguucacaugagaugaggagcuugagcuauuaauaauauguguguuaggcuggacgcagugcucacgccuguauucccagcacuuugggaggccgaggcgggcagaucacuugaggucgggaguuugagaccagacugaccaacauggugaaacccuguuucuacugaaaauacaaaauuagccaggcgugcaugguggcgcaugccuguaaucccagccacucgggaggcugaggcaggagaaucgcuugaacccaggaggcggagguuauggugagccaagauugugccauuguacuccagccugggcaacaagagugaaacuccaucucaaaacaaaaacaaaaacaaacaaacaaaaaaaugcaaaaaaaaaggggguuguaugugcacacacaaauguauguguguauauauauauaaaugcauauacacagauguauauguguauuauauauaacauuaaauauaaauuauauaauacuaugcuaaauacauacacguuuuuguuagcagacuuccucaaugaaggaagcaguggggacugguagcucucugaguagcucugguucgcaucagucuaacucuaguaguacuucucuuuugcgcugggggcugaaaaaucuacuggaggggagagagguuuuugaaucacaucgugaagcuggaagugcauucuuacgucacacagugaacagucccuuccagucuccucguuaaaccauccuccuacgagaaugaacacagauuacuuauuaaaaacaaaacaaaauacccagugcuuuugccuuauuaugcugacgauuuggaggcagaccagcuuucccaagccauugcuuaguccccgguugggcugagaaaggacaugagaggcaaauggaaugaggaagugccucaggugaaaaggaagcuuagggaaaguuagcuguggagucugagaucagaauauuuuaacauuuuaucugagcccuacuuuagugaaaccaaauggauaaagauaaguguuaucacuuauauaaucugguuuuuaguuggaauuacugcugcucugauguagcuuucucagugcauucuuguuuccagguuaaaaauuuaauuagagaaacuagucgaugacucaguucucaguugaacauuuacauuuaauaauacuaauaaagaaaacuuguuuugaaaacacaucuccagguuuucauagugucauucccauagggugacauuuuauucuauuaaaagcuaacauuugugagaaguaguugcaauuucaaggccaauuugacauaauaaaacuugaauuucucucuggagggaaggugcuggauggcuauuuuacucccaccuaauuuauuacucugagaugcuuuuuccaagaucaagaaugagcuuuuuaucauaaaggccauuaaagcagcugagaaaguaccugagaaugugcgggguaacagauaguuucuuuccaguguucagacuuagaauuauguccuccagauuucaaagggacauauuacucaacagugcauuuauuuuuaaaaagucuaauauaaaucaguguuuuuucuaugaucaacuauaaauauuuuaaaaauaauauauuuuuaaguauuuuugaccaagcauuaagaauuuuaaaauucuuuaaaucaguuaagucacagguauauuccagaauaguugagauuuuuaacagaucaaaagaagucuugggcucauauuugauaguugccaucuaaaucauggccacuuauacauacuuuuuuauugucaacuuugccacuuguuacuauacuaaucacauugcauuauccauucucucuguuuuagauaccuuuuuuuuuuuugagacagagucucgcucuguugcucaggcuggagugcaacggcacagucucggcucgcugcaaccucugucucccggguucaagcgauucuccugcaucaggcuuccaaguagcugguauuacaggcacccaccuccgugcccagcuaauuuuuguauuuuuaguagagacgggauuucaccauguuggucaggcuggucucgaacuccugaccucaggugauccacucugccuuggccucccaaagugcugggauuacaggcaugagccaccgcgccuggccgguaaauauucuuuuaaaguuugauuuuuggugaugcauagcauuccauuauuuggaguugcuguaauuuuuaaauccaguucccaauuguuggacauugagguuguuacaaaauuuucccuggauacaugauacugcuguugcuauccuuguauguucaucucugagucauuccuuaacauaaauacuuggaaggcuuuugacauauugccacauugcacuucagaaagguuguaccaagugacacaacagauaugaaagugacuuuuuaacugagcauuuugauaauuaggcuaaucauaauuuguguacuugauugaaaauguguuucuucuuuuaugaacuguuacuaguaauuuuccccuaucuuucuccuguuuaucuuauugguuuauagaaacucuuuucagauuacagauauuagcuuuuuaaucuuuuguuuaaaaaaaaaaaaacuuuagacaaauuaaauuugacgguuuaauuagcaaagaaugauuugagaaccgagcaccccccagcccuggcccccaaccagacaaaauggaagugagguacagaaacaggcuggaugugguggcucaugccuguaaucccagcacuuugggaggccgagguggguggaucacuugaggucaggaguuugagaccagccuggccaauguggcaaaacccugucucuacuaaaaauacaaaaauuagcugggcgugguggcccaccccugcaaucccagcuacuuggguggcugaggcacaagaauagcuugaacccaggaggcggagguugcagugaguggagauugcgccacugcacuccagccugggcgacagagugagacugugucucaaacaaacaaacaaaaagaaaagaaacagcuggauugcuuauagcuuggcauuugccuuauuugaacauacgaacacacccgugauuggcccagacucugacugguacaagagcagguuacauuuaauaauacuguuaaauguauuauugcacaucuguuuacacauccuguuaggauccuguuuacacauacaagugagguuacaguucacuaugugcagagaaaccauuaggcugaacuuaaaauauguaagaaagcaucuuuagcuaaacuuuauuuaacacuuuguuauguugcgaauauugucucccaggugaucauuugccuuuugauucaucuuauggugcuuuuauuuuaggaagggggcaaaggcacauggaaauuuuguguuuugucuaaccaauccaguagucuuuuaucuuuaguuuucucuuauugcuuuuaugcauaaguaaacuagagggcuuguuguugguuuugucuuauaaaugaucaguggguccaguguuucauaguugucugcagaaaaaucuuugcauuggguagggauauuugacuauauauucuaauccguuacauaaugauuuaaccuguugguguuauguacuaaagcacaggcugugggggcugacagcuugggacuccuaucugcuuucugcuacuugguaucugugugaucuugggcacaguguucaaaaacucuaaacuucagcuucuguaucugcaaaauggugacaaagauaccucaugguauucaaugagaauuugguuaaaaaaaaaaaaaaauauauauauauauauauagagagagagagagagagagagagagagaguguguguguguguguguguguacagcacguagccugaaaauacagucauuauuguguuagucaagaaaaaaguggccagacgugguggcucacaccuguaaucccagcacuuugggaggccgaggugggcagaucaccugagaucaggaguucaagaccagcuuggccaacauggugagaccucugccucuauaagaaaauaccaaaaaauuagccaagccugguggcgcaugccuguagucccagcuacuugggaggcugaggcaggagaaucacuugaacccaggaggcggagguugcagugagccgagauugcgccacugcucuuuaaccugggcaaaagagccagacucucucugaaaaaaaaaaaaaaaaaaggaaagaaagaaaaaaaaagaaaugguaguugguuguucucuucauuuagacuuucauaguuauauuuccgccuuaaaaguauguauuauuuauggucuuuuagauaguaagaaacagauacccacucaguuuaucauagauaacggcauuuuauuuuaaggauaaagggaggugaggaaaaagaugauggggacgccucuuccgucaacaccucccugaggaccgcgaugccucucuggaugucugcauuccugggauuccacuuuccucuugcccaccucugccgcagaccucccuuucuuggcagcuucugugguuccuugggcgcauccugccauucacccugcccccugccucaaggcuucucacuauuccuggcuucucugccuccuccuguguuucacuuuuugcucuuucuggauguaggggagggaaaaaugucuucccuccacccgucuacuuauuugguugggcuacaaauuaaaucgacauaagacagaguagcaggaggaaaaccacauuuaaggacaucguaugcaugggagucccacagaauaugagacuccaagaagggccaggucauggaagcuucuacagcaacccgagcuacagaaaagaauaggggcuuggggcuuugggggugguggcaauccguucugggaggaugaggggaaggaauguacgguggugaauaaagcuugucuuguuaugcagauaaaagucuuccagguaauaaaaaguuaccuggagcaacucuuuucccgauacaugaauuuucuuuauagauauuauuugcaaaaggacagcuuuucggagcugcuucuuuguuugcaguuucucaggauaagcagcucaaacuaugccaaagaacucuaauuggagugucauguucuggucuccuauagucauguuucggggugguuggugugucuugagccccaacauggguauuacuggguugucuuguauuucugggauugaugacaucgugguagaagugugauacuggaauccuuacuggccucaccuccuugucaccuuuuugccacugagcguccuuuaacagcagagaauccuuuucacaguggaauaaagaaugcuauuuauagaugauucuacacgaguuaccagauuaguaugguuugagaaaguuugugggacaauuaauucuccauguuuuugaucagguaggcaacaccugccucaacacucaggaaaacauguuacugccuuuaaggguuauacuuucucccauguuuguaguuguagggauagcuuaaugcauuuuuuucacugacccuuugcuagaaguucugucauuuccaaugugcaucgaaggccucuuuagcuuccgggacuggguugagaauuuugucuuggauucuuauugccaaaaucucuggguuuccaauuccugugguuucucccuucuuccccgaggcugcguuauucuuguaccuuuucaacugcuuuuggcugccaguuguccucuggugugagaauagaguauugauugcuuccuguugccugugggacaggaaugcuucuugaauuagagcuaauuuuggaguuuaaaguauuaaaugucaaauuugaaagaaagcacaucuaagaccucuuuguuguggaagcgaaggucaucccagggccuaggggaagggaaaggaagaaagaaaagagaaaggagaaaauagcugaugacuucucccucuuccagaucauucccucuacacucauggaaugcucuuuccauuuucguaaaauccauuuuuagacucagaauucugcaucucaagccauuugccagguguacugugaugucagaauacucacugcuggggaaauuucccaguuguaacuagcuuaaaaaauaaaacaaacguuaccuuuacuuggagaugaucauuuguuuugucauucaaacacuuaaugguggcccuuuuuaugcagagcugcugguaaccuguaugggcuuuuguacacauuggaaaagcugugccuugccagaccaauuagaaaaagacauccccucugggugaaccaauuaaaaaaaagcacuuccucaagugggccaauuagaaaagguguccccucugggcagcccaguuggacaaaggcuuccuguuugaauggaugcagcugcaaggugcaugguuuagcaagcagacagcauugcgggaggaaauauacccuuugcucuagggcacagaguuggcaagccaaguggggucuggauuucuucccccaaauggcccccuccauugggugcuuuugucugaggcaccaaaugcaccgcgaacaggcucaacaaucugaucugcacccaguaguuagagcuaagcugugaaucacaaacacggaacucauguuauuacaguggaaaaggccauguuucuuccaacagugacugauuaagugucccaggauuuuagcgaaucucagguaaaaaucugcagaaucaguccuggucucuuucuuuggcaaagucugcuucguugcuuguucuguaagagaaagagaagcaaggugaagaauuuggaugauaaauaaauucaguguguuuaugucacucaaggcccaggagacacaagacaugcucuggcauauguaacaauuagggucuugggggaaugcccuucacgagaccugugaacuuugugucuccugagucaucauucaaccugcuucaggggcccagggcucucagacuuccuguguguuaagagcugaagcagcuguugaacuagggucucagagacuccagucugcaaauucgaagagaaaaauucuccccaguguugauuacuuaucagcccgguuccuuucuuggauggggaaauggugugacaauuuaauaacgggccugugacaauuacaugcaaguggagagaaugaaaaaccagccuuggaacagagauuuuucuuuucugggaaugguacguggugguuuuggcuuucucuauguguaaugggagaggcccauccaucucugugugacagaggaaaauuucagcauuaggagaguaacuucugauuuaucacaaacagcugggugggccaugccucacuggugcccaggcuuaagcagccuuugaaauagaguugcucaguguggcuucugcaucugaaagggccagugagcugcuguguguuucacagugguugcugagcucuugucauccugaucaccccugguagagggucagugugaaggagggcauuaccuugaaccugacaagucuuguaucugucaagguguuugcuaugggcugaauuaugacccccaaccacaaauucauauguugaaguccuaacccccaguaucucagaaggugacugcauuuggagauaggaucauaaagagguaacuaaggcgaaaugagguuaucuggauaggccuuaauccaauguagcugguaugccuagaagaagaggaaauuuggacacagaugugcgcacacacagagagagacugcacgaaggccacagugagaagguggccauucacacgccaaggagaagggccucaggaggaagcaacccugcugacacuuugaucucagacuuugggccuccagaacugugagaaaauacaguucuguuguuggagcugcccagucuauaauccuuuguuuuggcagcccgggccaacuaauacacucuucauacaccuccauuugcugagugucccagaagcuaaggucggcuucaggaaucaugccgggaaacuucaccugauucacgagaccacuuucuaaugggauccuccucuucaguaacuuuuuccucugggaaggaaccugggguuucucucucuuacuucuugccucacuaaacucuguucuguaacaaaucacauucugugcagauaccacgauaccuggaaacaaucuccuccuugaguaaggaaaucaauaauauucacuggauuccugacuuguaugguguugugugcugucucauuccauguugggucaagaaaaaaacaaacaaacaaacaaaaacaagaaaauguugucccucuagugguuucuugguuucccuggcauauuucuacaaaacaccgucaaaagaagaagguguuugagguugcuauuagaauuucuucauggacacauauaaauguaugaaauuauuaggaugguccauaaagcucuuuauauuguuuguaggauauugacacaugacuugugauuacuuugcguaugauuugugugaacccaaaagauuauucucuguagcucuuaaaauguucacucuuuaggaacacucuuaaagugaucaacuaaaaaauguuguugcuaguagcaugaugucauguggauuaguugccuauggcuaccauaacaaaguacuauaaacuguguggcuuagggccaggcgcgguggcucacaccuguaaucccagcacuuugggaggccaaggcagguggauugcuugagcucagggguuugagacaagccugggcaacauggggagacccugugucuacaaaaauacaaaaauuacccagaagugguggcgaaggccuguagucccagcuacuuuugggaggcugaagugggaggaucgcuugagccuaggagguggaggcugcggugagccgagaucacaccacucacuccagcuggguugacagagcaagacccugucucaaagaaaccaaaacaaaaaaaauuagcaacaacaacaaaaaacuguguggcuucaacaauggaaauuuauugucucauucuggaggccagaagucuaagaucaaggugaguugguucccuccgagggcugcaaggaaaggcucuuuccaggccugucuuccagccucugauagccccaggcauuccuggcuugaagggcauccucccucugucuucacaucaucuucccucugugcaugucugccucuuguucaaauuuuccauuuaauaaagacacaaucauguuggauuagggcccaccauaaugaccucaucuuaacuggaucaucugcaaagacucuauuuccaaauaaggccacauucacagaugcugggaguuaggacuccagcaucuuuugcggggacagaauugacucaugacaccauguuauuguuuuucuuaucccaucucauuagccgcaaaaaggucuuuggacccuggaagcaaagagcaagagacaggcaaaggccaagaggacagugaaggaggugggguggucagggcuaaaagguagacugcccugggcauugauguuucuugggcuuuggguggagggugcugccuggaccuucuagguagcuucauugccucuguuccaccauguucuaucuuuccgagaugcucaccuccucccugcccugggaugcucaucauuguuaagugcacuugggcuuaugguucauuggcaguucucuuggagagagaaagagggaggcuacguggaguagggaugcauugcagagauacgacaguuaugcugacauucuguuaaggaagaccuuagacucuggaaacagacuugaggugcaagaccccccgcuggucuggcuuccaggagaaggccgagaggugagucacacagggcaguauuucucagucuuauuuuuuaauccauauacucuguagugaaaccccaccugggcaaaaccauuuuauguuuugugauuaccauuaggacaagcuuuauacuuuguggguauuuauuuaauuuauuuuugagacguaguuucgcucuuguugcccaggcugaagugcaauggcgcgaucucggcucacugcaaccuccgccucccaguuucaagugauucucuugccucagccucccgaguagcugggacuauaggcauccgccaccaugccuggcuaauuuuuuguauuuuuaguagagacaggguuucaccauguuggccaggcuggucucaaacuccuggcgucaagugaucugcccaccucggcuucccaaagugcugggauuacaagcaugagccaccacgcccggccguggauuuuuuauuagggcaaaaauagguggacugaaugugccuuuuucagcucacuuuucuucucgacccuggaggacucucccgucuuuuggucaccccuauggagaggcccugcauugagcuuuguuguggagugggguggaacagggcaggagugggguccaagcuucuggaaguguaaggagagaggaugauuaaugucaggccagcucugcuuggaaugaguuugagaaguuugagagaaagggcagugucuacugaugcuagaagacugauaugaaagcaaagcuuuuaauauccacaaagcauccgaucaauaugccuaaauaguuuguuaggcuccucuuaagaaauaccaucugugagcuuauucucuuuuaugguuuaacguuacaaacacuuguaauguauguuaucguggaaacugaaugaugauaagcugcucuuaaguucccacccucuucccuuguucucgguagguuuaugaguauaaaaggggaaaaacucauucugcacuuggugccauggaggaaaugauuuaacaagucgaggcuggcaacgacuuccugcugcacugauuuuacuuagaucuucccuuuuaacguucucuauuaguuuccugggcugccauaacaaaguaccauaaacuggguagugucaaacaacagaaauuuauuaucucacaguucuggaggccagaaguaugaaaucaaggcguuggcagagccaugcucucccugaaugcuguaggggaggagaaucuucuuuucuuccuagcucuggugguugccugcagucuuuggccugcuuuggcuuguagaugccucacuccagucucugccugcaaauucgcgugaccuuugcugugugugugugucuguguuuccucuuguuguaaagacaucagcucuaugggauuagggacccauccuacuccacuaugaucuuaucuugacuaauuacaucugcaaugaccccaucuucaaauaaggucacauucugagguacuggugguuaggacuucaauguaucuuuaugggaaacccaauuuaaccuauaauguguucuaaaccaaacucguugccuuugccacugaccaaucugccucuucuucauucccugcuacuccugcucagcaccaucuugguuccuccaucuucucagucccuuuuggguuauucagcuccuguaaguuacaccucuggcugcuguguguuuuuuuuuuuuagacagaguuucacucuugucacccaggcuggaguucaguggugcguucuuggcucacuacaaccucugccucccagguucaagcaauucuccugccucagccucccacguagcugggauuacaggugccuaucaccaugccuagcuaauuucuuuuuaaauggagacggaguuucaccauguuggccagguuggucuugaacuccugaccucaagugauccacccuccuugggcucccaaagugcugggauuacaggcaugagccacugcucccagccucuggcugcuuuuugauuuuuaucuccuacugagucccuuugacacagucuaguuuaauccucguucauucuccccauccccuguuccucgcagcauaauccauccuaauugccuagaaaugaacucuaaugaguccacaaacucuccaggcccacccuccuagcuccuuccagccccacugaaaugccacguuaguucuuccuggagccugcccuccucugcccagcuggagguaguuucuccccgcucuuuguucugucuccaugucaccucucuuacuccaugcaacaucuugagcacaagcaagcgugugguagcugccucccagguugcaggauuauuuaggcuagaaccaggucuuaguuacugaaacacacacacacacacacacacacacacacacaaacucuacugugcucgucaugauuuuucacgaauaguggguacuuugacagacucgguagaaugcaggucuccauguggaagcucuggcuacaauucugagguuuugucaugguccaaaggucuccucuucgagucuggcucucuuaacaacagcacucuacuacagagcccugcgcgugcagugauaccugaguuaaucaguacucuggaaguaagccuuuauccagagucagccuuggguuuaucguguuuauuguuuaacuuucugauggacuggacacggagugguugggaagaauuucccaggguaguuucaguauggaucagaugccuguagcccuugaguacugcauucguuuccuggggcugccaugacaaaguguccacagaccuuagaacaacggaaacugucucacgguaacccagaaggagcuggaaguucaaaaucaaguugcacccucugagggcuuuggggaagggucucuuccaggccccucucccagcuucuggcacuuccguggcuacuggcagcacgacuccagccuucccauggcauucucugugugucucuguguccaaauuucuccuuuuuauaaggacgccagucauauuggauuaggguacacacaaauaaugucgucuuaauuaauuacaucugcaaugaccugauuuccaaacaaggucaccuucugagcugcuggggguuaggacuucagcaugaaauuuguugggggacacauaacaaacacauaacagguucucagcuugaguucuucuguagagucuggggugugucugcugggugacuugguuggucacugagguuugcagaggguagagauacacccucaguggugaguagaagggugugaccaucuucaccuguacugucccccucuaggcccugggaaagcaacucccgguuuguacaccuggcuuuuaaugcauugccaggaguucucugauguggaggccuuggcuugguggcaggaaugaugagcuugggcugagcaggcagccugugucaccucugcuugacaggccacagagauuggcaggccgccucagagggagcuuugaagucucaaaguuaaggacccagggccagucacaucuguauuuagcuaauguuuaaacuuguagcucaccuguucuguuucucaccuauacuguuucucccucugcaaacuaaacuaugaugcucagguguaguaaggcuacuucuguaugccaggagagcauagguugucuugcgaggauguccaugguguagagauaugggaauuaugcuuuuaaagugacaaauuuggagaguaagauguuuuuguuuuucuuuggucacauugaacuacuaccugauuuagguguucacaaugaucaaauaacccacuggguuauuugaggcccagcucaggccucaaccaggucauaccaccccucuagauggcaaggggcuacuuagcugucgguugagagucacauccaugccugaccaugucccagcuggacagacugugggcaaguuuccccucuguaaaaaggcauagguguagaccacagucaugaagccauauaaaccuccaacugggacuaguuucauugaauaagcacuugauaagcaagacccugcaaaacacuguacaugcuucauguaacucccacaagcccuacgaggaagaauaugccauuauuuccccuuuuuacagaggggaaacuuuugguucacacagauuaagaaaguuggccacggccgggcgcgguggcucacaccuguaaucccagcacuuugggaggccaaggcagguggaucaccugagguugggaguucgagagcagccugaccaacauggagaaaccccaucucuacuaaacauacaaaauuagccaggcgugguggcgcaugccuggaaucccagcuacucaggaggcugaggcaggagaaucacuugaaccugggagacggagguugcggugagccaagaucgugccauugcacuccagccugggcaacaaaagcaaaacucuaucuccaaaaaaaaaaaucuucuuccucguagggcuugugggaguuacaugaagcauguauaguguuucguagggucuugcuggucaagugcuuauucaaugaaacuagucccaguuggagguuuauauggcuucaugcugugguccacacauaggccuuuuuguuuucacaccaugaaauuuacagagaaauggcgauuguccaaagagcucaucaauugcaugcuuauugacagcuaaacuaguuaauuuaggccacuaaauggaucucccagccauuggaauauuuacuaagcuuaaguuaaucagacaguugccuacauuuauuuauugauuuucuagaccauggagauccgcccugugugcugcuuaauuauaagcucucacacuauuaaucuuuucuuuauguaaugauaaaauguguuuaauauaaugagauuaacacuacugauccacuuuugaaaaugugaucaugaucaaagugucuaauuuuacuuuuuuuuucucggugcgggagagagguggaauuugcaaccaauaaaucuugauucgaugaaagccacauuaaacucuuucuaacaugauuuuaacauaacaaagcuccauuaauguugaugaaagcaauggauaacuuaugcuugacccaaauucagagcauggggcccagugggauagaaaaucauaaacugagaauaauaacuccaaucacagcuaccccuccaccacaaaucaaaaaagauaucucagaauuuaaaauguauuuucauaaugauuaguucuuguaaguggaaaacaucccuuugaagucgaugauauucugcucucuagaaauaauucuuuuauugaacuugacuauauaaauauucauggugcugcguguguauauuucauauuguuucauuaguuacuuuuuagucauuggaauaguaaaaaauguucgcuagguacuaaaaauacuguggaguugaaaauaauuuucauucuuggccacacagauuaauuuacucuugccaaaaaaaaaauuaccuuuacagcuaggcgguugacuaaaugaugaauaagaagucuauauuuuaaaagaauuuugaaaguuaguguccuggauagaacagaaauguuuguguuucagucuuggaauugucugugugacucuaggcaaguccccaaaccucuauuaaauaaaauuuaccccuccguuaacggaaacaaaaguaaaacccccaauuguuccuucagugaucacaguuucaaaaggacugugcuauuucugcauguucacaagaugagacccagaagauuuuggagaaaguaagaggaauguuuuaaguuaguuuuucuaaaacguccucagguuguaucuaaugggaucaacaguauugguugaaagucauuaguuucuucuuuuuguuuucugauagcugauuuagaugauguuacucuucagucgugaugcuguuuaagaaaacuaaacaaaaucaacuaaagaaauagcccacuugcugguagcugugaauuucucauccaguaguuacaguuacugcaagaguuuaaguaccucuucauggagguauuuugaguuccccuuuuccuguaagcuaagcaauuagucucgguucuccaucuaguauacaaaucauggcuauucaccacaaaagauuggccuuuuauguucaaauauugaaaucccaggagauuuugacauguauuuugcuucaggaaaucuuuuugggucuacucuucgggccccuucugucucuguuuacauguugcuaaacuuuaaaugguugaacaaaugguaaagaguagaaacuacauuuaucugauguuuccuaaacuuuaugccucacugaaagcagcugagaaaaugaaaauccaaggugacuaaugcaaauaaaaagauggugaccucuuuuugcaaagauaagcaagaaguagagaugucuccaaagaugccagcgauaggcuuauuugcagaaaaguuaauagcuuaaaaucguauuuagaaagucauaagcugggaaaacaugugacagagagaaaaggaacucaaaguaucagguuugcuuggagaugucuugggauuguuggcguuuccuugagucauguugcuuccucuccggaguuuccgugggucuuccguguuuuagaucuauuucuuuuuuccuuaguucuagaauucgugauaaauuuuacugguguuaugggcugaauugugucccacccccaaauucacauguugaagccuuaacuccuaguaccauagaaugugauucgauuuggagauagucuuuaaacagauaguugagcgggaugugguggcucaugccuguaauccuagcacuuugggaggccaaggugaacggaucaccugaggucaggaguuugagaccagccuggccucaaacccugucuguacuaaaaauaguagccagcacgguggugcacaccuguaaucccagcuacucgggaggcugagaugggagaauugcuugaacccgggaggcagagguugcagugagccaagauugcaccacugcacuccagccugggcaacagagugagacugugucuaaaaaaaaaaaaaagagguaguugaguuaaagugagguccugugggugggccucgauccaaucuaauuggugucuuuauaagaagaggaaauuuggacacggacacauagggaagaccgcaugaagacacaaggagaugauaaaugggguaauaggaaauagauuauuaguuaauuucaccuguuacuuuuuaaagccaccuacaagccuaggagagaggcuccagacguaaccaguccugcucacaccuugaucucagacuuguauccuuucaaaauuguaagacaguaagccacacagucggugauacuuuguugugacagcccuagcaaacaaacacacugggagauaguaauuaaaaugguugaaagagcaaaauguauugaaaaagaaaaaggagucaaggccggcaucuuaugaucuccaugucguucuucccaccaugugcacacgugugugcaaaccugcgcccaccucccacugagcucccuguuaucugcuuauggauuccuggcccuuccugagagccauuaucugcugucaguggaagcagagcauucauuauucccagccagugcagggaggccaggaggauuuauggagucauugcaggaacacaaauucugcuuuguacagacggacaccauaaacgcacaugaauaaaucagggcagaguggaaaaaagaccuacuuuucccuuucucaugaacacaggcaugggggcuagccccgauguuuagugugugauuuagugggggaggaaggaagccucguguucucauagcauagagaagccaucugcagagguuuauugaggaccuccugugaaugggucacuagcgggccuggggcugggaggagcugugauaaggauuccuguguucaguuuaguguacgacuguuauuuuaauuuuuuuuuuuccuggagcugcugugucucucccuccccuggguuuuugcacugcugccccugccaugcacuggcuugcuuugauauuuccccuuagcaucaucugcaucuauuagcuauaucuuaauuccacuguguuguuauuauuguuggcucaguuuuagcuacaauuaauggauggucacuaugugcaagcacuuuccauuauuuaccuuggccaccauuauuauccccggcuuacugaugaauagucggaggcauaccgagguuaaguuuuuugccuaggauuucucagugcugggacucugaccucagcuggguuccaaaaggcaugauuuaauucucauuacaaaugugggugacugguaaucucauaugcacuuugcagaugagaaaacagagcauuucuuccuuccuucauucuccagauuuugugguugccguuguuguuuguuuaauuguuuuugagagagaaucucgcucugucgcccaggcuggaaugcaguggcacgaucucagcucacugcaaccucugccucccgggcucaggcuccugccucagccucccaaguagcugggaccacagaugugugccaucauaaauggcuaauguuuguauuuuuuguagagauggagcuucaccauguugcccaggcuggucuugaacuccugggcucaagcgauccgccuaccucagccuccuaaagugcugggauuacagguguaagccacugcaccuggcccagacuuuguguuuugagugcuaggucucaggcaggcagucagcugguccgugggcucagagggugugugguuugcccaaagccagacagccagaacuucccugucccuuacaguugccucucaccacauguagcuguugaacacuugaaaugugccuggucuggcccggugugguggcucacaccuguaaucccagcacuuugggaggccaagguggguggaucaccugaggucaggaguucgagaccagccuggccaacauggugaagcuccggcucuacuaaaaauagaaaaauuagccuggugugguggcaggcaccuguaaucccagcuacuugggaggcugaggcaggagaauuucuuucuugggaggcagagguugaagugagcugagaucucgucauugcacuccagccugggcaacaagagugaaacuccaucucaaaaacaaacaaacagaaaaaaugugcuuuguccgaacugagaugugcuccaauuguaaaacacacaccagaucucaagacgucauaguaugaaaaaaaaaugcaaaauaucuccuuaagaauuucaaaauauuggucacaugcugagaugauaauauuuuagauaaaugggguuauaggaaauagaguguuaguuaauuucaccuguguccuuuuacguacuguggcuacuaggaaauguaacaugacuuauguggcuuacagaucuugguuggauggcacuggacauguggcugaggcgaggaugucuccuguggauucucuugugccauucugagauugcucagagguaccgguuguucccucugaaccaagagugauagugcccagguggggaccauugaugaguuggacaugugagaagcagggagccagcacggggcauaccuggaagauauaaaaaguagagaggagucacaaccacgugaacauauuucacaccucugaucugugcacuuaaaaguggugaggaugggccgggcgugcuggcucacaccuguaaucccagcacucugggaggccgaggcaggcggaucacuugaggucaggaguuugagaccagccuggccaacauggagaaaccuugucucuacuaaaaauacaaaaauuagccaggcgugguggugggcaccuguagucccagcuacuagggaggcugaggugggaggaucacuugaacccgggagacggagguugcagugagcugagaucgcgccacugcaacuccagccugggugacagagcgagucuccaucucaaaagaaaaaaaaaauggugaggacaguaacuuuuauuuagguguuuuuaccgcaauaaaaaaauuuuuuuuaaaugaacaaaaacuuaaggaguaugugucucacuaugacuauuguauaaaagcauuuaaagaaugaaaauuuuauuugaccauaggcaauugggcuaaacaaaaauugauagaauguaagcuagucaaaauaaacuuuguuccaagaaaaaaaaaguggagagggaggugugggugggagugggggccugcuggcagcagaucaugaaggacuuucaacuucucaucgaggaaucuggacuuuauuuagacgaugaccguaacugucuuuagaaagaagacuguggggccucagcgcgugaaagugcugaaagccgggagggugggggagugcuaggggccuguaaggaggcuggccagggcagggugguggccaggaaggaaccuuucggaggagacuuggcaauccaucguaggggaggggcaaggggaaaggggaugaaccggucgggcaacagguggggagaaggcaggccucagcgaggaggaacgguugugaaugugugacuuuugaaaggcagggagggagaguggggugcaggcugcccaccacgucgggguguccagcugggauucucagcaaguuccccgucauggcuggcgaggggugguugugcauaaccagcccauuguuuuuuggaucccguggaucuguuugcuuuuagauuaugucauuugaggcuuccucucuguuguugcggaguuacacucuggaugauuaaagauggggcagaguuggaagagacugggaacagacagggcuacuggggaaugggagugucugaggauuuaagaccauuggguguucaggguuuuuuuugccaauauauuuaucaguuguguuucaggaguuaaauauuuuggggcauaccaagaugaaucacacacggucucaaaaaacuuguaaacugggcccuuuugacacuuuuccaaaccaaagagacaggaugcuagcauuaccuguuuuaacaauacucaucuccccuuaagauucccgaguuuugugcacuguaagugggcagcacuccggagggacugaggguuaauuuuauccuuguggauaauaaaugcaucuuggacaaaggaagaacacauauuuuaacuaaguagcagccuucugauaagaauuccagcaauugcacaagccccaccguugucuguacagcccagcaauucuaccuugcuaucucaauauucuccguuuugcauuccucucuugcaggaaccaguuucuagucucucaccagcaggauacguuuccagggugaucugcuuacugaauuggggcuggagcccaggcgcagaggauccccgggaaaguggcuugagaacuccccugggugggcgugggaggguuucccagcccugcguugggagcugccauuguuuuuuccuuagucuugcuuuuugccuuugcccagcaccugguucuguuagcaucgccaagaucaguccuaaugagcuuuguuguuuaaacuggggaaggaaacuuuuucccucaacaaaaaggcgaauuuuagcucagcagcaggaggguggccaguggggagccaggggucagaggcaguugagcccugcuacauaaauagcagcaauuaaugggccccuguaaaagacagggauguguguguuugcugucuagcaucguuucucugcaaaucggagcaacacugaaauuaauuauaaagccagcaaaggcuauuuucugcuuucuguuaaauaaguauuguccacacaggagcacguuccacucggaugcauuuacccacaucguuucuuuggaagauggcgugaaaccaauuuauuuucaaaacuccccacugggucaugcuaaucaccacaguuuucagcccuuuuaugcggaauucaggcuugggcuggagccgggagccgggagcccucaggcccuugucauuuccuucauugcucugggggcuuucccuuugcccacccugcccaaaucauuuccuccagugcugucaaccagguuugaauuuuuaugaugagauuuacaaagcaagccauucuguuauuacuaauaaccaucauaaagguuucauaaagguucugcuuugguuugcuggggcuaguacaguaaauaacacagaccuggggggccuucaacaacagacauugauguugucugaguucugcaggcuggaaaccugagaucaaggggucaguagguuugguuucuccugaggccuccucuccuuggcugacugaaggcugcccucccacugugucuucgcacagacauccucuguauucucaucccuggugucucucucuucguaucaagacaccaguccuguuggauuagggcaucacccucauguccucauuuaaccuuauuucccuguuuaaaggcccuguuuccaaauacagccaucuuucuguaucugcagggauugguuucaggauauccuuuuuuuuuuuuuuuugagacugagucucacuccaucacucaggcuggaguacaauggcgcgaucucggcucaccgcaaccucugccucccagguucaagugauuguugugccucagccucccaaguagcugggauuacaggcaugcgccaccacgccugacuaauuuuuguauuuuuaauagaaacgggguuuugccauguuagccaggcuggucucgaacucccaaccucaggugaucugccugccucugccucccaaagugcugggcaggaucuccuucugauaccagaguccaaggaugcucaaguucuugauaacaaauagugucauauuugcauauauccuauacauauccuccuguauauuuuaaaucauccccaccuuacuuagaauaccuaaugcaaugccuacacaucacuucauucacguggauucaacuuagcacuuggcaugcggcaaauucaaguuuugccuauuggaacuuugugaauuauuuuccccaacauuucugaucugagguuggaacccauggaaggucaacuguacaaucacauuggggcuggaauuuugggggaggacacgacuuagcccauaacagauucugaaauaguuaauagauucuucuucuuccaacugcacguggauucauucauucaagaaauacucauugagcgccgccugugugcgggggcuguucuggaugugguaagcaugucagugagggaccaucucuucccuucuggggcuucuaagcgucaggcagauuccaugcucacucaguucugugggacuucagaggugauaagugcuauggaacaaauagccucggggcacagggguugugagcuccagaugaugugguuauaagugggugagucagggaagcuucucugagagcugacauuucgucaggaucuuagagguugagggagugcuauguggccaagauccccaggagggaacaccccuguuucugcugcugaggaacaacgaggaggcgggucaagccgagggagccgugggcugccugaugggaguggcgcaggcauccucaugacguggauucuuuccuuugggagccacggggagccuggguguguuuucaugguccucacuuuuggguagccuuccugucccucuagauucgcugcucuggagaaggugacagcucagacaaguuugggagagagauggggugccuaccaaggggaccacccagaauuagacauuggcaugucaggaauuuuaggggggcgugugggggcugguggugaagaaugaggguccuucugucauggaucgccugcuguaaugcugcgccugugaggucuccccaccaccccuucuccccauguccuguccccaauucuuagucacacuuuuaggaagugagaaaccauuuucugcagcaggaaaaggcuggacggcaagcagggacgauagucacugccuugggcucagcgcggauccuaaauuucuguuucuguugggacuuucccagagcugcucggucuccucguaccuacuuucuagcauuggcauuuggcgucaguuguacggcugcugucuaccccaaauuggaaucuggaagaaacaccugggauugggguuggccguggccaugcaucuguccuucccccaccguuccucccuccccaucuucuuuccagguccaugcuggcccuguuguuauccagggcaugcugauggagcuccuuccagguuccugacgcggugcuggacacuggacacgccagguucagucauuuuugaaaugaccgaggguuuggugccuggaaggggguucugaaaguguucuaggaaaagaaugggccuggccuugaaaaagggugagaaggagccaaaagggcugaucccagcaggggucuggagaugggagaauuucuuguggugacgaaggaaaaccuauuguagccuagugaguuacaggggaaaauaggguuaggagauugugaaugccucggucgggggaggagagggguagaguuguaauuaggcugguuggggaagccucucugagaaggggacauuucucuuuuuuuguucgagauagggccucacucugucucccaggcuggagugcaguggugugaucacggcucacugcagcgucaaccucccagggucaagcccuuuucccacgucagccucucaaggagcugggaacacaggccugcaccaccacagcuggcuaaguuuuuguauuuguuugguagagacgggguuucacuguguggcccagacugguuuggaacuccugggcucaagccaucugccugggggacauuucucacacagaggucugucgacucugcaucacgaucgcacacaagcugaaacgguguccacagauagcacucauauuugauuuaaaugauuuuaauguuugaagggaaggcacuggucugccuacauuguaauugggaaaucugagggcugaagucgugggauuucccaaggcaguaguagagauggccaagaacuuauacuggccuccuguagugcccuggugggauuuuccacacaugcauucauuuauucauugauucccucuuucccuugcucccaugagcccagcacuguccuagggugcugggaggucagacaccauuccuacuuucauggaaaguacaguggaggguaucauagcagcuaagcgugugugugaugggugugacagcuggagaggcccggagugaccccagccagucuggauggggaagcaaacuguaaccugaggccaguggcgggugggaauugggguugaccuggccaagagugugugggagggaauuccaggcugggcugggugggagugggagacaggaggcagagagauuagcagggaggcccaacucugcccgagggaugaugguggggcugcagcaggggaguacaggaaggaaggggaaggggagggaaauuguccaagguggaggugacagacucuuggugaugaaugaggugugggaauaggggcaggguggcuggaggaggauguuacaguagggccaccuguggaugguuacuguaggcugagcugggagccccagagaggaguuggggccgggggaggugacaggcucggaggcccacagauuauccagguggagauggccagaggcacgucagagcucaggaagaggugugagcaggacaggcauuggcacucaugggcagauggacagucaugagcgugcuggaaguggagggguggacgcgugccuccccagcagaggaaggccugggauagaaccucagggaggcuacugggggagaagcaggaggugugggaccugggagggcaagcagggugugagaggucagcagggagaguagccuccgggugccagggacccuggugagguagucacagggaguagugggaguggcaguccggggcaggggcugucugggcuuccgugucuacccacuccucugaaccaaacacgcagagccuacugaccaccacuuauugaggacucugaugaaugcucucagagccaggguuugcagcuucagaggcugugugcccagcugcuguugcugugacguccccagacuggggaaggcaggaggagaguggaagaggaacuguaagaccuggcccuaggccgggcgcaguggcucaugccuguaaucccagcacuuugggaggccaaggcgggcggaucaccuguggucaggaguucaagaccagccugaccaacauggagaaaccccgucucuacuaaaaauacaaaauuagccgggcaugguggcucauuccuguaaucucagcuacucgggaaggcugaggcaggagaaucgcuugaacccaggagguggagauugcagugagcugagaucuugccauuguacuccagccugggcaacaagagugaaacucugucucaaaaaaaaaaaaaaaaaaaaaaaaaaaaagacccggcccuagcccgcagugaaugaaugcuagcccuuuguucuuacauuuuuacucuucugcagggaaucccguagaauuguaggaugcucagauggucuauuagccugcucaggcugccacaacaaaauaccauggaguggguggcuuaaaacaacagaaauucauguuucacaguccuggagucuggaagucugagaucaaggugccagcgggguugguuucucccaaggcucuccccuuggcuucuagaugacugccuucucucuguguccucacaugaccuuucugugcaggcucagagacagagagaguucuggugucucuucuccuucuuauaaggacaucgguccuacuggauuagagccccacucuaaugaccucauuuaacguuaauaaccucuuuaaagucucucucuuuaaauacagucacguuggggguuagggcuucaacauacgcaauucagucuauugcagauggcaaucuugaaccaugacaaagaaucugaauuauccuccccuccccgacaaaugguccuaaagauccaggacucuuuuauaguacagguuaauuaucucuuaucugcuugggaccagaaguguuuuagauuugggauuuuuuuuuuuuuuuuuauauuugcuuaguauccaguggagcacccuucauuccaaauacuccagugaccauuuucuacaggugucguguugaugcuuaacaaguuucagauuuuggaacauguuggauuuuggguuuucagguuagagauuagagauguucaaccugcauacacuuauaccuagaacccuggcagguauauuuuagguguuuaauaaauguuuguugaagaaggaaagauucauuugaguuuaguauacaguauucauuaagaaaccaaaguguucugggaagaaagcuuuuuuggggauaauuuccauaugaaaagaaaacucaguugaucagggcuucccauucccugugcauuuugauuauuuaaaacaugguguaaaagugcuuugauuaaggaaaggcuaugaacuuucuaaaauacagcacauuguauaauguguaaaacacauauguauauuucugcgauauuaaagaggagucucuuugaucaguauauuuuuuuucuuccucucaguuguacagaagauccauuuuacaucugacuucucauuuuggagauuggauacaucaauacuugauguguuucagaguaaugaauuuuaaaggcagugaagggugauacaggaggaagggaugaauuuaaaauccuguuaacucugauccuauguagacagucucagcuaagucaauauuuaaagaagaugagagacucgccugauaggaagucacugccuugggauuuaaaagcuacucuauuccagagaguugaaaacccugagauagaguucagccuucuuuuuuaauaugcugaagccaccggucaaggaaaugcauauuguuuuccuuagcugaacugagcuugaaugcuuauucacccucucuacggguugauucauugaaaguaaauugguaaugauaauaacagcaucaauuuaaggagcacuucguaugugccagacauuguacuaagugcuuucuuuuuuuuuuuuuuuuuuuuuuuuugagacggagucucgcucugucgcccaggcuggagugcagcggcgcgaucucagcucacugcaagcuccgccucccggguucaugccauucuccugccucagccucccgaguagcugggacuacaggcacccaccaccauacccggcuaauuuuuuguauuuuuaguagagacgggguuucaccauguuagccaggauggucucgaucugcuggccucguuauccgcccgccucggccucccaaagugcugggauuacaggugugagccauugcgcccggcccuaagugcuuucuuuauguacauuaucuuagggacuauugguagauggaagugugugucauuaccgggugcauuacugggccugggugauuuugagcaucccuuauucuaaguaaaauucuacauuggauuuuuuucuccuaauaccuaacaaaggccgucaagcauggauuccucggcagucagcaagugaccucucuccugauggguugggauccacacacauggccucuuccuccuguccuguguuggggagagcagugcuucccuuucgugcagggcaaacucuuccuccucuuccucuccuuccuuaagguuuccucucucuuucuuuuuuuuuuuuucugagauggagucuugcucugucacccaggcuggagugcaauggagcuuucuuggcucacugcaggcucugccucccagguucaagugauucuccugccucagccucccaaguagcugggacuacaggcaugcaccaccacgcccagauaauuuuuguauuuuuaguagagaugggguuucaccauguugcccaggcuggucucaaacuccugaccucaaguuaucaccagccucagccucccaaagugcuggggugacaggugugagccaccacacccggccggguuuccucucuuucugucucuccugcaucuuguauuucguuaucucuguagcugcugcuagugauuuuuuggccuugggggauuuccauugcuuucuuaugagcuuagcuauuuauuuaaaagugguuugcugauuuuauccaucaucauugauuggugguguuuguuuggcagggaaggaggaggguggaguuaccguguugugagaaaugcuuucuguuuuuccuuuuucugagacagggucucacucugucgcccaggcuugagugcaguggugagaucauaggucacuacagccuggaacucccagacucaagcgauccucucaccucagccucccgagcagcugggacuacuggcacgagccaccacgccugguuaauuuuugugagaugagguuucgccauguugcacaagcugcuauuucuuaauuaauaaaagaaguugaugaauaaucucuuucaacugucauauauuggaacugugcucuucucuuucuacuaauuuuccaccacugcaggacuuugcuacuaaucuucuuggaaauaugggggaaaucuuuggaaaacugauuccuuuguaaaauuuugaaaaggcuugcaacuuggaucuguugaugagucucgguuuuacugaucuuugacagaaaguuguuuuucuugugcucaugaugacauccaggcuuagauacccuccugaaacucccauucccaaacauacacacacacacacacacacacacacacacacacacacacacacacacacacacacacacaccccuggacugaauugggaguucccuggcggcauuggcugggggccucauccuuaagugaaucggggaaccugcagcguugguaagagccauugauugguguggugcuaucacuccuguugccuggaacaugcuaaacuugcuuauuuuacugccauuugauagcaaagauuuaauuucacucuguaaaacucccccgacucaaguaguuuauuuugcagcuagagauccauuauugcauuaggcuuuacccaguuagagucaguguuagcuuuguuuugccugcaaaccucugauuacugucaaauugaauuagaugucucccuuugcugaucacugauugacuuuuccuuaauuucccauucauuuuuuuuccccauuucaguuguuauagaugaagucgauuaaaugguuuuguguaaucaagaacggcauuccauuucaguauuaucaacuuguaaguauggagcuuguaagucaggggguggaugaaaacaagcugauaaugagcugguauuugaaaauugagagggagcuuaauaggaaaccuucuccaaggugagguagcuuaagggcucaggguuuucauggagggaaccuugauggcagaacuugggaaucaaggugucagaugaugguagggcacacaccagggguguuaguuuccugcagcugcuguaacaaaugaccacaaacuugguggcuuaaaacaacagaaagugauucccucacagucuggaggcuggaaguccaaaaucagucucauuggagaucaaggugucaguagggccacgcuuccuccagagaccuaaggggagacuuggacuuugcuucuucucccagccccugguggcugccaugggcaucuccugggcuuguggccauguuauucucuugucuccgucuucacuuugcuuucuucucugcuuguccaucugauccccuccgucuuuuaaagacauuuuugauggcauuuaggacucacccaguuaauccaggacagccuccccaucugaagaccauuaacuucaucaugucugcagagucccaucccccuaaagaugacauuuucagguuccagggauuaggaugugggccuaucuuugggaggccauuuuucgacuuaccacacugggccugcuucacggaaggccuugguacgacggcccaaggccugggcuggacugagugguaugagguugaggggcuggacugagcgguaugaggaggaggggcuggacugagcgguaugaggaggaggggcuggacugagcgguaugaggaggaggggcuggacugagcgguaugaggaugaggggcuggacugagcgguaugaggaggaggggcuggacugagcgguaugaggaugaggggcuggacugagcgguaugaggaggaggggcuggacugagcgguaugagguugaggggcuggacugagcgguaugaggaggaggggcuggaaugagugguaugaggaugaggggcuggaugggguuuccaggggguauuuccccagcaccauagaucaccucauugccuuguccuuucaccuucaggaaagggaggaggaugggcuagagaaagagcaagaagugagagaguggggagaaaugcuuggaaauacugcauuugcacagaaguuggaagguacaggaagaacugccuaaagaaaagccuagcaugcacccuuaagccuggcaugugggaaccaacaccaauuguuaggaugacuguaaucguacggcugugauaaugaggucuagauucauggaaagagccaccugggcuguccuuucuguucagaguggucugcaguguagacacuugcuaaccaauuguggagcuucauaggguccuauuuugacauagcucauggaggugcaaaacccugauaugggcugguucagcccugggaguggagccugagagggaguucgugaagacucugcucuccgugggucucauggacgugcgggagcagaggggacgguggagucaaugaggaauugucagaggcuccugagacuacgcugaagggcuagagugaggaggagagagaggcugccggugaaagguggcgucauuccccacugccaaggagggucucuccaugccuggaaaugcgucccaaagggcaucagauagauuccuuauauuuucagggaagcuauuuguuccuuguggcugcuauaacaaauuaccacucugguggcuuaaaguaacaaauugauucucucacaguucuggaggccagaagucuuaaaaaguauuggcagggccacgcucccuccagagacucuaggggaggauccuucccugccucuucuggcuuccaguggcagccaacauuccuuggcuugucgccccucaccccaaugucugccuccuuccuccuguggcugcccccucugcuuauuugugugaaaacuccuucuuucucuauuuuauaaggacacuuaugaggacauuuagggccuacccagguaaucuaggcuaaucucaucucagaauucuucacuuaauaacuucugcaaagacccuuuuuccaaauaaagucacaugauccagagauuaggccauuauucaaccugguacaggcaauugaagaacucaauaagguaucuuaacuauaauuguguacucuguuaaaaaggcagauuguauuacugcugggccuuuagacuuguuuguuuacaguacuuguaagaauuucauugccagaggguguaauuuuuuagauacugccacacggaguggagcaaagacaaugccuaauuguacuuuucagcauucuuuuuucuccaccuccccaagaggauggauaugaaauaugugugugucuauguguuuuuggaggguaacaguuaacaaagcuguuaguuuagcaucccuugaacuacuuggggccagacacagccagaguguaacuuuaccuccugggggcugagagcaucagcccgagcugacuugagguagugcaggccccaugcugugagguguggauggcaggggcucuucuagccugucugguccccuugggggcugauugacucuuuguuacucccaucuuuggauuaagggccugaaccucccuauuaaaaugagacucugggcugggcacgguggcucauuccuauaauccccgcacuuggggaggccaaggugggcggaucacuugaggccaggaguuugagacuagccuggccaacauggccaaacccugucucuacuaaaaauacaaaaauuagcuggaugugguggcgggugccuguaaucccagcuacucaggaggcugaggcaggagaauugcuugaacccgggaggcagagguugcagggagccgccaagauugugccacugcauuccagccugggccacagagcgagauuccaucucaaaaaaaaaaaaaaaaaaaaaaaaaaaagaaggagacacugcucuauagaggagauaauacauuaugcuguuuauagccaucuuugcuuuggugauuccauugguuagucacuauuagucacuugcuguuuaugaagcgcugugugucgugaagggggaguggucccugcauuaagccaugacuuacaucuuacugcagaugcuguuguauagggacguagggaaggaaggugcgggggagucucucugguagggagguuagccucugaaggaccugggguugggggcuugagugggggaaggggguggcuggaguaccuggagagugauagaaugcaugucccagggagugacaagacaugccaggagggagagcugggaggaguugggaccggguggugguggggcugauggagaagaugcuugggugcucccauaggcagcagugagaccucaagagcuucugcaagaaaucagaguucuagacccacugauuuggaggcagaguguagaaugaauucaagaggccaggaggagccucaagaagaggugacauccaugccuuaguucacccuggggguggccagacuuuuauugauucguucacuauuuuguuuaauuuaaaguuugccuuuaguuuggacuuuuucccuuuuuuguuuucuuuuuguuuuuuaagguuuucuucagcuuuauugagguuuaacugacagauaaccgcgugugcuuauaguaugcagguuaugauaagugagcauguugugaaaugguuaccauggucaagcucauggacauguccauuaccugacaggguuaucaguuuugugugugucuugagaacauuaaaaaaucucucagcaauuuucuuucuuuuuuuuugagauggaguuuuguucuuguugcccaggcuggagugcaauggcacaaucucugcucacugcaaccucuaccucccagguucaagcgauucuccugccucagccuccugaguagcugggauuccaggcguccaccaccacacccagcuaauuuuuauauuuuuaguagagacaggguuucgccauguuggccagacuggucucgaaccccugaccucaagugauccacccgccuuggccucccaaagugcugggauuacaggcacaagccaccgugcccagccucuuagcaguuuucuuucuuuuuuuuugagacggaguuuuguucuuguugcccagucuggagugcaauggcacaaucuugggucacugcaacuucuaccuccuggguucaagcgauucuccugccuaagccucccgaguagcugggauuccaggcauccaccaccacgcccaucuaauuuuuguguuuuuaguagagacaggguuucaccauguuggccgggcuggucuugaacuccugaccucaaguaauucacccuccucggccucccaaaguguugggauuacaggcacgagccaccacgcccggccucuuagcaguuuucaagugugcaauacauuauuguuaagccuggucaccaugcuguacauuggaucucagacuucuguuuuuuucuuuaucaugaacuauguccacaaaauaauauuugagccccucacugaaaacauguauucaucuguauuuauuuacuuauuauuuauuucuguacuuguaccucuguguauggcauauugcauauaaugcauauugagugcguugugaaacagguacaaaauguaauuacaaaaaagagaaauaacaagaaauggaagguccacugacuucauccugcacccggaggcuccauagcuguguaugaagguguuccugggaugcucaugucucaguucaugacagggcaucugggcacuggggcagugguuggaaugaaccaggcgggugguguaggggaacagagaggaaggacagguggcgagacagcuggaagaagacauugacaucauguguugacgucaguggcugaucacauuagagaggggagugaagaaaaaagaaggaacagggcagccggcguggugacucacgccuuugacgccggugcuuugggaggcugacaaggagaaucacuggaagccaggaguucaagaccagccugggccacauggggagaucggucucuacaaaaagaaaaaaauuagccagccgugguggugugugcuuauagucccagcuccugggaggcugaggugggaggaucacuuaagcccaggaguuugaggcuucagugagccaugauugcaccauguacuccagccugggcaacagagagacucugucaagaaggaaagaaagagaaaaagagagagauagaagaagaaagaaaggaaggaaggaaagaggaaggggagggagagagggaaggagggaggaagggagggaggaaggaaggaaggaaagaaggaaggaaggaaggaagcgagggagggagggagggagggagggaagggaaggaaaagggugaauacaauggagaggugacuuccccuaaaggaaagaggacuggggacagaugcggauuuggguggaauagacaaucuucccuucccucuguuccuccauccuuccuucuguucuucccucccucccaccguaccucuuaugacaaguugauuguaggggcaauggcccaggaggagcuuccugaggguaguagaaaugugauccugaguaacaacaaagguuggguccugacagugggggccaaguuucccuaggaggcaauucaucaagggaaggagguagacccugaggcuugagggugugcacagggcagggcggagcgggggcgggcaaggcuaggggugcugcaucuuugggcagugucccccaaccaugccuuggaacuaagauugggggaagauuuagcuguuucugaaguggcuggggguccucagaccuggagggagaugauggugaguccugagggggacugggacaagcccuuugcuggaagagaaauuguuauuucaucuucccauccuguagaaaaauaaauuugacauuaauccugcacugugccuuccagacagccauucagguuuucuuagguaaauuccauugucuuccuuaauaauuggaccuuuugauuuuuccuaauguuguaccuauauguguguguguguguguguuugugugguauaugcauaaauauaaauguguauauauauauuuucuguugaugcuguuuuagguaagguguuucuccucugcagagacauagcuagcauuuuucuuggguuccugugaguagccaaggcaucgcuauugucuguaaugucugauaacaggcauguucuuguuuucuccuuagguggccauaaaagucauugauaagaagagagccaaaaaggacaccuaugucaccaaaaaccugcggcgagagggucagauccagcagaugauccgccaccccaauaucacucagcuccuugauauuuuagaaacggaaaacagcuacuaccuggucauggagcugugcccugggggcaaccugaugcacaagaucuaugagaagaagcggcuggaggaguccgaagcccgcagauacauccgacagcucaucucugccguagagcaccugcaccgggccggggugguccacagguaagggccaggccacgcuggugaucgcugacugugugcuccguggguggcacugggcuguggcacccucugagccucugagaaaggcugagcaauugcagccuguuuuacaauuugucuauauuuuaauuuuauuuauuuguuuauuuuuuugagacggaguuuuguucuuguugcccaggcuggagugcaauggcgcagucauggcucacugcaaccuccgccuuguggguucaagcgauuuuccugccucagccacccaaguagcugggauuacaggcaccugccacaaugccuggcuaacuuuguuguauuuuuaguagagacgggguuucaccauguuggccaggcugggaauuuuucuguauuuuuauuccauggaauuguuuugugaauuggguuaaugccagugugaggguuaaaagaguagaaucugaagccagagugacugggcuugcaaccuggcucugcccuguaacaguuaugugacccugggcaaguuacuuaaccucucugagccuuggucucuuaaucuguaaaaugggaauaauaauaacacuucucucucaguuggaguaaaggucaaugaguuaauauaugggaagagcuugggacaguguuuguuaccuaguagguaucagguaaguguuagcugcuuuucuucuuguuugcauagucaugagaccaguuguuuaggugccugaaagagccaguguuaaaauggcaugagauucgugcuagggaugauggugcuuucauugucuuugcuuuacacauaguagacacucaauagcaguuuuauucaaugaaauugaaucaccauucgaauuuugaacuugcccuugaaaucaaggaguguuuuccacaaaccaaaccagucuugcaaauaguuaggaaaaucaagcuuguuuuuaauauccuguuguuuccuaggaaggggcucuacaaagaaagugaauggaaacagcguucuuggcaauguugccauugguagugggugccugcuuuuaguacuguaugaaaauaaaaucaaacaaauuuaaagaaauaaaagcucccucuuuuccuccaagggaguguuggcuucaccaauaaaugcaugguucuuccuuuguggaauuaugaucaauaauuacucuggguuauugagaacaaccagaaauauuuuuuuuuuuuuuugagacugagucucgcuuugucgcccaggcuggagugcaauggcgcaaucuuggcucacugcaaccacuucccagguucaagcaauucuccugugucacccacccuaguagcugggauuacaggcaugugccacaacgcccggcuaauuuuuuauuuuuaguagagaugggcuuucuccauguuggucaggcuggucuugaacuccugaccucaggugauccgcccuccucggccucccgaagugcugggauuacaggcgugagccaccacgcccggcauagaaaucauuuuuaauuggugcuuauuuuaaaaagcaagauugaggcaugacauauuuauguguguguauauauauaaacaugcacacacgugugcacauguauguuuaaauauuuuuaaauuaauaaauuuauauacuauaaaagucaccauuuaaaaguguauaaucuaguguuuuuuaguguauucacagaguugugcaaccaucaccaccuucuaauuuuagaauauuuuuauuaccccccgcaaaagaaacccuguacccauuaccagucacuccccauuucccucuucccccagcccuggcaacuacuaauuuacuuuccgugucuauggauuugccuauucuggccauuucauauaaauggaauuauauaauacccggucuuuugugauugcuuucugucauguagcauuauguuuuucagguuugucuaaguuauagcaugugucagugucuccuuccuuuuuaugacugcauaauacuccauguauggauauaccacaauuggcugauccauuugaguuguucccacacuuuggcuaguaauacugcuaugagcgcuguuuucacuucucagaaaacuccacucuuaggaguggaauugcugggucauaugucagcuuucuuuauccuuuugaggaaauauauauuuuaaaaaaauucaacauuuaaugauaaaucuaauuuuaauuuuaauaaugauaaucuagcucuauuugaaggccauuauucuuucuuucuuuccuuuuucuuucuuucuuccuuucuuucuuucucucucucucuuucuuuuuucuuucuuauuucuuuauuucuuuuuuguuuuuuguuuuuuugagauggagucucacucugucgcccagacuggagugcaguggcacaaucucggcucacugcaacuuccgccuuccggguucaagagauucuacugccucagcuucccaaguugcugggauuacaggcacgugccaucaugccuaacuauuuuuuguauuuuuaguagagaugggguuucaccauguugcccaggcuggucucaaacuccugaccucaaaugauccacccuccucagccacacccaaagugcugggauuacaggugugagccgccgugcccagccaugaaagccauuuauuuucaggccgggcgcagugcucacgccugcaauuccagcacuuugggaggcugaggcaggcagaucacgaggucaggagaucaagaccauccuggcuaacacagugaaaccccgucucuacuaaaaauacaaaaaaauuagcugggcaugguggcaggugccuguagugccagcuacucuggaggcugaggcaggagaauggcaugaaccaagaaggcagagcuugcagugagccgagaucacgccacugcacuccagccuggacaacagagcgagacuugucuggaaaaaaaaaaaaagccauuuauuuucugaucagugaugaaagcagcuccaggccuuuacuuaauagaacuuagacuuccaagguggagagagcugccuccuuacuaacgggauuggugccgugggaugcucugcccucucaugucuaaacccaggggaggaccauuguccaggccuuuucuagagccagccuuggguaggcaccauucaggccaaucauuuccgccucaccaaggugagagcaccucuucacauacguauucuuagucaugcauguugucaugagaucacccuucauuagaacucuuugggcuuagauuagcaaggaagagaacauucagaaaugguaagugaaucacgcuauuuuuggcucuucccaacaauacccuuggguagccugaggugucauaacgcugcuguuauuaggaaaaugauagucguaagugugccuggcucugucuuuguuuauuaagaugacaaaggcagaaaccucacaagugaaucagcuuggaucaccgacuccgcaggucacaguggaaaauagaaccagggacugggagcggcagaucuuucuguaguacucaggguguuuuuuccaaggguuuugugcugucaaaaagaggaugagcaccgagcuucucaggaucgcgagaacaacaaagaaaaccaaguggaagcugugccuugugcacuggccucuccugcaggaaauucucaacagcccuuuuaaaguaauuuuaacaaaauccaaucccucucagcgcaauuacugucagaaugucaaagcaaugaauuuaauaauguuuugauagcaaagacgguauacuuuuucuuucucugaucuccagcuuuuucuacuuuugccucucucuccucaggaauauauuuauaauccaauaauggcaagggcucagaucuuuuaaaguuagagaagacuggagauacagggacgauuuaggaagauuuuuuucacuuuucccucuaaaaaucauguuaaugugugucaccgcacacggacauaggugauuaggugguugagaccucacauuaaaaugcuuguuuagaauauauucauaguggcuuuaacggaaugucuugacuuucaaagacucuauaccacuaauuuuggguguucguauuucagcugaccacugguauguucuuugcuggagcgcuuucucauaaagaauuuucuccuuuaugcugcaaagguggaaugaauuucauaaauuauuuugagguuagauuuuucaaaugaauaagagaguauugcauuucagagaggcccuggagucccuggugggaagauuucuaaguaaauacauuggaugaugcaaaaggaugcaggaugauuuuuuguggcuauauguguacagugauuuaaggggcuuuugguuguguguguguguguguuuguguguguguuaggggaugcuuuaaaaaugcaguuccugauuaggcugauauuauguuauuaugucauaaucaacuuaaugcuagcagagcccucauuuccuguggcauuaaauggaaauauuuauuuaucuuuccagaacuauuuaaacaucauuuaaaagaaacaauaaauaugacaaguagguuuuguuuuuuuuuuuuaauacaaaggaaacuuagcauguauaaagcagauucacuuugcuggcagagagcuuccuauuagauuggacuugccacagccucugugucuagggcuguuguucauuuuuacaaagguagaguguguucuaacuucuuuauuauucuauuuuagaauugucuaagcuucucuaaaauauaacgaguuguuuuuccuuccccuaaacgugcuuacugagcaggaugccaaaaucugaugauuugccuauuguauauagagcaucaacucuuaacgugaaucaccaagaacgccgauucugcugagaggcuaauuugagauucauguguucauucaaaauaacaaaguccaaucaaacuauacagauaaaacacaacuggguaauacaauaccaccaucccuaagcaggaagagaaaagccacggggcugcaggaccaggagaaagagacacaugaucaaagggagcccgagccugagcucggaugugugucaacaccguggcucccagggccaugaccuuauccauucaucaauauggagaaaagggcucucugcgcuuaagaggaaggcaguggaagagaggaggcccuucuuuguucuuuugggccugacaagaagcaggcacaaccugugcugguuaggggguuaagaaguucuguuaacuuucagguuuucuuggauuucugcucacauccaggagcuggguggaaucccagggccuucugcugagagcaagcacauaucuggaggcaucaguuacagcaaaaguuuuguguuuaauuggguuuaaaaaaauagcauuggaaaugugagcucuugcaaagcuccagcccaacagcuucauggauugggauguacagugguccgcagugcugaugcgaaagccugacccccuuguccauaugcugguuugaccacucgaaaguggcgcugggcaaaucgcucaggcuuuugugccucucuuuccacagcuacacaacagggaaagcggauuauccacuucacauggcuguugugaggauuaaauaagucaaucugcauaaagcacuaaaaacugagacucuguguaaggacugaguccauguucucuguaauuacuacucaguccagcccauucauuuuauccacgggaagcugagacccacaguucuccgugcugagggucccacagcuguucucugcuugcacugcccuuguuggcuuuggcugaauucuacucauccuucaggucccagcuccaggcucaccuucucugggaagcccuccaggcuuggcccccuggccauagacucucagcacccucuacuuuucuuucugagcacguaucccaugguuacuuuucucuaucugccuucugcacaggccauagcuuagcccagugcucagcccagugggcacacaguaagacuuuguugaaugaaggaaggaaaauugaaugaauacagcuagugucagaguuugcacugggauggaagcuuucugguagccaguccuauguucuggaauaguccauauucucccuggaauuucaaaggaguuucuucauugacuuagugucaauguguuuauuuuuuaggucacaauuuguagaguggcaucuuucuagugaaugggucuuucaguuuuauaaacagaauuuguuucuggaacauuacgggaacucaauaaagguuucauuuugaauaaauaaaucagguucauggaugacacauuauucuuguauuuuaccaaaauacccauauuguaaauaaaucaagaauuugcacaucauuugcuuuuaauacagugcuuuugaagauaagaccuaaccaaaaaaaaaaaaaaaaaaaaaaaucauguucccugcaaaaugccuguugccuuggggaguuaugugcuuggggaguuugggaugcuuuauucuuaguuuauuauuaaaauccaucuugugaccaucccuguaggcaaaacuuuuuccauccaacuuaauccugucugaguugggucuauccuucccugggccccuucucucuuaccuuucauugggcuggggggcaugccccccaauacucuuugcuuauggccaaauuaaucaccucuuuuaaguauuuucuggagucuuuccucuucaccuugucuuagaaucuuucacuuuauuauccucaccuccagccucucaccucguaaauggaguggcccgcaaagcccucgggaauccacuguggcaucucccucugccaguggcccugcuggguaacccuucucaugauggucggguuccaggggagaaucagaagcuccgagaguuuaaaugacuugcccgggccggguuggcggguccauuagagagagccagaccccagcaccuguccuuacucccuuccccaggcccccuugcuuggcugccugucuuugcucagccuccucacucgggguguucacugguucugccacgucucacgcucuccuccccuucccuccucuccugaugccucgguguuacaccauucaguucuuuggacucaacccugagcggcucccccaggcucuuuccugaguuccugccccucagccuagaccuccugggcugggcauggucuguggaggcccaggggagagacugccuucucccaucugccuucucccaucccacaacccuggaugcaugugaugcaugcacgcgcgcacacacacacacgcgcgcccaccgccauauacacagggugcacgcugacacagagcucacacguguguaugcaacacguaugugcaaacauguguacauucauacacccauggaugcgugcacaugcaugcacacacccacacacguacacucaugcucucccccacgugcaugcacauacgugcacauagucacaugaacaugugcucacacuugcaaugugcccacacaaacucauguguacuuacacacucgggcguaaacacacacacacacuccugauuuccacuuccccagcacugcuccugucugccucuuugcuccacaggguuggagcagcugccuuucugcccccaggggugggggaucaccuguauguuugucauggcaacaggacccucccugacucuccucccucgcacccucuguccugaagggcagugacucaguuuauggcggccagucucagaacuuuccaacugaccaucuugaaagagaugcaaggagagucuggguggguggcuggaggggaggggaagggguugcuugguaggcugugggggaaccuugaaugguuagucauggccuguuugcaugcuugugcuuuugaaagaacuucaaacaaagggcugugauuaggugauaccuagaggguguggaggagucuucuccccuuagguccuuuccggaucucuguaaaaacacccugcacuuaucucaacaucuggucugucugcugugauggguccccuuugagcauuucuuccuggaacugccuaaugagcagagaaggguccugaagccuucugaacccacaccacugucucucuaguggccucuucucugcugagcucccugcuccugcuucaccguggcuucugguugguauaucgguguugccuguuguuccuaagacauccccugcaccccugcauccucacccccagcacuguccucaccaacccauccuccugcgcugccuucuuccuuuuuuuuuuuuuuuuuuugauacagagucuugcucaaucccccaggcuggagugcaguggugcaaucucggcucucugcaccuccaccugccagguucaagcgaugcucaugccucagucucuccagccuguagcugagacuacaggcgcccaucaccacaccuggcuaauuuuuuuauuuuuaguagagacaggguuucaccauguugaccaggcuggccuugaacuccugaccucaggugauccaccugccucagcuucccaaagugguuggauuacaggugugggccaccaugccuggcccugcacuaccuucugugccuugagccacaccccuuuguugcuucuccuagcuccucuuugaaggcccauuggccaagaaaaagcaacuucccaucuaucccagggccauucucuucuccuucacauuuguucucaguuaaaaguuaacacugggccagguacagugguucacgcuuauaaucccagcacuuugggaagccaaggugggaggaucaccugaggucaggaguucaagaccagccuggccaacauggugaaaccccaucuuuacuaaaaauacacaaauuggccgggcgcaguggcucacgccuguaauccuagcacuuugggaggccgagguagguggaucaccugagguugggaguucgacaccagccugaccaacauggagaaaccccgucucuacuaaaaacacaaaaauuagcugggugugauggugcaugccuguaaucccagcuacucgggaggcugaggcaggagaaucgcuugaacccaggaggcagaggcugcagugagcugagauugugccacugcacuccagccuggggaacagagcaagacucugucucaaaaaaaaaaaaaaaagguuaacacugaauuuccaguuuauaugccacagggggagcucuucagacggcaggacugaaggaagauccucccacuucccucuccccuccaugaaagaaguuaaucagaucaaggaccauucacgugaagugggcauucuacuucccucaccgcaucgucaugugccgaccagccugcccuucaccuuccuucccuuaaagcacgucucacacuuagcagagccaaauguuuugcucuugggauggagcuagaguaaacaucaggcuuuucacauggaccacaaggagguuuucugauagagccaguauucuggauaauauaggcuugcucauaauuuuuuuaaagguccauuauaauacacgaauacugaggcugggcgcgguggcucacuccuguaaucccagcauuuugggaggcugaggcgggcggaucacgaggucaggagaucgagaccacggugaaauccugucucuacuaaaaauacaaaaaauuagccgggugcgguggcgggcgccuguagucccagcuacucaggaggcugaggcaggagaauggcaugaacccgggaagcggaacuugcagugagcugagaucacgccacugcacucuagccugggcaacagagugagacucugccucaaaaaaaaaaaaaaaaaaaaauacacgaacacugaaaccuuaugaagaaauucaccccuuuuaaaacuuucaacuuuuauuuuugcuucaggguguaccugugcagguuuguuacauggguauauugcgugaugcugagguuugggguacagauuccaucacccagguacugugcauaguacccaacggguaguuuuucaacccucguccuccucuuucccacccuucucugguaguucucaguaucuguuguuccugucuuuguguccauauguacccaauguucagcucccacuuacaaggaagaacaugcaauauuugauuuuuuuuuucuuuguuaauuugcucaggauaaugacuucgagcggcauccauguugcugcagagggcaugauuucauucuuuuuuauggcugcaugguauuccaugguacauauguaccccguuuucuuuacccaguccaccuuugauaggcaccuaguuugguuacgugucuuugcgguugugaauagcgcuguagugucuuuuggguagaaugauugauuuucacccuuuuuuauuccaguugucucucaauuuuucugccucuuuggaucauuuguguccucuuugaucacuguugaguagcugagcagagggucuggguugcucacuguucugaauggacucagggacauaacuucagggggcuaaggaugucccacagugaacugccugagugaggcacuugguuguaguuguaccauucuuaguguggauugcuuaggaaagggaaauguauccaaaagcugcuuuuacaaaaaucuauagacaauguuuuuuagagcaguuucagauuuacagaagacuugcauagaaacuaugagaguucccgcauaccuucccccuacucacauuuucccuguuacgaauaucuuguguuccccuggcacauuuguuacaauggaugaaccagcauggauacagucguauuaacuaaggucugaguuuaccuuaggguucacucugugauguccaguucuguggauuuugauaaaugcacaguaucauguaacaccacuacaguaccauaaagaauaauuuuaacacccuaaaaccccucuauacuccaccuauucaucuguccuuuuuucccucucacaccccaaccccuggcagccacugcucuuuuuaccaucgccauagauucccagagugucauacaguuggagucaaacaguauguagccauuucugacuagcuucuuucaauuaaaagcaugcauuugacguuccuccaugucuuuccaagugaaucacaccauuuuuggcucaucuuauuuguuuuuaucacugaagauaaaaagauauucuguaauaucuuaucucuuuuuucuuuuucuuuuuuauuuuuugagauggagucucacucugucgcccuaggcuggagcgcaguggcacaauuuuggcucacugcaaccuccgccucccggguucaggcgaguagcugggauuacaggugugugccaccacgccuggcuaauuuuuguauuuuuaguagagacgggguuucaccauuuuggccuggcuggucuugaacuccugacuucaggugaucaacccgccucagcuucccaaagugcugggauuaugggugugagccaccgcgcccaaccuuauuucuuuuuaucacugaauaugccauuguuugggugugccaacguuuguuuauccauucugcugcugaaggacaucuugggugcuuccaguuuggggaaagaaugauugaaacugcuauaaacauuuauguccauaaguuuuccacucauuuagguaaauaccuagguaaaagcuauuuuaaaaaaugagauuuuagugccuuuuguccuaaagucuggaagaaaguguucucucucuuccuauuggauaaguuacaaaggacagagcaggaaguggaaguaaauaaagccaaaggcuauugaauguucuuuucuuuugcguggguaaguacacugaucuuuuggacagagacagaaguagcucacccucccauuaacuagccauggaaccuuuaagcaguuggauugguugucacugaaaccuuuuagaaaucuggacaaauaacccagguuaaccagguuuauucugugcauuuuucuuaggggaugggaguugguuauaaugggaugcuaugggugggaagauagugacuuugaacugauuuuauuuuuuucucaguuugccuaauaauuauuuuuaauauguccugcccuaguuuuaggacauuuccuagauuugaaaagcggauauuuuuuuuucuuuugcauuuucucuuauuuuuggucuuucguuuauaucauucuucuaaucacugugguuguucucuaggcuuuuguggccccagaauuacccaacuuaguuuuauuguucuuggcaguugcugucuuuuaccuugccucuuuaggauguuuuuccccacaguauuugcucugaaccaaauuucuccuuuaaugccuuagaggggcuuccauucuucccaggcaaagagggcuuaacuucguuugaaacaaacuguggccuuccuuuagauuuagagaguacugcuguuuauaaucaggguucacggaaucacaguuugggauauugcuggcauacuauuuuguguaugcauguguguguuucggaauuacuguuuaugccugaauagaagucaggcugauauuacaucuucaguaucuucagaaaagaagaagugccuuacagaguccuugcaagucucucauaugauaaggacacaauuucaaucauaguauuuuauuuucaauaacaaaguacuaguuagagaagacacauaaaccuuuauuuggcucacugaugacuuugggugcucuagaaaucacucgaggaacccaguaggaaggaagguaaaagcauuuauggggcuuuaauaauaacuucuagagauacggccucuugauugugagaguuugagagaccagucucaaaacaguucacugagugguuaauuuauggagauuuuaaauggguguguaugauuugggauaagauuuccagcaagugccucauaugcaaauuuuaaaaauacuuuaucucaaauauccagucaccugaaagaucauguuacauugaaccacugcacaaggacucaaaaagucauccugguucugccugugacuaguuugaauaaaauuguuucaugaaaugugacaguguggaaacaguauuucuuaaauuaacuauguuaaccuuuuaauguauggucuuaaauaggaggaugcagcuucaaagauaaguaguaucaacagucauuuaauaauucuauugcauuccuaaaaauuauacauuuguguuuuccaaaaaccuuuuacugagggacaaagucuuccuguuggaaaagcgaggauaucacuguauauuuggagucacccuauauuuggacacgugauaucuuuaaaaggcagacacaguuuugaaguauucuguguauuguuucauuuggagugaagggaaaguauguaauucuucuucccauuggugggcacauuggauuggggaaugucuguuuauauccccaguuugaacauggaucuuccuucucagccagugcccagccuuaaggcuauuggcaacucugaaucuguuggacaccuuuuagaguucaccuuuuuuucugcauuugacuccuuaauucuuaccaucuuguaguccugcccuuccugugacaacagccuggcugacauaaccccugcccaccccgcaacuguucuuucccaguuugcugugaaugccaguguuccccaccagccuguugggucuuucccccgcaccacuucucugcccucaccuucacaaucucacguccuuucaaggcuucagcaucugcccauauugagguugaaaacugguagccugcaagguugggguuaugguuguuuuaaauaugaguuuguugccaacauuuaaaaauugagaucaaauccagaccucuggcuucuucuguagaaugaggugagcuggcaguguugggaccgagccgugaguagcuguccccguuaaguggggcacugcuguccuguuugccacagccaguccuagcuaucgcuccuuuuuguuucagacauugacguaguguaucaguugccguuuuuguuuuaacaugauuacgccauucaguucccuacaauagagauaagaggaaaaagaaacauuucucuugcuuaucucucuauucaaaagugagaaaauaaaagcuggaccaagaaugguauguuuaaaaacgguggaagagaacguguguuuguauguguguguuugugugugucugugugugugcguguguguaagaguguuuuuacauaguuaacauucaagguaugccugcauuggcaggcuacaauuuaagaugccagagcugauaauaauugaccuagaugguuuugauguccaaguacauccuuugcccacauaaauacuucugcuucugaaaucucaaaugaucucaucgguaaucuggauucauugguauuuacugaguaccuggaaugugcaaaaguacuggggugcaaugggaagcaggguagacauguuuccugccuucuaggagcuuacagucgcaggcgcagacaccagagacaccucacacucaacaugacccugggcucauuucucccuuccaccuccucccgucaccucagugucaaugcauggcaucacccauuaucugauuagcaaucuucauuccaucuggaacuuaauucccuugagcucuguaaaguuaacauguucucgggugugacagcaggaauuaggacaccaacaucuuuggaguccauuauuuugcccaugauaauaucugccugcuaaauagauuaacuuaucaucaccugccaguuuguuaugacccuugggcuccaaacauggaggucacuggacucaucaauuaaguuggcuuucauguguuuuuuuuuuuuuuuuuuuuuuuuuugagauggaguuucgaucucauugcccaggcuggagugcaauggugcaaucuuggcucaccacaaccucugccucccggguacaagcgauucuccugccucagccucccgaguugcuggaauuacaggcaugcgccgccaugcccagcugauuuuguauuuuuaguagacacaggguuucuccauguuagucaggcuggucucgaacucgcgaccucaggugaucugcccacccuggccucccaaagugcugggauuauaggcgugagccaccgugcccggccucauguguuguuuuuuuuuuuuuuuuuuuaaauugcuuccccaaaucugauguugcucauagugucaccaacccagggccacauucauaugaaauauuugccuggccgcucaggcugugccaucuugagugauguguuccucucuccccacacccugguucugcuuaacuuccagguuccaguuuaggucuugcuuuuuccagaaacuuuucaugaucccuucuguccucuuugcugucugucaugucugaaauucuucagcuuuuauagucuacagcaauuaauuauuaauauaucaugucuuuuaaauauuuacuuguugauugaguuuuggcagaaagcuuuauggguugguuagaaguggcucuaaaaacaguucauuucccuucagaagcaaaauguaauuccauuauuucgaaugcuuaucugaaaugcugugugguuuuguuuauuucagagacuugaagauagagaauuugcuacuagaugaagacaauaauaucaagcugauugguaugacuuuuuuuuuuuuuuaagcaaaaguaucuuuuaaguguuguguugucaguucucaacuuugaaaauuauccauggucuaucucuaauacccagacaauauucuagauuaucuucuuuuaccuccaauauuuaauaaugguuuugaaaaugggucauguguuuccuugucuuauucaaacuauagcuucuccauaaauucagauggagcugaccuuuuguagaauuuauuuuuauuuggauuaacuggaaaacuucuuuaaaauagugaaagauaguuuggcuuagaaaugcuucccauagcuucgccauaucucauuccacuucuuggugaaugcagggaugccuaaaguaagggagaaugcaauugaccuucucuuuuuaauacaaucuuuauucaggcuuguugguacaaugggagcugugcagagaaguccccacaaagggauaauuagaagucugaaccaaucagaaggaagcuacaagauggggcaucauaauugguucauaauucaugguccauagcaaauucacugcacaacucguuuucuagacgaauucaggugguucuguuguuguuauuuucucccucuguggucgcucugggcagaauucagggcaucauuuuuauauccagauauuagauggcaccaucuuuuauuccccucuuuucuuuuuucucccaccucagaugcaaguaauuucuuuuaccucaauggcuugaaaagacuuuauaugaggggaaaagagaaggaucaauaggacuuugugaauuuaacuuuuaugcccaagaaggaacuuuuguuugacaaaugcugaaagucaucacaagauucuccaaaacacaucauuaaaaugacuuauuagauauuuugggauuacagucagcucccaauucaguacugggcaagaggaugcacagacucuggauaauuaaacaccacugauagguguugauggauacacuuauuacuagagaguuaaucgugaagaggaaaccaauuuuuccccaaaagcauuuagaagaaucuauucuuagaagauucuuagauaauucaaaggauuuucuuuucuuuucucucucucuuuuuuuuuuuuccugagauggagucucccucuguugcccaggcuggagugcaguggugcaaucuuggcucacugcagccucugccucccggguucaagcgauucuccugucucagccucccgaguagcugggauuacaggcacccagcaccacgccuggcuaauuuuuguauuuuuaguagagaugggguuucaccauguuggccaggcuggucucgaacuccugauuucaggugaucugcccgccuuggucucccaaagugcugggauuacaggcaugagccaccaugccuggcugauuuucuuuuuguuaaauuguuuuacuauugcauuuuaguugucuugaggggccaagugcagaagcuggaaaacaaggcacucguguugaaaugcuugcaggaagucucucugguccucauuuccgagaucuggaguguuaaacaaaggggccuccuggugugggguagggaauggaggaaaggaguuuuuuguuuuagguucccuguaacuguucuuuggaaaauguggaggugacagugauagaguuguccuaacagcaccagagacuauaaaagaacagacuuuguaacagcaguauuuauaugacaauaaaaguuagaauaggccaggugcaguggcucacaccuguaaucccacuuugggaggccgaggaggguggaucacaaggucaggaguucaagaccagccugacuaacaugugaaacccccgucucuauuaaaaaugcaaaaaguagccaggcgugguagcgugcgccuauaaucccagcuacucaggaggcugaggcaggagaaucgcuugaaccugggagguggagguugcagugagccaagaucgugacacugcacuccagccugggcgacagagcgagacuccgucucaaaaagacugaggcuggugagucguguaagguacagacggaguuuccacaucucaggaggugggcauugcccauccuguuucuucccuuuccucuugccccucugucuccucugugcuuggucucucugcuuucuccuuaagugguagcccuaggugaccacugacagaacuaucuuguggaauaagcaauggugaaaugcacagaccuuuuuauugguuggacguuugcucaggggauucuaggaaaaccaaucauuucacugcugcaaucgguggaugcauuuauaaggagcucacggauugguugaguaauagaaccucuuagaggagaccuguccagucaagugaggaaauuauacaccuaaaucagagcccaccccuuccccucuugcugcauguuauggucacucuuugggugccaggaaccauuuuauucaaaucucucagagucaucaccucucugcuggcaauggcugggugggcacuacaaagacauuuuagguauuugggacaaaaucggcuccuucagaaagcaggaugcccgcaccugcuagaaagcaggcagugaccauuggauuucccuuuguuaaagaugccaauuugguugccaguucucuacugagcaguggaaacugaggaacccuaccucauaccugccccgagagagaccuuagaccacaccugagggcugguaggaacugcauuuuguuaagaaagaaccgcauuuccggaaggcauggagggagagaugaaggcccaguguguugugagguuucuugccccuggguugggcaauuuagaucaaagaucuuccaacuccugucuuuuuuguaaguugaaagcucuuugaaccuucuuuucuucaaaggcauuaccuacuuuuuuuuuucaaaggugauuauagcuauuaugauugccucuuaauaguuucucuuucuuugaaagaauuugguuuaaauaaaucuacuuaagccauguuucaaauuaacuagaauuaccaggaguaagaugugauuuaaucaggagguuuuuuuucccuuucaaaaaaagcagucugaugucugguaaguuuaaucuuaaaauggaagagcugcaacuuaggagaguuuugcacuucaguauuccaaaacagguucacuugggcguuuugugagauucauucuguagcucucagaaaauugagucgucguugguugauauauuuaccaaaccuaauugagacagacccaugugacauugcugggagguggccuucucucaaguuccacaauuccaauuauaggcagauguguacaguuuuaauaauuucaauuaugaaugugaagcaaacugguuguuucucuacaaauauauuuuaaaucaaacccuuuuggcuagaucaacauaaguugcuuaacaugcagauucucucucuuccaccucccagauccucugcuaaguuuucuucuugaaacugugcucaagauaaggccagacuguucccaaacuugccugggaugguggagggugaucuggccucuuaucucucucucugcccucuucugagaacaaguccuucuuucuggaccucaggucucaggguggugaggaagugaacagaucgaggcagcccuuugcugugaagggacugcuuugagauuaggaacagagucuuuugcuuugaucucagaaguuuagagauaacaauuuccaggacucugaugaaauugggccuccccagcuauuauuguguuuauuugauggugcugucucucacaguaggugcuccucacacauuuguuuguucauuaacauucuuuuagguucauuuucaaacugaaagccgucaaacaacccuccaauuuaaagcacaauacuauuuuucuugucccucccaccuuucuuuuugagauggagucucguucugucucccaggcuggagugcaguggcgcagucuuggcucacugcaacuuuugccucuuggguucaggcaguucuccugccucagccucccgaguagcugggacaacaggugugcgccuccgcgccuggcuaauuuuguauuuuuaguagagacaggguuucgccauguugcccagggugguuuugaacuauuggccucaggugaucugccuaccuuggccucccaaaguguugggauuacaggcaugggccacuguccccggcagauuuuucuucuuauaaaaauauucacccccuuuucuucccguuucagugauccugagggguggggucugagaacaggguuucucagguucuuuuuaacugauaucuccuccuaaggugggaauccagagacagucccacacccaugacuccugaaggacuuaucugggacaggguuuguggggucuaugggucuggcuggguugaugggaaaggaaaugggguguggggggaggguuggggagggaagaguaagggagucaaggaggagaaggggagggagguuaagggagaaauauggaaucauaaaaaaacaaaagaagagcucaguguuuggacaugcagcaugccugguugguuugcuugccauucccucuuauaguuugggcugaagagucugggugauauuuagagucuucaagaguuuucugagcucugcuuagaugagauucuuuuuagaaaagcuuaacgcaaugacuuuuggaaaacauuuuggcugugacaucuugauccauggugugcaauuaacuucacagacuggacuguauuucuccuucccugagauuuccuacaacguuccuaauggucaugugccuugcagguggagacauguuagagugaggugagaauacauucgugaaacuggacauaaauacugccgauugagaaagugcgagaguuuuguucaagacuggaagccugucucugccugagcccugcagcccgagucuucuguuugugggggauggaccauaauauuuacauugaaguucaaaggaugagcugcgaucuuaauucugagaucaacaaagauuaaggaaagauucagaugagggcauaacaguaacagcucuuuaauuaccugucaguuucaguaucuuuaagaucaaaagauaaacauggcgcagaaggcauaauagacccaaagucacucgaugcagugggcuuucuccccccucuuccugggcaucuuaaucauccaggaacaaagcagugccaugaggucgcuuagucuaguuugcauugccaucuuucuggugcuacuuuuccagccagcauucaggguuguuuaaacuguuggguguauuuuuccccucuucaagucacuauaugugcugcauaacuuagggggaauuuuuaaaagacuuucaugaaacgaaaacauucagcugaaaaagucaacuguaaguggcuggauugcaugucacugagggugacacaggcagccagagagaaucaaucuucccucaucuuuuccccacuuggcagcuugggagcuaacucaaauccccucugcuuguucuuucuuccugccuucauccuagaaagcgaauucucucuuuuuuuccuggaugacucauuuacaagauuggauggaaauagguuuuaguucagcauacuguuugcucuaacuggcuuuaacagugaggcccgaugucaaaugcucucagcuaagccagggaauucuuuugccuugagucucguauccagacguuaugguuugcagcugcuacaguuuucuuuaggaugcuaaaugauguguuagccugagagaauguuuccuuuccugcugcccuuuuuauuuuuccuuuuguuccucccucuucauuuccgcaguuuucuaauucggagcuuguuuuguucaccucucuuugcagacuuugguuugagcaacugcgcagggauccuggguuacucggauccguucagcacacaguguggcagcccugccuacgcugcaccugaacugcucgccaggaagaaauacggccccaaaaucgaugucugguccaugugaguuaucaagcuucugaaagucaguguuccuccugcugucuccaccgugccuuccuuaugaaaucaugccugaguauuggauggcauguauaggugacaggcccaggaguaugucaucagggauucuuuggggccuggcuuuccaucucuguuccuucuguuuuuuucugcacaaacugucagaguggccuuuaccaaaauucacugcggugcugagaagagaagaaaaccacguccugcccucacagagcucacauucuggcucugcgacucauuuaugccccauccuccugcccuuagcuucccaucgcccucugugugaagcuccauccugcugccuggccugugcuccuugcgggacuugcucgcccaucucuccuacccccuguccugcucacaguucuucagacauauugaccucccuuuugucgcucccaccucugggcuuguuuuuuuuugaggcagagucuuucucugucgcccaggcuagagugcagucgugugaucucagcucacugcaaccuccccuucccagguucaagugauuacccugccucagccucccaaguagcugagauuacaggcaugcaccaccaugcccagcuaauuuuuguauuuuuaguggagacgaaguuucaccauguuggccaggcuggucucaaacuccugaccucaggugaaccacccgccucggccucccaaagugcuggcauuaccggcaugagccacgcgcccggccguucacuggugaugccuggaauguccuuucccagcucuuuggauggccugcggauucccacaucccauucucaagccaguggcaccugcacauucccacaucccauucucaagccaguggcgccugcgcauucccacaucccaggcucaagccaguggcgccugcgcauucccauaucccagucucaaaccaguggcgccuaugcauucccacagcccauucucaagccauuggcgccugcgcauucccacaucccaggcucaagccaguggcgccugcgcauucccacaucccagucucaagccaguggcgccugcgcauucccacaucccagucucaagccaguggcgccugcgcauucccacaucccgggcucaagccaguggcgccugcgcauucccacaucccggucucaagccaguggcgccugcgcauucccacaucccagucucaagccaguggcgccugcgcauucccacaucccauucucaagccaauggcgucacugccgagaucauuucugagcucccugccagggagucccccguacucuguccucacccuuuuaauuucguucucggcaccucucaaugccuguccuuuuccuguuuuaaauccauuccucuccugucuccccagccagcaaggacucugcacgaagggagggaauugguuggucugguucaccauuuuguucccagggucugguacaggaagggccaccagggguaagcacaauaaauauuuggaggaugaauccucaguugcaccaaagguagagccugggucccccauggucacagugagucacccccuccaccauccccugucagugaugguacagggucaguucagagucuuggauucuuggauaggacucaauccuuugccauagggaaaugggcuguagagagagugagguucugauuaagauauagacgagaaagacucguuugcgugaaggguguguugauccggaguauuucuggaauuccccugcaucucuucauauucacuguaacccccuuguccagguuggcagaaaagcuaacgcuuacuuagugcuugaugugugccagacaccaugucacuuaguuucacaaugacccagugcaaucauuacucucuauuacccuauuuuauggaagaagaaacccaucauaagagaaaugaauaaaaucgcccaaggucauagagcugcuaagugguagagugggauuugaaccaagcaguguccuuucagggucucaagauacagccccagcucuccaacguggcguguggggacccuugcuugcccuguggccucgcugaaggcaugcccgcuccccuccucuccccauccauucucuggcuaaccuggcauuguuuccuauucccugaacacagccugcuccugcuacauuccagcccuuacaugcacaguuccuucggccuggaacccucucuuuuucccucuuguguuguugggugcagguuccucugggcagcccucugugucuccagcuggcuggcuuugaggcccucccauguacccuccagugccuggcuaucuguguuccugggccucaccgugaggucucaguccaccugcuggaacccucugggcuguagcugagggggcagggaccacuuggcucacucccaggauuuccucagcaccugguggaacuuggaggaagggagggaggagaaaaaggaggugggaaggaggagagaggaaggagaaaggaaaggaaggacggagggagggaggaaggaagagaaaagggaaagagggacaggaggaaggagcaggcauuucauccagggaaacagaagcuggaaggucagggcugaagcuggcugagaaagcaagcagaggaaugugggucagcucaaggcucuagaagcgagaugagcucaggauguuccgguuggagauugagaagaaacagaccagaaugagauguggagagauaaagaauuccuggaacuuucccagaaggggccgacucuucuggaacccuggcuaagaggaccugcuugucagcgaggaggugaaacacgucaggaaucagcugcugcuccugagcgggcugggugcccugguuagucaccccugaaccucaggacaguccugugagacacaucucuugcccccaguuugcacggauagaagagaguggugagcacugccuagaggcacacacgagcccgaauguaguggagccacacuuugcugaaggcugggcucccaguuacuuugcagguguggucuggugugcaggcugcauaugggguguguguggugugcugaugacgggcccaggugggcuggggucauguggagcuaguggaauggagcagggagcagcagaggaugccuucucuucuagggcauugcuagucauagacuucacuucugagaaggccucugaaucccccucaacacagccccucccggcagcuaaugccaguggaucagaguuguauaugggaggaaauccauuauggauuucuuccaacccuuaagaacucucaaaggugucuggcacacugucuucccucaauaaauauguauugaguggaugaauaugaauaugugggucuauaaucacuuucuuaacaguuagagaagucauuuaugcuaaaugggaagcuaugagaggaagaauuugugcacacacacacacacacacgcacacaaaagcacaaaaggcuaugggagccugaaagaccaagagguccccugucuuagucugucuuuuguugcugcaagggaauaccugaggcugggucauucauaaggaaaagagcucuauuuggcucaugguucugcaggcuguacaagaagcaugguggcagcaucggcuucuggugaggccccaggccgcuuccacucauggugggaggugcgggggaccagugugugcagagaucacauggugggagaggaagcaagagagaggggaggugccaggcucuuuguaaugaucagcauguauugacucauccuaucugccuaacaacccuucaagguagugcuguauuacucccaauuuaaagguguggaaacugaggcaugaaagaccucagccacuugcccccaugacacagccagcgugugacagagccacgauuugaccuacgugguuugcccuaggccccugaaucaccacccucuacugcaucugugauguuguacuuccucuggugggguuuacaugcuagugggacaaacagcugguauuuuaaaaugcuauaaacugagugugguaauggcuguggaggaagugagagggauucagggaacaagauggaguggccucuugaggagaugacuucaaagccagauccuaagaaugagaaggaaccagcuaugggaagaggaaggugucagggaagaaggccaggaaaggucaaaaguaaacuggugagaaaaaaaaccagauucuuuuguuauggcaacccuagcacauauggcugcacagcuggguuaagucaggaaggcaucuguagucaaguaugaucuguuccucaaagaugaguggagacggccagguggagaacagguggggaaacguuccaggcagagggaacagcauaugcaaaaggcugguaggugugacacaucugauuucucuuccucuuaauuuuggcgaaaacauaaaacuucagcaccuuuuaagagaugaauuuccuacugcuuuggggucugagcaaacuuucuaucugucuaaacuuggggucugauuuugugucugagauacaaguuagguuucuguuuggugcccaugacuuugcuggcagaaguggaaauggaaaaccaaaauugaauuuaauguagaaggcuguuuaaaaugagagugaaaauggaaccgauuuucuugcuggguuagacacuguuauuauaaaauggcuucucucuuuauggcucagaaacaaaaacagaaugaagaguucacuuccaaaaaagcaaacuccccucccuggaggcuuuggaccugauggauggcagagacuuuauccacaacuucugagauagauuuaggaagaaaaucagccugucauugaaagaaaccuugggaaagaaagcucuucccuacaaauagggcccccaggacccuccgcuagugaagccauaauuaacaauggaaaugggaaauggcgcgcuuucuuggggguuuguauuucuuggggguuuuccauuauuuucaauggugguuauuuucaagaccguaaagaauagcuguaaaauaauucacuucuuuccuuuaccccagauuauauguauaaauauauauauauauauaaaaauaacauauagaugugugugucuccaaugaacuuugagguuucagacacaaaaaccaaaaauauucauucuggugcauugaacuuuuauuacugugaauugacuuuuccucagagugacauauaugcuaauuuauaacaacuuuaaugcagaugugcuuuuuaauugaaaagaaucaaaauuaacuuuaucuucagaauauuacaauacucaugugcaaccuucagugaaucccuacugguaaggaaaacagaaauugagaguucuauaccgagaagauugagaaugcaacguuguuggacuaaagcuguccuuugcucucaugggggucccugggauggaugggugaaguauuugcgugagggccuggugccuccuggagagucacacacaacacacucaguccaccuuccuagcucagugaaucuguuuucacauaguggaaaaaaaaaucccugucuccagugcuguaccuguggguggacaacucggccaagaggcaccaugucuccaaauagcucuccugucuccauauagaacuggguguucaggagggagagugagagaauuuguucuaggccucagacucaguguuuuguaaaaguacuaccagauaucaucagcuacuggcaggggucaaauacagaaggaugguauuaguguuuucucuguguugagacccucucaaaaugaaggcuagcaggaggcagugggaagaguaaagcuaugacuccuuuggggaaccuuaggccuuuugacuuuugagagagagguuucccuuagcuucugagauuauucaguuauaaaguacgagauuuuuuuuuuauagcuagcauguauauuuaacauagaguaaaggaaggaaggaaaggaaaagaaacaaccauuuugaaauccgcaagaaaauaauuucuugcuaaacauagaccauuuaauggaacaguggugagaucugagauuuuccaaauggaugaauugguuccuagucuacuuucuuuuuuuuuuuuccuagucuacuuucaaggccuuaaauuggaaguuauauuauuaaaaguugauacugaaagauggaaagauauugcuuucagguggaaguuauuuuuaauuuuuccaaggcauuuccuuucuuggagagccacacagaagcaaggugcaucucccgaagguccucuuggcugcacucuguguaaacugggcaguuuccgaggcuccuguccacaugccccuuaagaacgaguaaucagaccuucccuccaccugccgggguggcucuguccauugcuuugucccuugcaucuuguuaaaauugccagcgacuucuccagggagcagugacuccaugucuuuccucuuugggauggcaggugauaccacaacuuuuccuccagggaguauuuuuuuuuguguaccagacuaaauaucaggauggccauuuggcuuuugacuuaacuccaagcuuucccguuuguauuucauaaguaagggcccuuuuccucuucuuucagcugccgcccccaccccccacccagugucugccuuucuuccucuuuugagaucagaguauucuaugcugccuaguaucuuuggguuuucuucuguccugcgauagcucauccuuauuucauucugcuggaaaaaccccuggucguauuugauuguugcccucucuugucccagucucucaucccucucauuuguuaagacugucuuugauucuugggaaucccaugucugccacggagaauccagaaagccccugggccauauuucaaaagacccaucaggaaauucugaacauguuuugaaacuccuacuaauucuaugggauuacagagguuuauaaacugcauuccacauuuuucccuugguauccucacauacuucugaaaugucagauggacuagguuucucuuuauccagauauuaaacauguauggaaacuccgggggagaggaauuaagaugcuuaaucugguuucccuuuuuaaaaucuccuagcuaggaguguuugacuguucacauagguuuccauucuuuuuuuuuuuuuuuugggauggaguuucgcucuuguugcccaggcaauggcgcaaucucugcuuaccacaaccuccaacucccggguucaagagauucuccugccucagccuccaaaguagcugggaauauaggcaugcaccgccaagcccagcucauuauguauuuuuaguagagaugggguuucuccauguuggucaggcuggugucgaacuucugaccucuggugauccgcccaccucagccuccugaaaugcugggauuacaggcgugagccacugugcccggccagguuuccacucuuauuuggcaauacaguacaaauaaaacuguagcuuuuucccucuuauuuuaagaaagguuuuuugaugaaacaauagaucacaauuuaucaagcuuaauuuauuccaacuacagaauucaggucuuucuguggcuuaguugaugugagccucauacgaucugagagguagguacuauuauuauccacaucuuauggaugagagacccuaggaugagagagguggguccucuuuaaggauuugugacaauuuuuuuuuucauugaugauaaauuccuccaaaagaaauggaauucuggaaucaguuuguaaagucaucaauuaaaguuacuacaaaaacugcuugcucaacccugaccagaccugccaccuggauggcucuggcgccaucuugaagacaagcaucuguuaaucuuaucuguggucccagccagaugauggagagaggcaaagaccaguguaauaugcagugacuugaggagauuuuuggcgucuguugaagccaguuggugacaagaaggcaagcaguuuggugucucagggucuccuucaagaaagaaacauucauaaaggcuuuagaguugcuccucuggccucauauggucuccaaaccccuuuagugggguuguccucccauuaucaugauguccuacuuccuagaggcaucugcacuauacgacacccccaccugggacaggaagcuaggugugccguaaagauuaaagggaauauaaaaggucguagagcaguggucugcacauuugaguauuauacacuguguuuuuaaaggaagaacguucucgauaacuguguguguugacgugaguuauuuuuauuuaaauguuaguuauaaguacaugagccccaaaucaaacuccuuuuauuuauggcccuguacaacugaaaaaccaaaacucauuuacagguuaaauagaaccaagaguaaaagaaccccagaauauucaaauuagcaacguuaaugcaauggcuaauguuuugugggaagggaauggcuguacacagcaugagugcaguucucacugcugggcacagguucuuugagcuugucaggcccaucuugugaugccacaccuccccuaaaacuuuucauucuuccagggcuuuccaauuuuuugaguacgcaucagaagcaccuggagggcuugcaaaaacacugcagaguuucugauuccggagaugugcaguggcauccaggaaugugcguuuucuuucuuuuucuuuucuuuuuuuuuaagagucagggucuugcucuguugcccaagcuggagugcaguggcacacuuacaucucacugcagccccaaccuccugggcucaagugauccucacaccucagccccccaaguaguugggacuuacaggcgcaugccaccaugccuggcuaauuuugguauuuuuuguagaaauggggucucaccauguugcccgcccaggcugaucucgaacuccugagcucaagagagccacccgccucagccucccaaauugcuggaauuacaggugugagccauugcgccuggcugaaugugcauuuucaacaaguucucagguagugcugaugccacuggucugaggacgaaccacacgcuauuccagucaccaggagacuuuccacugacagaagcacagaugcaucacugacacauuaaguccaccucugcuuccuucucauuaggcuaugacaauaaaagugauuuuuuuuuuuuuggcaaaaauagugcauugauaaagaaauaccaaagcagggccgggcgcggugcucacgccuguaaucccagcacuuugggagaccgagacggguggaucacgaggucaggagaucgagaccauccuggcuaacacagugaaaccccgucucuacgaaaaaaaaaaaaaaaauagccaggccugguggcaggcgccuguagucccagcuacucgggaggcugaggcaggagaauggcgugaacccgggaggcagagcuugcagugagccgagaucgcgccacucuacuccagccugggcgauggagcgagacuccgucucaaaaaagaaaaagaaauaccaaggcagacacugaaauugggugugugugguggaagguguucuuaguuauaugguggucauccaaugccucugguuaugcuuugugaaauguuuuagucaauuaccaaaaagaaaauaaaaauuagaacuguugcacccgugaggaugugucuguguaccucaguuugagaaacacugaaugaguuaggcauuaugaagcacuuacugcggaaaaaaaugauauuguauaaguagcaggcucuucagcuuuaggugugaauguuagagccaagauuaggcacucagagguggugagcagggacagaaucuugguuuuguuuuuuccuccccuuaacucaauucacuccaacucuguugaaauaugaggucuuugcuauguagcauggaaacauugaagcucauuaacugcaugaaccugcugguguauauucagggcagaggacuggguuguugaggagacucucaaucaugucaaauaaagcacaggcaaaagaccugaggucccagccuggggaagacccagaaaggugggaagauccugguuccaguuuucaaagaugugaagugcugaucauggaagagcaacuggucuuguuccacaaccaaugaauagaagauguagacauuggcuuagccuuggaaagcuuuauuuuugcauagaaucgcccuggauggaacaggcuggcucagaagcauugggaacagcuugucucagaggcuguucagugguccccagcaacaacuuugugggaugugccagaagguuuccauccauaaaagcgauguguccaaguccucuuuguaugcaaaacucuacaauuuugggacccuuuuagcauuccuucuuaccgaucuccaagaauuuuucgaagcaagaguguuuagcucuaccucaaacauacucaaagugcagcaucgcauaguacguucucaaauauaucacuagcccugauacuccuucccugcaccccuaaccugucucuccuccucagccuccucaguaccauucuguuaccaccauugguccugcauucugaguuugccaccuggcacgugcccuucaaaugucuccacugcgucuuugccuuucccuuucuguugcgugccaucauuccgauuccgauuuuaacagcaaccugcugauuuccugccauaguuuccuacuuuccauucugagccccuuuaauccacuuauacaauauaacuacucccugaauuauuuggucauaccacuuguaucugccgaaccccuauuccuccccugggguacguuuuccacuaaacacacacagggaaaugccacccaaauagcucuaugugugccuuguucauucuuguuuccauuucuuuguuuaugcacuuuuuaucucuccauccauacaaccagccagccaaagacacaugagcucacacacaugcagucacuaccuguguggcauguucccucuucauguaccuguuucuaaguucucagucucccuucauugcacuccucuuguggucaaaaguggugcaauucagcauuuucuuauuccuuuugcacucaucaccgcuugaaaggacugugcucaucuauuuguuugcacguugcuugccugucuucuuccccacucaaaacccaagagggcaggucuuucucugguccccaguacccagcaccuauagucuugccuggggcagagagccauccagcaaguauuuguggaauggauguuuaugcaucugucccccuaacuccacugugaguuuggaacuaacuccacugugagugggaaccaggucuuacuauaugucugaaauuugcgaaugauuucuagugggagcggugggcuccaguaccugucauuaucugaaaugccauaauucagaggugccucuguggaauugggccucgagggucuuaauuucaaucagucucauuggauuuguuuugacuagaaaucuuagugccuguuuuuaaaguauauucccuugggcgcuuuugaacacuugagaccucuugguaggcaggcauuucauccucaucaggaaaucucaucaaaaugauauuagauuuacacaucaggaaaauaaagauccucuaagaagauguuucuauucuguagauuggcuuuggauaggugcaguuaagcuuacucagaagguauuucaaccacaucugagauguuggguuggggccagguggcagaaucucacaauaaacaauaaaaaaaucagggcaggaaggaaggggaccuccccagaaauuucuguaguuacaagccaaggcaaaauuuaagaguagagcaaaacgccagguuuuguuaugaggcuucguuucugagggcugagugguaaccuggcucacaguuuggcugugacuggagcuuccacuguagggggcuuuuccuguauuguuuggucagccuuuuccagguaccaccuuguaagccauccuuggaaaaccacauaauggcaguacuacucuuaauugaagucccugaugucucccagguguuucuuacauugcuuggucugggccuccuuguuguugacuucuuccugccauaacauucggagagagcagagggccaugguuccccuccucaggagguggcuccugaugcucuugaaacuccugcuuuucucugugguccccuuccgggucuucacauucaagugcucucacccaagacuuucuuucuuucuuucuuucuuuuuuuuugagacggaauuucacucuugacgcucaggcuggagugcaauggcgugaucuuggcucagugcaaccuccgccuccuggguucaagugauucuccugccucagccuccccaguagcugggauuacaggcgcccgccaccacgccuggcuaauuuuuguauuuuuaguagagaugggugccagggugugcgggggcuucaugcacagcuuguagcacagcagcgagauagugguccaggcugaugaggcagagauugaggauggaggugcuacacaggcuggucucgaacuccugaccucagaugauccaccucccaaagugcugggauuacaggcaugagccaccauguccgaccucacccaacucuuucaacaugacacugagcauucuacaaagaugacuuugaagagggccuguugagguuggcauggaagcagcagcucccacgcuucggugaagcccguguccccagucuuccccuccccaggggaccugacuccgcuuucauguguaugucucucuuuucagaggugugaacauguaugccauguugaccgggacgcugccuuucacgguggagccuuucagccugagggcuuuguaccagaagaugguagacaaagaaaugaacccccuccccacucagcucuccacagguaaugcaccagcugcucuagaucacgguucaggacugcugucgugaccaguucgggucuaccugugaaacaguauuuguuuugcaguaaugguguuaugucuaucccaugguuauaaguuucuuucuaguguuaaauagaagugucaaggggugguuggguuucccgucucucaauggccacucaugccuuucaccuguauccuuuccuguucuguucuaucugaaccccuaacuucuccuuccuccuucugcacaaaacacguagauccaaaggaucugauauucuccauuuaaaaaaugauugcaggcuugauuguuuuaaaacucaccaucuuaugaugcugacuuggaaaagaggguuuauggucgcauuuccaauauggcuucuuucugcaauuacugucaagaaauguuuguugcauucaaguuggggcugugauuuguuuugugaguugagguuuugagcccguucaaaagcuuuuaaauauauagagguuaaguuacuugauuggacugaaucaucagguguguuugaaaaguucucucaagcuuuagcugguucacauuucaguaaacaguuuguauuaagguuugguuucagauccaguaaaucaguacaauuuguucuuuuguuugguucacaauucaaguccuggccuuggcuuggcuuugaugagcauuuaauuggcuccuuagaauaaacucagcuucacuaagauaaggcuuuugaccaaagaagaaagcaguuauuuaacugcaacuuaugauacuuagcgauaguuaaaauauagcauuuuauuuuacuacuguuaugcauuuuucuucugaguuuaaaagcaugcaugaagcugccccugaauuuaucuuggcaaguggaauccaaguggagacacguucuuguaugcaauuaucuaauucagcccauacugucaccucaagggaggggagacucucuggaggcuugaaagcaaaggaggcauuaaguccuugggaagaugaguuacagcucugucauuauacaagaaauauuucugcacugagagucauaacucuuggaguuagaaaaugugcaaaaugucaaaccaauugucauauuuaaguuuuagagcuuucagaaauguugaaagugcggcagagcacucugaggugugcccauucauucauucauuccauauuucauacucauuagcuuauuccgugaauauguguugugcaccaauuaugugcuagguguguucuagauuaagcaagacagagaacaaaccagucucuacccuuauaaagcuuauauaucagcaggggaagcuaaaaauaaauaaauggguaauaaacaugugugguauuugguaauguuaagugcucuaaagaaaguaaaauaaauugggacaaggggauagagaguaaaaagguuuuuuuuuuuuuaacaaauaagauuauuuuaaaaacuuuucauugugauguaauuguagaugcacacacaauugcuagaaauaauacaaagagauccaaacagccuucaucugguguacuaguccauucucaugcugcuaauaaagacauacccgagacuggguaauuuauaaaggaaagagguuuaauagacucacaguuccacauggcuggggaggccucauaaucaugguggaauaugaaggaagagcaaagggacaucuuagaugguggcagggaagagcgcuugugcaggggaaauccuauuuauaaaaccaucagaucucgugagacuuauucacuaccaugagaacagcaugaacugccuccaugauucaauuaucuccaccuggccccgcccuugacauguggggauuauuacaauucaaggugagauuuggguugggacacagccaaaccauaucacccaguuucccccaauaguaauauauuguauaacugugguauaauaucaccacugggaaauuaacauugauaaaacccauugaccuuguucagauuucacaaguuuuauguacaaucuuguguguugcuguauauuaguucuauagaguuuuuucacaugaguaauuugugugacagccaccacagucaagaugcaagacaguucccucacaaggaucccucgugcugcuccucuguagccacagcuaccuuccuuccuccugcucucccuaagcccugucagccacuacccuguaucaucuauaauuuugucauuucaaaaaugcuauauguaaaucacuuuuuuucccacucagcauaauucccuugagauaaucugagcuguuuuuuuuuuauuggugaguaguaucuccugguguggauauaccgcaguuuguuucaccauuuacccacugaaggaccguugaguuguuuccaguuuggggcuaucaugaauaaagaugcuguaaacauucauguuuaaguuuuucugagaauaugguuucauuucucugggacaaaugccuaagagugaaauugcuggguuggguaguaagcacguauuuaguuuuguaagaaacugccaagccucuuuuucagaguggcuggaccauuuugcauucccacuagcaauaugugcaugaucucugcauccuugccagcauuugaugcuauuauuauuuuuuauuuuaguuguucugauaggggucuaauaauaucucauugcaguacaaauaagaugugauguuuccaaauagaugcagucuuucaaagcagucucuguagggguuauauagucauaaauauugccaucucucagagugauuccaaaguuucuuugaggguucagagccuguuuuauucaagugacccauaacaaaggacaaaaggaggaugaauguacccccacaguggggaaaggcagacagugcucucuuugaacccgaugacagccugaggagcuggagaacugcugaucugcugccauuucauuguauuagucagaauagaccagguuaugcugcaguaacaaucagcccccaagucuuaguggcucaggaccacaaagguuuauuucucagucaugcuacaucucaguugagagcuggaucaaacauugaaagguucugcccagccaagggcccaaggcugauggagcagccaccacuuccaacauuucugguucaugcagagggagaaagggaaagagaaagagaaguucuuucgccagcaauuaaaucuuccaccaaucuuccaguuguaaguggaagcuuucuaaaacauggcaugcggcuucacccaacuaaagagaauggggcagugcaaccuuaccaugugcguugaaagugaaaagccagaaauauuuguugauuagcauuagcaugagccccacacagcugugggaaaaggagcagacaagcgcagguagguuaguaacacaagaaaaucaaucucauugcuucagaaccauaccuuguuuuuacuuucaauaacaucacgcagucuuagcaggcugggcucuaaguguuuuuugugaaaauuaaauuuaaccuuaaagaagcaggaguugcaguucugaagauguuaaaaaaugguccaaaguuagucccaaaggagacauauuaaaaauguucccagcaauuucagcaucacuggaauugcuguccaaccucgcauagcuccugcauugagcagacagcuuugccuuggccuuaagcucugugugugcuuguuaaagaucuucacauuccuacaggacuuuguugucuucacuugucaagcaugaauugcauuucuauaucugauuuucuaauuagggaaucugaugcucuccccaucuccuccuuuuuaaaauaacuauugggauauagaaauaucuuuuuucaacuaggauugaaauccuuugagccaggugucaagugagguguuugcacaugauagacacucagggaaucuagguugcugacucugguguuaaugugucugugugaccuggaaagguggcccauagauuauuuugauuacucaggauugggaauuguccugacccaguagggcccagagcagugcaccagcugcugaggcagcccagggcaucuuaucugguucauagagugaaugucuucagguuugaggaucagcugcugcccuucugacagccucccauuuuuucaauccuuugcaccccgcuaaguuuaucuccucucccuuccaaccagccuggcccugcuuauauccaaaaauacuaguuuaccaguaacaugaguagcugccacuuauugaauaauccuuuguagguguuuuucaugugguguuguuuuuauacaauccugcaagguaagucccuguuuaccagugaggaaauugagucucagagagauuaagucugcuugacugaaaaccuagauuuuccuaccaugcuguguuauuucacucuucucugauuuuauuuaguauaagacgcacccccccuacaaaaaguuggagguauuaucuauugucucuaugaccuuauguuuugaguaaugucaauccaaauagaaaauaugccaguuuuauugugucucacuaaugcacaucuuuauuaauuggaugacucugucauucauauuuguuuuuguuuuuguuuaagacaagguuucacugugucauccuggcuggagugcaguggcacaaucauggcucacugcagccucggccuccgaaaccaagcagucuucccgccucagccucccaaguagcugggacugcaggcgcaugccaccaugcccagcuaauuuuuuuuggugggggguauauuuuuuauagagagagggucucccuauguugcucaagcuggucuugaacuccugggcucaagcaauccuccugcgucggacucucaaacugcugggguacugcaccuggcccugucacucauauauguaaugaucauaucuauuaauucuucggcucuuuuuaaagauuaaguuggaagaauuuuuaccaaacuugaguugaaaacagcauuauugcccuugugaauccacagaacaugcuuccaaagaacugcccuucauucaucucugucaugccguuugcaaacuuaagcuucgagggccuuucuaagucucucuucuacacacuuucuuuuugcuuguuggcacuuguaugucacagaguagcgaaugccuuuuauggcugagcaguuuuucagacuguuaccuuuucaucacuacaccucaacacuagcauuuauaauacauuccaagcagucacuucagguuaugaugguuuugugcugugaauucuccaaagucaaacuggaggagaagcguuagcuuuuaugaggguugagucagugcuaauuacgauguccaagaaggcacaaugaucagauuaucaaauaauuuuuuagcuugggaagugaugaggagggagcuucaaguggggaggggucucuauuugcaucuaucaggcuacacuaaugugaaaagucugaugacagaccugcagcccuuucacuugguacaguguucaggugcucacacaagccaguccagacuuuggaaagcugaugguucaugaaagaaagugggguuugcgauggaggaagguguucuguguguuacguugagcagggugguacuauuuuuccaggcuucaguggagaaccuaaguguuaucucagagggguggaggguggcguguggccuguggccaugccuggcauggcuuuccaggauggugaggaauauuuuaaucucuuuugcccauaaggcagggguuuucaggacccuaaaacaaacuucaaagagcucuaaggacuucucaaaguccuuuuuggauaguaaugcaaugucugugacguccaaaggaagaaaauucgucagcggagauuugaacuaaaauuacuugugcucaucagcaguuuuugaagaugcagagcgcucgguuaugaaaauagaacaaaaaugcacaucuaguuuguccuuagcacuucugguucaucauacuuugaaaaagccuggccuguugcccaagucuuuugaggcaacccuggguuguugcccaaguccuuugaggguaagcaacagcaaugucucagaaaacauuaacucaacagcccacccgcuccaauucauuaagcccucaucuuuuuuaucugaccaauagaugcccccaguuaagaucuaaaugacucuuccaaugcaggguuguuaaaggaagggagauagacauucugaaaagcagagaucuguuugauuuucggguuauuauagaacauggauggagcuggaggccaucauccuuagcaaacuaacacgggaacagaaaaccaaauaccgcauguucucacuuagaagugggagcuaaguaaugagaacucauggacacaaagaggggaacaauagacacuggggcccacuugaggguggaggguggaaggagagagaggagcaaaaaaaaaaaaaaccuauuggguaccaggauuaguaccugggugaugaaauaaucuguacaacaaacucccaugacaugaguuuaccuauauaacaaaccugcacauguacccccgaaccuaaaguaaaaguuaaaaaaaaauuuuuuuuaaaguacguugcuggaaaguuuuagcugaguauccagcgauaacacuuacagugguaaauguaccucauggccucuacacaugcauuucuacccaccucacuguucuuuguuuuucuuuuuuuuuuuuuuuuuuuaauuuugagacggauucucucucucuuacccaggcuggagugcaauggcgugaucucagcucacugcaaacucugccuccugaguucaagcaauucuaccaccuccgccucccgaguagcugggauuacaggcaugcaccaccacacccggcuaauuuuuguauuuuuaguagagacgggguuucgccauguugaucaggcuggucuugaacuccugaccucaggugauccacucaccucguccucccaaagugcugggauuacaguugugagccacugcuccuggcaauauuuccuuuuuucaaaauuucaguacguauuugaggaacaggugguguuugguuacauggauaaguuccuuaguggcgauuucugagauuugggugcauccaucgccugagcaguguacacuguacccaauguguagucuauuauccccugccccucuccuacccuucccuccaaguccccaaagucuauuguaucauucuuaugccuuugcaccuucauagcuuagcucccacuuacgagugagaauacacaauguuugguuuuuccauuccuggguuacuucacuuagaauaauggucuccaacuccauccagguugcugugaaugccauuaguuugcuccuuuuuaugacugaguaguauuccuugguguuuauauauaugacauguauauauauaugucacauuuucuuuauccacuuguuaauugaugggaauuugggcugguuccauauuuuugcaauugugaauugugcugcuauaaacaugugugcaagugucuuuuucauguaaugaccuauuuuccuuuggguagauacccaguagagacuacccacuauugaaagggagaugaccugguaaccucuucaacaguaugggaacccacccuggugguggguugaccauggagguugaccuggcugcaugaccuagcaaagauuguuucucuugaguugauucuggcaucacaacuggccccuuuuuugauggccucauuuuuacccugcagaaaaugaguugacaaaaggcucagcauuuccucaagaacaauguucaaaugacaacuuaaagcuuuugagaaaguaggacauuuuauggcuucuccuugcaaagaagauuacuuuagaaaacugaaaaaauaacuuugaagagaaggauagaaaaaucgggggaccaagcacauuauuauuuucugggaucuauuauuugguauguuggaaaucaaguacaaagcuacguaaaagaauucuucauauugcaaaaacauuaccgcaauacuuuguaaaauaagggcuauagcauaagaaaagaucacagucccacaacucaagcaagacagaccgucugcauuuugaagucaucccugccauucuuugcccacauguggguaugcuguauauucuucugcugaacaauuuugcagccuuagaagggccuucauggguugggugugguggcuuacacacuuaaucccaacacuuugggaggcugaggcaggaggaucgcuugagcucagggguuugagaccagccugggcaacauggcaaaaccccaucucuaccaaaaaaauaaaaaaaguauccaggugugacggugcaugccuguagucucaccuacuuggaaggcugaggugggaaggucaccugagccagagagaucaaggcugcagugagccaugauggcacaacugcacuccagccugggcgacagugugagacucugucuccaaaauauaaaaaauaaugaauaaaauaaauacaaaauaaaaggcuucgugugcauuauaaacgcauuuuuaccucucauacaguuguuuccguuguuauaaucuuaaaggaugcaaauguucugcuuagagaugaauuagcuucuuaucuccagugcuugaauggacaagugcucuguaaauauuugugaaaugaaaggaaacccagggcauuuaaaacauuauuuuuggccaggcgugguggcucaggccuauaaucccagcacuuugggaggcugaggcggggaggugggcggcggugcagaauggcuuuaaaggaaaggaucagaaagcaggaccucucuggccccuugagacucugaguguccuguggugcccaguugagaggucuaacuuaggaugccuguacacuucuggcuucucccugagugcucaaaaaccuaccuugcgagcaggcauuuucuguuuauuuucuuucauuccuacaagccugucaauagugcaucucuuuggcucaccuaugagcaacaagaaaagaccacagguugucuugggaaacacggaauggggagacccaaacugguucuugcuguaucauguaccaguugcuccccuuggacagagaaauuaaauucuuuggcuaugugguguguauuuuuuaaagagagagagggggaaaugggauuuuccacaccccuccugucugaagggagguggggcugaaaccaagcuccacgauucauugaaucggaacccugcccagagaccuagagaagagaucaccccagcagugacucgggaugggcaggcaagguggcgaguccccugugaugguggcuuucacuggugucugcguucagccuguaacaugcgugcauucuuucccaaaugucucccaggugccaucaguuuccugcgcucucuccuggaaccggauccugugaagaggccaaauauucagcaggcacuggcgaaucgcuggcuuaaugagaauuacacgggcaaagugcccuguaaugucaccuaucccaacagguaauuucgugcacccagaggaacuccucgggagagacggggccuguccuacuagcccugagcaguuccggacagaaagcuguccgugauugaaggaaaagccgcgcucucucuuggcuaucuccccuucccccuaacacccacacccacacauccacaagaggaagcguagacagggccaccaugugcuguuaugccgugugcccugcaggggcaccuggaggagaggugaguggaggcugauauccaggcuuugagggucuguaucuucccagggguugccuuuuucuaguucacacagagggaccuuugagacuagcuguggcccgagugugugugugugugugugugugugugugugugugugugagagagagagagugagugucuaugucugcuugggucuccaugugcauggguguugugucuguguguguguauguguuguguguaaauuuguguguguguguguguguguguguguguguguaugucuuuguuuuguuuuuuuaauacauagucuggcucugucacccaggcuggagugcaguggcguaaucucagaucacugcaaccucugccuccugguuucaagcgauucuuaugccucagccuccugaggagcugggauuacaggaacgugccaccacaccaggcuaauuuuguauuuuuaguagagacgggguuucaccucuugcccaggcuggucuugaacuccugaccucaagugauccgccugccuuggccucccaaagugcugggauuucaugugugagccaacgugcccggccaguccuuguguugugaguguguuugcgugugugugaucagcucacgagcccaccugccaacaucaaacagaaacaugggaucgccccucccuuuccaaaccacccuuagaugccuucuucugccuuguucuugauguuuauuucagcccuaagaccccugccuuaaaaugugggaggcaggaaggaaaggcauaggagucauucguuuuaggccgggugucccuaugaacuuuccgugaaggcuucacuuuaucaguuuccaugaggaggguucuuuaagcaaagcuugcagacaggaacccacagcauaggagcacugaugggcucccugugcagcccacgcuucuccaugcuggugcgcuaacuacagauuaaaaaacauuucucuuuuuucuuuuuuuuuuuuuugagacaaaaccuuacucugucacccaggcuagaguguaguggcauggucauggcucgcuacagccuccaccuccugagcucaagggagucucccaccucagccuccugaguagcugugaccacaggcaugagccaccaugucaggcacauuuucuauuuuucuucagagacaggguuuugccauguugcccaggcuggucucaaacuccugggcucaagugauccuccugccucucaaggugcugagauuacaggcuugagccacugugcccggccaaaaacauuuccuuguauauuuuuuucuacucauuuguccuauuucuaacuaaccugagcgagggaaugagggcccuuauuuuggcuguuuuugagcaaacaaggaaaccacguggguucaguaccuuccaagacugggacccaccuuccuucuuccuucagaccuaggguggcuugcacauuugaccaggcuuggaugaagacaagagaaccacugacccagaggggcagauaggagacugaaagggcagagaaagggguguccuguguggucauagguucaaugccuaggaaggucuagaaacacccaccaagccuuaugaaagcagaagugcugaguccuucaaagaagauggccaggcagggcucugcuugggauggaagcucuagaaaaacuuuaaaggggcgugggagucugcauccacacuucagugccaaauuuacacucaccgugcccagagaggaggugguuucacuccguugccaucuagaauucuagcauuuggcucaugggagguaauuuaaacaaagucuaggugacuuagguuaccaagggaaccuggaaauagauugcuguuuuccaauaacagcucgaugugggccaggaucugaaacagacaccagaaauacuacuccaaagcgaggcagggagcaaagcugaaaggaccuugccucauuauccauacucaugauggagagcagcacgcagguaugcuuucuguuaaaggagggggccuugcugguggccacaugagucauuaagcucauguaaucaccgccuaaaugagcauaaucaauccacucaaugcggcaacuguugaaggaaguggaguugguguuagacaguauuuccccuccuuguuggcugcaucuucauucacaaagaauuacgaggcgacaucucauuuuguagcuuucccacaguuugcagacaggcuuugauagauuaaaacuuauaaaacaggauaggcaacuccuauccuguuguugccagauuauuguaaugguuuuugcauuuggacuuggucagaagcauaauggcugcacaugaaacugguuaaguggauuguaaaacuggcugagaucucacaugcucaggaaaacagcacucagugucuucuguguguauaaggcccauugcugauuuuacacuagaggcaaaucaguguuugguuuuuaagcguggaaccagaauucuuuuucuuuauuuuuauuuauuuauuauuuauuuauuuugagacagagucuugaucugucgcccaggcuggagugcaguggugcaaucucggcucacugcaaccuccgccuccugggaucaagcgauucuccugccucagccuccugaguagcugggauuagugccaccacgcccggcuaguuuuuguauuuuuaguagagaugagguuucaccauguugcccaggcuggucauaaacuccuggccucaagugauccgccugcugcagccucccaaagugcugggauuauaggcgugagccaccaccgugccuggccuggaaccagaauucuaggcuguugggggagguacauguuauuuacaguguuuauuuugaaaaacauuuaucuuuaagacaaaaaaaauguauuuuuuauauuuauuuuucugguuuuacuggcauguagauaaagggagugagaacauacaaacagagaaagggauauuuucuuuauaaaguauguuuuauaguuucccaacauaccuagccccagauguauuuuaaguguugucaauauuuuucuuuugagaaaguuaggaaaauaaaggucucguauuuuacaucacucuucuauaaagccuucuccugugaagucauuucagccuccaaguugaucucuaaaagcaaagagggaaaugucuuuggaaguaaauuuuuuauaaauaaauguuuaugccagucagucaacagauguuugcuaggugccagcuccccuccugauccaggugcagacuuuuuuuuuuuuuuuuugagacaagucuuccuucauagcccaggcuagaguucaguggcgcaaucacagcucacugugaccuagaacuccugggcucgaguaaccuucacgccucagcuucuauaguagagggacuacaggcaugugcuaccaucgccagcuaaguguuucuauuuuuguuguagagauggggguuuuucuguguugcccaggcuggucuuaaacuccuggcuccaagcacucucugugccucagucuccuaaagugcuggguuucagacuuuuguacagagccaagcuugcugccucuuucugucucccugcaggggccuggacagucucuccaccccuccaguuagcuuuggaacuggugggaggggaggaggucgcaggcaauacaggacagaauuagaccaaauuagauccaugguaucaaaauggauugcaugugaauuugcucaauucaaauuauaucuaguauucuggaacauuguaccauucucugugucauccaaacaugaagccauauacagauugguuaagugauacuugaaagcaucagguuuaugcaugguuuauaggaaaacauuuaaacuauuccucucaguccagagucaguugaccauuuacauuuuggcagagcucguuuuugaagauacuggacauaaaaggcagagauggggugucugccccugugcacaccucuccuuuccaugcugcugacuuuucuuccagaacaccccauacccucggcgggugcacugcucuugggauucccagguauuuccaaaccacuguucccucugcauuguuuugguagaccucaaguaguuauuuuaauaaacaaacuuguuauuaauacacuuuuuaagccaguaaucgugccaaucccucucccacauguuaucuggaauguguaauuuugugacaaacaggaaugaggaaggcugaucucauuguuuguuggguguguuuucauuuguuugucuuuugggacagcacuuaggcaaaaguaguggagggagaacugauguagguuacaccgaccgguggcaggcaauggucaggagaccucguucugcucucggugccccugccaaccggccgugugcagugggcaaguucucuucuuacagaagaacuugcaaagucuccucuucuuuacaauuauggggcuaccucucugggcauuaugguucugagguucuauccaaaugucuucagaccccuugacauggaggcuaguggcucuccagccagauaacuugccuucugcuccgauugcccucuuuguaucacucuuuuuauuuauuuauuauacuuuuauuauacuuuuuaauuuuuuuauuauacuuuuaaguucuaggguacaugugcacaacgugcagguuuguuacauauauauacaugugccauguugguuugcugcacccauuaacucgucauuugcauuagguauaucuccuaauacuaucucucccccuuccccaccacaggcccuggugugugauguuccccacccuguguccaaguguucuuauuguucaauucccaccuaugagugagaagaugcgguguuugguuuucuguccuugcgauaguuuguucagaaugccaucauucuuuguaucacucuuaagggauuuagaauguucuuuugacacagccccacuaccaacacauacacucccuuagagcccucccccugauuucucagucuccauagccauuggaugauggugauggugguggugaugaugaugaugaugaugaugaugauggaugugucuguuuauuugggaagcagugagcaucuagacacugaacccggcugccgguucuuaauucuagggcugucacuuccugccugugugacccugggcaagguacugcauugcugugggcuuugguuuuguuaucuguaaaguuggggucaugauaguaccuacucauaggacuaucaggaugacuaagugaauuuacauccucucuuccccacugggagggugaacaaaugaaugcguagaugaaugaagcccgguauuucuuugccauuuuaucccaaggaguuuaucuucacaguccccuugugaaguagcuuuaacucucuuccucugagaggaccccacuuugccgcugagcccugaaccccccauguaugaacuuaugaacucuuucuguuccccuaaacaugaucuggcuaguuccugaauaccuuccuuuuccaccccaaaauccagagucagaguggcuucuguccaugacaaccaauacauuuuaaggaaagaaugugugaucauaaggaaaucugggggacaguugggagauuugaguauaaucuggguauuagaugcuauuaagugauuauuaaaauuuuauuggguauguugaugguauugcgguucugugggggacaucuuugguuuuugaaggugcacacucaaggguuaagggguaaaaugucaugauguuuguaauuuaaaauacuucagcaaaaaaaaaaugcaaggauggcaaagugaucacugguauaucuagaugaugguauacauaaagugauuguacuauucccuccgcuuuucugaauacgagaacauuuucaaaauaaaaacucaagucagugaaugaaugagugaaugaaugaagcugauugugcccagggggucuguguggggcucuccgugaagugcaggggugacugguccucucucucugcaccucgcaggauuucucuggaagaucugagcccgagcgucgugcugcacaugaccgagaagcuggguuacaagaacagcgacgugaucaacacugugcucuccaaccgcgccugccacauccuggccaucuacuuccucuuaaacaagaaacuggagcgcuauuugucagggguaagugcgacccuagaggcgaucgucucugcugucuguggaaaaaagagcuccuacacccaaagugcuucucaguugcugacacuugauccaagcugcuaauuuaaucuaaugugaggcugaguuuucugaaugugggauaaagucguagcuaaaccugcuucucagggagugccuuuuaucugcaauguuuuucaaauacucucccaccgaguuaagcccugggcagaauugggagggguucaagccucuuuuuccuucaacagcaucucuguugucuuuuuuuuuuuuguucugcugccucuuaggucuuuggguuccccauguuggaggcauuggaggguucucugguccuaaaacucggguagcagugccucccgggcauuugucucugaacuaugguauuauauaugagaaagccacuauuuagguuuaacuucuccagaaaauaagaacaaaauuggacuugccuggccugacucuggcaccuucccucagucugagugucagaaaguccaagugucuggugucacccgcgagguaccuuugggguuuccacagcgugggguggauggugggacccugacacccuguccccuucaucauuuuugccacaagcaguuucugugugccugaguaagagaauuuaugugccuuaaauugucucucuccaaauggacaauggcuuaaaaagaauucugcaaauuggauccaagacaauauggagucugcauacagcagcucaugcuuuuacucagaauggugggugcugaccagcucuaacagggagucagccaaagaaauucagaauugccaggaagccuaucugaaauuugacugaguguucacuuucacgagggaccaccuucacccugggccuguugcaccuugacaucugauggcguggaguugucacuguuaggaagacauuuaccauccagaacaugugcuauugaagucacgugauagcccaauaugucaccaaauuucacuagacaauaggcuuagaaaccuuuuugagguuucuauaugagagcuaaagaugaaaaucuaccugcaguuggggaaaugauauucucgcuggcaugguggagaugaccaaauuaauacccggaggacaagguagucagugugugucuuuuguuagcaaauggauuugggagccgucuagaaaacauugcugaacagaugaagaugcuccacgggagguugguuaaacauuuggaugaaaguacagauguuucuaagcugauuuagcucagaauauuggcuagauugugcuuccauugugcuuccgcaggaaauuauccacagaacuccuuuguuuuuguuuuuguuuuuuugugaaccaccaaaggaaagaucuacaugagaagaaguacucucaacaauaaagagauuuaacaauguuuuaugggggaaaaaacguggucuguaugaugggguggcaccucucugauggggacagagucaacgcuuugaguuagauuucacagauggugucacuguggcugccuugcucauagaaagcuacuggagaagagaugucaaauccagaaagacaggacuuucaacauauaguauacuauuuauuuuauuuuauuauaugaugaggagagauucagaaaaucucuuguaucacacagcaguucucuguucucucaucacaaggaacauaaaagacauacuggacuugaagcuguuucucucucauuucucuuguuuuaauuguuuuuugagacuuuuuuuuuuuuuuuuuuuuuuuuggagacggagucuuucucugucgccuaggcuggagugcagugggacgaucucggcucacugcaacuucugccucccagguucaagugauucuccugccucagccuccugaguagcugggaccacaggcacgugccaccacgcuugucuaauuuuuguauuuuuaguagagauggaguuuugccauauuggccaggcuggucucaaacuccugacuucaagcgauccuccuaccucagccucccaaagugcugggauuauaggcgugagccaaagcaccuggcccucuuuuuuuuuuuuuucuuuugagaugaggucucacucugucacccaggcuagagugcaguggcaugaucucggcucacugcaacaucugcuuccuggguucaagugauucucccaccucaguguccugaguagcugggacuacagguacgcaccaccaugaccaacuaauuuuuguauuuuugguagagaugggguuuugccauguugcccaggcuggucuugaauuccugagcucaagcagucugcccaccuuggccucccaaagugcuaggaauacagcugugagccaccaugcccgaccccauuucucuuuugcaaaaagacuauauuccccaaacuucuuucucauacuuuaaaauuucuauuuauuauauaucuuauagcguacaugauauauucguacaauguuacaugcuuauaauuuauaaauaugcauauguugcaggugccugcuuacaaguuugucacacauaagggauuagggucauagcauuuggacaccaccaugcuauagaggaugaaaguuaagaauuuaaauagucuucagauaaaaggaagaaaagaggguuaaugcacugguaaucuuuuucaggugaugaauacuguucaaaacuuaguuauucaaauguguuuucaugaaacugacuauauuauaaaguucaugauuuugcuuauuagagaaugacauugcuacuuucccaaguaaguuaacaguuccaaacauuuuucuuuugguggaacuaguucuuucaggugcugaccaaguaagauggagggguguuagguuuuaaaaaacuguccuauguuuacuuccacauuuagagauacaagcuuuugugauucacgcucuucuuaaacaaauacauagcucaugccaagcaagagagacauuuuaucugaagcuuuuuugucuuuuaaaaccaaaccaaaacaaaacacaacaaaaagagucucacucugucgcccaggcuggagugcaguggcacaaucauggaucacuggagccucgacuuccugggcucaagccauccugcuauagucccagcuacucaggaggcugaggcaggaggaucgcuugagccugggaagucgaggcuaauuguauuuuuuguagagacgggcuuucgccauguugcccaggcuggucucuaacuccugggcucaagcaguccgcccgccuaggccucccaaagcgcugggauuauaggcaugagccacugcaccuggccugaagcucuuagacuguguccugaggugccuggguguguugccagcugcugcauuucugccugucugcuuugcccagcauccaggcugcaaguguugcaaagcagaguguggcuuugucaucugagaacauucucuggaaacucagcuggugucauucuaacuggaaaagguuuggggguuguuuucaauuaaauuuauuuaauugaccaaaaaaaugguauauauuuauccuguacaacaugaugcuuugaaauauauauacauuguggaauggcuaaaucaagcuaaauaauauauguguaaccacacaaauuuaucauuuauuuguggugagaccauugaaaaucuacucucuuagcaauuuacaagaauaaauacacuguuauuaacuauagucaccacauuguucaaucaugucuuaaauuuuuuuccuccuguuuaacugaaauuuuguaucuuuugaccaauaucucuucugcccacuuucccucauccccuucagccucugguaaccaucauucuacucucuacuucugugaccuacacuuuuuagauuccauguauaagugagauuguacacuauuugucuuucugugccuggcuuauuucacuuagcauaauguccucuagguucauccauauugucaaaaaugacagaauuucugucuuuuuaaagguugaauaguauuccauuauauauagguaccacacacuuucuuuauucauucauccguugauggacacaauagccauuuccuggcuauuguaaauaaugcugcauugaacauggggugggggugcauaugugucuucaacauacugauuucaucuccuuugaauauagacccagaaguggaauugcuggaucacaugguaguucuacuuuuaauuuuuugaggauccauacugauuuccauaaugguuguacuaauuuacauucccaccgacagugugcaaagguucuuucuucuccacauccucuccaacaugugguaucuuccaucuuuaugauaaaagcuguucuuacagaugugaggcaguaucucauuguagcuuuaauuugcauuucccuuaugauuggugauguugagcauaccuauuggccauuucuuuuuuuuuuuuugagagggagucucgcuaugucaccaggcuggagugcaguggcgugaucucggcucacugcaaccucugcuuacugcaaccucugccuccuggauucaagcaauucuccugccucagucuccugaguagcugggacuacaggugcacaccaccaugcccagcuaauuuuuguauuuuuaguagagacgggguuucaccauguuggccaggauggucucaaucucuugaccuugugaucugccugccucggccucccaaagugcugggauuacaggugugagccaccgcgcccggccccuauuggccauuucuaugucuucuuuugagaaaugucuucagauccuaugugcacuuuuuaauuggguuguuuucuggcuauugaguuguuugcauucuuuuuuuuuuuuuuuuuuuuuuuuuuuugagauggagucuugcucugucacccaggcuggcgugaucucagcucacugcaagcuccgccuccuggguucacgcuauucuccagucucagccucccaaguagcugggacuacaggcaccugccaccucaccuggcuaauuuuuuguauuuuuaguagagacaggguuucaccguguuagccaggauggucucaaucuccugaccucgugaucugcccaccuuggccucccaaagugcugggauuacaggcauaagccaccacgcccagcugcauucuuuauauguucuuugucagauguaugguuuacaaauauuuuaucccauuccauagaucucuuuacucugucgauuauuuccuuuguugugcagagcuuuugaauuugauguaauuacauuugucuauuugugcuuuuguugccugugcuuugggagucauguccaaaaaaucauuguccagaccaauguaaugaagccuuuucuguagguugucuucuaguagauuuauaguuuuggaucuuguuuguuuguuuauuuauuuauuuuuugagaugaagucucacucugucacccaagcuggagugcaguggugugaucucagcucaccgugaccuccaccuccuggguucaagcgauucuugugccucagccucucaaguagcugggacuacaggugugcaccaccaugcccagcaaauuuuuguauuuuuaguagagacgggguuucacuauguuggccaggcuggucucaaacuccugacccuguggucugcccgcaucggccucccaaagugcugggauuauaggcgugagccaccgcaccaggccugucuucuucuuuuuuuuuuuuuuuugagauggagucucgcucugucaccaggcuggagugcaguggcgcgaucuuggcucacugcaaccuccgccucccagcuucaagcgauucuccugccucagccuccugaguagcugggauuacagacgccugccugccaccacacguggcuaauuuuugucacguggcuaauuuuuguauguuuaguagagaugggguuucaccaaguuggccaggauggucuugaucucuugaccucgugaucugcccaccucuaccacccaaagugcugggauuacaggcgugagccaccaugcccggccugggccuaagucuuuuuuucuuuuugagauggaguuucauucuuguuguccaggcuggagugcaauggcgagaucuccauucaucgcaaccuccgucucccagguucaagcgauucuccugccuuagccucccaaguagcugugauuauaggcaugcgccaccaugcccagguaauuuuguauuuuuaguagagaugggguuucuccauguuggucaggcugaucuugaacucccaaccucaggugauccaccugccuuggccucccaaagugcugggauuacaggcaugagccacuguggcccgggccuaagucuuuaacucauuuugaguugacuuugcagauggugugagacagggucugauuucauucucuguggauguccaguuuuccaacaccauuuauuuaagaggaucuccuuuccccauucuguguucuuggcagcuuugucaaaaaguaauugaccguaagugcauggauucauuuuuggacucucuuuucuauuccauuggucuaugugucucuguuuuuaugccaguaucaugcuguuuugguuucuauagcuuugugauguguuuugaagucagguggugugaugcaucaacuuugauuuuauuguucaaaaugacuuuggcuauucagggucuuuugugguuccauacaaauguuaggauuuuuuuuuuuuucuguuucugugaaaaacgucauuggaauuuugacagggauuccauugaauccguagauugcuuaguauaguauggacauuuuaaucauauuaauucuuccaaucugugaacauggaaucuuuucauuuacuugugucuucuucaauuucuuucaucagugucuuauaguuuucaguguacagaucuuucacuuccuugguuacauuuauuccuaagcauuugauuuuuuuauggcuauuguaaguggcauugcuuucuugauuucauuuuugaauaguuuguuguuaguguaugaaaacacuauugauuuuuguauauugauuuugcauucugcaacuuuacuaaauucauuuaguaguucaaacaguuuuuugguagucuuuaggguuuucuauauauaagaucguguaucuacaaacagggacaauugaacuuccuuuccaauuuugaucccuuuuauuuauuuauuuauuuacuuauuuauuuaguuuaacaauuucccaaauauuuuuauuuuuauuuuuucuucaacuuuuauuuuaaguucugggguacauguuuaggaugugcagguuuguuacauaaguaaacaugugccauggugguuugcugcacagaucaacccaucaccuaggcauuaaucccagcguuccuuagcuauucuuccugagggugccuuugauuucuuucucuugccuaagugcucuggcuaggacgugcaguacuauguugaauagaaguaguaagagugggcuucuuugucuuauuccugaacaaguugucuauggggauuaauucacucuaguuagaaacaccugcuugccuagaguguggauucucagaccaguugugaguuuuaugaugucuguuucacauuuaaugcuuaaaucauagggcauaccuagucugagaauccauacucuaggcgaguggcuguuuuuaacuggagugaauuaaucccuacagacaacucaacugcucaguaauuucugcacauggcuaauuuaauuguacuguaugcauugucccgguuauuaauuuuaucaaccaauuauuuacaccccguguauaauuuugaagcccaaucuagugaacuaaaaaguaaaauguuaucucuuaauugucaucucuucccuucucuuuugguuuccucuuuuuaaaaccacgaaguucguauuuuaagauagagagccuguaagggcauuuauuaacuauuuguugguugauuaauuaauuaauccauguuuuuauuucacccauuuccagacaggauugcaccuuccucagcuuaggugcagcuguuuaucuucuuugagcuauguuaugaauuguuauggcuuucauuuggguggugguaguggggagcaguguguacauguguguuugugugugugugugugugcacuguuuuuuguuuauuuuuauuuuuauuuuuuugagagacagagucucacucugucacccaggcuggagugcaauggcacgaucuuggcucacugcagccuccaccucccggauucaagugauucuccuuccucagccaccugaguagcugggacuacaggcgugugccaccaugauuggcuauuuuuguauuuuuacuagagacaggguuucgccacguuggccaggcuggucucgaacuccugaccucaggugauccacccgccucggccucccaaaguggugggauuacagguaugagccacugcacccagccgugugcuguuuuaaaauaaagcaaacaagcaagaucuauguucuaugcagugguucaauaaaauaaguuauucuuuccagcucauuuucuugguuucucuguucguguuuuugaguagucuuacugcacagauaaaagaacugaggcccugcagggggcagugaucuacucagggucaccuggcccuuuacuggcagcgauaguaacacaaaguaggugaccugacucugcgcccagggcucuccccacacugcaaccugccugcaggccuuccuggggugagacuugauguugcaauuuacuggacugccaaacauuuccagcauucucucagccaagcgcugguuuaaaaauuaaugacugcuuaaugggcauuucuauuucugagaguugagcugugcuuuuucuuuucuccucugguagaaaucugacauccaggacagccucugcuacaagacccggcucuaccagauagaaaaguacagggcccccaaggaguccuaugaggugagugaccccugaagcaaaccucagggucucuuaggaaggguggauuuccauuugcaguaauuggaaaagaaaccaauuacugugggacacugaaguagcaaaagacacauacuuacgcucauaacugagcccuugagaaaugguuuacagcggaaccagcuuugcggugucuaaaccaugguucucagcuguggcugcauguuaaagucacggggagcguuuaaacaucuggaugcccaggccgcaccugggacccauuccauugaaucuugggaggugagacucggguaucaggaguuuuuaaagcucccuggauguuccaaugagcagccaaaguugaaaaccacugucaggaucucccaaaaugaaaaugagauguuucaguguuucacucauaugugagugaaacuagcaaaaauugaucucauagaaguacagaguaaaacugugguuauuagaggcuuggaauggcagggggaagggaggguagagagagguugcuuaacgaacaugaaauuacggcuagacagaaggaauaaguuccgguguucuguggcacuguagggugacuauaguuaacaguaacuuauuauguauauucaaaaagcuaaaagagaauuuugaauguucccaauaaaaagaaaugauaaauauuugagguaauaaauaugcugaucacccugauuugaucauuacauauugaauacauagauggaaauaucauucucugucccauaaaaaagauguauaaugauuaugcgucaacuaaaaauaaaaggaaaaaaaugcaaaugcuagaaaaaaaugagaugcuuaaaaauagagcugaguguaacacguggcaucagaagaaagugagaugaggaacgcaaaaguuugggaucaggcaggcuuuccuggccagcugucccuggugaccugauguaaccugggacguaccuagagaaaaagaacacaacucugauuucagaauaaaaacuaggcuccuguagcaaacaucccacauccauguuuguuaggaaacugugucugugaauuccagauccagggagggggccaggaguggggugcagccucagggccccucauucacuuuuugccaagugagcuuuucuuucucucagugauuuuccugggaaccaccuucccuuuucccucuggagccuguuuauguccccugaguguccuugccacaggaaccucucuccugggacacccaggucuauuagucuguucucacgcugcuaaugaagacauacccgagacuggguacuuuauaaaggaaagagguuugauggacucacaguuucacauggcuggggaggccucacaaucauggcagaagguaaaugaggagcaaagucacgucuuacaugguggcaggcaagagagcuuguguaggggaacuccccuuaauaaaaccaucagaucuugugagacuuacuaccaugagaacaguaugggggaaaccucucucaugauucagugaucuccaccuguccccgcccuugacacauggggauuauuacaauucaaggggagauuuggguggggacaaaucaagucacccacccagaaguuccuucauuugagaagggaucaaaaagggacccuuugucuaugccccagugaggucacugagccuggccucuccccucuuuccuuuuccaacguaaaguuuucauccugaucccaugagcggugcacaucgcucuggaagauucuucucugggcuugucuugcacgcagggcugcaguggagcauggugguuacuggggcccacacugggcuccuaggcagccagugaagcagguguccagagacacugaugacagggagugcccagcugcaggacucugugcgaaugugaugggagcucaggagagggacuugcccccggcauagaggugggcaauggcacaggucuccauuucagacagacccuggggcagagagagaggagaaacuggcaaagacagggcuggagguggccggcagugggcagccggcagggggcggggcagccagaaggcagugaugcugcaguggggcccgugggaacagaggaaaggucacaugugaaauggucagcauugucuacugggcagcuaguuguccugaggauguuagaaagaacagcuucgugaagugccaaaggcagaagagagguugcauggauuuggggggugggagaggggaagggaagucagugagcaucugccucuccgucagugacacugcagugaagggagagaacaugaccucgauagaaggaugcucaaggccaggcaggaauggugggccuuagccuugaccccaggcuggaugcccccuuccucaagacaggcuguggggcucggggaagaugaggauggagacaagcccuuuggaaggugggcuguggccacagaagcuaagccacaagcccagguguggcuuucaggcuuaaagccagagagccaggugguggggacccagaugcccccugaacucuagaccccucuggccaguugcuuacuaaauguuaacccccucuugcaugaaugaaggggucuugaaucuagcacgcucugaaccagacucuccccccgccgcccuccgcccuccaccacaguagcagccccauccuccccagcagugcaaggaagaaacccaagaguccuugacuuugacccuccccuuacccccagagccaacccaucaccacauucugccaauuugaccgcuaaaccccuccaaccccugcacucucucugucuccauccccacaccuggucccagccacaucaccucuguccuggacuucugcuaugcccuccuaaccgacucucuugcuuccgggaugguggcccgccacucucuccugccuggccgucagagcgagcuuuucacccucgcaccgcaucaugucacuuuccugcuugagaccuucggagguuuccuucauuugccaggcagacuccgugcauggucgcccugugugguucagccccagcuugcuucuccugccuugucuccuagccacauggcccacacacacagcgcugcaucccucccugugcucaguccacagccuucgggcuugcugugcucucucugccugugggggcugugcacaugcugcucccucuuccagaguguuuucccugcuccucuuugcugaaccuaagugucuucagaucccagagcaagaucaccuccccaugggcaccugcuguucccugaccucugccauccagucuuauccuaucgauccuaucugccuaccacguucuacauccuggggccugucccauuugcagcuguuuauuuguuuugggguuguuugauuaacaucucucccucugggcugugaguuccagaagagugggcucugagucccuuuugcuccucacaauauucccagaggccacacgaugccuggcauguaggugcucaauaaauauuugcucaauaaacaaaugaaaagaucaagugggcccugaucagagucucagaaaauggauaggucugggauaagcaaccggaauagguagaacauuccaggugggauaccuggcuggauuaaaggcagggggauaccugcagccuagcacacauaugacguuaucaucaccaaauggccgugccuuacggcagggagggaccucuuauggucaccugcacugaggguggucaccccagccagaguccaggggaugcagaauucacuguuagacuuccugccucgugcuuugcaugucacucaugaggaccucaaauaacaaugcaaacuuaggugcauggagagcccaauguguguacccuagguggccccuaagccaacuugccgaugcccugguccacgcugaccugacaccugccccacugcgagugugugucggaaggggccagaacuauagugggaaaggggcccuucuuucaucucgauuccuuuucuguguuauuuccucuguccugaagacacauggugagcguuuuaaacauuuguugaaauauuuaaugguuaggauuuaaauaggaacccuaaugggcaaacagcauucaauuuucuaugauccauuuguuuccucuaaacugcagugauacuucucuaauuaaaugacagcuauuaccagaugauccaacuugucucccgaggaaccuagaaaguggaguggggcuaguucaggaaagggaagggcccaggccucacagggaaaguccauucggagccagaggaccuuccagucguccuccgcaccacauggcaggggguggagcuggauggggagagggagugguggagagguuucagauugugagcaaaccaggguguggcccagggcucguguccccuagggcugucaucaacccgugucccgggcacugagugcaagcaguggccucuuuguuccuuuugauuccaguucguuuucuccuaggagacaaaggagcugaauuaaguugcaaaaacuucccucuugggguaaccgugcagugauuuuacaacuuuaccauuuucucuaccucuuuuuccugucaaaggcagagacuguaucuauaaaaguggggugcauuucucaucugaggaggacaccuaucgugugugcccgacggacuccuuuuucugaaaaagagaaccccccaggacuuugggggucgagguggggagguuaucauuuuaaauuggcuuaucaaagccauuagagagcccagggccaguuuuauuaaagucuuuugaaaaauaauguuaauuuauaggaaaaugucaaauccagcuaggaggucuccucugcaaugacaaaguaauguuggcguuuuggaagaaaacugacggagaggguggcagggaacuggauucgucugcuuggcugcucuaacaagcaccacaaaauggguagaaauuuaacuuuucacaguucuggaggccagguucagggcuuacggaugcaucacuaugaucucugccuucaucuucacacaguguucuccuguguguguaucugugucccaauuucccuguucuuuucucuccucccucccucauuuuucucucuuuucucucuuuucuuucuuucucuuucuuuucuuuuucuuuuugcuuuauucuuuucuuuuucuuucuuucuuccucucuuucuucuuucuucccuuuuuccuucccucccucccuccuuucucucucucucuuuuucugccuucccucuccucuccccucgcuuccuccuccucuccccuccccuccccuccuuccuuuuucuuucucgguuuccagaccaagcuggagugcagugacacaaucauauuucauuucagccuugaccucccuggcucaggugauccucccaccucagccucucuaguagcugggacuacaggcaugcaccauuaugccuggcuaauuuuuuguagagaggggguuucaacauguugcccggcuggucuugaacuccugagcuuaaggcauuugcucaucucagacucccaaggggcugggauuacagaugugagucaccaugccuggcccaaauuuccacauuuuuaaaggacaccagucauacugcauuagggcucaaccuaauagccucauuuaaacuugauuaccucuguaaagauucucucuccaaauaaggugaaauucugagguccugggguuagacuuuaaccuaugaauuuuaggagaauacaguucaacccacacagggaugaaacauuuaaaggcaaauauuaaaauauucacuuugugucuuauuucaaaaucuauauaacuuuaaaaaauauaguucagaaucagauccagcaaucugugcuauuagaaaucagaaguguaguuacuuggccgggcucagugcucaugccuguaaucccagaacuuugggaggccaagauggguggaucacuugaggucaggaguucaaggccagccuggccaacauggugaaaccccgucucuacuaaaaaugcaaaaauuagcugggugugguggugcacgccuguaaucccagcuacucagguggcugaggcaggagaaucgcuugaaccugggaagcagagguugcagugagccaaggucgugcuacugcacucuaaccugugugacagagcgagacucggucucaaaaaaaaaaaaaaaaaaaagccugguuacuuugggggacagaaugccuggcagaggacauggggauggcagggaggaccuuccagaugcuggcuguguucuguuuuuugauccaagugccauuucugugggugucuuugcuguuugagaaaacauugagcugcugacuuaucauuagagcacuccuccauacggcaucuuagauuuuaauaaaaaguuuaccuagaaaaucuauucagcacacgaguuaggacaucugcugucuacuuccauggcaauuucaggauuugcuuucugucuaugaaaaccgaaacgaauaauucucaaccagagcugcagggccguaggggaagcauuuagggaauaaauagcaggugcagauucucgaauuguugaaggauguuccuuuucacaggccucucuggacaccuggacacgagaucuugaauuccaugccgugcagguaagaacuugggggauuauuauguuagucaggguucuccagagaaacagaaccaauagaguauggagagagagagagauugagacugagauuuauuuuaaggaguuggcucacacaguuuuguggggguuggcuggaagucugaaaucugcagggcagaccagcagguugguugaauugauguugcagcuucaagucugaaggccaucuagaggcagaauuucuuuugccagaagaccucauucuuuuuuuuuuuuuaaagccguugacugauuggaugagacccacccacauuauggaggauaaucuacuugaagucuacuaauuuaaauguuaaucacuuuauuuauuuauuuauuuauuuauuuauuuauuuauuuauugagucucgcucugucgcccaggcuggagugcaauguugugaucuuggcucacugcaaccuccaccugccagguucaagcaauucuccggccucagccucccgaguagcugggauuacaggugcccgccaucacgccuggcuagcuuuuguauuuuuaguagagauagaguuucaccauguugaccaggcugaucuugaacuccugaccucaagccauccaccugccucagccucccaaagugcuaggauuauaggugugagccacugugccuggccuguuaaucacaucuuuaaaaccaccuucacagaaccaucuagacugguguuuggccaaacaacuggguaccauggccuaggcaaguugacauaugaaauuaaccaucacauaugauccuaaggguuggucagucucugcccagggcagcaggcucugccagccccauccuuauccagaauuaaaacaugcagaauccuguugugagugaguuuaucagaaucccuuuagaucacauugguucuugcuaugcggaauuggcuguuuuuuauugucuuguuacaacucuacaccugccugugcauuucuguuaccaccuguaugagaaauggaguuugcagcuaucuagagcuuccuggcucaauggccuaauuuaugaacaaaaccccaccuuuuuuuuuugagguggagucuugcugugucacccaggcuggagugcagugggugugaucuuggcuaacuauaaacucugccuuccaagcucaaaugauucuccugucucaaccucucaaguaccugggacuacagacgcucuccaccaugccaggcuaauuuuuguauuuuuaguagagacaggauuucaccaucuuggccaggcuggucucaaacuccugaccucaagugaucugccugccucggccucccaaagugcugggauuacaagcaugagccacugcgcccggcccaaagcccucuuuuuauccacucacuuguagguuuuucugcagcaaaaccagguuucuucuuaugugaugggugacaaggaaccaaaaccaaccagccaacgacaucugggcccugggccaucccagguggcagcagucagcacuugguucugacagaccaaacagccuggugaggcuuauuaaucaucagagggaaggaaagcuccagaaaagcccaugucgaacuggacuugauagaguuacucaaagaaaacuuaccucagcucccagggcuccucugccacauguggaaacaggcagauuucccaggcagccauccauccuccggccuggggugaugaggaugcaaagcaagcauccgucccuguuaaauggaugcauuugcuguucaggcgauaaagcaagugugauguguguucauuguuauccucccagagcugggaaggauccacacuuuugguuacacgugggaaaacaccucccucgaggagaagugaauugcccaagguuacccaacacauuauggagagagcgaggaauggacuccagacuuccggacugccgagcugugaccauggcugggauccucagguggagcaccuguggcagccaugccgggaaagaagggggcgcuaugggucuuuggaacacagaagccuggggucauucuucauuggccaucauacccccaguugcacagccaucagggaagacucugaagggaaccagcucucuggagcucagaccucagaggcuaaggauggguuucccccuccuguaggcaucuccgucuccuccacaggacaauauacaacauuaaggauccuggguaaaugauuguucauggggcugcguuuucaaaaugucccacuuugcaaauguccgugcacauccgcaguggguggaaauaguugauagagaacaagaagguguuuaguguauggcuugccucuggggccucauguggucuuuucucugaucugccuugggggauuuggaacugugccaugaaggugcgagagggcgggcuucgaaccgagagcuugaauuccaucgcccacccucaagucuaugugggugcuggagcgcaucggagggaagccaggagucucugcaggcggcagccuugccgugugaggagcuugcauguggaagggggaggugauagucccucugaagaucuguuucuguuauguaaggcaauuuagcauccugcucccuaggaaauuucuuuuggagaaaacaggccaugcaaaugaaaaagucuaauugggugauuggcugcauuugguaacaugugcuuggagggcagggagauuggcuaguuguaaauaaacaugcuuucucugggcgguugacccuucugcguggacugacucugagguuuguccccgacagggagcagguggggugaauuucuugauuucuccuuagacaccaguuacuaugaaaucacugauucuuuucagcuggagaaggauaugcuagggguucuuggaggacauaccagggugcaggauguugggaugaaguuuaauaaggguggucuuggcaggguuuccuggaauuuucugucugggggugcauuuuuccuuuuuucugcccccauagcagcuuucugcucauugccaaauagcccccuugucagugacgggagaaauuuggucuuacaggccaaccuuggucucuuugcacagcaaacccccacgcauuacacaccacuagguacccauagacccuaacuggguggcgauacugguccgcagaaguuuugcaucuugauuguuaagcuuuugagaacccaaggaggguuagaaaggaaugaaaauaaaccuagacagccaccggcagcucucaaggcugugggccacagagcagccugaaaaaaauguuugcugaucgauuuaaaaagcaauccuaaaacagaaggaacugccguguugucuuuucuaccaaauauuguuuggaaauguaugacaaaggugcauuugauuacuuuuuccuguagaagguguuagcagguagagcuggugacuuuagcauaaaaguagagaaagggaaccaaguaaaaggagauugugccagauuuuucaggaaagccgguaacauugccuuugcugcuggaugggugugugucucuguguguguaagcgugugugcaaaagcuuguucuccuuugccuuggagaagguggccuguuggugugucaugcacacaaagggagaggaaagccguggaaaauagugauuguccuuugcuggcuucaaccaaggugaccuggaggacacguuccccuucauggcaucccagauaacguccuggagcacauaaccuucucuggaacauucagaucccacugcaggagccuaggacuguggcaugcuccugccucugggccuuuccaucucuggaaccgccugacccugcugcaggcucugagaguguggugucaagucaaggguugacaacaucaacuucagggccgggaaaauccgcguuuccaccgggcucauggguggaugacauaagcacugcaggcuguuucuucacauguaaaggagguagcagaauuugccuuguggugggucaugcccucagugcagugucuggcacccugcauauucucaaaaaaggcugguggcagcugugaaggugcugaggagggaguuugaggaagcuuugccucuccugucuucccaugucaccccuuuguuagggaggagccacaucagcuacaggccagggcccuagagagcuguagccccucacaguggcacuugccacgaggcucagcauccccacuucccacaucuacccugucgucuuucccacucaaaaacuggacaucaugaacucuuaucugcagacuuugaacauccuuauuagaaagggcugcaaaaguguagagagauauuucccugagaagcuucucaacaacaugaaugaaaaaauagacgagcucucuugguuugcaaaugcucuuaaaguugagggcaaaaaugugaaaaagaagagucuuuuuuuccuccucacccacggugaggucagagguggaguugcuuuaauaguaaacaccaaacacaggcuuuagggcuggaaaaagaacugcugcugcuucuuagugacaucacccuucccagaagcuugaacugaguuaauuuuaguucaguucaguuucuaccagcccuuuuaaaaaacauuuuaauaacuauuuauuaagcuuucuguaagcaucuggcuuuaugccagaggcuguggacuugaagauacauaaaauagucaaauucauuccuaucagauggauuauauucuaguacaacgaaggcaagauuuaaaccaaaagaauggccacugccaagcguuuuggcucacaucuauagucccagcauuuugggaagcagagacaggaggguugcuugaggcaggaguucaaaaccagccuggauaacauaacgagaccccaucucuacaagaaaucuuuuuuuaaaaaauagcugggcauggugaugcacaccuguagucccagcuacucaggaggcugaggugggaggaucacuugagcccaggagcucgagguugcagugagauaugaugacaccacugcaccccagccugggugauagcacaagacccugccucaaaaaaaaaaaaaaaaaaaaaaagcuucauacacacguucauacacacgaguacuaaguacgcaaguaagugcucacacgauuaggguagaaagggcuggaagcccaucaggaccgcucagggcucucuggauuuguuguauauguuguguuggcaccuccuuggcuugacugccccaaauagaaccugaugugaagguggaagcaguuauguuuccaguugccuuugcaaagccguuauugcaggcacaaucuuuaaauguagacaguggguuuccagaaguccugcucugcuucaccuugguuuguugggcuuguuccagaagaauugaccuccuaggaaugcccugcccuugcuggaaugccuuggaagagcacagugaaagggaacugggguccauugaaggccucucgcugcccaggcagagggagaugggcuuccuggagcauuggcugggccacagcuccucccucauucaacacacaguugagagcauagaguauugaaaagguggaguuucucuaaucaguuuggaugacuuuucaaagaggaaucccauugugucuucuaguaugugucuaagugcauauguuugcuucugauuuguaggauaaaaagcccaaagaacaagaaaaaagaggggauuuucuucaucgaccauucuccaagaaguuggacaagaaccugcccucgcacaaacagcccucaggcucgcuuaugacacagauucagaacaccaaagcccuccugaaggaccggaaggccuccaaguccagcuuccccgacaaaggugggucagcucuggggacucucucaggccacucguguugggcuguguguccgcuguguagcccucacaggggauggucgaaugggcccuagagcagagaugauuccugugcccacagaaaagcaggauuaauggaccugagguugccugagcacaguccaggaccaagcuguguggcauuagccaucugugcaggaagaauuugagaaaacagagauggggugcaaaguauuacggaaacagaaauugggguggaugauauugucagaacagagguugggaggcacaguauugcaggagcagagaucagggugugugguacugcaggggcagagaugaggcuguaaggaauugugggaguagagauggggugcagagcagagaccggguaucucccugaguucaaaucccagcucuacugccugcagagguccaaguuccuuuagugcugaggaucuucacuggauuauuuguaaggccucccaccuguuggagcuguuggguagaugagaugagaugcauauauaagcucccucaccugagucagaauccagcccaucacagauaacugacaaauauguuucccuccucugggacgagugcuaaaagaugcaaaaggcagaccuuacugggcacaggcuuaacacaugguagaaacgccaagaggggacacaggagcugagggcguccugaagcagagccaugaaguagaggagagguucuuauuacugagggggaugagacacuucuuggaguucaaucuccuaaaauaugaaagaccagguucagagagggccguggcugucugagauacacucagguguagcgggcaguuagucccugagcgggacuugaaccugccuccuguccuucuaucucccaugcugcucccggagagaagccacuguacccacuuugcccaaagcaaccugcuuucccuggggcagagcaugcaguggaucggggaggggcagcaguguccauguggcagcuggaacacuggagaccuuggccauuaaugaaguuuuacuucuuucugcugaugcaucucaggugccugcgccggccuuucauuucggugccuguguguuuauuucugcaaggcagggaggcuucccagugcccucagccacucccaaaaucgaucccagugggcaggagcuugcuccugcagcugggccuccacagagccuauaaaacguuaugggagaagaaagaagcuaagacagagcuuauuccgcaugaacuuggcuuuauuucccucauccccaaaucuguaggggguuuccccuuucuuuucuggcccaguuuccaaaccuggauucuagucuaugccaaccagagacagaaaccauggggaucuggcagguugccuuaacuguauggauggaugauauucuucccccguucagaauuggaugagguuccauccagaucaaaagucacgagggagccuuaaaagggaaggaaauccuggcacaugcuccaacacagaugaaccuggaggacauuaugcuaagugaauuacgccagucccuaaaggcggauacugugugauuccacuuauaugaggucccuagagugguuagauucauagagacaggcaguaaaauggugguugcuggggguuucagagaauggggauguauaugggguguuagauuugcaacaggaagacaguucuggagauugauucuacaacagugugaauauacuuauuauugcugaacuguacacuuaaaaaugguuaagaugauaacauuucugcuacguguuuuuuaccacaauaaauaaauuuuuuaaaugucacaagggaaacaugucuuccacugugggcuguccaaggaccagauuggcaggaauucagucaagggaccuuggugugcuucugggaguuuuauggaugugcuguugagugcauguaccuuuuuuauuccaagauccuuuggcaagguccagaauuuuuuuuucuuuuuuuucuuuuuuugagacagagucucacucugucacccaggcugcagugcaguagugccaucacggcucacugcagccuccacuucccaggcucaggugauccucccaccucagccucccaaguaguuaggaccacaggugcaugccaccacacccugcuaauuuuuuaaaauuuuuuuagagacggggucuugccauauugcucacgcuggucuugaauuccugggcucaagcaguccucccaccuuggccucccaaagugcugggaucacaggcgugagccaccgcugccuaggguccagaauuuuaagcaaccaaaagcagggacgauguuaggcuggggccaugaggcaaauuggaauccaggagacguccugucgccagcccucugucccuccauccuaggaagacugcccgaccucuguggggagagugacaugcugcuggugacuuuugcaaaguagccaaggcuguuugccgguugguuucuucugaccuuggcgggaacugucucaguuaagcuggaggucacagcaggcaggagaagggccgugagcacuguccggacguccucaugauuguuuaugcuuucuuggugugcagauuccuuuggcugccgcaauauuuuccgcaaaaccucagauuccaauuguguggcuucuucuuccauggaguucauccccgugccaccgcccaggaccccgaggauugugaagaaaccggagccccaucagccagggcccggaagcacuggcaucccccacaaggaagacccccugaugcuggacauggugcgcuccuucgagucuguggaucgcgacgaccacguagaagugcugucucccucucaucacuacaggauucugaacuccccggucagcuuggcucgcagaaauuccagcgagaggacgcuguccccgggucugccauccggaagcaugucgccucuccauacuccuuugcauccaacucuggucucuuuugcucacgaagauaagaacagccccccaaaagaggagggccuguguugcccaccuccgguucccagcaauggccccaugcagccucuggggagccccaauugugugaaaagccgaggccgguucccuaugaugggcaucggacagauguuaaggaagcgccaucagagucugcagccaucugcagauaggccccuggaggccagccugcccccacugcagccccuagccccugugaaccuugccuuugacauggccgauggggucaagacccagugcuaacuugggccagcgggguuugggguaucucuagaaaacagcaacugaacagagcuccacacaucugucagggugugagcacuccaaggccucgcguggagcauccuuagucccaccuguagcugaauccacagacccaaagccugcacaacccaaccucgcuuagggacccccagagaugcuggaaucgcuaggaggguuggcuccaggggcagccaauuccuaucauucagaucuuccuuccucccaaguacucaccaaccccuuccacuucccacuucccccaggcuuggggggaaaacagggcaugagccuucuggggcacucagauuauggacuguuaccagaucuuucuucacgcugugcuacaugugugccucucacagcaguuggccacaguuacagggagagaacaauaucacagucauucauccaggccacguuuccucugcggaguguagcagcccugccuuucauagcagggauuaccugaaggccagcaggagccgggggcaggcccaggauccucagaggaagauggagaggagcuucggaccaagaucaaaccaaacaguggggaccccaacagaagagaaagacugaaggagacacucauuucccaagcaagauuuugauagauuuuuguuguuguuguuguugaaacaugcuaaugauugaauuaucuuuuccaaagauuuuuuuuaaaugugaugucgguaaauugaaauaacauaauuuuuuaaaacuuggauggagagaugagaagcaauuccaccaaacucauguuuucacaggaggguucaguguggagagcaaaaaagcugacuguggugauuugcugagugcuguggcccacaggcagggcaagucucgguggcccuguguucauccuguuguuuaaggcauagcccugauccuucuggaaggcauagaacacgguuacagcugguucuguagaaagagggaaaagaugauugugacaauucagagcauaacucagauggcgagaaggcagcauuaucucugugcgaugcugauuucaagcugcccacagaacuggugcggcucagagcucggcgaguuugcugggagcugggagcaggcuugccuggcagagaaccuguucagauacaggccaguuucuucuucgaggaaagccaagcuccucaaacaggguucaguccacguuguguuuucacaccuuucuccaaggaucgaaccaaagaugugucuccaguauugugucugugccccuguguguguuuuguggacagccguguugucugacuguauccagcuggcacuugacagggugcagucauuggugagaagaaucagaaaaagaagacccaucagcacagguuggauagggguuaguguaggagaccaguuacagaauggccuggagucuucaacuuuugaccggugcaggugugaccagagaccaccucuguggccaccucagauagucaucucaguccaaggaucccaaaacacaaaucuagaauugcaaagccagccuuuauuucccuggcaggcagccuugccagaaggcagagaggcaguucugaaucauucucucauucaccaguggugacauccuucagucccucacaucucugacagagcgggacagaauggauauuuggcugaccuuggugagaccuggagcugccuguuucuucccuaggggaucaccacggcucuagggcauucuaggaugaggucagaccccuuggccauugguguuauuuuuuguauagcuucagacuggguuccagaacuuaccauugaaaacagagcuuuuaggccaggugugguggcucacaccuguaaucccagcacuuugggaggccgaggcagguggaucgcuugagcucaggaguucgagagcagccugggcaacauggugaaagcccgucucuaccgaaaaauacaaaaaaaaauagcuggguguggugguacgugccuguagucccagcuacuucggggacugaggugggaggaucacuugaaccuaggaggucgaggcugcagugagccaagaucaugcuacugcacuccagcuuagguggcaaagugagacccugucuccaaaaaaagaaaauagagcuuuauaagcagagagaagaaaauaaucaucuaagaccaucucuccauucgacaugaaguguaccuuuucuaaagacgguuuccagcugcaacggcuccacuuugcaggcuugcaggguguauaccugcgcauugggaacuugcuggaaccccugaugcauuuuccuugagagcagggguacuuccgccuugccguuagcuuguggagaacgugcuucuuauuccuggcaggcuucaagaacagcugcacaugugccgcuaacugaccgcguugccauuggcgaccuggacucugaacucagguuuauucuaaacccagugagaggugagggggagugaugaaaggggaucagcuguauuugugugugugugugugugugagcaccugacaaaucuaugaaaccgagugaaaggagaaauguuagauucuuuauuauuuuauuauauuuauauggaaagcucgacucucccuuugguaaguccgaagcauguugucuguucgaccgugacugucuuccucagucugugccugugauuccagucacccuguaguuacugacagaaauugacuggacugucauugugugaagucuaggaggaaauguccauuuuaauuguaugauuuggucauaaguaaggacuauauuuaugucaccauuauuagauauauguacuuuuguaaugacugugaaauacacuuuucccucacuacga

SEQ ID NO: 18167 - RNA, 697 nt, Homo sapiens
guuuacccaccauucuauuuaguaacagccauuggccaaggggaagagaaugaaggauuccaagacaggcuuaaagcuuucagucuaaaaugaauagguguuuccuccugcagguuuaggaugaucucuuuguguaacucacaaggaggcuaauccaauuccaggucuaaggucgucacaucaccgcuuuuaagguccccugaaaaguccacgguaacucaagcagucuuucucccuuagaugcuuuauacuucaagauucuggucucuugacuuuuuaauugaucuucacuuggcacuucauacuuggaacacaucagcuggaagguucuuuguccccucccugagaaauuaacgauguguggggaaacuuuuagaugcaccaggggaaugcuaauuaaaagaggccugcuccgagaccuuccgcaaaacaaucauccuuugaauacguggcugcucacccugccccaaucugucugcuuuguacguuuggguuucauguauuaagaguugcuuaguguaggacucacuuuugaaccuccuucaggcuccaagauaaagccuugagcugggucugcagggagcagugugagccaguuagcaugugguggugacggccacagccucuugcugggcucuaaaucauggcuaaaaccccagagcuaaaagcaucaccccuuucuggcacuuucaauuga

SEQ ID NO: 18168 - RNA, 3018 nt, Homo sapiens
cugaagcaccugcugccaucuguaccuuuucagcccaucugcauuucgaggcccaccugcggugccugcuccgccugccguaucucccgauccucacugccaucugugcugccagcauugggcucuuucuccuuugagaauucuuugcacuucauuguacuccaugcucagugcugcucaccgucugcuuuauaauacaggccacggugugcuucgcucagccccugaaauagaugguagucacucugggagcaagaacuguuugauuucuuuuuguugcucuggcaguaucuggcaagggucuuguacaagaucuugaucgaauuuauggaagugauuagccacacuguagauaacgauggcuuucugcuugcagaaacaaguggaagccggugucuguguuaccauggagauggugaaagaugccuuggaccagcuucgaggcgcggugaugauuguuuaccccaugggguugccaccguaugaucccauccgcauggaguuugaaaauaaggaagacuugucgggaacacagguacguaguuugugaguggguacucuggagguugaguuccuggcccccaaagcccuuaagauuugaugccccucuucuggauguaguguuuugcucccuacacagcuuucagguuugcuaugcccugcuucagagcagaguucugaauucaggagcagccccugagaguggguacucaugagugagggguuuggccccacacacaggaggcaguggacgcaguuugugaggccgcucaucaggagugacugcaaacauuuccacugucuuuggcugcuaggaagccagcuaccuaauuucuuccuauuucuacccaaaugcgucagucccuuugcauggaaauuuguguuucuagucuuaccuguugcuucauguuauuuucugacccucauguuccauuuuccuuggguuuucucacuucuuauccuauuggacaauauucuuugucuaagccauguuaaauaaaugaaauaugcagaaguaaacaggcagccccuuuauaccucgauuuaaacacccagcacgaugccagugcccuucccuggcaguggccuacagaucugucuaagacgaacuauauggaucaaggugcaaaugagauaggaucucccuguuguccagaggaggaaguuaacugagucagggcaugaguggaaacuuaacagggaagguacuaaagucagcaaggacuuagagugaggugcgggagucaggccucccauggugagcacggggagaaaucuguccccugcccccugcugggaggggcucagcugggcucugcccccugggugggaacacacagucaagccauucuuacgacuggccccaggcagggcucaacgucauuaaagaggcagaggcgcagcuguggugggcagccaaggagcugagaagaacgaagaagcuuucagacuacguggggaagaaugaaaaaaccaaaauuaucgccaagauucagcaaguaaguacuuuuugcuuuaaugugucaguaguuuuuguuauuucccuucaaacugauaaaaauguacagugaauccgaaagauuuaaacuacugguacaaauauuuuaaucuuauuggcucggguuuaaacuaaaaauauccucuuccugcacaccaacaaaaacuggaagaaaauauggauugaguaccaauaucuagaguuuguuuuaauaugugggggagaggaaauauacuauguuaauuucaagcguaaaaauagggcugcaaguaaacagauauguuccuugaaauguaaaauuucgcccgucacugauuucaggcuuuuucaaacugcugaugcuguguacaggagggggaggaggaaagguucgagaccuuugaaggacaucguguagcgcuguaaccugaggggccgccuugguuuugugggugcuccuacgucacuaggcugugauuuuggggaaauggggcccuccaccuuauguagauccagaguccguggcucugagcauccucccuuucccacuggaccugccugcagugucugccuugggaauggucaagacagagaugguaucgugcagccucuggucuccacacagugagaguccagggcucagggcugcucaagaccaaggcuucccuugaugcuucacuucgggugaucagacaugggggaccuguuuaucuuuaguagccggcaaaggcaaucguaaaacauuuguuguaacuucaggauugucacucuaagaacaccuuaauccacaauuugcucugcucuccucuuugcagaggggacagggagcuccagcccgagagccuauuauuagcagugaggagcagaagcagcugaugcuguacuaucacagaagacaagaggagcucaagguagcaggggacagaugggcuuucugcagugcuggcgcccacacauagccugugugccuuaccuggggcugcuggggagcagugagcucugcagaaugccggggaggggucuuucuagagcuucugucugcaggucugucgggguccugccagguguccccugguguuagacauggcaguauccugcuccuagagggcagggagagggggaggucagucauggacucuuucuucagucucuuuaugugcaaaacacuuuccugaaaugccugccugaauaaaacauacuuauuuccagagauuggaagaaaaugaugaugaugccuauuuaaacucaccaugggcggauaacacugcuuugaaaagacauuuucauggagugaaagacauaaaguggagaccaagaugaaguucaccagcugaugacacuuccaaagagauuagcucaccuuucuccuaggcaauuauaauuuaaaaaaaaaaaaaaggccacuuacugcccucuguaaaagauguuaacauuucuaguuuucuuuuagugugaauuuuuaaaauagcaguuauucaagguuuuagaacuuaauaaauaccuagucagaagaaaauguguaaaucguuuuuguuucagga

SEQ ID NO: 18169 - RNA, 868 nt, Homo sapiens
acagcucucacaguuuauuauauacagcgaaaaaacacauaacacaccuuugcccacauuuacauguauuuuacggaccauguuucacaucaguccgcaugcacaucugcacgugugugcauucggcaguauuuaccaagcaccugccaagugccagggccuguccuccgcacccggcgugaacuguccuggaccagucccgggagccgcgguucugaccagccgugcugacccuggacgacuccaugagcuguuuugugagaaagacacgccauuuguuugcagaguucugacuucugaggggucauguagcacauguuugguagccaaacgcugucauucacgaccaggagcgauggcugcaaugccuuuuucuuugcuuugcuuuccggugccgggagccuugccucccgccgccaccccuggucagcucugcgcaagaacgucguucuguuuggcagccaggccgagacgcagccugaaugugagcaggaacucggagaagggaagggagagaaucagaaagaaggcccgggagggacccgggaagcagugggaggucugcgcccuggagccccgcgagagcccgccgguuuggcacgggcuccucccgggccgcccggcgguccaacaaaggccggccccgacacgcacccggucuuuugugggagagaaacacaaagaagagggaaaaacacggaggaggccaacagcaccaggacgcgggggccaaccaggaacucccggagccggggcccauuagccucugcaaaugagcacuccauuccccaggaaggggccccagcugcgcgcgcuggugggaaccgcagugccugggacccgcccaggucgcccaccccgggcgccg

SEQ ID NO: 18170 - RNA, 2307 nt, Homo sapiens
guaaaaaaucagacuuuaaauguuuuauuuuguugauucuguacaccgucaggaaacaagguuagaaguaaaauaaagugccaguuaaauucggcuacuaccaacaaccaaaaccuuaaacauagaaaaucaaaguaaacugcggaaaggucauagcauaaccuuggguaaaggaauuuguuaacgucuguaacaaaucgaaacugacuacguauguagcucuucaacugcaagacggcgagaaggaagaccugcgggccgcgcuggucaagggcccggcccgcugaggaacagcggaaagcgccuucccgccgucgccaccgcagcugggauccgccgagcagcgggcgguucagggcucccgguacuccugcguguuaaugagaacguucauuagcgcucuugacaggacggcgacugugagacgccugguuaccuauuuuaguaaaucgggaacacuggaugcaaggcgguugguuuucguuuuuaagcaagcuuaaauguugguuacgcuacuuuuggggaaagggaaacgaaaggugaaucucgaguucuaaguugcuuucuaagaaacccccaggauuuaagagcgaaaacucucugcgacaaaacacuggauacgcgagucuuaaauacagcucuccaaacagcuggucuacaaaaguggacccacgucccaacccagcgcacccugcguuguccucgccccuacccaccgcaccccgacgccgaccaccuguccgccgaggguccguccgucugccacgucccagaccgucugcaccgccuaacuggucuuuuucugccucuugaguuccggcagccuccuuugauaggaccuggccggcgggaacaagggcgcccguggccucuggcggaggagaaggaaaagaaccaccccuccgcccccgccacugcucgagcgcagccccuaguacugggagccggcgugcuccgcuccggggagguagcgcucggggauggccucucgcugcacccggggcgcgccaaccacggcaaggcgcccuaaguucuacaucggccccgcgaagcgcgcaacuccagggacaaggagagagaugugcugggugagagcgagcacuuucugccuaaagccgcuggaaccgacccagaaccccaaacugccccgaggcgccaucgaacauccgcucuggucacuuuaacgucccaggggugggggcggggaagggggugcccgacagucccuuccucuggacuggaagguucgaaaugcuuuccuugcucggccucgcucucccagacgcagggagcaggggcgcggagaagcugagcgaagggaggccgggccgaggucgcgccccaggcccaggcccgcccucacuuggagaauugcgccugcacggcggccaggcccaggcuggccgggaccaggugcgggaacuugcacacggcgcaggugcagaggccggggccgccugcgccgccgccggggagagcgaacuggccgcacggcggcucguccagcgccagcgacagguacuuggcggggcgcagcgcgucgggggguccuacggcgccgggcgccagcagcacggagccgggcgcggcggcgagcaggggcagcccggccagcagcaggcgcggcgcggcgggcccggcgcccucgcccagcgcgcggcgcagcuccugcagcgagcugcccagcaguaggauguaguugcgggcgagcagcagcguggcuaucuuggagagcuugcggccgggcgcgcccuggcagugcgccgcugaguagggcaggaugaccucgcgcagggcguccauggccagguucagguccugcaugcgcuuccgcucgcggcuguugaucuugcgccgcagcugcugcugcugcuccuccuuggcguccggccgggcgcugccgcccgggugcgcgccugacccgggcccggggccuggaggcucggccggcgccuccggcuucucgcgcgcagccuuggggaggaggggggccgucguggaggaggaggaaguggaggagguggaggagguggaggaggaggaggaggagggcggcugccuguagcccaccagcucguagagggaggccccgagcugcaagucuccgggccgcuguggccgcagcauggucccggggaccgcguucacgcgcgccugggaaaccgcauaguacaucugggaggcggugggggcggccgaggacgcccuucaggaacgcccuggggugggccggucggcaggccgccccuccccgcggaccugcgcgcggggaaacgaugguggggcccuggcccgcgcccuaccccu

SEQ ID NO: 18171 - RNA, 6209 nt, Homo sapiens
uaauuauuauaguaacuuuauuaacauagacaacauuuacaaacauaaagugcacugugcugaaauuaaaaauuuacugacauuuucugguaaccuuaccuucucauugaccaauauggaaaaugguuuuguucaucuauguugcuguaaugcaguuaagccucuuacgucuaauucccacuuuuuuuuuuuuuuuaagacggagucuugcucugucacccaggcuggagugcaguggcgcgaucucggcucacugcaagcuccaccuccuggguucgugccauucugcugccucagccuccccagcagcugggacuacaggcgcacaccgccaugcucagcuaaauuuuuuuguauuuuuaguagagacaggguuucaccguguuagccaggauggucucaaucuccugaccucaugauccgcccgccugggccuccccaagugcugggauuacaggcaugagccaccgcgcccggccucgaauucccacuuuuaacaagagucacaaaauuacugccuucuaaaauguuuuuggaacuauagcucuuauuaagcaacauuccauacuguucacaauuuuauuuacagugauacuaucauuguagaaaccaaaugacaaaucauucaauaaauuauaaucacauauuaugccaauuaaugcugcagcaucuaagcuaaaggccaaaaauuucuuuuugaagguguaguuuuguuuguuguuuuaacuaucacacauuuuacaaaauaacacuuucuuccaaaaugcagguggugagucccucacuucugaaccacuucuguaacacagcacucuggauuaaagaaggaaacacugcacuccagccugggcaacaacagcaaaacuccauuucaaaaaaacaaaguggccacuggaccaggcacaguggcucgcgccuguaaucccagcacuuugggagguuaaggcagguggaucaccugaagucaggaguucgagaccagccuggccaaaauggugaaaccccaucucuacuaaaaaaaauaaaaauuggcugggcguggugacgggcaccucuaaucccagcuacuugggaggcugagguaggagaaucacuugaacccaggaggcggagguugcagugagccaagauugcaccauugcacuccagccugggcaacaagagugaaacuccaucucaaaaaaaaaaaaaaaagcggacacuggaguuuuuuucuagaauugcuaaaucaacuagcuucacugauuucugcagccaauaaaccaucaaguuagacaggaaaaaguagaaucuggauguuugguguguuuuucauucaguacccacagagaaggcccucauaaaaagaaaaguacaguaauuccaguaggcuaauuuucugaucuuaauauuuccacccauauggagggugucccaaaagucuuggaacgguuuugagccuuaauaaguucaggaauauaaauccagcaagcucguuuaaaaaaaaaagucaucuggagguuuaauugguuaaauuucauaacacuucaguuuugugacuuuugauaacauauuuuucgguuucccuguuguuuaaguaccuauguuugaaaauggcaacagucacugcuuuuaaguuaguuauuacagcucaaaacugcaccaaaacuuuuggaauucauguaugauuccuaagucagaaaccugauccuagcucauuucacuggaugaccaacauuuuaacacuagaaugaacuaaauuauuuucuuuagaaguuucaguuauuuuuggccaggcaugguggcucacgccuguaaucccagcacuuugggaggccaaggggggcggaucaugaggucaagagaucgagaccauccuggccaacauggugaaaccccaucucuauuaaaaauauaaaaauuaggccgggcaugguggcucaagcccguaaucccagcacuuugggaggccaaggcagguggaucaugaggucagggguuugagaccauccuggccaacauggugaaaccccgucucuacaaaaaauacaaaaauaggccaggcgcgguggcucacaccuguaaucccagcacuuugggaggccgaggcgggcggaucacgaggucaggagaucaagaccauccuggcuaacacagugaaaccccgucucuacuaaaaauacaaaaaauuagcugggcgugguggcaggcgccuguaaucccagcuacucaggaggcugaggcuggagaauggcgugaacccaggagguggagcuugcagugagccgagaucgcgccacugcacuccagccugggcgacagagugagacucugucucaaaaaaaaagaaaacaaaauacaaaaauagccggguaugguggugugugccuauaaucccagcuauucgggagucugaggcaggauaaucacuugaaccugggaagcagagguugcagugagccuagauugugccauugcacuccagccugggugacagagcgagacgccgucucaaaaaaaaaggaguuucaguuauuuucuuuucuugcuauauccucaggacaaaccugauagguuucucacucacacaucauuggcuaugugauuaguuuugugauaaguacaauggcacaauucuuaaauucuuguauuauagcaauaaaucucauuuuccauguaaagugucaguggaacuaagaaugauuuaugauaguaaacaucaaaaugaucguauuuuaauaaauuuccacagauucauccaguuuaaaaaaccuuucuugauuucagguguuuucucuccuucuccuugaucaagguuauuuggguuucuaucugugacuucuuuuguuuuuauaagggucucguauauuuucugggcucugacaauuucuuucugagcaucaaaauggacuuuuugccuggucaggaugggaacaauuaaauuaaaaucauuaauucgcuuguuuaauuuucugauguuuucuugaaacugcucacaaacaugguuccacuguuucuuuucaguuggugucauuggauucccaaguuuuuuccuagacacuaaaauugccucucugaguugcucaauaguaucgcuuauuuccuuuugcuuaaggauccauucugguugguauccauuaucgaucaguauucgguucagguugugagucaugggaucaauguaagaacagucagaaaacuuuuucagagguuuuccuuucccacugagauugucaaagucuccuuuugccauggauucuugaaugagguccuccacuaaacguucuauagcuugcguuaucuuuugcuguuugcucugucuuauauuuuuaacaauuacacuaucaggaaaauacuggcuuuguaguuucugcuuuugauauuccaucacuuguucagcagcacggucugcccuaaauugccuauaaugcuucucucguugaguuggagucccaaaaccaauaccuucaaaacuuaaauaaugucgguguugggguguuuuauauuugaauuuuucuacaucuucuucuucuucaccuuuacucugacuggcauuuguuuguucuaucacaugggagagcaccuuucuauaagcuuuuucaauccuuauaaauguugcagaaucagcaguauuagagccacugucaggaugauauugcuuggcaagcuuaugaaaagauucccugacuucaucugcagagcauccuuccuccacguucagcagucuauaauauucucugaucuucuuuuuggauuuauggguugacaucauucuauuucuaaugauaccaaaauauggaagcauuuucacucgauuaggaaucacuguagccuuuaucaggugagaucuuaagaucugagccaucaucacauacauuguauucauuauuguacccagaguucuuccuagcaaugaccuauaaaacgacaacaaauauagguugaacaaaguuguauuaucaguuaauuucuuauuuucagcaauaagguaaaagauacagcaugaauuuauaaguacaacaaggggcaguucuuuugaaugcugcugucaacuuuuuccuuuuuuuuuuuuuuuugagacagagucucgcucugucacccaggcuggagugcaguggugccuccaccuccagagccacgccuagcuaauuuuuuuguauuuuuaguagagaagggguuucaccauaucgcccaggcuggucuggauauccugacaugguuaucugcccgccucggccucccaaagugcugggauuacagguaugagccacugcgcucagccuuuuuuuuuuuuuuuuuugucugagacagggucuugcucuguugcccaugcuggagugcaguggcacaaucguggcucacugcagcaucaaccuccugggcugaagugauccucccaccucugccucucauguugcuaggacuacaggcgugcaccaccacaccuggcuaauuucuguauuuuuguagggaugggguuucgucauguugcccacccuggucuccaacuccugagcucaaacgaucugccaguuucugccucccaaagugcugggauuauaggggugagccacugugcccagccacauucuuuuuucuuuucuuuucuuuucuuuuuuuuuuuuuugagacagagucucacccaggcuggagugcaauggcaugaucucggcucacugcaaccucugccucccggguucaagcgauucuccugccucagccucccaaguagcugggauuacaggugcacgacaccacuccuggcuaauuuuuguauuuuuaguagagacggcguuucaccguguuagccaggauggucucgaucuccugacccugugaucugcccgccucgaccucccaaagugcugggauuacaggcgugagccaccgcacccagccccaccagcugcauucuuauagcuauauuucacugaugugggcagaaaaguggaagcugaugaaguuuaguguuaacauauuguggggccaggcacgguggcacacgccuguaaucccaguacuuuaggaggccgagguggguggaucaccugaggucaggaguucgagaucagccuggcuaacauggcaaaacccugucucuacuaaaaauacaaaaauuaacuggagguugcagucccagcuacucgggaggcugaggcaagagaaucgcuugaacccgggagguggagguugcagugaaccgagaucgugccacugcacuccagccugggcaacagagugagacucugucucaaaaaaauauagauagauagaaucuggauucuaccccucacuaacuaaccguauauuuuacaaguggaaaguucuuagagaucaucuaauccaaucuucucauuuaaugagaaaacguagguccggaagguuaagcaauuuaaccaagucccauaacaagguguaagcaaaaugguuaggggugggcacaguaaaaaaggaggcuugcuuaacugucuauaccuccagccgauuauaaacugcacgagagucugcaucaucucaagaagucuucucauaagacgacuuauggacaagguacguaccuggucugauacuggauugaauagaaucaaguguccaaaagacuuuaagcuccacagcucgcuaggaaggagcuaucugccagaggccagaaaaaccaugaugaauugugaggccucccaacacguuugcugcuauugcaauaacauggucucgaagaggaggaagacuuguacacugacaauggccaaaaaauacuggaaguggcuuaauuggaauugggauauauaaacgcuaaaacggagcuccugagacccccuauuuucuaggcaaucggugccaacggucugggagccggcugcgaaggugguuaucauggcaagggaggucgguccugccccgcccccuccucaccugcgcagaccugggguagggguuccgcggcucccgccccccugccgcgccucugcgcaugcgugcgcgguccgcccuucacugcgggugucccucccaccgccuccagcuggugccuccgccgggcuagaccauuugccacuuuacacugaggggcucggggguacggaaggcagaaucguaccugauugggacaggugaccuuaccaggaaaacggacaaucuuccgccaaacgaacuuuaccccggaggacccaggcagggcaccucgggagccuucgucccgaccggggaccaccagcuccaccuccguccccgcc

SEQ ID NO: 18172 - RNA, 545 nt, Homo sapiens
cugagccuccugugagucaaagugagauuucggagccuucagcagugccuacugauuauucagugucagcaucagaucccucaguuuuaguaucagaggcugcugugacuguuccagaaccaccaccagagccagaaucuucaauuacguuaacaccuguagagucugcaguaguagcagaagaacaugaaguuguuccagagagaccagugacuuguaugguaucugaaacucccgccaugucagcugaaccaacuguguuagcaucagagccuccuguuaugucagagacagcagaaacauuugauuccaugagagccucaggacauguugccucagaaguaucuacauccuuguugguuccagcaguaacuacuccagugcuggcagagagcauucuggagccgccagccauggcugccccagagucuucagcuauggcuguccuggagucuucggcugugaccguccuggagucuucgacugugacuguccuggagucuucgacuguaacuguccuggagccuucgguugugacugucccg

SEQ ID NO: 18173 - RNA, 545 nt, Homo sapiens
cgggacagucacaaccgaaggcuccaggacaguuacagucgaagacuccaggacagucacagucgaagacuccaggacggucacagccgaagacuccaggacagccauagcugaagacucuggggcagccauggcuggcggcuccagaaugcucucugccagcacuggaguaguuacugcuggaaccaacaaggauguagauacuucugaggcaacauguccugaggcucucauggaaucaaauguuucugcugucucugacauaacaggaggcucugaugcuaacacaguugguucagcugacauggcgggaguuucagauaccauacaagucacuggucucucuggaacaacuucauguucuucugcuacuacugcagacucuacagguguuaacguaauugaagauucuggcucugguggugguucuggaacagucacagcagccucugauacuaaaacugagggaucugaugcugacacugaauaaucaguaggcacugcugaaggcuccgaaaucucacuuugacucacaggaggcucag

SEQ ID NO: 18174 - RNA, 6238 nt, Homo sapiens
cauuuuucuugcaguucuuggauauguagaucagagacaccuguacucuucacuguagguucccuuccuuggcuuggccauaucaucaucuuccaguaaacaccuccaauucuacaaauaaauccuguuuauaaaaucagaaagugaacagaacccaaaucagaaacuuuuugauagcaguacuuuucuccccaagcuauucacagcugacauuuucacuuuuuuuuuguuuguuugaccugcagcauuuugagagaacaaguucuguacaaugaagcuggacaugauaacuagccagugcaacuuacaguuacuggugauaaucuguauucccaugggauucaacaagugaagcaaguuaugccaucaccaguuaagagggagauaguugguuuggauaauauuuuagugagaccauuugaguuguuaaucccccaaucaggcuaccugcauaucucaagagagaaagguuaacugacaugugcagcugacuuaaucuucuuguaguagcugaauagaaaccaugauaagaggguugaacaggcuuacuuagaaauccuaauauguaugcuuuuaguaauuuccugcaguuuaagcauuuaaaaaagaguuggaaaaaaaaauagguagggagagagucuguaugacaaauauuuuccacugaagacuuaacaaauauugcagaauuccaagggaucuuccugagaagauaagugagcauaacuguuuugaauuucuucgguucaaucauggggaaagugcuuaguaacuccugaugcuuacacuuuuuugagagagagagagugugugugugcgucuauuuauuugaaauuuaguacucagccauuuucaaucuuaacacugaguguggugccuuagccuuguuugucaucaaaaguugucagauuuuaauuaaagguugaggagaauuauucuuaaaucuggugggaaaaguugauagagaaagguacucaaauaauggugacauuauuuuuuguuaaaaaaauuuuuuuucuuaccaaagaagaauccuagaagguaaaauuauuuuacaauucuuuucaaagggcuaaaugaauaaagcagaugaugucucuugugggacgauauauguaacuauuugauauaaaaccucuuuaagcugcuuagaagauuagacucaaaagaacauacagauuaauucuaaagaagagaaucccaaaauacaagggcaaagaggcaggauugccuuuugcuuucauaucugcacuuuuaccuggcaauaauguuaaaauguguagaggaaauagucacaauuuaaaauguuuaguuccaguuauuuagugaccaucuaaauauacuauauuguauauauagaagguaaaaguaaugaauuuauuauuuauacaauuaguguuauauauaccaauguugugaaauacuuuugguaacacuucgugggagcauuaacccuuuugauuccuuguuagaguuugaaauaaaggcuucuagaguaaaaggagauaguucuuuuaaauggucaaccuuugaacugaauaguaauuuuuaucuaugccuuuuucauuuuaauaaauauaaauggaguuugugguucuuuguuguugagcauaaaacauuuaggcaaagaucacagauuuuaucuccauaagagggcugaauuagcuuugcuguaaucccuaaucccaccaauugucuugcauaugaaugcucuuugacaugaguaugaauggauagacauuguggaugaagcagcauaaauucauuucuuauggaaaaacaacucaucagacugugugcgguacugccauagcaucgucuucauacucagaaaccagccagcaucauccucaguaaggagugacuacagaacuuugacuguauuugugugaauuugauuuauaaacaaugaaauaaaauguuggaaaacuaauauuuuaaaaauaguccucaggggcauuaauucuugguaauaaaguuaguagagguuuauugaguagaagauuaggauguaaucuuugacauaaguggaguaguaacuacucaacuauuaguguggaguuuucauggauuuaguaucaaucaaauguuuuagggguccagagguaguauuguuaaggucuagugaaugcuuagauguuaagaucaucuuuauguuaagcaguuuacugguuuguauuuaucaaaucauauuuccacaucccaauggaauuacaauuuuuuuaaauuuauaagcucuaaauguauaggaaaacuuggagaaaaaugaaaauuuuaauuggaaauuaaacacauaggucccggcacugcuagaauguguaauauacagccuuguuauucuuuccuuccuagauucucuuaugugguuaacgcugaauuucucugaaccauuuaguagguuaucuauuuguuuucccguuguacuucauuuagucuauuauacacuagagaauuuuguaugauacaauaaaaagauucguaauucacuuuuuaaagccaaccaaacacauaacugggacauucuguggcuuuuauuuuuguaguugucauuuugcucuuguaugcauuaaccucuuuauauuuuaauauuugcuaaauauucuaaaaucauguuuuauauacaggccagaugcuuuuaccuuaggucuauuuucuuauaauuaaaguuuuccuuuuaugccugcuuuugagauaucugugauuaccaauaauagaaaauaauuuucugguuauagguauuuuccuuaucugacucaccccauccuaacaauuaucuuuagcucuuuuauauccuuucacugauauucuaagaagucucuuaaaauauuguucuuuuuaugucaacaguuguguuaacaaaaggaguaaauggauuuagaagaauuuccuaaaugagaaauaaaaauguaaaaggcucacuuaaauguauuaauauaggucaugaaaugcauguuauauggugccaguugcauuaugguaauuucauuaugccucagacaccuuuguagguuuuauaagaaguaguugucugcuuucuugcugagggagagagagugaagaauuugggcaguuuuuauuuaccugagauuuguaauucaggacacuuuuuauguaaauuucaccuuuuagagcaaaggugaaaagucaguaaacauuucccccauuaucauaccuagaauauuacuacagaauuauuuuuauacacuagguaacaugcuagucuuauaguguauugguagaaacuaaggcuuguuggugacagcuugguaauaguauucuacagauuaaagauucucuuuuucccaguuuuuggaggggccuuuuaccaucauuuuggugccuuucuuauauuuccaguuucugaauauuaaacgacaguuaagauucuaaagcucuauuguccaauacagcaguuaccagccccugaaaaaucagguuuuuaaucacacuaguuacauuucaagugcucaguagugaucacuguaagaaguuguacugggcaaugcugcucuaaaggguagcugugguauuaugaguguuucaauacugauaaguaacaucggguuugacccuuaaacauugcugcuuuggggauuguauuggcuuuuuaugccucauuguauaacuugaguuaccuugaaaggcuggaaacaggcuuuuugauguaaacuuuugaggaucuuuaugagguuaagauaaucuugauucauucuacuuugaguauauguuuucgcauuaaaaauaaaaauauggccaggcacaguggcucacgccuguaaucccagaaauuugggaggccaaggcgggcggaucaccugaggucaggaguucaagaccagccugaccaacauggagaaaccgcgucucuccuaaaaauacaaaauuagccggggguggcagcgcaugccuguaaucccagcuacucaggaggcugaggcaggagaaucacuugaacccaggaggcgagagguugcagugagccaagacugugccauugcacuccagcuugggcaauaagggcgaaacuccaucucaaaaaaaaaaaaaaaaaaaaugaaaccaguagucaaauuacuauuugguaauacauuuuugacaugaacuugcagcucccuugguaagucuguugaagaguaaaugaaguuuuacuaccucaggaaaaacauaguuguaauuuuauuuaaauaucaagguugcuauaauaaaauuccuuucagaaucaugaguuuaauaugaaacacuaagauuugaagaguuucauucuggggauaaauggugaggcauuuagguuaaacguuuaauaaaggcuaagagagaagaacauucgcagguguaauaguuugcuuuccacuuggaaagaauuaguuuuauucuagaaguuauauuuuagagccaucugaauagaugaguagcuaauuuauaguuggaaauuagggaucaggaguugggauaguggguagacacauuuuccccaguauccucagauuuuagccuuguuagaauaaaagccuauuauuuaugccuaagcacccuaacacuuagauuuauagagacugcuaggaaaagcaaaguaagugugagaagguuaaugagacaguacuugucgcaucuugugugccuucaaaaauuaccuugauaauccuaccugacaaaacaucuuaagguaggccuagggggacaugaauuuucaccugaaauaucugcauucucauuaaagucccaggaaucaaacagacuuaagugaaagaugacauacuaaguuucuuaguguuucaaucucacuuugcuuagauuaauauuucuaauaggucuuagaauuguucuaauuugugugaugauuuacuuaaaucaacuuagcgaaauuacaguugagagauucaauuugaaagaugcauucugcaguugauuagacuguuuauagaucucuagaaagauuuauauauuaacauaaacagucuuaauuacagaaaggauuaauuuuguuuucauuuuaagaaggcauuguaucagaauccauacuuaaagaaaaaccuugaguuagcuaaaggaauauuaguuuauuagcaagguaacuaagaauuauggaggauuagggguucugaagguaagaaagauuugugaauccuuaugcaugaguuauaauuauucucauagucauacagccuucucuacuagacaggucuuauucuuaagagaagucuuuuauacaugauacauagucuuaauuacagcuagccucuacuuguaaaaaagaaaauccuuagccguuagcuauuuacugacuuccccguauuuguuauguucaugcagugucuacuuauucuuuguauaugaaaacagcaaaaucuuccaugucagauaagcauuuuacaaaaaugaauuuucuugugugagauaacuaggaaauaauaauaauguuaaaagaaggacaaaaaccaagaaaugaguugauaaaaaucaacucgagcuuuuaauuuuagaacaaaaaaaauaacaaauacuuaucuugauguguuuuucauucugugguuaaaccuuccacaaaucugacaaauuaagaauuggcuccaaagauuacuuugaaaaaaaaaguuucuuccacuugccguaagguuuuaaaagguagaauaugagcuuugaaaagaaacaaaaguguuucaguugauguuauggacuuccacagaaauauuguaauuauaaauaguguaauauacuuaauauaaguaauaaguguguauaaacugaaaacaugguucauuuauuuauauccugaauauauuguuuaaagaaauuggguucuuaagaccaaaguguccacaacuggaagauguuaaagauacgcugaugaguaaaggagugaucauagugguuuucugcuugcuuguucaguaauuuugcuuacugcucuugaagguuaugcuaaugaguaaaaugaaaacugcuaaggaauguaauaaccuuaccacaguucaaaaaauuugcaguuuacuauaaauggcuuucaaucaugaagaguagcgaguuuuaaguucuuaauggaacuuucuaugauuauaguuugauauauauauauaauagaaaauugacuaaauucagucagauuuuggguucaguucugcgaccugugugauacuuuguaauuuaucuuaauccucuucuguuuuccaagauuacuuucucuuucugagucuucucccuguuuuccaagauuauuaguauuauaagacuauuauuuuguuuu

SEQ ID NO: 18175 - RNA, 7576 nt, Homo sapiens
caagucuaaucaucuuucagaagaaacaaauugaaggcaaggaauccagauguauugcuggagaaggaucagauggaacaaauagagggaagaaagaauaauuacucagggcgggaggaaguggagggaaggauguaaggaauagcaaguuuuucauacuuuauuuucacauaaaaggcugaaggcgcuaaagaagguccccucaucuaaucucugcuuuaagaaaaaaaagccuuccauuagcuugacuuccaaguugaaacuuuuccuuacucuuuuggucuugacugaaaaguucugaguuuuuaaacuaaagcuuaggcuaaaauagaagacuaauaccauauuuuccaggauuuguuuugcuggggaucaaaucaguaugccucuucuucaauauauguauggugugcaguucucuugcuauaauuaugggcaccuuauuuuccaaaugaaaaaucaggaauuauuuugauuuucagauuuguuuguauaucuuauaaggauguaaaaaguaaauugccuuuagaucugcagucacacagacauguuuaucuaaaauuauuuuuuauuauuuauuauuauuuugagacagggucucacuucaucacccaggcuggagugcaguggcaugaccauggcucacagcacccuugaccuccugggcucaagcaauacuccugccucagccuccuaaguagcugggccuacaggugcaugccaccaugcccagcuaauuuuuaaguuuuuuguagagaugaggucucacuauguugcccaggcugaucuugaacucccgaacucaagugauccuccugccuuggccucccaaagcgcugggauuagagguaucagccaccaugcccagccuguuuaucuaaaauuauuaaaaucacaaaacuagaacugucccugggacccaggacaacugguugcugucaggaugccacuuguaauugcuguggcaucuaggcauacuaccagguacuugcuguagagugcaugggucugagaaaugguguugagaagcuccagcuccauagguggcauguagcuuuuuuuuuucucauuuaacuauuguuauuacaaaugauaaugaucaugugaggauguuucuccggggcuuugcaguuacagaguauuucccuagccuguauuucauguacccucacaacuaaccuuaaguggcacaguauuguucccauuuuaucaaugaggaaaucaaaugccuuuuccucuccuccuuguucuuuuauuuauuuuucuuuuugagacagagucuugcucugucacccaggcuggagugcaguggcgugaucucagcagcucacugcaacuuccaccucccagguucaagcaauucuugugucucagccucccaaguagcugggauuacagacucaaugccaccacacccagcuaacuuuuuuuuuuuucuuuuugagacagagucucacucugucauccaguccagaguacagugaugcgauccuggcucacugcaaccucugccuccgagguugaagcauuucuccuuccucagccuccuuaguagcuuggauuacaggggugcgccaccacacccagcuaauuuuuguauuuuuaguagagaugggguuucaccauguuggucagacuggucucgaacucuugaccucagguuauccagccaccucggccucccacagugcugggauuacaggcaugagccacugugcccagccuccuccuuguucuuucacuguagaaagccacauuaaguauacuagguuuguguugcacaggcucauugguugccaucuuuuucuuuuuucuuuuuuuccucuuuuauuuauuuauuuauuuuuuugguacuuuacuguggguaaaaagcuggcauauuagggagugcuugcuuuuuuuuuuuuuugguacuuuacuguggguaaaaagcugguauauuagggagugcuuguuauucaugguguugugcuuuucccuccagguggcccaccagcacgaaugagaaaccagaaacggauaacugggaugcaugggcagcccagcccucucucaccguuccaagugccggccaguuaaggcagagguccgccuuuacuccagccacggccacuggcuccuccccgucuccugugcuaggccagguaaaggcagccagugagagugugaagacuuagcaugcuaucuagugccaaaaacuucagcaaaugcuuuuuggcaaugucauuuugaagcaagccuuguuaugugugucuugguuggcuggcaguaugggaauccagugcaggagccagaaaucugcugugaauaguugggaguugggggugggggugggacacagucaacuucuccugccuggguugaugaaggaagcuucauugcagaaguggcacuugagcugcaucuugaccaguggguaagaucuuacuagaaaauggagagagccugccugucagacagaaacugcugggaaggcucgaaggcagacagucagaauguauuuaaggaaaaucacauaccccuccauuugucuagaccauugaguuuuuuuuggaaaagguagaccaauuaaagguuaaugggaggcucugaaaugcccugcucggaaagaauaaugucugaaaggauaaaggugguuauucugaauaguucucuuuugcuuaauacaauaaugauaaaauacucaaauuucuaucaauaaucaugccaaacagcaagugcccaucugggaggcacuggagguuccagcaucauuucugaucugagaacacccagauggaacacagggucuaggcagauccaucuggaggagcggugugcaggaagauuagaguggagggccggcagggcggugccaccagucagggggcuguuggugucacccagcugagaccuagggcaggccuggacccagcugaguucauguucaccaaguagggaggugccgguggaagcagaagaggcgagcacgugggagagacugcagaggagagugaagagguuggagucacaaugccuaugggagccgaaggaaaggaaagagggcugggauugagaauaagggcccaccuuaaagcgggaagggagaaaggcagaaaaugaaaugaaugcgcaguuaaagggaagaguuguguuuuaguuguguugaguugaaggugaacgugggacccugucuggcaggcugucggaauauagaucuggaggauggaagagagcacgagacugggauuauagauuggagccauucccauagagaacauuaucggauaucaggaaaugugugaggucauccaaggagagggaauacagggagaaaauagcaaauccacaggcacguguguguucuguggucuggaagaagaagaggagcuacucagcaggaaaugguacuuuccuuugcaucuguccuagcucagcauuuagcacgugucacaugcucaguuaacaguaacucagugaugggguggggguuuguuccagagaguggaggugggggaugggagguugcuuauguuacuaaguaccguggucagggcaaagaagagaccauucauugugacagguagagcuuuguaaccugggaaggagaaggaugaaaccacacugcaggggcguaaaaggaaaugagcagcaagaaaguggaaagaucugcaaaaggaaagagaaggaccagagugaggggccucgggaaagcaagaaccagccauguugccaguggagaugggaauggaaaagugaagugucagaggauauaguugguauaaggcagaaaacauuaaaagcacagaaaagacaggagucuuuuucuucuggaugaggaagagugaagagauuggagaagauaaagccaagaaaaauguucaaguugggcugcaugauauuguucucagugaggagggagccuggaggggcugcggaguguagaagagguuugggagcaggcgaaugagggauccgacaaagaagaaugaagaauugggccggcgcgguggcucaugccuguuaucgcagcacuuugggaggcaggcaggucaccugaaaucaggaguucguguccagccuggccaacguggugaaaccucaucucuacuaaaaaaaauaaauaaauacaaaaaucagccaggcaugacggugggcgccuguaaucccagcuacuugggaggcugaggcaggaguaucacuugaaccugggaaguggagguuguggugagcugagaucacaccacugcacuucagccugggcgacagagcaagacugaguucucaaaaaaaaaaaaagaauugccuggcuuaauuuaaccugaguccguaauagaucauugcacauugccucagcuuucucuagcaaugcuucacagcuugggacuaggaauaauaauaguuauauagcucaccacuguuauuucuaucauagcaauacugugcauggaucuuacuaaacuuccuucccccuccccaccuacacacaucuugcauuaccaugggauugcuaaacuuuaauagccuuuuggagaaaguaucaucucuacuuuacagauguggaaaucgagauucagagagauuaaacaguugccaaagccagaaaauuaguaagugacagaccugggauucaaacccagaguccacauccagcccaggcuggggucauuagggcccaucaaugugaaaagguugacaaagcagacacggggaagauuucucagggggagagauucugaaauaccagugagggcacaguugaaaggccaacccugggguccauacguagagaaaucagugaaguggcggagaggauuagacagugcagaagggcugugggaugaggagcuacgcgggcagcagguccacugcaagagggggaaaauggaaggucgagaauauacaaucuuagggguguucgaaauccagggaaacccccucagcucugagggacuugaaggagugaauguacagcuaaguggaaggaaauaggauagggauguuguggguuuaagaaggcaagaacccaugaagaccaggaauuagagguuaucaacauagaugcugaaacuauuugaccuguuguaaauucucugcucaucagacauaaucauaacuuaaugucaguauaauauaaaugacuucuaaaggcauguacaaauugguucugaaguaacucucucuaggcauuaucuuuuguucuuguccauucauauauaugauugaaaguugguguuucauuuuuuacuaaaugcuuuaagauacuguaaugguuuaaugcuauagcuuaaaagauaauaaaugccucacccugccuuuccagccugacuuccuccuccaccccuccaugagacuaggccacaugcagccccggauugugcuucucuucccggacccccugcaguguuccaccucgaggcuuuugcccaugcugcgcccucggccuggagugcccuuccuccgaagcccuagcugucaaaguccuucucauccuucaaggcccaucucagaugcugcccccucugugaaauuuacgcugaugcccccaggcagaauucaucccuguuuucucuuuauuccugcagugaauaguaggaacuccuuuuuaguauauuucauucugccaggugguacacuugguuguuuuuaucucugucuuccccauuacuugugaauuaccugcuaguaauacugcccaucuuuauagugcuuugugguuaauaaagugcuuuucccuaaauuaucugggggaggcagagacuguuuuuuucaucuguaaucucauggggcagugcauguagauguacaauaaaugguaauuacaaugaauuuaugcuaaccaaaucccuguuuucucugaaaaggaacuaaaacaagcauaauccagauagggccuauuucccugggucuaccuaaucuaaaaugccaguuaaugaucucaugauaguucauaaaaugucugcuccacuguuaauccuccacuaaaaaugccagucaaauuggaaauggggaggugucccgggcaacuugagagugaaaauagaaccaaaauauaaagggcacacagccagaugcaacagaauaauugugaccuccuggcuuuuugaaauagagaguucuagauggucagacaaugacuuugugaagaggcuggaaggcuuuggccuccacuuuuggaaauaaacaauuguugggaaacagugaagcauccagcccuccugcugugcugccucagggcccuuuguggcugugugugcuugucuggccugugcuuguuggagaggugccaugcucacgucugcccuaauugauaacaaagcgcaacauaacgagagguccuuuauguuauuccacacaagggugaaaagguggaggggcuacaagcucaagcccuauauccuuggagagccaaaaaagacaaccacuuaaauuuuaacaaaaaugaugucaucaccguccuggaacagcaagacauguggugguuuggagaaguucaaggucagaaggguugguuccccaagucuuacgugaaacucauuucagggcccauaaggaagucuacaagguauuuuuguauuuaucugcuuguauuugaugaaaacaauauuaggcguuauauuacuguuugcacuaguuaagauucacagacaggaguugcgggauuaguuugucuucuagaucuuuuaacugcaaaaguuauaguauauagaguaccaaaagggagccucuuauagauaagugcauucuuucuucucucaugaaaaccuaugugccuuguuuuucauugccuuaugcaagaaggaauucagcucugagaccuggaacacucuugugcauuaguuggagauuaugacucucuuuaugcuuauuacccagugcuguaccagauauaugugaauacuuggaaacccaaaggaucuggggaaaugaucagaaggacuuaauugucuuuuucauuagggucuuauagcauggaaccuaagguuguuaauuccuccaaccauauugauguucaaaacaaauuaugagcuuuaaaaggaugaaaauagcaaaaauauucaaugagcaucucucagucagucaugccuugaaauaaacuaguacauaagccauguguccaguauagcaaagugcugaaaaauaagaaugcgagcuuagagucaugccucuguaguaccuuauuauguguuuuuaaccuagcuaaguacaacuauuucagcugugggucguuuaaaguuuuaaaaguuaagcaguuuuaacagaaaaaucagugucauuguacgauuuucuuugaagauaaaaauuaaaauacucucuucuuccauuauugcagcauggauucugguucuucagagaguccugcuagucuaaagcgaguagccucuccagcagccaagccggucguuucgggagaaggugagggccugaguuguauuauguucuucagaagggucaaggacauuguguaaauguuugaaaugagauugaauuucaucuuaagauagacugcauuuaugaucaguauauuaaacuacaguaaaauguaaguuuagcucuuuacagaaucggaguacuucauggaaaauacugucaggua

SEQ ID NO: 18176 - RNA, 2647 nt, Homo sapiens
ugcgugcgucagcggccagcgaagaguuuccuagucaggaaagaccccaagaacgcgcggcuggaaggaaaguugaaagcagccacgcggcuugcucccgggccuuguagcgccggcacccgcagcagccggacagccugcccgggccccgcgucuccccuccggcuccccggaagcggcccccgcuccucuccccgcccccgugcgcucgagcggccccaggugcggaacccaccccggcuucgcgugcgggcggccgcuucccccugcgccgguccccgcggugcugcgggcauuuucgcggagcucggagggccccgcccccgguccggcgugcgcugccaacuccgaccccgcccggcggggcucccucccagcggaggcugcucccgucaccaugagucccuccacgcccucccugccgggcccugcaccucccggggccucucauccaccccggggcugcaacccaguccccggaucccggccccguuccaccgcgggcugcuuugugguccccgcggagccccucaauuaagcuccccggcgcgggggucccucgccgaccucacggggccccugacgcccgcuccucccucccccagggcuagggugcuguggccgcugccgcgcagggacuguccccgggcguugccgcgggcccggacgcaggagggggccgggguugacuggcguggaggccuuucccgggcgggcccggacugcgcggagcugucgggacgcgccgcgggcucuggcggacgccagggggcagcagccgcccucccuggacgccgcgcgcaguccccggagcucccggaacgcccccgacggcgcggggcugugcggcccgccucguggccuucgggucgcccgggaagaacuagcguucgaggauaaaagacaggaagccgccccagagcccacuugagcuggaacggccaaggcgcguuuccgagguuccaauauagagucgcagccggccagguggggacucucggaccaggccuccccgcugugcggcccggucggggucucuucccgaagccccuguuccuggggcuugacucgggccgcucuuggcuaucugugcuucaggagcccgggcuuccggggggcuaaggcgggcggcccgcggccucaacccucuccgccuccgcucccccugggcacugccagcacccgaguucaguuuuguuuuaauggaccuggggucucggaaagaaaacuuacuacauuuuucuuuuaaaaugauuuuuuuaagccuaauuccaguuguaaaucccccccuccccccgcccaaacguccacuuucuaacucugucccugagaagagugcaucgcgcgcgcccgcccgcccgcaggggccgcagcgccuuugccugcggguucggacgcggcccgcucuagaggcaaguucugggcaagggaaaccuuuucgccuggucuccaaugcauuuccccgagaucccacccagggcuccuggggccacccccacgugcaucccccggaacccccgagaugcgggagggagcacgaggguguggcggcuccaaaaguaggcuuuugacuccaggggaaauagcagacucgggugauuugccccucggaaagguccagggaggcuccucugggucucgggccgcuugccuaaaacccuaaaccccgcgacgggggcugcgagucggacucgggcugcggucucccaggagggagucaaguuccuuuaucgaguaaggaaaguuggucccagccuugcaugcaccgaguuuagccgucagaggcagcgucgugggagcugcucagcuaggaguuucaaccgauaaaccccgaguuugaagcccgacaaaaagcugauagcaaucacagcuuuugcuccuugacucgaugggaucgcgggacauuuggguuuccccggagcggcgcaggcuguuaacugcgcagcgcggugcccucuugaaaagaagaaacagaccaaccucugcccuuccuuacugaggaucuaaaaugaauggaaagaggcaggggcuccggggaaagggaaccccuuagucggccgggcauuuuacggagccugcacuuucaaggacagccacagcguguacgaagugaggaauuccuuuccaccaagagcgcucauuuuagcgacaauacagaauuccccuuccuuugccuaagggagaaaggaaaggaaacauuaccagguucauucccaguguuucccuggaguaaugcuagaauuuacuuuugucauaaugcaaaauuaaaaaaaaaaaaaauacaacgaagcgauacguugggcggaugcuacgugacagauuuuuccaaauuuuguugcggggagagggagggaggagaauugaaaacggcucacaacaggaaugaaauguacauuucugcaguggauuuaaaaaguacugcuugguuaguuggaagaaaaauaauuucauuggaaaacaguaacagugcauugacguuuuucuucuacaacuuuagguaaagaacuauagguggucucagaagauaacuaaaucuuuuaccuuuuugcucuuucaaaagccuccccaaaauaugcauaaagaugggauuagaaucucaacaauucucuuaaaauuacccuuugcgagcaauauauuuccaaaauca

SEQ ID NO: 18177 - RNA, 2518 nt, Homo sapiens
gugcggcccaggaguccuccgcgcaccccugcagcggcggucacauaaccccaccucuuccaggagugcagcuuucccggccccccaggccagagacaggcucagaggacgcagggcaauuccuuaccuuggcgucgagaucauguggggacucucggccgugugccacaggcugcagagccguggagcaguggggugcgugaccuggaggucagcaggggccgggaggacaccgggccgcggaugggggcgcggagauuuggguucucggugucacugcucucgccacuggcccgggaucaugagccugcugcuccgaaaacucgccgucggacagcgacugaguauccgcuucccuccccuggcccuccccugcgccaggaaggccuggccuucggcaaccgugccugcagcaggcgcuccugaccuuuuccagggacuccuuugaaggucaaaaguucgaaggcguucgaagccgagcaggcucccuccaggggcuggaaggugugcgcaaacccgggcucucccccugccugucccuagccccuugcggaguccacaucguggccagggcucgcaggcuuggugcuccgaaaccgcgacgccacgcgagccggacgcacagaguaacagcgcuuuccuuugggguuucggauccaggagcgcuuuccuguugcagcggcuugagcagagggccaugggcuagcggcgcgggucuccaaugcccaagccuggcgagucggacccaccuccgcgcccaggaucccgcuccuggcugcgcugacagcugccggcuccgggccucugggagaaggagcuccaagggguuagaggcuacggacccagccccugccgcagcuuccgcaggcggcccccugagcccgcucuggcaccuccugggcuucgggaggauuuaaugcguuucucacccccacggcuuccgacccucaauuauggacccgggagaauuccuccugggcuugaaagggauuacccagaucgcagaaacauggcuaaguggaagugggagaaacccgacaaguaacaagaacggaaacuuuccucaaggcaaauuucccggauuuuacgggaaagcgcacuuaucuucccagggacagccucuguucacguguccgcgaggcagguucgaagcgcgcuacgggaggcagagcaaugccguguuugaagacuggaagauacgugggugugagauaccuccaggcccaacgccugcccagcagcugcccaagcagacguuguguacucggcucccccaagcacauccuuucgccguacacgcgcgcgcgcgcacacacacacacacauccacacacacacgcagcuguggcucuggggucccugauggcaccacgcaaaguaccagaaguacacgggcaccgcaccucgagguuucccagguaggaaggacagggaugccucuguggaauugugaaggaagaaacccaacccuuggugggggccgucccggagcucucccugcuggagggggagccucgggcccucggaaaaggacacuuagagcuaauacccacaggccguaugugggauaguuaguaugaagcuggaagcucuguuggaauggaaaaguaccgggcaggugcucacuagaguggucaggagcaucggcggugaccgcagauugggacaccuccuaugucuuucccuucuggcgcggggagaagaaauuccugguccagguauugggccuaaagccgaacgcccagcucagaaagcccggaccagccucgcgggccccaggggggaggcagagauggagcgcacgacccccgaguccgaggcaccguucuaaauggcgguucacccacuggccccaaaggagccugaagaguagggaaugaaaggagacugggggcuggaaaagggcgguguggagacgggucggacgcauugagguccggaccucucaguacguccccacccgcagucugucccacugcgcgugcgagcaagccgccucguaccccaccucuuagaaauguuccauuaggaaacuuaucuggaagaaauucaggccccaagaggaacgaggcgggcccggaucgccucacaucugcuuggauuuuccgcuucagaugcuccgcaacuguucuuccccaggccgcgccggcgccuaccugcgauccauccccagcggaagccgacucgggagagaucaagggaagaacuccggccguuccccgcgggaugggagaggcuauugcaguggcagcaggagaucagagaccuugucacuaaggaggugggggagggggaagaauuuccaaccucugaaguggaguuuaagaacuuccacugccccagcaagcagaggcaacagaaaauccaggacugcguugauucaagccuauuugguuuauacgcucuugucuacauccgcaaucaguuaugauaugguuacuccagaaaaguccgcuuggcccagcaucacauauaugaccuuuucauggcugagaggauuuuuggucugggcuaucug

SEQ ID NO: 18178 - RNA, 148974 nt, Homo sapiens
uggcggcggcaaccgcggcggggguauccggggagacugcugcugucgcugcugcugaucgcggcccaggucggccucagagagcggacaccccgagcggggggugcgggcgccgccgccgccgcuucugcugcugcuguuccugcugcugcuguuggugccgcugccgccgccggcgagcaggcgggaccggugugagugcgagugugugugcgagggagcgugugcgagggcgauugugcgcgcgagugugcgggugugugcgagugucugucugucugugcggggacucgggggcgggcgguucgggcucuccuggcggaggagccgccgccgccgcccgggccccggcgcuucucgcugcgcagguucggagcgcgcgccauuuugugagauuuacaaaauccuccucgggaagaagccgccggcagcagccgccgcucggcgcccggccucgccgacgccgcccucugcgccgggccggccgugcggccccgccgccuggaaucggggcccggggacugcgguauuugccggggagggggcugucgccuccccggccccgggcgccgcuggaaccgcgagccgaggagagacugagcaggcugcggcgcggccaggagccggagcgccgggggcggagagaggcugccggggcggcgcuggcugcggaggccgcggcgggagcgcggcgcgggagcccgaggcugagacucaccggaggaagcggcgcgagcgccccgccaucgucccggugaguguccggcccggccgcggccccgcccggccuggcgcucggcucccccggcggcccgcagccgggccggagccgaggccggccgggcggagggagggaccugccauuuuaggaggaggcgccgcgggcccagggccggccgccgggggagggagccucaggccgggucccggaggagcggcgggcgcgagcggagggaaaguugcggagggugggagcgggggccgcggccucccgggagccggggccuggggggccguagacagcgccagaccuucacuggccgcccgagcgaagggguggagguugucuuccuccuccuccuccuccucuuccuccucauccucuucccccagcuccucccucgucccuccucucgguccccaccagugugggaaccgccggggugauucgcaaggacaaugcacggguuaagaaaauggggccggcugccgggugggcgaggacggcggggccgggccgggccgggcgccggcgaaggucgggagccgcugccucggcggcccuggggguccgcgcuggagcgaggggcacucacuggccuccgaaguugggcggggagcgcgaguguccccggcggcucgggguggagggaugaccugcccggcagccgggggaguugguggcugaggagaggugaauuagaauagauaccuguguaucgccacaaaacuucaccagucuauuuauaggcacaaacccacucucgcuucggagccaccaaagcugcugaguagcucaguacuuggcgaaaggcuccucccuaaucugaaauaguuaaaaaugguaaaauuagugagucagugacucugguuacuugccugugccuuucgcccaacccuaggugacacgaaucccauaaucugggcacagcgcaggaaugcuagcaccauuugguucuugaauuccgcccaaauugucagaaaauacgccuuagaacguuguuuucacaagugccaggcucuguuuuuaggguuuucaguggaucgaccagcuugcccagccgguaggaacuguucccauuuuauagaugaggagagugagucuggagaggggcacugacuggucuaaggucauacagcugggacuccaggagccagaaggcuguagccagucuggaguugugaaucauuaggguguaacucauuauuagaaauacuggcaaauuuuggagugauucguguuuaaugacucaggguucuaaccuagagauguguccccguaagguuuuuagcguggaauuaccuuuguggcuugccgaggccaaaagguaagguaauggugaugaggccuguuaauaaacuuuucaggccuuuccccccccaagaaaacuauguagucaauuuuugaaugaaaggaauuaaagauauuccuugauguguuuuguacuucaaacaauuuugauuauagucauuuuuugaguauugaugagucauaagaaaguuuuguguaaaguuauuuuuaguuauucuuugaaugcuuaaggguuccucugugacccuuuuauaguuuauguguccaaaguauuaaugaauauauuuagcauuuugauuuugagguguuuuaauaacucaggggaauuaccuuuagcuuuuguguuguuuaauuucucaugucuugaucaguuacuuuaggauaauauuguuuucaaguagacuuuuaaaaaugugagaccagaacuaaaguuucauguguuaagguuuuaagcugcagaagaucauuucaaagaaacugguuaugaaaaaagcuuacuugauuauagucaagauuuuuuacgcauacuucagguaucccaguacuuuggaggauuuucccugguauagcagugguguuuaugguagcuguccaaauuuauuuauacuucaaaccaugccagaaaguuaaggauuucugucaaugucuacaccuaguucucuuguuaagacuaguaaaaaguucucuuguaaaaaguucauuuuuaccucgagaggcauaagcucagagauuauugcaggaggaagggucaccccuuguguuugcgccaugaaggcacacuccuuuuuaccugguggguguugaaaaaauauuugaaggaauagaccugaaugaaugguaauuauugguaggggugggaaauggacuaaaugaccuagugagaucuuuguuuugagaucuaaguauaagaucaucucuuaaaccuuuuaacaauauuuugguggaaccuauuagaaacuuaacacauuauugugugcaagauaucuaaaaauaaguccaguuuuuuagaggcaguaacauuuaagauaauuuaaaacauuccauauuaguguaaugucuuguuagggaauguggacaguaaaaacgaccauuuguuaaauuuuuuuuccccuccaaaauauugucugauguuugcuccuucguguuacuuauggagaguuacuguuuaugacuuaaagauauggggguggagaggccuagguaacugcaacaauguauuuagguaauuuacauuagguuuuuagagggcuaugacuaucugcaaaaggaaaauucaagauaccuuguuauaaacaugguauacagugaccuuuggcaugcauuuuguuuuguaacuacacgaaguguuaauuuggauugaaucuuuguuuucacuugaaaaccuuuuuuuuuuuuuuaagaaauagcuuggaaauuuaggcugcccugagguguuuucgugugucuguuuaugguugacaaguaucuaguuaugagaagaaaauguggauagaauuaacuguauuauaggcgagaagggaauugccuuauaaucuugugccacugaacacaagauuaguagaagagugggcuucacuugugacuuucuugguauuugugauuaggcgugugccaguuugucuuugcuuuggcauuagcuuuccucauauuugagaaggcuuucacguuuccuguacacacacaggaagcaguuucaccccuccccaagaaaaaacuuaucuaaacccagcaaaacccaaaaacuuccagaaagucuuuaucaagaauuuaguuccucauccccaaaguuguguuagucuuauuuuguaguaaucauaagcaguuauuuaaacugaaccaagaaucuuuacuuucuguugaguguuuuggugauuuuaccuccauauauguucgucuauuuucgauuuagaaguaaagauauuacgugaaacuauuaguaauguuuccugaaacuugauacuaacaguuugcucugugaaagugaauugugugaccaguguaauagcaccuuauguauauauggugguuuugccuuuuaaaagacuuuuuaccagauguuaucuugacuguugggcaauuuucugauggcuagagaggugguaauuuaugacccaaagcuugcucaacuuuggauuaaaaaguuuggagaguuaaaauuuguguuuaauuacuuggaaaaaucagcaaauuauauuaaauuaccuaaaauuucuccucaguugcucccaaaugaagaaagcuuuuugaaaucuugccuuaugucagugcuacaauuuuaagcuagaguuguaaaguuuaccauagaguguuugaaagugaaauguagacuucaugugacuaaaauaaucauugaagguucguucauauuggguaauugaagaaagaucuuauuuguuaauacuggcuaccagcagccuuaguuugauuauuauuuuuuuauauggaaacaaaaugauuuggaaauauugcacugcguaagccagcuagguauuuaaaaaguuaagcuuuugcuuugaaauccuacuuccagaguacuaaaacgagugagaauuguuuauuggugauaauacccuacguugaacacgugaaauggugugguuucuuuugggcauauauguuuugcuaauguagaaccauuuuggugucuuggcaauugguucuuauaccagagcuauguaucuucucuucuagaaagcgauauuuaaaaguuuguauuacuguuaaaacuagguuuugacaaguuacauaauuuuuuuuugguuuggggcagaugcucauaucugauacauagugaguaauagcuuaaaaugugucuuuguucuugucagugaauauucuuguuuuaucuccccauguuagaaaaguuuguuuuaauugauuuuuggggggggcccagugaacuggcuuaacauagaaugaaacuggcuuucagcaucaacucuauuuuaaauaacaucccuguucauuaaauaacccccuaauuuuucuugaguguauaacauuuccaaugacaagauuugauuuuuuaauuuuuaaaaaagcuuucacaaaaagcuuuuccguauuaucauuaucuauauuauuugauaauauagagccauuucgacaucuuggcaguugguucuucuaccagagcuaugcauuuucucuucuggguuuuucacaaaagcuuuugcauguccguaaaauguuauggacauguaugguuaaggcuugcaucuuggcacccauguauuuggguaaaaagaugcuugaggccuggcgugguggcucacaccuguaaucucagcacuuugggaggccagggugggcggaucacuugaggccaggaguucgaaaccagccugggcaacauggugaaacccugucucaaaaaacaaaacaaaacaaaaaaaaaacagguguguuagugccaccuguaguccaggcuacucaggagacugaggugggaggaucaguugagccugggaggugggggguugcagugagcugagauugugucacugcacuccagccugggugacagaguggagcacugucucaaaaaaaaaaaaaaagguuugaacugugacaucugucugucugcuugcuauccaguuauagacagcaguugaggcagcaugauacuguggaaagauccccugcccaugaaaccaugaacagaggcuccagaaucuggcugaucugagucucaacagguucuguuggcugugugacuuuagguacagugauuucaccaaacaucaguucccucaucuguaaaaugagguugauaguaauuagcauaggaaucuugugaaaauugagauaaugcauguacauuucuucauggauuucuuucuccuccuuuuuucucuccucaucuucauucaugcucauucugugauccuagcauaaauauuuucuucagagaggccuuccccaaaccagguagucuuccuuggccaugcauucuuuuuuuuggccaagcaggaccauuuguuuuucuuugcaacccuuacugcaaauaugauuauucauauauguucuuauauauaauuguucauuaaauuucauuuaauauaauuguaaauuuaauuucuccauuaaauuuuaaaguccauuuggacaggaagaaguuuuucuugaucauggcuguaacuccagugccuggcacauaggggguuuagauucauagaaugauagaaugcggaaccuguauguugaauccuuccugacuaccacuccuuagccaugucaucuugggcaaaacagcuucuccucgcuucaguauccuguaugccagauauagauagcaccggcugcccugcccaggauuuugagaaugugaaaugagacacuauaaugaagugcugaaguguaaaaugccauauaaauauaaaauggcacaguagcaauaaucucaguaaugggguuauucaguaggaagcucuauugugacuuaagaguauagaauuuuagcuuugcugaguugguugguagcuaauauuuaagaguuacgauaaauuuaagcuuucuuauauguaccaguuagaauguagaugggccuguuucugacuaaauacaguggcuuaaacgagaaauuuauuuuuccuucauaaaacaacaguauaacuuaucuaaggcugauaugguggcaccacgaugugagggagcuugguuccuucugucuuguugcuuuccugugcuuaccauuuucuucauaguacaaggcaguuucucacuacauccacaguccaggaauaggauuuugggaaggcacauuccaucccuuuaaagacaaaccuggaaguugcauacaugauuuuucuucauacccuauuggucauaacuuagucauguggccauguuuagauacaaaggagucugggauauguggucuuugauaggugacuauuuggcugaaaauuugggucuacugaagaaggggagaaugggggaugauuaaacauugccuguuacacuucaaaauguuuugggagaagcuuccagaaauagacuuugaaaauacaauggauugcauuaguuaauaaguuuauuuucuguauuuaaucauuaauuuuuuaaacuaugguaugugaauucaaauagaccguuaugcaaaauauaaguaaguggucagauuagaaaaauguagcuauacuuuuaguagugaagggauuuugggucuaauaacaguuauuuuacugacgcuuuauuuucugauagaaacaugguucuugauugcugugcuuguaucacguaagcaauauuugaaaucugagcuuuugcauuuaguguuaauaguccacuggaccaacugaaugucuucuugcucauacccucagcaaacaaugcuacaauaacacucgcauguugucaggaugucauaaagauuugagucaccgaacacugcaagaaggaugauagcagagauauuuaaacguacauuuacuaucuaguauguuccucuugaauuccuguggauuugaaaaaagagaaauauaaauaucuaagauucccuuaaacuaugaaauauuauuagcucuaguacagacuugggaaaacuaaugguucccaaacagucuucuggagaacuugucaaaguuaagagauuuccaagcucagaugccucucuuucuguagguuuagagugaugcucuggaaucugcuuucuuuuuuuuugagacagagucucgcucugucgcccaggcuggaguacaguggugcgaucucgguuuacugcaagcuccgccuccuggguucacgccauucuugugccucagccucccaaguagcugggaccacaggcgccugucaccacgccuggcuaauuuuuuuguauuuuuaguagagacgggguuucacuguguuagccaggauggucucaaucuccugaccucgugauccgccugccuuggccucccaaagugcugggauuacaggcuugagccacugggccuagcuggaaucuguuuucuuaaggacuccagguaauccugaugcaguaggaacauuuugagaaacaccaauaaaguucauuucucacauauuagagaaggaagugggugcagagaagcugagugacuaaucagugccucagaauaagcaggccugggacuagcauuguuuuuccugacucuucguucuuuguucuuucuacagaagagggaauaaaggacaagguguacagagugcagugggauuuuauaggaauaguuaucaucuuaaaguaaguauguggcuuuuaaugugggagcuuaugucuagugaaugguuggcccaguuguccuuuuugcccuauagaaaaauaaugugaauauuuaaauacucaagugaauguuuaaagguuaagugaauauuuaaaggugaaaagcugaagguuuuaaguaagguuuuguuaguaucagcacuauugugggcaauguauauacagcauuagaauagauguauaggcagcuacuuacuugacaugauuagaaggaacaaagguaguucuuguccucaaauuacuacuuuccuuuuagguugcuuguaauuuucacuguuggaauucauuucauuagauuaagauaaaaucuggaauucucuaguuuaaaauuuuaaaauuagaauauuccuagaggaauauuacuuuuuuuuuuuuuuuuuuuuuuugagauggaguuucacuuuugucacccaggcuggagugcaguggcacaauuucggcucacugcaaccuccgccuuccggguuccagcaauucuccugccucagccucccgaguagcuggaauuacaggugccugucacauacccgacuaauuuuuuguuauuuuuaguagagacgggauuucacuauguuggucagacuggucuccaacuccugaccuuggccucccgaaguguugagauuauaggugugagccaccacacccagcccuggaggaauauucuuuaccuguuaugagguuaacacuuuauuuguaucaguuauuauuauuagaucuagccugaaaacccauagcccuaaauuggaacaggcaugccuguuuuugcacccaaaaguugccuuuuggcccgccaagccccccucuuccuauaccaauauaaaccugaaaccgcaggccccacaagcagacgaggagaugaagaacagaaugacagaauggcuuggcagagagaagagagagucugagugcugggaggaguuccacugggaguggucaaaggggagaacagcugcuuagugcaggugucaguccagaaaucagaaugaugccugcacuaagaauguuuuggaaaggagggaagaacacaguccaugugcccuuuacugagaaaaaugaaggguauguuuaggccaggcgcaguggcucaugccuguaaucgcagcacuuugggaggccaaggcgaguggaucacgaggucaggaguucgagaccagccuggcuaaaauggugaaacccccaucucuacuacagauacagaaauuagccaggugcaguagugagugucuguagucccagguacuugggaggcagaggcaggauaauuguuggaacccuggaagcggacguugcagugggcugagaucgugccacugcgacagagugagacuucgucucaauuuuuuuuuuaaggguauguuuaagaaauaucaccuugugguauggucaugggaagguucaugugaguauucucugguggccagagguugguaguguuagcuugcuucgauggcuuccuaucacugagaguguugguaauggcacuguggguaauucugccuaggacccugcgcuugauuaacuacuggacuagagggagugucccuguuuucuuacugucuuauuuguuagggcccguauuugagcaguguuaucaaacauauaagguacgguucugaucaucuaggauauucuaguuuuuaaagagauccacaaguaguauauaguuuaaaaaaacaagcucuguggaaugauagcagaucauuucccccuucucauguuccauaauaauaacuguucaguuuuuccuaccagaaauguaugcauguguauauauacacacacaauuauauauauuauacuuuuaguauguauuguguuagaaaacuauguaugauuccauuauuuuuaagugcauagacagguguguguguguguauguacacagugucuguguauuuaaaauccaaaccaaaugggaucagacauacuaaacacacaguuuugcaacuuaagcuuuuuauuuauuuaguuaguuuuugagacggagucucgcucuuuccccaaggcuggagugcaguggcgcaaucucggcucacugcaagcuccgccuccuggguuuacgccauucuccuaucucagccucccgaguagcugggacuacaggccccugccaccacgcccggcuaauuuuucguauuuuuaguagagaugggguuucaccauguuagucaggguggucuccaucuccugaccucgugauccgcuuaccucggccucccaaagugcugggauuacaggcuugagccaccgugccccgcauuuuuuuuuacuugaccuauguuagaaauauuuccaugucagcucacagagcucccauuuuuuaaaauuugggacagagucucgcugucacugaggcugaagugcaguggcaugaucauaguucacugcagccuugaccuccuggguucaagcgauccucucaccuuagccuccugaguagcugagauuauagguguacaccaccacacccagcuaauuuuuaaauuuuuuguugagacauagucuugcuauguugccuaggcuggucuugaacuccuggccucagugauccuccugucuuguccucucacagugcagcugugagacacugcccagccucuauuguucuuaauggucggaaaguauucuguucuaugguuguaccucuguuuagucagacugcauuaaaggacauuuaaguucauauuuuugcucuuuuaaacaaugcuggugcguacuuccuugcauguauaguuguguucugugaguauuggccauaggaugucuauuuauaaggaaaguggcugguucaccagguauauggauauuugaauauauguugccauauugucuuccagaaaaguagcaguaguuuaugcuuucaccagcagugucugagaguguauaguuucucaaaucucaccaacacuguuguuaccuuagauuuuugugaauguaauaggugaauaaugaugucuaguuguuuggauuugcauuucuuuaauuaugacugaguuugaacaccuuaaguuguacuauaagauuuuuauuuuaaauaacaaaauaauucauucuucaucagauguauguuauaguuaaaguauuuccugggggccaggcaugguuucucacaccuguaaucccagcaauuugggaggccgaggugggcugaucaccugagguugggaguuugagacgacccugaccgacauggagaaacccugucucuacuaaaaauacaaaaucagccggguguggugguacaugccuguaaucccagcuacuggggaggcugaggcaggagaauugcuugaaccugggaggcggacgugguggugagccggagaucacgccauugcacuccagccugggcaacaagagcgaaacuccaucucgaaaaacaaaacaaaaguauuuuuuggguucccuuuauuucguuacucuguugauugaauaacugauguuuugauaaauuguaaaugccuacagaaaagggggcucuuguucuucuucaauugagugaacauuugcauguccucuguaugagauaugagucgugguagaagcuuuugauuauaaaagugaauaagguuugguuacaucugcuuuuaauguugagauaggugugucaauacaggaaaacuugaacacagauaagaccauggccguuaacaguuagagggguugacauguggagagcuagaagagcacaggaaguaagacaauuauggggauucgagugugcauuguggagaugggacugggucucgaucuugaagaguggauggaugggcuuuuuaugguggaaccugaggacuugacagucuauuggaggaagucaugugggcaaugggugguggugggaaaugaaggugacuuugaagaaugacagagucauaucccuggagcaucagaugagggagagagggagggagagugaguuugguaugcucagggagugaaggggacacuuguggacaugagagugggguugagucuuaauauuauaaagauaugaauuuggggcgauugaggguuuuucagcagggauuaggacagaucuguggguuggagggaggugacacuguaagaaggaggguuuggaaggcaggaccauucuagauguaauguauaggcaugagggaauacgaagaggugaaaaguggaagacagaugggaaaaccuuaaaaauauucuuaauuauacuuuaauuuccaacagaccaaagugaguauuucuggauucaaacagcaacauggccaaguuuuuggagauaggaaaaagaguauuaagcuuuguuggcaguauacuaaaagguucuaggaaugcagugauuagguuuuagugggacauggagaauauguccuacugaggaccugaaggaacuguugaggaacugaagauagaauuauuauuguaguucagaccuuacauuagggacagguggaaauaauuugcagcaccauuaaauaugagcuaaaaaauagggcagugggagagggcaauguuugaagcugugaaucuguaaaggaaaagguuguaucauaauucaugguuuggaaaauggagaguagcugagcaugugagcaguuucauuuuuucugagcaucuuaguauuugccugaaaaaaaucucauauucucuuuauuuuuucauguauccuaauuggaagacugguuauuuaaaaagcauuuaucuuguggagugauagaacuauuuauugagcaccugcuggugccaaauauagaaaaaccuggggccugggaaucagugcugaaacaaaggccacuccugucccugcuaucacggauguuacguucuggcugggggaaucuuuaauaguucuugaguaggccuaaggacuuagucuagaauagauacaaauuaaauuuuccuuaaagcgaacauagagucuauaaaauggaauaauuuuugauguugcuuuuugaaggucaaaaaauuuuuguuucauuuuagaguccuuuuaacaguuaauuuugacuuaaaaguuuguuuggauaaaaauaggacucuagcccuuaagacaaauacugucuguugaaaaauuuauucugauuugguuauuuucccucgaaaaaaacaacuguuaccacagugguguuuuuuacuuuaucuuuacaucaaauguucguuauugagagacauugcuucugugauauaaaagauuguuuuguaaaaguuuguugaaacaacaaugguaagauccuauaggaucucauugaguauuuuacaguuuaauuuuuuuuuuuuguauuucguuguugugguucuguaguacaauuuaaaacaucaguaaagcuagguaaauuuaccuaggaauuggccugaaggcccacaguuacucagcaauauuagagacagcuaugcaaagggagaagccaggcguuuuaagauucacgggagacaguuuguaggaaggcuguuugcugaauaagacaaagauacagacaugcaaaguaaaggaugugggccuauagggaaggucaaagaauaaggaaaguucacuugagugagcagaaauggaagagggauuuaagcaaauagaugaacaagaauugucucuccuaaaaaaaaaaaaccuacacaauuauuugaugauuuauuaugacuuuugggguagagaccacgcuagucacaggaucugcaagcccugccaccuggaugaucuggcuccagcuggcucacugccucuucucaccagucucuggaucaugugacuguaccggcuccuagucuuugcauaugcugcuuccuuggcuugggaucaucacuucuaucagcucuucuaucccuucuaugcgcucuucguuuuaaaaaucucauguguccuuguacucuuccuucauaacgcuuauuacaguugauaauuuuuuagugcuuauuugauuaaugcccuccagagaugaggaccaguaguguuuugcucucucuugcaaucucagugguuggcagggugcuuggcacauaguaaacacuaaauaaacauuuguugaaugaaucagugaacuacaugcuuuggucuuuacuaguuggucucaaggaccaaaaaccuacaguaggaagauguuuguuggacuaagagauuagcaggaaauaugagagcuuugaggaaaaaggaaaagaugaaguuuuuuaaagauaggauuagaaaguucuauguagucaggagaaagaaaauuauucguggaauaauucaacaaaugcacaugaaaugccuacuauguauugagaauuagauacuggaaauguggaguggaaagauucugucuucuguauuaaaggaguguauaauuguaguaguuuacugaaauggggacaguccuuagugguuguuuggagcagguguaaguuguggagagggaucagccuggaucaggauauucuucacucuucuagccgacacagugaaguucauucagcaguuauaucuggaauguagcucuggcauuuguaguagcuuucaggugcauaucgaauauaagugcuauagccagguguggugguccgcaguccagcuacucgggagccugaggcaggaggaucgcuugauucugggagguugagggugcagugagcuguguuugugccaguguacuccagccugagugaguacacuuugagugauacccugacucaaaaacaaaaacaacaacaaaaaucccuguagcuuugauuauuuguuuaaagacugacagaauaguucauuuggauucuuuuuggcuuuaacuucaaguuuggacaacagaacaagaaugaggaaaaguuuguaguauggacaaguuuucaaaagaaugagucguguaguuagaaaauugaagcuguugaucuugucagcugaaugagcuuucuuaaagcuuauaaagggauauguuugaauauaguuuuauaaccuuuuucagugacuaauuucuguaguaaauauuuggaaaagcaaaucaucacauaauuccugcaggucucuuugugccuggcuccaugcuaagcucuugggacauaauagugaaucagauggauauucaugguuccugcccucaugaagcuugcuuucuuuuuuuuuuuaaaaaaaaaaauuaaauuuuuuuuuauagugaucucacuuuuacggggaucucacuuuguugcccaggcugguccaaacuccugggcucaagugauccuccugccucagccucaugaagcguaagccacugugccuagcaguugaagcuuucaguuagucagaacucccuggagugaguguaaaggaaaaccuggcuuguggauugggugagcaguuguauugauuuacuuauuuauuuauaauuucuugaacuuaguuuugguagcaccguuuuaaacuacuuuaaacuacuuguugcuuuauuucugguaacauagggagugugggaucacacuuacuuuaccaagguaaaauaaaaacuuggaucuucaaccuuuuggcagauuauuuucuaaaaaagguauucuuguaaaucugaguuucuccucuuaaaaagcaagcuacuauuuaguaacaguaacaauagcuacuauuaaucaguuaccugcagcagaccagccacuggccuacugaaugaauaacuauuuauuauuaguuauuuuaauauaccuagaaagugauugguauuauccguguuuaccuccagauaauaaaaagccuaaacaguuaagugccguaaaguugaacauuuagagaaaaagaagaguuucuguaacccauuaacugaagaaauagauaaaaguucuggcaugcugggauugauaccuuguguuauugguucauuaguuuuuuuggauuauaaacaagauaaucuaacaccuuucuguguuuggggaagucuuuaucuuaggagucuuugugagagggagagcgaucuccaccauuaagaaagcuaauuguucacuuuccccaccgcuuuugcaguuaggaugcaauccuguggccuccaugacuggcagugcuugccuaccucagaggccagugaucugcagaggcaggcgguauguagaaucuguauucucuagucaaggagggauggggaugggauagcagcuuaucuuuuccauaggcagcagugacugagauuccaguugcaacacuuagugccugguguugguaucaguauaaguugcagugacugagucucauuuggucuucacuggaccauaucugugguuugaauuuuggauguucuuaacuauguagcuuuccagccugguccccaugggguuuucugugaguugccuaauacacuuuaauaacuuccuuucagcuuaaacaaagccagagccaguuucuuuguuugcaacuaagaaccuuuacuuggaagaugcuaauuaagacaauagauaauuccaaggaacucuccugggucagguuuaccugcauguagauuagaauuuacugagaagaguucacagcauauauuaagugaaauacuuagaaaccuguuuauugauuuaauuaguuugcugaauuugagugccucuucuuggcugcgauauguuuuagguguuaaggauacaggagugacaagauugacaaggucccugcacucacagagcuuauguuccauuguaagauguagaguaaacaagaaagcaaauaacauaauuacaaaaagugauaaaugccaugaaaaaaauaaagauggggugaugugauagguaaugguguauguguguguguguguguguguguaguuguaucuuaguguaaaacauuuaaacuucagugucaggaaucauggcuucugcuuuugacuauucugaauuugccuuccuacuguaaacaucuagaaaacuggacaaaacacagggaagaacuguuuucagauaucagauaauagguagcacagaacugugaucccugacagaugggaaccaagugagaugagcccugugauggccaguuuucugcuugaaggcacuuuucacaccucagugcaggaaggggaucccagauaaagccacguggccccacuaaguugagaaaacaaagauuggaguuagggguaaccaagggugguugucauuugaggagcagaguuccagagaggagggagcuauacugagaaagaguucuuauacaucuacuuagugguccccuuaaauguuugauuguacauguauaaggugaaguuucacaaaagaacaguuucugggggagcuguaagcagaaaaaaucucagaguuuacagagggcugagaauuauuugaguaccuuguaaccagaguggaaaugcaggauucauugagaccccagaagaguuaugucuugguaguggggcuaaacuaguccugaaguaaagacuccuagcuuugccugaaaaaagcuuaaaagcaagccuucaaagaagcaaacuaaucugaaacuaauguaauugccuguuacuacagugcccaacauucuuuaaaggaauauaacagaucccaauauuaaucauguaaaauguccagcaugcaaucaaagauuacuaaauguguaaagaagcagguuaacaugacucauaauuaggagaucaagcaguugaaaccuagaacucacacagauguuaggguugacagacaaggauauuaaaacaguuauuguauuucauauguucugaaaguuuggcagaaacguggaagguauacaaaagacccagaucaaacuuuuagcagcaaaaauuauaauaugugauaugaaaaauauacuggguugcauuaaugguauuuuagacauuuagaaggaaagauuagugaacuugaagacacagaagagaaaacucagucaauagaaauaguaaugacagguaauagaauuagcagacaagguuguuaaaguggcugucauaaaaugcaggaucagauugugguuaauguugacaucuuggacgugagguuugcuuaagaacaauugugacaagcagaaguuggcuucauauauacaucuacaugaaguuagaguaguugaaaaucaguauuugagcagagcagggacuaugguagaagaacuuuauuauguagcaguauguuuaucucuugcuaaaugacaauaucaccacagaguuaguagcuuaaaauauacacuuccauuuauuaucucaguuucugugggucagaugucugagcacaguuuagcugaguccacugcuuuagggucuuagaaggcuguaaagauguuggcugaggcuguggucucauuugagacuuaaccacagaaagaucucuucuaagcucauaugguuguuggcaggauucuguucuuuguacgcugucaaucagcaaacauuugccaucaguuucuugccaugugguccuuucugacacacccacuuacuuuugcaaagccaguaaaagagucaccuugcaagagguguacaucuuaacgugucauaaccauggacaugccaugccauuaccuuuguuguauucucuugcuuaaaaacaagucacagguacugcccacacucggggaauggugugcacaggaugugaacacuaggaggugggucaugggagccuccaucaaaguucucugagcuuuucuuucuuaucgcuucaugacuuguuucaccggaauuuuagagcuauuaggcuuuauugcuuuaagaaagcacuuuuaguauuaccauaccauguucuucuaguuaauggagaaauuagucugaaagauuuucccucuguuucugcucuucuucccuaaaauuugcucugcaaaccauuccuccuucagaugguaugaaggaaauaagccuggggaaaauuaccuucuuggagauugacagcucacauuagcauauuguaggaaaccuucuuugcacccguuaacauaguuagggcaaucuuuauuaagcuugcccugagcacuuuauaaacguacacauaccacuagccaguaagguacuguuuucauuuaaccuaugaugaaacaagcuuagaggugaacuaauuuucccauuuuaaaugggaagugguugauaggguaggauucaaaccaggccuuaguuuccacucuuagauuuuauucuguauuccuucuauauuauggugaguuguauaauuauuucacuauauauuaauauuaaaagguaauacuaauagaaauaaagugcacaauaaauguagugcgcuugaaucaucccaaaaccaucucuccacccccaacccccacccuguccuuugaaaaauugucuuccacgaaacugguccccggugccaaaaaggucagagaccgcugcuguagagcaauacuugucagacuuucucacgucggggccuucauggacgaaauugaagacaccguuuuggguauucugaggguuuuaggggaucuuugcacaucuaaaacaucuguggugcugugugccacacacaacaguuggcaagcucugcccuauagguaaucacuuuuuccucaguucuuuuagcugcuucuucaauuuaccugucuauucuaaacaaugugcuuguuuuaucaggaugcuuuuggaugcagcuauugaaccugacccauacuggcuuaaaauaagaggacuuaacucacaauuggaauuccagggacaggcucaggggcuaauugauuugguagcacagugaugucuucagggccccagguuuucucauuucccccuuuagucacuggcaggcucuauccucagauuaaucagaugguugcggcagugucaggaguuggauucagaugcaacagugcccaugggaagaagggaagauuauuuuucuuguagcuggauaagaaugugguaccuuggccuaggaacacgcccuggauucaggaaagacucacuagaaagggaaaugggauuacacuuagaccaguuaggcucacuccuggcacugggcacgcucuccuugagcacaugucuaaauggacgugggucccuuggcacugggcaugcuuuccuugagcacaugccuaaauggaggugggugugcaaguggguucugaacaaaauuagcuucuguuacaaagaaagaaagggaauuuggaggccggguaggcaacccugucccuauuuuuguauuugccuuaagauuuaauacauuauuuguugauuuuauuuaaggucgaugccuauuuaacauuaagccaccuaucacacuuuuuucuuccagcuccugauuauaguuauauaaucuuuuuugguaaaaucaauauuccaugcuuaauuaugacuaaguuuuguucaccauaaaccagauuguguacuaugauuacauuuuccaccuuguauaaucuuguuuuucuaagaguuaguaauuguauuuccauucgcuuuguuuucuaguacuuguaaguuuucucauucuuuuuaguagccacucaauguaguuuuugguauaauaaaaaauauccgacaguuguuuuuguucccucuuaagaaccaucuuauagagccucaaucaaacugcuccucuaugaaauucuugcucucuggaccuaauaggaucccuuuugcauauuuuccagcaugguuggaucuccuguuuccuggcuuucuggccauuaucguuucuguuuuuauccuucguuuuacuggaggacaucuuucaauacuuccugagaaaaggguacaugggaggcuaauuuuuugagauacggucagaaaauaccuuuaaucugcuuucauuuuuaaaaguuuugacuggguauagaaauggaguuggaauguaauuuuuacugagaauucuguauauguggcuucauggccuucuagcuucauacagcagauacaguuugaauuuuggauuucguuaaaaagaaaacacaacacuauggaaaagguagaaaauauaaugagcuccuuguacucaucauucaaauucaacauguguuaacucaugaccucuuuauaaaugucuguguuuuuaucucucccucuucccuucaugaccuccuuauaaauuucuguguuuuuaucugucccucuucccuuugauuuuuuuuuuuuuuuuuuuuuuacucuugcccaggcuggagugcaguggucauggcauacagcaguuucgaccucccugggcucaggugaugccaccucagccucccaaauagcugggacuauaggcacauaccaccuugccugacuaauuuuucuguauuuuguagagacgggggucuugccauguugcccaggcuggucucaaaacucugggcucaagcaguccacccaccuuggcuucucaaaguguugagauuacaggcaugagccaccagccugacccugccucuuuugcauuuguaaaagcaaaccuagauguauaauuucacuuuugaaaauuuuaauguguaucuguaaaagauaaggaugcuguagcaccaauuccuuugucauaccuuuaaaagguuaacagugagucuuccaguauccaguaagaauucacauugccuuguuugccucaucaauauuuuuuuuaacaguuuauuuuaaucaggaucuaagcaaggaccagaaauugccuuguuugacaaaucuuuugaguucuuuuuucuccauuuuuuuuuuuucggagucucgcucugucgcccaggcuggaguguaguggggugaucucggcucacugcaagcucugccuccuggguuuaugccauucuccugccucagccucccgaguagcugagacuacaggugcccaccaucaugcccggcuaauuuuuuguauuuuuaguagagacgggguuucacuguguuagccagguuggucuccaucuccugaccucgugauccaccagccucggccucccaaagugcagggauuacaggugugagccacugcgcccagccaaaaaaguuuguacuauauuauuuuuuugagguggaaucucauucacucuguugcccaggcuggagugcaguggccaaaaaaaagcuuuuaaauuaaaaaaaaaaauuuuuuuuuuaagagauggagucuuauuguguuguccaggcuggucuugaacuccugggcucaagugauccuucuaccuuagccucccaaaguguugagauuacaggcaugagccaccacuacuuggccuuacuuuucucucucucucuuuuuuuaaaaaaguauauauauauauaaacaaauacauacugcagucuugaccucccugggcucaggugauuuucccaccucagccuccugaguagcugggaauauaggcguacaccaccaugcccgacuaauuuuuuaguauuuuugguagaggcggggucucauuguguugcccaggcuggucuugaacuucugggcucaagcagucugcccgccuuggccucucaaagugcuuggaauacaggugugagcuacugugcugccuuaaaagaauauuucugauucgagguugguugaacuuauggauauauggaggacugguuuuuuuuguuuguuuuuuguuuuccaucauagcguugucucaguuuccucuggauuccuguuucucugcuuguuuugguuucuuuccuugauguuggcagcuuuccucaaauauuuggccauccuugggcauguggcuuguauuuaggaguaaggcauaaagcugaugagagcucuuugcgagggugaggcuuguucgcuggaggcuuaguaggcggauugguggacccaugaauaugaguaucccuaagguuuuauggcagugcucuugggucucagguugggguugugaaucccaugcugguguucugcaggcagaacuguggaagaagggcuggcaugcacaguucugucuaaacacuuuugcucacuucuguaguauuuacuuauguauuuuguuuuuuguuuuuuuuuuuuuuuagagacaggguguugcucacuugccugggauggaaugcaguggcacaaucacaacucacugcagccuggaacuccugggcucaagugauccuccugccucagccucccaaaguucuaggcuugcaguugugagccacugugcucagccuucacuuuuguuuucaguccugugccucaaaccuauuuucuguugugcuugauaccugucaguaccaagucuccauauucacugguccccagagaauaugucuuugaugucuuuggagcuaggauaguugccauccuggaugggguuugggccgcaauuuuggggucuuauuaccuuuauuuauuuuucuugacaauaacugagaaaacuugcagguaugguacaaauagcuuauuuucuacaccauuuaaacguuguuggcaugaaguccauuauuugaaaacuguagugcauuuuuccuacaaacaagggcauucucuuacauaacagcaauacagccaucaaaguagcaguuuaacauggagacauuacugcuaucuaauccauaugacuccauuccguuuuuggcaguugcccccauaguguaguguucuuuauggggagagaauguugccuaggaucauuuacacauuuugucguuacuguuuuucuuuuuuuaugagacagucucgcucugucacucaggcuggagugcagcggcaugaucuuggcucauugcaaccuccgcuucccguguucaagugauucuccugccucagccucccaaggagcugggauuauaggugccugucaccacacccggcuaauuuuuuguauuuuuaguagagaugggguuucgccauguugcccaggcugguuucgaacuccugagcucaggcaguccgccugccucagccucccaaagugcugggauuacaggcgugagccaccacgcccggccuguuacuguuuuucaacuguccugauuuagaacaguuucuuaccuguucuuucuuuugugauguugauauuuuugaggaauacagaccagugauuuuagaguguuacccucagugugcgccugguguuuccucauauuagauacagauuagaugucucaggcaggaaugaugcuguuuugaauuuugaugaagucuaauuauuaaaaguuucuuuuauggauugugcauuuguuaccaaauuucagaacucuuccuagugcccugguucuuuggaguggagaauggcauuuggaaaccuaugucugaauguuaggugugcuugguaguguuagugugugggcgcuccucggcuuucaguggacagagccagagaauaugugcauguccugagccuccuguucguccucuuuccagguuuggggauacaugagcuaguuuccuuggcaucuucaacuguagacacuuauucuguggcuuccuuuagucuccuaagccugccacuacugugccaucuucuauccauugucuaaaaacuucuuuguccaucacugucuuguaucuuguuuuauuauuuuuuaacuacugauuuuaggugaguuuuaucuucagugcaguuuugugagagaacagagguaaauguauggauuauucaauauguuguuuacuugcugaagcuuuaauacucuuucaaaccaauuuuugccuuuuauuauuuuuugcaguccuccuuaaccccuuguuuaccugcucuguuccugauugggcuguucuacagccuauaaucuuccacgauucuccuuuguauggaaugaagacaaauuuauuaaacuauucagauucucuugauaaccuagcccuaguuuaucuuuccguuuucuuuucugcaguucugccaucuucccucuacuucagagcuuacauuuucccacucguguuaggcuccucuucagcuuugccuuuggagcauacugugcuuuucugauaacguuuucuauauggcacagagccucugccagggcauguaguagguguguucagugcauuaaacaaacauacagauccucuaaacuaguaaagccacccaagcuuguuuguugccuguuaucauuuuccaaauacugucauuuaacccucaaagcaacucuguaagccauuauccaucuuucauaaaugauguugaguaaauugcccaagguuacauaguuguaguuguuaacacugaauuuaacaaauguuugugugccuguaugugacaggcucuuugagguuguagagacaguuggggaauaaagcugacaacauaccccuaauggaagcaguguuaaaaugcucaauccaagugagguugauuuuggggcaagucuucuguaaccugacguacucaucucagaugucaucuccuguagucuuuccugacuuuccuagaaggaggcaggggagaaguggaaagaauagcuccaucuuuuguucucauuaguuccuuccuuucuuauuguauuaucauauauagcauuuauaaaauuauuauuuguauuugaggcaugucuuggucuguuugugcugcucuaacaaaauaccuuggacugaauaauuuauaaaaaauagaauuuauuuuucacaguucuggaggcugagaaguccauaucaaggcaccagcggauucgguguuugccgaaggccugcuuucugcuucauagaugaugccucuugccguguccucacaugauggaagggcagggcaacuuccuuuaaccucuuuuacaaggacaugaaucccacaguuccccaaaggcuccaccucuuaauacuguuagggccuaauguagaaauucuguggggaacaccaguauucagacuggucauagucugugcugcuguaacaaaacacagguuagguaguuuacagaaaacaaaauaauuucuuacaguucuggaggaugggaaguccaagauaaaaguguuggcaggauugaugucucgugaggauccagucuuucugcuuccaagauggcguuucaaacgcugcacccucuugaggggagaaaugcuguguccucacaaggcagaacgugaaagagcagaagagaccaaacuuccucuguuaagcccuuuuauaauggcauuaaccaaucugugagggcaaagcccuuaugaccugaacaucuuccaaaauccucaucucccagcacuguuauguuguggaugaaguuuucaacaaaugaauuuugggggacacauucagaccauaguagggccuuugauagauugagcuguuuugguggggagcugucucuuucugguauccaggaugcuugccacaugauguguagucucaguaagugagugcauugauaaagaaguauccaugaugugcuuuaccgacagcagguagcaguacucucuguuacucaagacugccucuuuguaaggguacaaguaguuucagaaacuccacucucuguuuaguugggaggaugugcucucaaagagguuaccuacaggcacauuuuuaccggaguuuaauaaacugucuuuuuucuggguacauauaggucucuggucuggaagauggggucuugacuccccaaccaccaauaguaaccaucugguaggaguuuugaauuauuuguuaaagaaguaugcugauaugagaugucacaauguacaagccucuuuucaaaucaggagauaaauuauuucagaagagguagaauguuuauuuugaaacauuuuacaaacagguuuguuguaauucuuuccuuguauuuguugucauauaacauguugagguuaucuguugcugcuuaacaaaccauggcgaaauucaguggcuuaaaacaauauucauuucuuugcucacuguguuccaauuugggcagggccugucuccaucccacguggcaucugcuggcacugggcaguccaaggugauggauucccuuccaugccuggugcccugggcaucuuccuccagguggccuuuccaccuggcacacuugggcuuucucacagcugugacugguuuccccacaagugcgcaaaguugaggcugccaggccuucuuaagacuuacaccuugaacuggcagugucaucuccacuggauucuguaggccagaagcaagccacaggccagcccagauucaggggguucggggugggguggggauuguacaaggugugaacacuggcaagagugguuuauugggccaccaaggaacacuaccacaugaaccaagucucuuucugaaagggaaaaagaaagauaacuuuuuuauucuguuuguuuuuuauugucuaauccuacugaccgauucauuuuguaaugcagugguguauuucuuuuuuuuuaaacccuuuuuuuuuuuucuaauuuuuuuaaauuuuauuauuauuaugcuuuaaguuuuaggguacaugugcacaacaugcagguuuguuaccugcagugguguauuucuaacuuuugcuauaacuccauucaaauagcaguauaaaauuaauauaauuuuucaaauucaguugaacuguacucaucuugauacggaucauaaauacagauuugggagugaagaaaguagaacaaugaauacuuuauggcaggggucuccagccacugggccguggaccgguacuggucuguggccuguuaggaauuggacugcaccccaugaggugagcuuugggcaagcgaucauuucugccugagcucugccuccugucagaucaguggcggcauuugauucucauaggagcgcgaacccuguugugaacugcacaugugagggaucuagguugcaugcuccuuaugagaaucuaacugaugaucugaaguagaagaguuucauucugaaaccauuucccaccuccuccuguccguggaaaaauugucuuccacaaaaguagucccuggugccaaaaagguuaugggauacucagcuccacguugcaccuaaaguagcaaaagacuagauaaaaacccugaauauguacuugugaaauccugaauauguacuucgugaaaucagugacauaaaccuccuccuggguuacguguuacaguucacaaacgaucucaaguauucuacaguucaccugugguuguccuuuguacagguggaagaagagagggaucucagauucccuguaguugcguccccgcccccagacagaucucucccuucuucaugcccuggauuguuucauccauuuaaauaguucucuucuugauucugacuugagggaugggcauccugugauuagguuuggaugugacaguggaaguuugucagaaacauuuuggcucaugggccagauacauuggaguccguccgaaagcucacuaggaaauguagauucucagguuuaaccuaacuaggcuaacuauaccuaaguaucuuagcagagguuuggauguuacagaguuugaagaucgcauuuuuaggcccuguauucuuauucucuguaaggaugaugucgcccuucaaggguguaaggauuguuauuggggaguauauauucagggcagcuugaaucugugcucccgcuccucaccucauuguucuucggagggggauggaaaaucuuagauguuaaucaugguuuguggcccuccagaaguuaaucuuaccugacaaaaccuuauuccuuaauguuuaauuucccuuguuaagaauacauuuaauuuauugaauuaaauuuaaauuaaauuucucuccuggggaugggauacucaaaaaaagguugagaaacauaauccuauaagaauuacucuggcauaguaccugcccugcauuaucuguguccccucucccaucuuuggaaaccuuaggaugugauuuuggcuauauuauuuuaauacuaagauuuuacuuacauuuaauggauuaaaaagaaaaacauucuagauggguggaaacauuuacucugugaaauuuugcauccaagucaauugguuuuuauccuugugaauaaagcccuguuaggauagacucuguucugggauuuggaaaccuuuugucuucauaauggcacuguauacugaaaacucuucauguuuuccaccuuguuaacauaugacaagccagggcuuuuauaugccacacaaaacauaggagauguucucucagggacauguucuuaagucauugcugucuuuccuccugggagugauuccuggccccauguaucuguuuucuguguagugcagggccaguaggugaaguggguggaccacaggucccugugcccuuguccucuaggaaggagaagggguauaggaggcauauuguuaucuggguuuauugguuuguggcuuuggacuugguauaaaugaaaacgccucuuuuuuuuuuuagguuggggauggagggcaguagugggagaaguagaauaggguuucuaauauauuacccucuuuaaagaaaauuuucaaaaugaguuauuuuucugucauuuaagguaauguuaacuucuuuguauuuguccguuuucuguguaauuuguccaggcucaggagaguuaaaggcauaguauagccagaaaacugaaguccucuggaaaucuccauucaccugaaaauacauugcuuggcaauugauagaugcugggguaaauuauuuuuugagucagugaauuaaauuaauccaaaguuuuuuuguuuuuuuuuuuaaguguaauucccuguucuaugauuuuagaaucuaguccguagcguaauauugagggaaaagugaacuaggaaguuaagagaccuggcaucaacuauucuuacuaccuaccauguuuuaaaauuuccauaggcuuaacuuucauuguuuauaaacuugaagaauugguagacgacccuuugagagcccuucagggugcagaauuuuaucaucaaguauggugaacacauuagaauguccucaacugauguaguugugagaaggaauuaguuccauuuaucauguagagaguagugaauuaggguaaacaguugagccacucuaacaguuccagcaauuugauggcucuaagagcauggaaucaucuggaggugagugccuagguugguggcggugacugccucacguggucaucuggagucaugcauuuuuuuccgucuuguuccucugcucugcccuaggguauaguccucguguguugucucuguacuagcucagaagaugcagaguaggaggugcagagacagaauagaaaugcucacucaguguccuaaggcccagaaguggcacuuguuuucacauucuuuccaugcgaacuuagccacauggccauacccagccacaagggagccugggagguauaaccuaguugggccgucaugugcugggcuaccauuacuauggaagaugaugacuggagucucugccacaacuaguauauaugaagcuauuucuuaguauauuucuggggacccuuuuuccucauuuuuguuuagcaaagaauuaauguaauuaauggaaaaaguaaauuauuugggcaaguugugcuaaggguaguauauugaaagacaaguuuugaaauuaauuagaaaccuaaaacuaaccagcccugauuauaccuuugucuccucuaauuaaaaguccagugaagaguaguuagaaguuugcuacacucugguuucuuaggagcacuuaaguacacauuuagucacaagggacaucucuuuuccagagcaggaaccuauaguucucuucaguaaacuaguccuauaaaaggaagcugcugcuugaauaucaccaggccucuugggcuccaaauucuuaaucuaaauacccaaaguuggccauguuucagaauugccugggguccuuguucaaaauauagguucaggccuuacccucuggagauucugaugguuguguuucugaaucugaauuuuuuaacaagccccucagggugauugugaugcagcugucagugguaugggauccaguaccuuagccaucugugccccaaucgccuuacaugugaaagugcguaauuaauacuugccuggcuccuguaccacacaggauucagagagcaugagaugaguuguauuucaaauuauuucauaaauuuaaaaguaccguaaaagacugggcacaguggcucacaccuguaaucccagcaaacuuuggggggcugaggcaggaagauugcuugaaguuugagagcagccugggaacauagcaagaccucaucucuuaaaaaaaaaauauauauauauauuuauauuuauauauuuuuguauauuuuauauuuauauauguguauauauauauauuuuuuuacccugcaguguacacacacacacauacacacacacaaaauaguuagccuggcacaguggcaggcaccuguaauccuagcuacucuggaggugggaggauugcuugaguccagucuugaguccagggcugcaguaugguaggauugcaccucugccuuccagccugggugacagagugagauccugucucuuaaaaaaaaaaaaauaaaagugccguaaaaauuuuuaggugguauuacaaguuguuuggcaagauuuuguguacaacagcccugaaagguaagugcuauuaucuccauuuaggaauaaacugggaaauaauagguaaaacccuaggcuucuugauuuugcguaauuaaacagacucagaaaaaguuaucuguccuguguaacugccaauagcagaacaaacugaauaauuuauagauacuuuuguuuuuacauaguuuauaaaauaccaaaugacaacuugaugccuuugguguccuauguggaagacucugcuuuguacuuuggcgaugucaaguugaaugagacacauugucugcccguauggaaguuacaguccaguagaggagagaagacuuaaaaacuauucauuauaauguccuuaagaaucauuuucuuuuuaugaaugagcccuacaaccauaacaggacagguugugaauauauuguacaaguucagaggaacggagaggccacgugaggugauccuuuuguaaaaagcacagcuugagacaggaggagaaacuuuuuuuuuuuuuuuuuuuaaaccgcagagagaacagugucgguugcucagaggacucuucuuucuacccuggugcauuuacuaggaccuuguaggcaaauaaaaugauagagaaacuugcauagaugaaggaugugucccauucccugaagucaagggaagcagagcuaagauugguuaugcagaccaugggcuaggcacucccuacaaagucacuuuaaucauucccaacagucuugugaguagagagagcagagcccuuuaguggaaagagcaugagauuuuuaaaaccuagaagugguuggcaaugguggggccaaaucuggauuguguguggauauucaaauaaguggauuuuccuuuuuuauaagacccauaagacucuuccuccuuuuucagcacauuugguuugccuugauuuugacaagagugugauugcugcuaccccauuaugaaauuggggauagagaucuguggauucauugucaagguggaggaugcaggcagggaaagagugcgggaaccauuccugcagaguuugugguaggggaccuuuacaggaaauguaaagguuaauuuauuuggcaaagauuguaccagauguuugggguaaaguagugaaaaaaagacaaauacaguuuguacuuucauguuguugacaguuuugguguggcauuuuaacauuuacuguucuuaauagaauaugugacaacuuucuagacagguacuacuguuuaggauuggguagcucaguguuggguuucacugagcaugagaggcguggagaguuuacauuacaugucuuccagugguucugucuuucuaaagcuugaagguacucacgagaaagcagugagacuguacaucauuccaaaugagauguugauguagauuaagcacaguuuuucaucccagaaugcaaauuaagaauacaaacacagguugaagcauuuuucauaggugacauuuguagaauguauauauuuuaagaacauuuggaaaacuuuuuuuaaccuacuuguauuaguucccuguggcuccuguaacaaaucacagauuuagugacuuaaaacaacagaaauuuauucucuuacaguucuggaggcuagaaguccaaaaucagaaucauugagccuaaaccaagguguuggcagggccagggcugugcuuuaggaggcuguaggagagagccacuugcuaguggcugccaguacuucuugacuuguggaugccagcauuacuugacuuguggccacauuaccucaaucucuccugcgaugguuguguugucuucuuuuugugucagauugcccccucccucucucaacauuugugauggcauuuagggcccaccuugaugaugaaggauaauccccucaucucaagauucucaacuuaaucacaccugcaaagaccuguuuuucccccaaaucauaaaacauuuauagguuucacaguguaggauguagauaucuuuugguggaccauuuuccagcuuaucacacuccuauaaauuauuuggaaaaguaggaagguugcuuuugaaguagcaacuuguagauauaucauaaguauacuuccagcuauaauaagaauuagucauaguuuuauaacuuuuuaguguuaacuugaugauccaaauuugagauccaaccugggagacagcucccaaaauuuuaccaccuaaucuguuuuuuauaacaaugguuuugagcgacuuuucucuaaauaauggaaguuauuguucuuuuagggucaguguaagcugacagugguaauuuuuaucaaguauuaaaaaugagucugaguuuagggaaaugauaugaaugauuggaauuuauuuuagcaucuaggaauuuuauugacugagaaagugcagauugcagaagaguagccaaaaauauacuaugauuguacccuuucuaaaguugcuugguuaaaucaagguugaaaauaggggccaggugcaguggcucacgccuguaaucccagcacuuugggaggcugaggugggcggaucacuugaggucaggaguucaagacagccuggccaacaugaugagacccugucucuacuaaaaauacaaaaauuguccaggugugguggugcacacuuguagucccagcuacuugggaggcugaggcgggagaauugcuugaagccgagagguggagguuguagugagcugagaucgugccacugcacuccagcuugggcgacagaacgagauucugucucaaaaaaaaaggaaagaaaauagguuauaauuggacuauauuuuucuuauugugcuauauuagguaguuaauuuuggacuggucuaauauagcccauugugaauaaaauauaagcauauguaguguuuaaaaaaaagauguucacacuuagaaaggugccaguggaaaguuuucauggucaugagccaaucaugaacauaaacguguguauuaauuuuaauauuugauuuuuuuucuugaaccugccuguuuuuuaccuuuuacaaaauacuuuuuauuucucuacaccuuaagauacguauuuugaaguuuuucagauagucuuguuauuucuaguuccuuuuuuuuuuuuuuugggagacagaguuucgcucuuguugcccaggcuggagugcaaugguaccaucucggcucacugcaaccugcgccuccuggguucaagcaauucuccuuucucacccuccuguguagcuggaauuacaggcgugccccaccacaccuggcuaauuuuuguauuauuaguagagacaggguuucaccauguuggccaggcuggucucgaacuccugaccucaggugauccacccaccuuagccucccaaagcacugggauuacagaugugagucaccacgcccagccaauucuaguucuuuuggugugaaauuugguuucucuuuuguaaugaaagguucuuuguaucuuucgcaauuacuguguauaagcucuucuucacaugaacuuuggaagguguucuacauuuugagggauauacacauuacauauuuucaaauauuuagaguuaauauuguugcaacuccuacuucacacugacaauuuccacuucccacuucccauuccccaguugccaaauguaguagccauaaagagcaucagauugauuuaucugccaucccuuugugcaauugcugccauguuuuuacuccuacuuauauuauacauuauguacaauuuuauuauuuuugcuuuaagcuguauuuuaaacaacuaaaauuuauuuuuguuuaaaacucucaguuuuuaaauauaaguauccaaaggaaaaauauuuaugaaaacuuuguuuccauuugguaucaguuuucugucuuaacacucuucggcauuucuugugcagcucugcuggcaaggacuucucucacuuuuuuucccuucuuacaaauuuuaaucucuaaaugucuguauucagucuugaguuugaagguuuuuucacugaauguagaauucuagauugauacuuuuugucuuuuagcacuuuaaugguguuccauugucuucuggcuuccauuguuugugaugagauguaagugguaaugacuaucuuuauucccucgauauaccagucuuuucuucuggcugcuuucaagauuuucuauuucucugcuuuaagcuguuuuacucugcugugccuggguaugguuaucauuugaaagauuuuaagcuaugguuucuucagauauuuaucccuuuuuuuuucugugacuuuauuuacuugcauuauacaacuugauauuguuccacaggucacuaagggucuguucaguuuucuuuagucuuuuuucucucucuucuuuagacaauuuucuuucccuuucucuuucccuuuccuuuucuuuuuugagacagagucuuacucuguugcccaggcuggagugcaauggugccaucucggcucacugcaaccucugccucccagguucaagugauucucaugccuuagccucccaaguagcugggauuuacagguaugcaccacuaugccugccuaauuuuuguauuuuuaguagagauggguuuucaccauguuggacaggcuggucuugaacucuugaccucaggugaucugcccccccucagccucccaaagugcugggauuacaagcgugagccacugucccuggccuagauuagauaguuucuauugaucugucuuccaaguuugcugauuuuuuuucccuaccaucuucaauaugcuguuuaauuucaucuaguaaauuuugcccuuugguuauuauguuauucauuuuuagaguuuucuuuuuguucuuuuuuuuauaauuuuuauuuuucugcugagauccccuaucuguucacacauuaaagaccauguguuccuuuaagauuuugaaaauaauucuaauucuuugaauguauaaaauagcugcuuuaaaaucuuugcugcuaaauuuaacaucuguucuaacaugggguugguguuuuacugacuccuuuuucccccuuauuggaucacauuuuucuguuucuuugcugccuacuaauuauuuuuguauuaaaaaacaacaacagaggcaaggucuuguucugucacccagucuggagugcaguggugcaguggugcaguggugcagucauaguucacugcuaccucacacugcugggcucaagugguccucccacuucagccuccugaauaacugggacuacaggugugccccacuaugcucagcuaauuaaaaaaaaaaaaaaauauauauauauauauguguguguguguguguguguguguguguguguguguucaccaggcugguguugaacuccuugccucaagccauccugccuuagccucccaaaccaugccuggcaugcuucccuuggaacuuuugaugaauacuguuuuuuuuuuuuucuucuccuaagaagguugauuuuuguucuaaagucugguuggucaccuugaacuuguguaggcuugguuuuauacuuuauuaaggcaaaauuuauuuaccuuagguaaccucaaggugauuccuuacccugucuaauaugguggaccaugacuuucaaacuggguuuuccugugacucuugucuggauuuuguuuuagacauuauugguacugguuuggaguaggcuguaugcuagagugugguucuuagucuugaaggaggaagggaauguucagguguguauuaggguucuccagagacacagaaccaauaagagauacacaggcguguauauauguauguauccauaaguaaauaaacaaauauaaauugauguaaggaauuggcucacgugacaguggaggcugagcagucauaagaugcacauacccagaauaaugcuugaccaaaugugugggcacccuguggccuaggcagguugacacauaaaguuaacuaucacaagguguuaaugagauuucuugucuguggcuggguagggaccccagaucccccagacuugcucauugucuaucauuuugguucuggucucagccucuaaguaaucauucuguggcucagguuguuucaccuggcccaugugcauucugguccucauggcucuccuacauccagacuucuggagguccccuucugugcaccucccuucucucuggcacaugguuucagaugccugaacucuaagcuuuaccaagcuuuaccuucacaucucagcaugcccgccaugcuuuacugagccucuaguucguuucaccauguugggaaauuguucccagacaaccaggagacucaugacccuucagggaucacagucuugggcuaccauuuguugauugucagaaaacaguuggcgcaaauauuuucuucaguuuugugguuguuuaaaguggaaauagcaguacuaguuauuuucuuguacagaagcaggauaugugaggauuacuguuuaauagccguuaggcauacagguucuuugcaggugcuuggaggaauguaaggauuaauacagucaguuuccuauugagcauggcuggggugggauuguguaguggaauguauggauuuagaaugguucaguauaagcaaguauccagcgucaugauuccagaauacaguuuugcucuuacggcauguacauucucagaaaguacagaaucuaaggaugaaaaaacaagcugagugguggagacaguuuucuuuuacauuuuagcuguuccucugauuauauuucaugggguagguagauacuuaaaugauuuuuuagugaugucggccuuugggugaagaugaggcccacugagaggacucuagagcaguugaaccccgcuucccaccuaggguuggaaucauggcccaggcagaugcugugggucccaagcucugcaggaaugacugggggcugccauucauaaagcagcugucccauuauuggauguuuuuguucuuuuaucuauuuucugccuagucuccugcauccuuuuccuaauucuuggcuuuaguucuguuuucuucaacuauagggagcgagucaagucaucccaccucugugagacuugcuugauuauuugcaggcaucuaugcaugacuccuuccgucuuucauugucuugacugcacagccuuaguaccuccagauccccacccaccuauuacuuucucaggaguuuugaacuuucucacuaacuuuuuuaauguggaucuaggauugaaaagaaucgugagcuuaggaagcguuacagauacaaagacuacaaauucaggucucacuugucaaauaucagaaagguuauuucugacaguccuccuuccccaaaucuaaauguuucccucuuuuagcaaucuuucccucccucauaacuuuagcaugguguauggugugugcguagucauacauuagugugauuuuugucuguuuugaacacuauacugugaaguccacgagguagaggcacagugacagcaagccucacucuacaucuucagugcuggacgucauccagugucauggcaucaugugauuuuuaggguacuauucauguguguucaguuauguaaacuuguuucucaguuguaucaauaggcguaaauaaguucucauuguugauguuauugaaguguauccauaaguauguauggucauuccucuuuuuuuuuuuaaggaugauacauauauuuauuucuuaaaaauuucaggggacgucccaguguuagccacuucuugucccuucuguggcuacauccaguuguaauuguucaguacaacacaucagguguuugaaaugccucaaaugucaagaaacacuaacuuaucucuggcauaccguacuuuuuaaagcagaaguauuuucuguaaugguuacuacagaguguuuacugguuaauuuuuaguuaaccagaagcauacauuccauagcuauuccaguuaacugagguuuauauccauaaagacauuaccagagauagaaaaauuucccuuuucuucagcuagagaccccaggcaccaacacacccucaccaccuucuugaaaauauaaagugaugggacagggugcgguggcucaagucuguaauccuagugcuuugggaggcugaggcagauggaucacuugagaccaggaguuugagaccaguguggugaacauggugaaacccuucuguacuaaaaauacaaaaacuagccaggugugguggcacaugccuauaaucuguaaucccagcgacuugaguggcugaggcaugagaauugcuugaacccgggaggcagauguuauagugagcugagaucaugccacagcacuccagccugggauacagagugagacucuugucuccaaaaaugaaaaaaaaaauuauaucuauguauaucucuauauaucucuauauaucuauauauguauauaucucuauauacaucucuauauauguauauaauuauauauaucuauuuauauauguaauuauauauauauaucuuuaguagugacuuuuacuagugaaaauuuuaauauccuaauuaccguuauuuagaaaaaauucuuuuugaguugauguuuaaaauucuuuugauuuuuuuuuuuuuuuuaaagucaucuuuuacaacuccucccuaccgcuccuccccuagcucuccaggcccauugcccugacuaguaaagguuugcuguuuuuucuucuggacauuuuccuuugcgucuucauuuauauauaagugcucauauucuuguuauacacagauauauuuacaaacguagguuggguaucccuaauucgaaguguuugggaguacaacuguuucggauuuugaaauauuugcauauauguagugagauauguuggggaugggaccuaagacuaaacauucauuuauguuuuauauacuguagacagccugaagguaauuuuauacaauauuuucaguaauuuugugcacacaauaaaguuuuggcugagcuguggcuguaacccaucauaugaguucagguguggaguuuuucacugguggcaucaugucugugcucaauagauuuaaaauuuuggagcauuuuggaguuuuguauuacagaugcucaaccugcacuucuguaacagaguaguuugaaugcuuaauuaaaauggcaguugaauauuauguuaacuuugguuuuaugauuaaaccuuuucaaaguuuuuguuacuuucagauacucauaaguaaggcauauaaccucucuagaccucacuuuccacauuugauaaaggaacgauuugaauuaaaugaaauugaaaaucucuuagcucuaaguauaacaaauuauguguuaaauuguauaauucaucucuuagauaucaugaagaauguguuguuuauaauaugaaaaaguaugaagauaaaaaucaaauaugacuuuggguagcaagaagagauuuugggggaaguugcuaauguguacaguuuuuuccccuaagagcggcgagagaauggcagcugaucagacuggugguggaaucugucucuauugcccagcuuggcacuaugaaguuugaccugugucgaucacucaaaacuagcugaugacaucugaaagggaguuuuaccccggcucccugaaguuucacauuacagcucuacauuuguguuaacacaaugaaugcuucaaaaaaaaaaaguuauagaaaucaaagcuuacauaggcaaaucuuuguuagugacuuaguuaaaaacauuucaugaauaauaguugcucaagcuauuuuaacccuuuucccuuucccagaagagaaacaagaaaaucccacacauuuugcucagucaugguauguuuguaagcucucuugucagaaagugucacugauucuuuaaauuucuuuuaguuagcugcuuuuguccaguagcucacuuauuuugugguuugaagaugacuguacuucugacacuuuucucacauacuccugcuuuaauuuuucgaaaaacucaauggcaagaaacugaaaacauauacagaaguggagagaauacuagaaugagcucucacgucccuagccucuuggcuucagcaguacucaguguuuugcccaucagauuuucuaaugcuuuuaguguaaguaaugccacauuuaaaaauacuccuuuuagaaaagagacuuaguauuuaaaaggaaauaaaccagagucauucccaagauuuaucugauuaaacuguagaguuuauaauuauauaaauuuuuuuuagcacauagaacagucauucucuauagcaaaaguacuagcuuuugugcccuuugcauuggauugaguuauagagcuaaaccacagcaaacucauuuguuccacucuuagguugcaaguaucacuuaacugugcuuacuuaucucaucuucaauauuuacaaauuuuaacucacauuuguuucaguaaagcaacccaaaguagauguuuuaggagaugaguugguuugaugguuaugauuuucuuuuacuccuguauugacagucagcuguaguugagacuauuagccuucuggagggugaggugaacagggcuuuuuccacuucaggggcuagaggcugacaugcaugcaguuaccugcaguucagggcagagugggguuagggugguaaugguggcauaaauacuguugugccagggucaugucuauagguguguggugggaagcucugggggagacagcacuggcauuggguuuggacguggcauuuacgggcagagguggauaaagaagacccauggaguagccuuagcaaaagagugguauuuggguaguaggacuuuguucauguggcuggaguguagauguguacuaggagauagagugaaaagguggagguaauaguaauuuaaaauauaacaguaaaaagaagcagcuguguauugaucacuuacugugcacuguuuuaaaugguuuacaggugccacaucuuugauaauacagcaauucugugggugcaauaagugauggagccaggaguucaccuggggcaggcuggcuccggagcaucacuggugccuuagggccucaaauaccagauucagcaacgcuaagcacuuuuuugggucuuauuuuuggauggugauaguuagcaggauauuaacugauuuuuaaaaacaaauauauuuguccauugucaugaacuuuuuaacucuguuggaguuuaaaaaauuggaaguacuuagugguuacucauuguggccccuaguuacaguucaugaaagggauuuuuuaauguuaagauggaagcugaauuucuuggaccauuuuuuuccucauaaaagauguauauauuuauaaaaauugcgauacauugagaaguauaauaaauuaguaauuacucagaauuuuauuggccaaagauauucauuaugaauaaucuuaaaugcuuucuucgaguguuuucuauguauuuauucuacucuucuaaaacugugcuuugggaagggcuuugaguccuuucuaauauaaugguauaacuuccccccucaugcagugaagcuuucagaagaauucaagugaucacacaacaucauaucuguguuaccuuuuguguugaacauuuauuauuuauaacauuuaauuuuuaaugauaaacuuuuguauauacauuuuguauauucuguuaugaaacggauuucuaaaauuagagauugaacaugaagcagaauggccuacaaaaggaacaugaaucugugcuacagauauaaaaacuauuuugaaggcuauaggaacaaccacauuugccaggacucaugcuuaaauagacuguguacggcuguggagaucauaaauugagaaagcaugauauuugagcaagaaaaauuuacugagguuuguuaagauuugagaagagagauggaaaaucuuccuguucaguuggagaagaagcugaggaauaagucuuugugcauaugaagaguguuuuguaggcuguguauagguauuuucuguuucuucagaauguagcaaaaaacagugugaacuuaaguugguauagaggaauuuaggagauaauuuaugacuagggauuggaagcuauugaaauaguuuaucaugacaauucuuugaaauggaugaguuuucauuauauuuaggauuuuauucuccuuaaggagaggagggguuaagauggugucuuacagguauuucuagaacuuuauucccaagauuuauuuauuuacuuagagacacuuucacuuugucacccaggcugaagugcaguggcacgaucauagguggucacuacagucucagauuccugggcuuaagcagucuucccaccucagccuccccaguagcugggauuacagguaagugccaccauacucggcucauuuugauguuaauuccaguuuucucaccuauugcacgucuccuggacuuacacagaaaauagaagacaguuggcugggcacuguggcucacgccuguaaucucaguacucugggaggucacagugggcagaucacuugaggacaagaguucgggaccaaccugacuaucacagugaaacucugucucuacuaaaaauagaaaaaauuaucugggcaugguggcgcccacuuguaaucccaguuacuagggaugccgaggcaugagaauugcuugagccugagaggcggaaguuuuagcgagcugagauugugccacugcacuccagccugggcgacagagugagauucugucuuuaaaaaaaaaaaaaaaaaaaaaaaaaagcccaggcgugguggcucacaccuguaaucccagcauuuugggaggccgagguggguagaucaugaggucaggaguucgagaccagcugaccaacauggugaaacccugucucuacuaaaaauacaaaaaauuagccaggcgugauggugugugcauauaaucccagcuacucaggcggcugaggcaggagaaaugcuugaacccaggaggcggagguugcagugagcugagaucacgccauugcacuccagccugagugacauagugagacucugucucccccccaacccccucccccccaaaaaaugacaguuauacuacaugaagguuuguaguuuugacugaaaggacaaaccaaaacaagaaaaccccaccuauaaugcagguagaguaauagcaugcucauguauaauugauuuggcaagucugugaaugaagucccagaaauuguauauucaguuuagugaggccaauggaauuugaaguacagguguagaaauguugacauuaacaaaugucauauguauuaggauugugacagugugacuacugacaugguagugugccagucauuuuuauagaaugucuauugguugagaaaauuccaggguaacaauuuuaagguuuaaguuuuaauuucaucacaaaauacacauucauuuuagaaaauuuagagaauacagauaagaaugacaauucccugcaguuucucucuucugagauaacuauuauuugcauuuuguauguaauccaccaguuuuuuuccugcacauaacuacuauucucuuuuugaaaaacaaauacaaucauguuaucugcauauugcuuuacaacccacuuuuucuacaugaagcaauauuuucauuguauuccgcugugccaaucuguuuauugaacauguacugcgauacagaaauacgagaucuagugguacuuuucaccaaguaguagauaauaccacuggagugaguauauaacauaaauaauuaacagaauauagcaggagauaaaugcaaguuaagaggagaggcuggagugacuuuaaaguggaugaaggcaaauugaggugaucuugaaaauggauaggcaagaaggggcaaauuucagguagaagaaauaaacacuaaugcagaaggggcuuaaaugcacuuuauggaaugucacauugaacugugaguucagaggaauaagauaagaucauacguuucuaaauuauagagggguuaaauccagguugaaaguucugugucucagaaaaguauguguagcagcuuuaugcaaaauaaauuagggcagcggauacagcuuuuuaagcacaguaguucccaaacuucgcuggguccaggauucaucuguaacaucuuguuaaaacaaaacacauauucuuagguccuuguccaggcuuccugaaucaggauuuuugggaguagagucugauguaguuuagggaaccugcccuagaguuuaugacauaaccaucaggccuaggagauaguuaauucuaggaagcauuuguaauacuuaaggugaauuaaggacuugguucaggugacuaaagugagcauggagaggaauggaaaggcaugaggcacuucgaaaauggauaggauuuaguaagaccauuuagauaaagucagcagcuucuaaugaaauuacugaaagaaugguggugcgggaauagagaugggaaguucaaguggauaacauguggugcaggaaugugaugaggaguuguaggcauagagaauggaggcagggauguggcacuguaggcagccacccaacagcuuguuagacuagauauugagugaaaaguuugaguggagaagagaguuugaaguauuaguuuggaguaaaccauugaaaauacuucuuuugcagggaaagauguauagagaaaugagugaagcggucaggggauagaaccagaggucacaucugagguuagggcuaaaugugaaagagacauggauuauuuggaggauagcuaguguugugaaauacaagaacauacauuuuaagaauuuuuaaggggguagcauuucucuguaaacuccacagaagugugggaggggaaguaaguaaaacugaacucacuuuacugcuuuuaguaauagacucauuggaagaaaauguaagcuauucaugcaguguguguuuuugauuauuucugggccuuguuauuuuucuguguuucugagaugcaaggauuauuuaaaggcaaugguuuauaaaaugauauauaauuacauacguauaaaaguacauauaaccaacuaaguauauguaugcaugcacucaugcaaaucaauuauauauuuacauuuuauauauaaauuauauauguguguauauauuguauuauagaacauccuguguggaaaaguuggugcugucagaagggagagagagcaaggcaguuuuccagugcauuucuuauaagcuaguuaugagaagggcuugcagguuacugauugaacauauucuuucuaaaugucuucugucugauagauacuccuuuguuagggaauauauacauaaaugagauuacccuagauguucagguuagugagggaaacguuacaauagauagcacuaagcgcuggaucucagcuuugauucccagagcaccuagagcgucauugggccaccucuucuaaguuccucuuaagaucuagaauugauuugaauaauagaaauuuugaguacauuuuguguaggugacauaaaagaacauccuuaagcaagcauaucaguuaaaggacuugucuucauggcucuugguguuuucuucauaccacuuugcucuuaguuccuguuagcagaggggaagaagcaggcucuaagauuuaaaauucaugcuagugaaaauuagaaacaagccacauacccucaauagguguuugcuuaaaaugcauuuacgucuuugcaguggaguacugugcaccugguaaaaugaugaugcaaauauaaauuguugauauaaagauauauauguauauauacauauauuuaaggagcagagauuccaacaccaaauuuugggugguggaauuuuauuagguuggugcaaagguaauacaguuuuugcccuugggagauugggcugauggugacacccguuacccaagacugagaauacagaaaggagaaguggauuuuuucucuguuuuuccucccuuuuugaguaggggaaaugguagauucaguuuaauauggccaaaagcaguggcuuaguagucaguuugcuuggauuugaauaucucucuaccauuagucgugugugauuugggaugguuucacuucaccucucugugccuuaguuuucucaccuggacaaugggaaugauagugguacuuacuuuuuguaauuaugggguuuagugguuuaaaguagaaaauuuauaccagggcccauuaaagauaagucaucucaugcagugaaacauaacugggacuuucgagcucaguucacugaggucuucugggccuggaacaagcccgccuuauaaaaguuggcuuuacauacuacauacuaaaggaguucuuaauguagacuuuuaaccaacugucuuagaaaugagccuuuggaaccuaggucugcaugugauaggggugcuuucuagugucuacuugauagaccagucacuuucuaguagugggaguuagguucccgaaaagcucugugguuugagaauucauuuuugagaauaucuauucacaagagaauagauaaacaguugauagacuugaaggucauacaaaccugugcaaaucauuguaaauguuuucacauucuaaaggaagacagaggacagcaagcaaaauagaauaucagugguaguuuacauauuuugaguuaguaacagaguaccuguacuacuacuuuacaauuacugaugauaacuuacccccagaaacuucuguuucuccccuucaguuuuagaaaugaugugucagugcauuauguauuguugcagguaaugugcauaugaggcauuucccuccuguuuuccucuauuuguugguacguccaaauacucagugccugauuuugucuuucaggcccagaugugcucucagagauacugaguugaugguugagauagccaaaauuuggggcaaaacucauuuaaucugcucagcuuuuaguucuuaaaccuucucccuaguucuuuucacauaauugcaugagaaagcacaugcuucuagccucuuuaacacaaauuucagcuauuccacuuccaaaaugccauuggaguaguauaauccagcacccauguuuauaaucccacauguucuuugaccuugaccaagguuuuaaugcaaaauugacucaucugcuauugguuuuuaccuuccuuucaguuugucuccuuuaauauauauauguuuuuuuucuuuuugagacaggaucucacccuguugcccaggcuggagugcaguggcaugaucagggcucacugcagccuugacuuccuggaaucaggugauccucccacguuagccuccuuauuagcugggacuacaggcugcaccaccacacccaaccaaguuuuuuauuuuuugggguagagaugggguuuugccauguugcccaggcuggucuccaacuccuggucucaagcgaucuaccucccucugccucccaaaguucugggauuacaggcaugagcugcugugccuggccuaaaauguuuuugguaaagggaaaauauagcaaucuguuauaugcuggaaucaaaauuuuucuacuagaugaacuuuuggggaaauuuaguauucuguucuaaauuaaaugccuuuuucaaguaauuacugcuaaugagcucuuguuuuuucauguuuagggugguugaugcagaguagugcauauaggggcuaaaaucagacuuagacacuuggggguucuugcaucucuguauuuucucacaacuauuucagugauucuuaaugaguggcaucuuggcauagugaacuuuaaugugggaccauaguucacaaacugugaccuuaggccaguuaauccuucugacccuugcuuucccuguugaugaaauggaaguaacacuaccuacucguagggcugucaggaggucaaaugugucaacgucuauaaaaugccuuagccaagugguuggcacauagauaguaaguguuccacaaauguucauuucccuguaguuuuacuaaccauuuuggugcaauauuauauucuuuauaaagucuuguguuuuggccuuuuuuuuuuuuuuuuuuuuaaagacugugacuguuuucuaggguuuugaggggagugauaaauguucuggguuuuuaggauuucacuugaaauccuccuauauaacugcuuuuucucuguaaugcugcuugaucaucuuauuggaaauaagagauuuuuuuucuuguguguuaggcaucaaaacugugauacuucuauuuucccuuugacuccuuuggcuauuauaauucuagaaaauuauuucuaaaauugcuauauggaaaaaguacuuucuucugucacuucuuuaauucguuaguguaaaugagccaaaguuuauaagagaauguuaguuaacuguauaaauuuuagauaaugacauaaguuuaauuuauguaaucuaauuuuagaucuaguuuuucuugauuucuguuuuguagcuuuucuguuguugcuuauuuuuaaugggcaucuucugaguuaucuuuuuagaucccagugugcacuguauuuuaucuuuucauaugggcuaaauuuuguaaauugugaaauaugcgagcauuuauauaacauauaaaaugaaguaauaaaaaacaacuugguauuuucuuccagcuuaagaaaugagguaguacuuaacuaguacuuuugaagcuccuuguaucauacugauuuuuuuucaucugcuacuuguaauacuucauacuacuuuaguuauuuugaaauuagauauaauuuuuaguuuggugucauuacaaaacacugucacauuagagaacauauugcaccugccauuuaguuuauuagcuccuggguuagucugaacuugccugucaugcugaugcauucauuucagucccagucuuacauucuggaucucuguuuauuaguguauauauauauauuuuuggagacagaguuucccucuuguugcccaggcuggagugcaauggcaugaucucgguucacugcagccuccgccuccugauuucaagcaauucuucugccucagccuccugaguagcugggauuacagggaugcgccaccacgcccagcuaauuuuuuuuguauuuuuaguggagaugggguuucuccauguugaucaggcuggucuugaacucccaaccucaggugauacgcccaccucggccucccaaagugcugggauuacagagccacugcucccggccuuguauuuuuuauuuuucuuuucuuuuucuuuuucuuuuucuuuuuuuuuuuuuuuuuuuuuuuuuacaaaucuugguguaucagugcuuuuuauuaggugacuugauuucuccccaaccccugccuguggaauacagacaccaagagacuaagcucaguaccuaucugagcauaccguguguuuaacagccuguggaaacuguccugucccugaagauacgcuguagauuaauuuuaugcagugauuuuaagacaacuaaaaaaaaugguuuguaaguuuaacuucaaaaaaccauguaagcucgguuccuggauuguucguagaccuucacauugccuuuggcaaacugagcuagaacauacuguagaagauuugagggucaugagagguuccugugguaaagagagauguuugucauuagcauuugauuguuacuccauaguuugugaauggcuccauuuguggggcagaugaugaaaaauauacucuauauuuuucucaaaaaaaugaaaauaugacugucuagauuuuuaagcuucuuuaagaagaaaaucguaucuguagcuuaucugcaaagcacauuugguguguggaauuaucugcuuauugucauauaaaaacucugaccuuguauuaacauuuuuguuuuugaaaaguggcuagccugaaggaaggauauauggaauaaucacuagaguccuuauuuaaaguaauccaaggugaagauuucuggaguuuauuguuacuuagcauaugaugguuugguugcuguauaagucagcagaaaauuauguaacucagagauacuuuagguggccuuucauaugaguaaugauuaauggauaauguuucaaaaaggugucagaaauuuugaugugucuuaccuuuagauuuuuaaaauaguaaugaaaucuaauuucuaacaauuuuuaauaaagaauacugauaauugauucuacugucuuacaaagaacuuuugugucaguaauaucuacuucuaucgaaacuggcgagguguaaguagcauuguaacauuuucugggugaagaauaugauguugagagccuaaaggauuugauuauauaguucauagcuagagauugaauuuauguuuucuuuccccauaguucaugucauaauuuuaaagacugaccauuuuaggggaaaaauuauuagaaaaugauguccuuugaguaaagauaaucuugauucaauuauuuuuacaaauaaaacuauucugaugcagcacucuaguguucauccaucuagucauacaccccccacaauaugauaccagcuaguuguaggucuaguguuuaauguaauaccguaacaggcauuugaauuggaaugguaguucuucaggaauggaaucuggaauauaggcaaagauuucagagacaauuccuaauuuaaaaauaacucauauugucucugagguucuuuuccagugaaguguuuaguauugcugcuauuuggaguacaaaguuggagcuuuuaaagaaccugggaguucaaaaguauaaggagaaauaaaugaaaagcagaaauauuuugaggcaauaaguauagacucaaaucuauauuaugacccacuuguagcaccacuuggaauucuaccaauaagagauuuauuugggcaaacuauaaugguuguuggaaauugcaaaucuuagugugaauuauuuuaguccaguugguuucuuucuuucucuuaccugaaaugaacuauacugaggcaauaggagcuuuguauaguaauuuaggaguguaaaacaacuuagggaaaaggauuauuaagcaggaugauugggaugacaucaugugaaauuuaggaauuggaggcauugggaauugagagggugcuaacaaaggaaaacagcuuauuuuagaauuugucuggaggauguagaauugaagaaguuuugguauuucuucugcagcggccccagugcccuugaccaggaacaucucuuggagucaguaguuuucaugaggcugaccuaggaacuuggccaacauaugcaacauuguucuauuuaaaauauuccuugaauuaaauucgauaguaucaauuuaaaacauaaaguuuucacucaacuccuuuagaaguuagauuuuagcuuguacuugucuuuaccucuucugcugauuaucaguugacaacacugagauuacuuucauuuuccuguaagucauuaugaauuuuucuggucaaccaugaguuaucaguggaagcaauaaguaggaaguacuguaaaagaauuacaauaaaauaagagaaaccacuuggagagcaagagggcuuguggacuugggggagcgguugugagaaaugucucagaacuuaauuuacaaauaacauugguagauugacauguugucuuuccuauaaaguaacuuuaccucugucuuaauaguaaacuacuaugaaagugaauucguguuccucuugauuugugaacugaugaaaauuacaaaauguggaguuuuuuccccagauaaaguaaaugguggaauauucagguuuauuugauaccuagaaaauaccugaaauuuuccgugguaauaggcacauuuugaaacuguuuuuuuuuucucugacaauugaauauauuuuauauauaguugauuuugauuauugaagacuaaggaaaauuuaaguuugaauguuagaaaaugaauuuugcaaauuugaaguaauuuuauucuuuauguuuugggauuguaguuauguuagauauuccucaguugggguaauugucuugcaucauuaucucuuaucauaaucuguuuuucuucacacaguguuauaguuuugccgcuggacucuucccucccuucccccaccccaucaggaugauaugagacuugaaagaagacgaugcauacaggugacucaaguuuugaaauacaguaaaacucuggcuaagagaaugugggaaucgauggucuauuuugaaugggggagguuucugauaaauagcaguuaguggggggaauuguagaucaguaaaugcaaagguaguugggcuauuuguuaaacuuacuuuugaacucagauugauaaucagugauuuauagugguguuauuacaaauacagcauaguaaaugcuagcacuuaggcuuuucaagagcuaauauuuuggugggaauuggaauaauucuguuaauguaaauaacacagucaccuuuaugguugaaugcaugucucccccagaacucuauuagaauauggcagaucuuuuaugggaguagauguuaguaggauaucaucaaaaagacugacaaguuaaggauauuauacccauacauacgguuucuuaaaaagauaugcucugggauuuuguuuauuuuuuccuuguucccaauaucccugccucccauuuccuuucuucccacccucccccucuuauccuuuugucauuuguauuuuuauacagaagaagcagugugaaggcauuuuugaaagaauauuuuuugauugcucuauaauuaauugaggugaucuuuuacaugggaaacuggaggcuauuccacacauggcuauguucaaauuucugaaaauguagugcagcuaauguauaaaguguuaauaacuuuugaacuuaaauguucuuaaauuaggcauauuauaaggcauuuuguugaacuaagugacuuaacauuugaaacucugucagagagccuuauuugauuauauuuauaaacuguuugaaaaugugauugcuaacuggaaaagaaauauuuauauaaauuuugaauugauaccuaacagaugccuaauuauaucauugguguaguuuuugugauugguuuuuauuuuuggcgaucuggguuuugucuaggggaaaaaucaucauuuuaugauuuuaagauuuuaaaaaauuguuucgguguacuauuuuguaugaagaaaugugcuugaauauauuuauaaauuaaauuagagaguauauaauacuucacguucauguagaagucaccauuuuaagaccgauguuaauucuuguuuacgucaaaggugauugagcaaucaucucuguuacgcaucuaucaugcaugcacacaggcuugcacauguauguuugccuguacauauuagaaguaugccagguacacauucuggcugaguugcucgcugauuguuaaaagcaacgugaugcugaagcugaauaucaccaucauagaaaaacaaauaggcauauuuacagaaacauuuuuagaauuuuaugcacauuuuuuuguugucagauuuuauaaguuugaccuuuuggugcaggaacuauuucucagcauugucagcuccuggauugcuccuugggcgcuauacugcacauuggcuauaccaaguagaugcucacuuucgacugaggucaguagaggaacaaaguauuuuugggguaucucauagauuuaucuaugaauauuacugauuuuggagauuuucucucgugaaauuuuggaguuacaaaguuucuauuuauccucacaagacauggaggguuuccaaauagcucuuuuucuugaaaggcuuauggucucaauggaaugaaauaacuaaugaguaaauacaguuuauaguuaucuaguuaauuuuaugaaugcuagaacacaagaaaauucuacagauuagauuuaugauaaaauccaaucucuuauucagccuuguauucuuuaaaaauugucagcauuuauuggcuuacagaggaaaaaacccaggaaagaagaucuagcugucuaauaaauauauuagcuguugguguauucccuuucuaauaguuugaaaguuaacaauuguuuuugaacauaaaauuaacagcuuucagaaucaucauuaauuaauguagcaguuuggucuuguauuacuaugcacacauuuauucgacugauagaauuucaacacauuaaaacuaaugaguagauguucaccgaaaguuguuucuagagaaugcuuccugacauuugaaagcaaguggucugcuuucucugggccuuguuuuuacccucuggcauuguucaugguacuggcuuuguucuguugguuagaugugguaacuuacucucaucuuuuccuugaugaggcacagguucagggaugcuggaaaggacacugaaguaggccuuggcugaugggccuuucagaagugaacacuuaagaguagguuuucagaguaacuuugugaggugaugaauauguuaauuggcuugauuguggugaucauuucauuuuguauauguguaucaaaacaucauguuuuacaccuuaauauauacacaauuuuuauuuuccaguuauaacucaauaaagcuggugggaggagagaaaaaaauaguuuuacugaacacuaggccaaagucagacuuugauguauuuaguucauguaucuauagguguuccuguacuuacuuaauuugagaaucuuuuugcauguuuuaaaauacaguuagaacaugaaugaaguacauuuggauuuucuuuugauuuuuggaagaacaaaugauuuguuaacaaacauuuauuuggugagcauuugcuuuguaccagguacuauuauaggugcugcucugcauacaaggaucccugagcuuauggauaacaaauaaaugaggcaguggagguuuuugauaaaguuuuaagacucaccuauugaauucaaggcaugcagagagaaaguagagagcacugucuggguaaugacauugacaguaauggcuuuaccuguaggcagagguuaccaaaaucucugcaucccauucuucucuuccgagcuccacacucagguaacugcuuucuggaugccucucccgcauauucccuccuccucccccauucaguccucuuaguaaugagugacaccauucuacccuaacacaacaucauuuggggaaccuagcaaccacucuuugcccuuuugaaucacaaguaaccaaauucaguuuauuuaagguguagaaugacuucucagauuagauuuggaaaaaguacugccucagagauuaccauguauaugaacauaaagacuuuuauauaaagaaaccuguguaaaccagcauuucuucaguuuauuugauuaagggaccuccccucccuuuuauuuuugauuuauaccuauuaauaacauccuguggaccaugauuugggaaaaucauguuggaaauagaaggggcugccauucuuuguuuuguugaaaugaacuucuuuaacaacuaaaauuuuuuaaacaauagugauauacuagucacuuuuaaauguggaauaguuccaaagcauacagagcuaucacuuuuugaggaugaauaaacauggaaauuuauuuuuaaaugugcugauuuguucauauugucuaugucauaauucuuaugcauacacuauauauauacucauauauaugaauuuaaguacuuaaaaccguuuguggcagaguuuuaauuuuggauucucuuaacucauuuuaaaaugugaauuuuguaggacaaaauuuucauauuuccagugaucacaaaugggguguauucauuauacaagaguuagaaaucagaucuguaaauuacaaaaccccaacuuuuaaaaucccaucauaugugggguacacuaggagaaugaaagggcauguagauuguaauauuuaggaagcugucaccaguuugccuccccuuggaauuguugucguggucgugugugucugaucuuuuucuuugucugugucuccuucucuagcuuucguucaugucucaacccaagcaguuugacuuuuuucuuacugauucaauaaauuuauuuuucuaguaaguuaaaaagauaguggauuugcuuuugcacucauguuuuuacuuuuuguuuauuagaugauacaaaaucacugaaagaauucugaaauguauaaauauauauagauaaguauaaggaaacauaucccaaguuuuaguguccccuacaguguggcacauucccuuccaguuguuuuucaugccauuuuuuuaacuaauugaggucauuuugaauauucaggaugaugugguuggguaagauccauuuuauacucguguugacuaacauaucauaaauguugcccuacaucaucaaaagcuaaccauagugauuugcuguuacuuugaacuuggagcaaauccaggguacucagaaugcuuuugaagauaauuacuuuagauauuuauuuuacaguaugcuuauuuccuaguuaaguuagguaucucuuauuuuuaggcauuaaguuguuuuuuaaagcacuaauaccugugcauaguauuuggcuguaaaauuauuuucuuauaauugauuccuaggagucauaauguuugaaaaauuuucaggcucuugaugcaacuuuucagaaagcuguuugguaauauguaccacucuguacauuacaagaaugucucuuaauuuauuuuucucagcauugaguauuauaguuaaaauaaaucuucaacaggcaaaaagaagaaucucuuauuuuggaacaaaugaaguaguauuguauacuugguggaggaaauauaagugcuuuagaaaugcauaaaguaaaaagagacagccacuccccuuuuccuaauaguuuggagucugucuuucuagcgaguaguuuuuguuuaauacguuuauggcauuugcacauguuguuuaccaguuuuauguccagcuaguccgauaguuccugaaggucaggggguuaaggcuuauccucuuugugugcccugugacugucuggcaggauuucugggacacaggaagugcucagcaaaugcaaaaagaauaauuuuuggcauccuaauggcauuuuuaaugccuaaaaauaaguauauuaaugcuugcuuuaauacauuucuucaagugguuuuaagaguuucuuauuauuuuccauugcuuuuuauguuucauaguuuuauuuauguuucuaaguggaagcaauuaauaaugauuacauuauguaugugucauaugaaaaagcauuugauauuuauagaaaaaaugaugggaaaucugagguaagccacauuguaaaauugaauuuuuuaccuuagugugucuauuuaagacccagguaaaagaaaauacauuuauauucaugauuuuggauuuuagguauacuuauuaaguguaccuugaaagaaugucuaaguucuaggaagaugacaacagaacauaguuuuaaaauuuucccauuuuccucuagaagagacagaguaacuagcucagcaaaaccaaaacgucacauucagcaucugcaagacuaggugaacaguauccccacugacucacauacaaguaaguaggugagagugaauguugauagcaagaccugugugguaucagcauuugugcagaaggaggcaugagggugucugauggaccugagaauaggagaacccuaagauaaccaacagaggagacucacugcagugagagacuugcggaaauuauguuugagaagagcagcuggaacuggagauaguuuugaguucccuggaggacacaauaaguucugaagggggguuagagucaugugguccccaugaacucucaaaaccaguuuaagcuccauucccagucaaagcccuacaccaaggagacacugcuggggauagaauccacauuaaacaagauggagauaaugagggcaaaggaaaaaaugucagaugaaagugggagaagauaaaagcacaggagaucuuauucaugagucuauauuuugggauccuucaugaaaagggaagagaacucuuauugaagucagaaaagcuacuccaguuuccccaaaguuuuuuauuuuacauaaaaacgagcaguggacagggaucauagucaaaauccccacagaguuuuuauaagagaaaagcauaaggagccgaauauuauuacugcagacaaugaaagcaugccagaaagaaauguccacaaaauaaaugaaacuauaacuuguuucagaauaaucccagagaaauuuagaaaaugauacaaacacuaaagcacaauguaaaucugaauaaggaaaaaucagaaaaguggugauaacccaggaaagagaaguaaaagauaauuuaaaaaaugaaaccuaaacagagugaaaaacacaauauaaaauuucucaaaaaacuguuuaagaugaauaaccagccgggugugguggcucacgccuguaaucucagcacuuugggaggccgaggcgggcagaucacgaggucaggagaucgagaccauccuggcuaacauggugaaaccccgucucuacuaaaaauacaaaaaaaaaaaaaaaauaagccagguuugguggcgggcaccuuuagucccagcuacuugggaggcuuaggcaggagaauggcaugaaccugggaggcggagcuugcagugagccgagauagcgccacuggacuccagcuugggcuaaagagcgagacucgguucuaaaaaaaaaaaaaaaagagaugaauaaccaagaagaaaugaagaaaaaugaagcauuccagagaaagcgacaguuacuaaagacaggcaaggaaguuucaacauacaaauaacaggaggcucugaagaagaacuaaagcaaugaaacuuaacagauacuaacaauauaacucaagaaaauuuguugaaauuugcuuugcagauuuuuuuuaagagagucuugcuguguugccuaagcuggaaugccauguggcauaagcauggcucacugcagccuugaacuccugggcuaaagcuauccuccugccucagccucccaaguagcuaggacugcaggcacgugcugccacaccuggcuaacuucuuuauuuuuauuucuguagagauguggucuugcuguguucccuaggcugguuuugaacugcugaagaccagccuuaagugauucuuccgccuuaaccucccaaagugcugggauuacaggugugagucaccgucuuggccuuuagucacuuuuuagugugcuuuuaaaauuuaaacauucuccagcaucaauauucuucuauaguacuguuuuaaaugacuaaucaguauucugcgaauuaguuaauguuuaacgguuccccauuuuugcuaauuaguucaugaacaauguuuaaguggauacuauuaucguguuuuuuguuuguuuuuuauuuauugccuuagguucaauuccuagaaguuggaauuguuaaggugaagcauauguacauuuuaaagccuuuugauacauuauuuucaaauaccuuuuuaaaguacaguuuaugcuucuaccagcugcacaucagaauuuuucugcacccuaggauccuagguauuuuaaaauguuugccaauucaauagacaaaacauaacucaauauuuacauuuacauuugcuugaauauuagaccgaguauguuuuuugggggguuuguuacucauguuuuuugugaguuuccuuuuaucauucuuuguugauauuucuuugggguuuuaauuuuuuuucuuaauuuaccaaaguuucucauugaacccuuacuagaugccaaugacuauucuaaauuauuuacagguauuaacuuauuuacuccuaaugauaacucugguacagguacugugauugacccagacagagguucgguagccugccccaggucacacagcuaguaagggauggagcuggggagcaaauucagggccugugagucccuccucuuaaugaucaugcuuuugauuuuagggauacuuacuguuacuuauugcugguacauuuuccaguuugcauuugccuuuuguucauggugucguuuuauacaagagcuuuaacuuuuuguaugggagaacuaaguuuuauuuauuaguguaaugccucaaacauaacagauucucaaaucuauguguugaacaaaugagaaugaacccaucagcagucuguugauggugaugaccuuuuauguaguguaauauguaucuccuuuuaaagggauucccagggcuucauaaaugaguuacucuuugguuuuuaucaggcacaguaagcuuaucuguauuagcucuucuggaaaguuuuuuagauguaaucacugcuuuuaaaaggaacauguguucuuaaacaagcaaauaggaguugugaagaauguauuuauugauaaugauuugaauuguagauucaaagugaaaugaaauaauuucacucuaggaauaauuugaugggauuuguuuuuuguauuuuuagaaaauuauagauuuggccauuguuuaaaaaguuuugaauaaauuuuggcuuaguguaagaagauucuuugauaggaaaacuaaaacuauuugauauaaaaaguuaucauugcuuaagauuuggauaguguagaucaucuccucaaaaggugaaauuuaagauuuuacuuuucucgaauuccugaccucagguuauccugcugccuugggcucccaaagugcugggauuacagguaugagccaccgugcccgaccaagauuuuacuuuucuuuaagcacucuuucuccucuucucucugguggugaauaccaggcuacuuaauggugccuucuuaguuuggccucuguauuccuuagucuuuuaaaaaaguguagagauccauauugcuaauggauauacauuagagagaaacacaaauaaguuaauuuuaauuuuuauaaaccauccacaaaauauacuccauggaaucagauacucaaaaagauaccgagauguaaauauuuauguuguuaacgcaaauccaggucugcuuuguagaagguuaccaaagcuuaaaaaccauuguugagugcuugcuguuuuuguaaccuacugguugcagccagcucuuuccucuccuacuggugguaguaguauucuucaggccauuuguauuagucuguucuugcacugcuauaaaggaaaccuaagacugggucauuuaugaagaaaagaguuuuaauugguacacgguuccacagguuauacaugaagcauggcuagggaggccucaggaaacuuagagucaugguagagagugaaggggaagcaggcaugucuuacauagccccagcaggaggaaaagagagaagugggagugcuacacacuucuagacaaccagaucucgcgagaacguacucaccaucgugagaauagcaagggggaggugugccccugugauccaaucaccuuucaagaggccucuccuccaacauugagaauuacagcuugacgugagauuuguguggggacacauauccaaaacauaaucaccaugcuuagccgauauuguuaaauucagacuuguucuuuuaagcauuaaucagucaauuuacaugcuuauguuaauaaaauuuaauccauucuggaaguaaaagaacgaaaugucaguuuuccuuuuccucguuuccacuuacagggguaaccccuuuuacuauuuuccguuuuaaaauucuucucuugguugccuccaugauuuuuaauacauuaguauguuuguagcuguguuuuaguauuuuaaaaaacuauugaaaaaugaaaccagauagcucucagugcuaccucuuuuccauccaguuucucccgauccucuuuuaaaguuuuucuguugauuauuauuaaaauuuuauaaaacuaacuuaaaccucauucuuggccaucaguuuuagacaguuucucuugauuucucaagauuugaaaugagagcuuuagagcccuuuauauuucuuuuuaccucacagcuguuacccaccaguuacuuccagcuuguauauagguauguucacuuacacaucuuucuuucacuuaauugaauccuuuauuuuugucuuagaaucuucugaauauugaaaacagagaacuauacuggaagaacauaguguauuaagacucauggagagggagaugugauacugugucacugaggucguuccagucauaggagaaauguuaccacuggauugaggucugguacauuuuaaaagaugauuuaauucuaugauauguguucaacuugcacuaggauaguuuuuacuuucaccuuuguuccaugcaccgcgcaaauaccugggaacccuuguugcccaacucaagagccagaguccucugucaucauuuugccucucuccuaagugacaggacugagugcagacuugguguuugugggugaggcauguggacugacaggcaggcuucaguuuauuuagcgagugugagcccuggcaggaagauucucuuucucugcuugccagguugaggaggccucauuaagcaguuugaacuugugguuuuggcgugucuaguccuggugcagguggcuugguauccucacaggcauuucuuuggccucacccuuggggugacuguucacuuguguuugagcggcugggacucaguagguucacuggaguagguauuucuuuagagccacuggcggaggcugaucaugcggcagauaguuguuuaguaucaagccagucucuccccuucuuucuacuccaguuuuucuuuaccacccagaauggcaucugccacuucugcucugguuccuagaucuuuuugacauuccuuaaauuauugguauuaucccaguugccuuuucuugcagaaaacugacaaaaucuuugguucacugguaugucuccaucccaugcuuuauuuuauuuagugaucuuucacugcuuguuucuauggaugauauagaggaauauagaggauaagaacaauauguuuacucuauccaguguucuagauuuucuuguuagaagcacccuccuucccagcuugggaaaacugagcugcugggguggcuguuggcuccuucgcuugcuguuaguuuuaaaggauuguuuucagucacacuugaauuguagcuauccuugguucucuuuuuaccaaugaauucugguaguauguuuuaagagcuggguggccuuccuggccuuuguaaacauuuccugcaaugccuagcuuuagugagcugcgaaguugcccauuggagaugaggcucuauugaaagucagcaccuguacuucacucccugccuuuugugacuuuggguuucgaccggguguuuggaagcacuguuucuucuguccuugaccuuguuccacauguuuuacccauuaccuccugugagcaggcacagggccuuuccuugucaccugggcuucagcugcuuugaggaugacuacuuaccccuugcaguagcuucccaccaagguucuugaaagggaaguuuucauaauguucauuuuuuuaaaaaguuagaccagcuauacccccuaaacuuaagucugcuuguuuucauaugacguagaaauugauacaaaaauacuuuauguaguuuguauagauguaguugcuuaagaaagaugacacuuacuguacuauuuuguugucuugauaaguacaguacaaaaaccaguuuuuaaacccuaaaguuaauuugcaagaaauugauacaaaaauacuuuauguaguuuguauagaugaaguugcuaagaaaggugacacuuacuguacuauuuuguugucuggauaaguacaguacaaaaaccaguuuuuaaacccuaaaguuaauuugcaagaaucuuuuuguuuugacaauauacuauuauaacuuuuagcugaauaaaaucuuaagucaacuuuuauguuuucaugauaccuaaaugagggagcaaaaguauauuuaguauaugacaguauacugucauauacuacugaauuuucauaagguucuaggagccuuuuuuuuuguucugggaaagggagggaggaagaggauggcacuguuacccaaaugugaguuaguugauucagaagaguaaagaauaguccaauaguccaguaguuaaaaauuuaugucuguaauccagauuuaaauaccaguuuaucuucuagcuuuauaaacagucuuaaugagaaguaggggacaaaaaagaagcaggauugcccuuagguuagagaauagaaauaucuacuuggcuuaacguuuuuaugaaagauguccagcaaaacugugguggcagccucacuuuagagaaugagguauuaaaaacuugaccaagguagucaugccagacuuuugaauauuuuuccaaauaagauggcuucaaauugaaaaauuuuauccacuugauauuuuucaaaacuauaaagcuguguucuauuucuaccuaaaauauaaaauuguuaguaugguaugauuugucauuugagaugaucuuggcuaauacauuacugggcauaauaauggcuauuacacauugagaggauagaggcuguuuccgugucucaagcaucauuaacugcagauaaaaaaaaguuaacaguuauucuaaaaauauuucuuauaggggagaaaauguaaucaguauauuguauguuuuagucuggugugguggugcaagcuuguaaucccagcuacucaggaggcugaggcaggagaauagcuugaacccaggaggcggaaguugcagugagccgagaucgcgccauugcacuccagccugggcaaaagagcaaaacuccaucuaaaaaaaaaaaaaaaaguuaaugauuaauuguauacuuagaaaacuuacuuucuuuacuaggaauucuaaauauauauauauauauauauauguaaugaagauuuuaguuuaguaaguuaacuauuuuaaaacauguuuaauguuuaauuucugauucuaaaaguaguacuuuuugguacuuuccuaaacuccauaauuuaaguaacuuuaaaaagaacugaugcuaagcuaaacauuuaaauugaggauuaucccagagcaucugucacuaggcagaugauguuuccuuaugucucuaguccccaaaggaaaguaggagugccaaguuuuuaauauuugucccuuucaagaaggggaaaguuuugugauacaaaaaauguuuaagagguggaccaggaaacagucccuugacauggaaaaugcccaggcugaguuaggauugcuuuaucuauauggagggaauaagaaccugggagaacaaaccaaaauauuaaagauucaugaguaagaguaugaaugaaauuggcuuuaaaaucuuucccuuuuauuucucucuuaccuuuauccuucggaauuaaaggaggcuaaugcagguuccaaguaguucaaaaauguaccaaaaguugugaaguuuaaagggcugagauugagucuuucagggaauggauuaaauacuuugguuucgacagugauuuucaaaccugucuuaagccuugacucguaguguguagaugauaguaucgugaaugauccugagcuaaucucaugaaagcuuacauuuaaacaaauuuucauauggacaagaaaccaagagacauugaugugugacuaaaauauugauuauucauggauucugcgagagcuuugcuuuuuaucugugggaucuuacgcauuauguuucuaaaaauauaguuucuuuguuucuaggauggggggguuaauauuagauuauuuuuaaguuuccuucuaguuuuagaguuauugauccuuuuucugacuuuuagaaccugacuuuuccagucuugguuucauuggacuuuaacggguuccagaauuccugaguagagagaacaugggaagaaauuaagggacaggugugggugaugggugcuuagagaugguggaaaaguggcuucaggagaagagaaauuguaguguuagggauaggaccagcaugcucuucucuuggaaucugaugcuugaaaucuacucugucuuaaugaaauauacuuuacaaaugcuagacgucuuucuggagacguuuauagacacucuauggaaaaauaucuaaaaaucaugaaauuuuucaugauguggaaugaaucuguacucuauuuaggaggagauaauugcuaggcuaggugggacaaguugaucuauuuuaaaauaaaauuguaucuuuuauaaggcacaaaugggaacugugucuccuugacauguuucaaagcauuucucugaauaugugagauuaaagaaacucucaaccacucagaauugucagaacacugauguucuuuaaaacuaucuuuguagcuguuaguauguacugacacaguugaaguuuuuaauguuuuauucauuauuagacauuuugcauaugaauguaaugucuuuuauuuacaguuacaucuuaacugaacuugguucccagauaugaguauuauuuacuuggucucagucuucauauuuuaagcucuauagguuaauacuuaauuggguuuuauuuuaaaauuauuuuugaagcuauauauuaaaguuugucguaauaaaccaaauguuaguuuuccuccaccugggaauacuugagacuucagugagccacgcuuucuguuaugcccaccucuuuagucuuuccauuauagaauaaacaugcuuugugugauuucucuaaaauguaauguuugagaaucuauuuuaauguauagaaagacauuuacauaaugcuuuugaguagguggggaaaaaaguugaaauguugauggcagcaucuguuagaaaaacucacaugucuauauaguaaaaaguuaaaauuacaacaaaugcacuacuuuaacuguguucugcauguuauuccaugggaucgccuuuggaguaaaguagaauauguuucuagucuuuuauaguugguguuaauuuuguucuaaacgugaaaguguuaacagcaaguugaaaaugugacaaagcucaauuucauuucuuguuuauugcuuguuuuccuauuggacaauuggaaguagcuuugcccuggcaacuaaaauaggcuauuugcauaaccuaguuugauuggcuagcauccugacuaacaguuccaaucauauggugucgguuuagugguaggcuaugcuaauuagccgcuguugcugggguucagggaugguuucugugugcuguucugcugcauuguguugccuggugagagacauugauaaaugagcguuuaaugaucugcagcaguucccacucacugcgggcaggcggauuuuagaacagaaguggaaauaaggcuuuaauugcucuguuaaauaacuguaaccaaaauauguguauuacauuuuagaaauuaaguuguaugaaaucuuaaauacuucauaacacaaaaggaaaauacuuuagcuuugucucuuaaaauauaacucagguagcagcacuaugcacagguuuccuaaaacugugaaacugaucauuuuuuucagaucagaaacaguacccuuguaguaaguagcaugcuugauuuuucuuaugacuuugaccuuuuauaaagauacacguuuguauuuaauaaaauguugcaagcuuuugggcagaauuuaucuuguacugccuguguagucuagcaaauaagagcauaaacuugaauucccuguucuucuucuguugaauuugaagaucagguuguuauucacuaccuccugcuauuacuuuucuaauugaagucagauguuuuaacuguugcuuguaccguuauguugguguaugugaagucuuuauugguacugucagaugguagguucugcagaaaaaaaaaucaguucuuuguuuaaggaacaugaggugaagaauaaauacaugugacguuagauuaaaaauucaagaugaccauauggaaaagugcuguaaggauuuaucuggaaggguauaggggaaaaaauucuaggccuuuuuaugauagggacaugggaaauggauugagagucugggaaaggguuaaagaggaagcccauagaauuuguguuaagguuuuaaauaucacuuagguuucaaacagcuagagaguaauaagaagaaagagcauuuuagggugaggaauaggugagcaaaaguaauguuucugguauucaguugucaaauguaaguggucacagugaucaaggacuccggggccuuaggugugucagugccccagcuuccaggcaggcuugugucauucccuugaaauaagaccuggugucuuacuguuccagcuagcaccauuucuggcuuuuugucacuugguuuuguuggaagcagggcuguccacuuuuugugucugaugguuaaagcauaggacucuuuugccuucuuuugucccucccauuggcccuaaagcauugaaacacggaugccaaaaauaauucaugugaauuuagauguuuguauuaaauuuucuguaaaguguaucccuuuaauuguucuggccuuuauuuaagagcauaguaaaauuagacaagcuaacuggacaaucuuacagacuaguaaagaaugaaaaccaacauuaaaccauaacauuugauucuuaaucacacguccccaggcauauauacugaacauguauucuaaaauaaauuuacagaaaugcuuuauucaaccagucagaggggaccuagauacagaauuuauaauuuaacagagguggauaugucuuuacauaacuauaugacaugguggaguauggaguauccaugcuguaagagagguggaaauucagaagagggagaaauuuuuggauugggacuaggaaaagauucuuggcgaaaaugguauuucauauggucuugaggaaugggcaguauuuuaacaggugauguuugaaggcuacaggguguggaagaugcuauaccaguugaagaugggggccuguucgaaaauugcauuuacuaagguagaugguagaggagacuauguuguugagggcccuaagugguggauaguauagacuuugaaguuuuucuuguaaaaagugggggauuuuugaauuuuuuacagcagugguucacaauguguuuuuuaaaaacacaugcccuccaugaauguuugcaaguuucaaaauagacauuucuuugauuuuuaaaauaugaaaaugugguauugaguaauuucaagggguuuuugaguugccaucaucuaaaacgagauauguuguaggagaagcagauuuuuuuguggaguggagggaagggauugauuguacuuagagucagguuuugaauggguuaaaaguuuuuaaaacagcuuuauuguguuauaauuggccuacaguaaacuucacauaauugaaaguauacaauuugauggauuuugacaaguauuacuugugaaacuuuuaccacaagucagauaaugaagauuuauuacuucacuuguuccagaauuuuauauaaacaggauuauauguguucuuuuugccugguuuuaguucuuuugagagucauauguguugugauaccuaucaguaguucacuguuuuuauugcugaguaguauuucauuguguguauauacuuugguuuauccacuuaccuguugaagcacauuuggguuguuuccaguuuuugucuauuacaaauaaagaugcuaugaauauuguuguacaacuuuuuguauggacauauguuuuuauuucucuuuauuuccuaacauuggagugacucaaucaugugguggguauaugccuaacuuuuaaagaaacugcuaaaugguuuuacaaaguaguuguaccguuuuacauuuucaccagcaguucaggagaguuucaguugcuucacauuuugccauauuugguggucagccuuuuuaauuuuagccauucuaauacuuggguagugauaucucauuguguuucucugugauuaauguuguugagcaucuuuguauguacuuuuuugcccccuguaugucguguuuggugaaguguuuguucaaaucuuuugucauucuuuuuucgguuauugagcuuuuagaguuucuuauacauuugauacaaauccuuuaucaaauacaugauuugcuaagcuuuucuccuaguccauggcuugucuuuuuauucucuuuaaaagugucuugaagaucugauguuuucaauuuuuaugaagccuaauuuauucauuuguucuuuuaugaaagcugcuuuuggaaaguuuuugcauaauugucccaugaucaaaaacguuuuugccuauguuuguuguuguuuuuuuccccacuagauuuuacaguuuuagguuuuauauuuaagucugugguccauuuggaguuaauguuuguuaauagugugcugcaaaguauagaucaaagaucacuuuuuuuugcaaauggauauucauuuauuguagaaccauuugucaaaaggacuguccuuucuccacugaauugccuuugcaccuuugucaaaaaucagucuuccauauaugugugggucuguuuguggauuuuccauucuguuccauuaaucuauuuguccugauaccaauaccauauuguguugaccuucuguggccuuaauaauaauuaaugcaaucagguagucuuaauucuacaacuuuccucuuauucaaaguuuuuauaacuacucuaggucuuuugcauuuucauaugaauuuucaaaucaguucgcuaauuucuucaauaaaguuugcuaggauguugauugggguuguguugaauauauagauaauuucagaagaauugauacuuuaacuguauugauuuuuggacccgugcacauauaucuauuuagcccuuucucucauuuuucuaauuuucaguaugcaguuuuuucauguauuuugucagguuuaugccuaaguauuucauauuuuugucacuauuuuaaauggcuuuuaaauuucaguuucugauauauaguuacaguacuagcacauagaaauacaauugauauaaauauauccuuguauucugugaccuugcuaaaaucacuuaauaaugcagcuuuuugguagguuccaucacauuuucuaucuagauaaucacauuuccuaugaugagagacaauuuuucugcuuuccaguuugguuaccuuguauguauuucuuuuucuugccguucuacauuggcuccaaccucuauggaauguggaauauauauggaacauagacuacaauguugaauagaaguagugaaagaggacauucuguuuuguucuuuauguuagaggaucaaacaguauguuagcuguagaguuuuuuugucaguguccuuuaucacaaggguccccaaccccugguacugucugaggccuguuaggaacugggccgcacagcaggaggugccgagcacuaccaccugagcucugccucuuuucacgucaccugaagcauuagacucgcauagacaugcacaugcaagggauccagguugcgugcuucuuaugagagucuaaugccugaugaucugagguagaacaguuuuucauucugaaaccauaucuccccccauggaaaaacuguccuccaugaaaccagucccuggugccaaaaaguuugggggaccgcugcuuuaucagauugggaaagauaccuucuauuucuaguuaaugaaaguuuguuuuaggucaaguauggauguuggauuugucaaauguuuuuucugcaucucccgagauuaccacaugguuuuuauuuuuuaguuaauuugaugaauuguacugauugauuucuuaauguuaaacugauaauaguguuugcugaaauaaaggucacuuuguuaugauggucuuuauuuugauuguuugauucaaauaguuacaauuuuguuuagaauuuuuauaucuuauguucaugaaagauauugggguuuuauugauuucuguuuuucuguuuuguugauuucuacucuggauccuuauuuuuguuauuccguugacuuugauuuuguuugcuccuuuuuuuuuuuuuuuuuuuuuuugagacggaguuucacucuguuucccaggcuggagugcaguggugugaucucgguucacugcaaccuccgcccccuggguucaagugauucuccugccucagccuccugaguagcugggacuacaguugugugccacuacgucuggcuaauuuuuuguauuuuuaguagagacaggguuucaccaugcugaucaggcuggucucgaacuccugaccucaagugauccgccugccucagccuuccaaaguguugggauuacaggcgugagccacugcgcccagcuucauuugcucuuuuucuaguguauuaagguaaaaagcagaagccauugauuuaagaacucuuuuccuuucuaauagagaugauuaaugcuauaauauucuccguaacuauugucuuagcuguaucaaaaauuuugauauauuuuauuuucauucuuuucagaaugcuuuauaauuugcuguuugcuuucuuccuugaguugugguuauuuaggacuauuuuguuuugaguuaugguuucuuccuugaguugugguuauuuaggacuauuuuguuuuacuuacaugguucuguuacuuuauucugauuuaguuugucaccagagaacguauuuugaauaacucgauuuccuuuaauuuauuaggguuuguuuuguaccccauaauguugucuaucuugguuaaaguugcuuugucccuagaaaagaauguauauucugcuguucuuugguagaauauucucuaaauguuaauuaggucaacuuggucgguaguguugaucagaucuuguauaucuuuauugauuuucucuccacuuguucuaucaaauauugagagacggauauugaaaucucuuaauauaauugugucuaucguuguaguuuuaucauuuuuuuuggucuguguguuuuaaagcucuguuaauagguucauagauguucaggauuuaguauguucucuuggugauuugacacuuuuaucauuggaaaauaacuuucaucucgugauauucuucagacugcagcauacuuucuuugauaauauagccauucugucuuaauuuugauagcaugauauaucuuuucccagauguuuacuuuuaaucuauuaaugucuuuguauuagaaauuuauuucuuacagacacauauaguugacuugcuuuucuuguuguuccuggucugaaaucucugcuucucauuugagguauuuagaucauuuguguuuaaugugauuauugguauguuuugguuuaaaucugucauccugcuauuuauuuccuauuuguguugucuguuuuuccccuuuccucuuuuucuccuaccgucuuuuauucugcuuuuggauugauugaaauuuuuaaaugauuugauuuucuuccuuuuauugguuuauucauuuuaaccuuguuuuuuaaauuuagugguuucucuuuaucuuaucacagucuacuuccaaaggauauuagaucacuucacguauaguguauugaccauaccauaguauucuucuauuucucuacuacuguccuuuuuacugacuuuaaaauagauuuuguuugugcauauguuauuaaccuuacacuacauuacuauuauuguuuaaacacuuagauuuaaauaagaauuccuguauucuuauccauuucguuaucuuuucuggucuucauuccuuuguauagguccauauuuccaucuaguuucauuuuccuucauccugaguauuucuauuaacauuuuuuguagugcguauuuacuaaugauguauucuuucaccuuuuagguaucugaaaaugccuuuauuuugcuguuuuuuuuuuuuuugacagauauuuucaguggguauggaacucuaaaugacacuuuuuucuuucaguaauuuaaaaauguugcugcaccaucugcucucucgcauuguuucuuacagaaaaucuucuuuauucauuuguauauaauaugucucuuuuucuggccguuuuuaagauuuuucuguuuaucauugguuuuuagcaguuugauaauuacguaccuuaguuuaguuuucuuuguguuucuugugcuugugguuuguugaacuuuuagaucuauggguuuguaguuuuuaucagauuuggaagauuuuugaccauuaguuuuucaaaauuuuuggguucuccucucugucaggaacuuuaguuacauguauauuauuagggugcuugagauugucccagaacucagugaaugucuguuaacuuuuuaaaaucucuucuguuuugacauccaauuucaguuguugaguacucauuuggaauucugagguaguuuuuauugcugugucuucaaggucacuaguccuuuuuucuguacuaucuaaccuuuuauuaguuuuacccuuuguguuuuuuaucauucacauuguaguuuuuauuuccauuucuauuucaucaucuccuccucuucuuucuuuuuuuaaaauagagacagggucuuccuaugucucuguuugcuaugacgggcuggauuugaauuccuggccucaagugauauuccugucccagccucccaaagugcugggauuauaggugugagccagcaugccugaacuguaguuuucauuucuaguucaauuugggugucuuaaaaauauuuuccaugacaucccuuagauauuugaauacauggaguacaguuauaguaccuguuucuguuuuuuguuuugagacagggucucacucugucacccagccuggagugcaguggugcuuuuguagcucacuggggccucauacuccagggcucaaggaaucuucuccugccucaggcuucugaguagcugggaccuacaggcaugcacuaccaagcccagcuaauuuuuaaauuuguaguagaaacgaagucucuugguguugcccaggcuggucucaagggagccuccugccuuggccucucaaagugcugagauuacaggugugagccacuguccgcaaccauagaccaggguaggagaugucuuuuuuuuuccccuuucuuuuagagacagggucuugcucuggggcccaggcugaagugcauuggugcaaucauaacuuacugcaaccuucaacuccucaagagauccuccugcuucagccucccaaagcacugggauuacagauugagccaccgcuccuggccaguaccuguuuggguccauuucuguuaauucuaacagcuguaucaauuccugauugguuuccauugauugauuucccccacccguauggguugugucuuucugcuuuugugcguaccuggacauuuuuuauuguguaccagccauugugaauuuucacuuugucgggugccgaguauuuuuguauuucuucuguaaguuuucuuggcuuuuguucuggaacagucggguuacuuagaaauaguuugaucuuugagucuuacuucugagauuuuuuaggugggaccagugcaguguuuaaugauaauuauucuucacaaaugggagcaguguaguccuguguaguuuauccaaugcucggugaguaucgauguuucccauucugguuggugugggaagcuucugguaguuugcuggcaaucuugggcauuccuuggcuucugcugcauuacgccuaucuuugccuucuuucucacacgguggucuuccugugugugugucugucucugucuaaauuucuccauuuuauaauaacaccagucauauugcauuagugccuacccugaugaccucaucuuaacuaauuaugugugcagcaaagcuuuuuuccaaagaugguaacauucugagguacugggguuaggauuugagcauagaauuuugaggggacacaaguugaccuguaacguugccccuggaauguuuccugaauauacuucugugcucuuaggguguuacacaccuccuucucucagcuugguaugcccccguuccuuucuucugcuucucuuucuuaaaagccaccugcugaugagaaccucuguuuagaagguuuaucagauuguaccuuuuauuauaaauauuuacauggcauauuucugcacauaaaacauuuuugaagaccuggagaggauuugucccacuucuuucacugucucccaguaccaccuguaguacuuuauaacuagugauuacccgaauugaauacguuaaugaguaugucugaacagacaaguugcagaauggacauuuuaagaaagaucaguaacugcaggaaggauuggaggcuuaggcaucuggagugaggaauucauuuuggagauuauuauaguaagucaggcacgcauuaauuuauuaauugagccuacuaaguacggaagccuucacuggguaucagguguagaccugugacaauuucagaauuugccucuguccccauggaccuuacuguguguggggagucaugagguaagaacagaaaagauggacaagaaggguuuuccugaggaacccuagacaaaccuugagaaugauuagucaugggugaggaugaagcaucgaaaaacaugaugccaagccugggugcaugagagaggaccguuaguagaaaugagaagucaggcauuugguggguaggggaugauaaauuaguuugcuucuagauaagaugaguagaacaucuaaguagaaaauccagauugcagaaaacucacaguugaaugguggagugguagauguucuugcuuggguauaaagggagagagagcaccagcaguuaguugggugaaggggcugacagucaagagcagagauuuuucuggguaggugcuacaccgaacauauuuguaggaagaggggaagugacuggggcacugggaggugacaugcaauuauuuccauuuuacaaaugagaaaacugggacaccuaaaaguuaagaaaggugccccagggacacagcuaguaagugguggagccagaauggaaaucugggcaggauggcggcagaaucugugcuccuaggcacaggauggugcuucugauaguuuucuuuaaaucuauuaacuuuuuaauauguuaguuugcuuucauagggaauuaauacuauaaaguuagaacaccagcccugcuugucacuuacagaaggcaagaguaaacacgaauauagggaaagcagaauaauucaacaaaacagaaugcacaccggaaaguaauggaacuauuugugaucaguuaguaacuaagggguguuuucuguuagaugccaggagguuuaagaugaugaggaauguuucggaaaauaagcaacaaguauuugagcauuuacugugccaagcauuucauguuggugcgggggaugaaguagugacuaagacagagucccugcuuuuguggagcucguuuuguaauggagagagauacacaguaaacaucugaacaaauagaguuggggaagaugcaguuuuugcugggaagaucagggauagucuuuccaugggagugcuuuuuuucuauuucauuugguuuauuucaaaugagcaaauacaucugugggguagucugguuuauagaagugcccaucagucaugcagaucucuuguaucaugaacagugugacauuuuuuccccauuggaguacaguaguaacaguuuuuccauaucaaagcccagcacccucuauauaaaagaguagucauuuguaaucagaugccaagaaaaaguugggaauuuuagcacccuguccuuaaccaauauuagcagucuuaacauucuuacuggcagggcacaguggcuuaugccuguaaucccagcacuuugggagguugaggugggaguauugcuugaggaguucgagaccacccugggcagccuagugagacccucaucuguauuuuaaaauaaaaaaacaacauucuuacuguaauugaugugggaggaagagcaucccugcuucuaaaacgguaaaucaguguugcuaccagaguaucuuaggcguuaagaagugaacgcagugaugugcaggaaaauguauuggaaaauccuuguuagugacccacaccugcuguccuuguugcucugaagaacaugcuacaacugcaaguuugaaaaaguuuuccugagcauugggccucucaacgcucucauuuugcauguaauggauuacauugcugucuuauuuuagccaucuccuaagaaguauuagcucugaaaacauauuugcuuuuuuucuagaaugcauugaacuaaaugcauuacuauuaagauaaauacuguaguggaugcaacucuuaaaaaagcuaacaaguugcauuuucaagaaauucaaaaugaaaauggccuacuaaggucuguggggaaaacuuuuagaaaaucauuuaaauugauuuucccuauuuaauaaaguaguuaaugggaaaauucacauggcuuuccagcuauuaaaauauuccuauccugacauuugagaaucuacaauguauaggcagguuugaaauucuuuuuuuuuuuuuuaauuugagugguguuucagaguuuacaagugugcucacacguguuaccucacgugaaccucacagagaugucagaguggcuuaucaucccaacuuuacaguaauggcagaugagccuuggaaaaggucagggucacacagugaguuaguagaucugaggcuaaaauggacuuuucuguuuaucauauuguuuacugaaugccuguaauaugccuuagguacgcaagagaucuuguucugcgccccaccuuguggcgguggaagcacacaggucaggccagaggaggaguucugcuccuuuugugcucccucugugauuugggagcaugcaguucuucauaagaauccccacucuccugauuguuacuagucuugccaccauuccucauugcuaccacuuguccccugugugagagggauggguugggaggggaagagagggcacuuaacaucugauuacagaggcagagcuuuauguguaauaaaugcucuacucuccuaacaggagaacuugcuucuuuuauauccccuuccucccugucaaucuaugauuggaucucaggaggugaguugagugagacaguguuuucucugagggccuuguuuccugcucauucacuaaagauuugucagugaaugaagcagcacuuccacccucaggaucuuauguuauaguuggggggaaagugacaaugacacaccccauguaacuuauaaauaaauauauuuuaugauacuaauauauaaguguacauauauauacacauuuuuauaugugaacauacauuaaaaaaacauaauuucagaaugccucacacgaaucuugcugccacucaagccuuuaagaccuaaagucugcuuaccucuuuuuguaaauaaaguuuuauuggaauauagcccuacucauugguuuauguauuauaucuguggcugcuuuugugcuacaugggaagaguuuugauuaauugcaacagaagcuucaucuuccgcaaagccuaaaacauucacacucuggccccuuaagagaaagcuugcugaccccugcucaggauguagcaagcauuguacucacggcauuauacucacggccauggugcagcugcagacuuagaaaagaaggcuugaguuggcgagcugauggacauggcagguggguggaacuuagcaguggaguggguaguuucuagccucuaggugugggaucacugugcuaagucaggaaguguggcuaaucuuugcuuagagguggggaacuugugcuuuuaagaaagcacuugguguuuucuaguaaaugugaauuguggcgauuaaaaaaauuguauauuaaaauucggaauuaacaaguuuauguaaauuagaaagugagaguugccgcuguccccucaauucccacucuucaagguguuaagagcuguuaagagauggaguuuuucccccucugaguauuaacuucuacuuaguaauuuaaaaaucugcuauauuuuagaccaucuuuuuuuacauugugacccugagguucacuugauucccaaaauguagucgggauuguucaguugaguguuuguuacauagaagauuaacguguaaaauauuucagaagagauuuuaauagacaucucccugucaguugaugaguugacauuguuuuucuaaauaguuuuagaauuaggcuuuuuaugacaaguauuaaagcacuuuguacuguauuacugguauuuuaaauuuuuacaauuuuuuuuaaaaacucuuguucugguggagggucccauaaucagagucaccugagaaacuucagaacaaugcuggugccugguccccauuucaggccuagcaaguccaaaacucuagaggucaggagaucaucuacauuuguaaaagcucugcaagugagcuauggaguagauaacacuuuuuauaacauaacuuuguuuuuauaauaauuugugggaaaauaggaagguuuaacaugaaauauuauagguaugauuuauauuucuaguacaggucaugauuuaugcugaaaaaacuuguauauuuuauuuaaacucaaauauugagcaaaggagggaaauauauauaaaacaaguauuuaaaauuuuuuuuguuuguuuuugaggcagagucuuacucuguugccaggcugucaggcuggagugcaguggcacaauuacggagcacugcagccucaaccuccugggccuaagugauccucccaucucagccuccuaaguagcugggacuauaggcacaugccaccaugccuggcuaauuuaaaaauuuuuuuguggagaugagguuucgcuauguuguccaggcuggucuugaacuccugagccgaagcaaucugccugccuuagccucccaaaauguugggauuacaggugugagccaccaugcguggaccuaggaauuacguaauuugauuugaagagucauaucauuuuuccccugcuuuacuuuuguaccucuucuccaagaaaaaagucuacucucucaaaaaccgaaaacacauuucuuaacuucugggagguaguuuuguuuguauuaguucaaguccauacuggaauacguuugaccaguguuuucaagcugagaaaugacauuuaauuauuuguuaucauuucuagguagauaguaauuucuguauuuacuaagguaagcuaacugguuuaacgaacacaccuaauauuucagugguuuaaaucaguagaauuucuugccauauaauaguccaaugacuguuaguacaaugggauaacagcucugcucugcaguuauucaggcucugaacuaugggcauuuuuccuauuuuaaauuuaauaguguccaaaggucauccuagguuuuggcauuuguugaaugggggaagagcauggagguuuucacacgcaauuuuuaugggucagacgugguaguggcacacaucacuucuguugacauuucauuggcuuggucuuagucacguggccaugcuaacugcaagggaggcuggaaauguagucuaguugacucagggaaaaaaaugccuuugguuaucaauuagcagucucuuucguguggucaagguaaacaacaucagcaagacauugacuucucugugagcuaccuaauuauuucguuuuugcuuuuccuuuucucauuuucccauguuuuugcaauuacucuccacuuuuccccauaaauauccuguuuuugaggugauggcccgcauucuucauuuacuuucaagucuagucaagucaagucucuuggaugcagacaacagaaacccauuccuggccaaguugggcagaaaacaaauguaauggaaggcuauauguuaacccauagaauuaauugaaagcuggaaacuaugcuggaaaaauaaguaggggccaaagcagguggcagcagaggacacagccagggucgcagcagaagaccagucugcuucggaucccacaccuggcacuugugcaaugcauugcuaugugagccucaacuuuccugccuccacuguggauagucucuuacugucccuacaucuugcaggagugacccaucaagacuccagagucugaacaggagcaugugauugucaaaacuuuggucacuagcaaagcccugguuaccagggagguaagguaggagauuuguuaguuugguuuuuauacuugguggcauggcuuuuuugccuuccaugauucucaugaacugugaagaguguucagauaccaaauggccuaaaaaugacaaauaccuaugugggaaccuuuuucaucaggagaaauaaguugugguauaagaugggaggcuguguuccaaucuugauuuuuaucacguuguuaagccucuggguugcagccgcccccucuguaaagugaggugggggaacuagaugucugacagugucuguucauuuacucacucauugaauaaauauuuaguaagugccuuuuaugugccaacacaaaagaauuaucacacccuugccuuccuauauuugggugagucagcagagaagucauucugauacaguuagggugaagugcucagauacucuagccuugggcagggguuuaggagcucgugagaguucccaggccagccugggcagagaguguuggaguaggggauucagggaccacacuccgcuucuuucacucauucguuuaguguuuccuuuaagccuuugccuuguuguuaugagaauacaaaaauaaauaagaccaguacuucccuccaaagcacuaauugugagagcaugcugauggcuuuagcaggcagcaugcuugcuguguugagauaagagcagaauacagucaugcaccaaauaacauuucaguguuggacugcauauacgacaguauuccccuaagacuguaaugaagcuacaaaaauccuaucaccuagugaugucuugcgauccuuacccaaggaggucuuggcuuacguguauguguaucuuaauuuuugagaaaaauguuuaaaaaguaaaaaguuaaaaaaaugaaagcuuacagaauaagaauguaaagaaagaaaacauuuuuguacaguugugcaguguuuuaagcuguuauuacaaaagaauccaaaaguuaaaaaaagauuaaaaaguuauauaaaguaggcuaaaguuaauuuauuacugaagaaaacaaguuuuaaaauaaauuaguguagcuuaaauguacaaugucuauaaagucgaccguaguagacgguuuaauguccuaggccuuugcauucauucacucaucucucuuccucuccgucccuccaucccucccucccuccaucccucccccacccauugcaacuuccaguccugcaagcuccauuccuguaaacgcccacacaagugaucuuuuauaucauauuuuuauuguaccuuuuccaugccuauagcacaaauaaugaggguuacaguugcccucauuauucagcacggcugaacagguuugcagccuaagagcaguaggcucuaccgucuagcgugggcgugcaguaggcuccaccgucuagcgugggcgugcaguaggcuccaccgucuagcgugggcgugcaguaggcuccaccgucuagcgugggcgugcaguaggcuccacugucuagcgugggcgugcaguguauacucagugauguucucacaaccaugaaaucgccugacagugaauuucuuagaacauauccucaugguuaggugacagguaaguguucugagggaagaauggaguaggggaccaguucccuguaagauucugagaacguuucuuagcaugacauuugauccugggucuugaaguuugaguugaagacuucuaggaggagaaaauaggagggcggggauagcaugcuaguuggagagaagaguugcugaagagaagagcgaagagcugcugaagagcaccauugaagaauggugagaaggucggugcaguuaagggaaaggaugucauggaggggacaggauggagagaaauggugggaaauaagacgagagguguaaacacuuaaccuggguacucuggguauuuaaaguauugugaaguauugauuuugagcuuuuuuuuuuuuugguuguggacaugaacuuugacagcaguagggggaauacacugagggagggcauggagccuggauaaggagcaguuauuguaggggauuccccuggccccuuucuggauuaagaucuugacagagcauggaaauaagcagcuggauucaugagacauuccagaggccaaagucacagaauguaguuagauugagggggauugagguaaaggggguggggagguggaaguaagagagcgaauaagauugagguuucuagcuugaguggauggauggguggagaugccguuuauagaacugggucaaacuuggcgcuacugccugcuccccagccugugcagacacaguuaaauauagcaugccgugcuuuccagcugaggcuugaguuagcuuuggaaucuuuucuauagcagugagugcuccagacagccacugccaaucuauuugaguuuguacuggagaggaaaccuauuugccuucccugucauaggagauggggaggggaagggaaggggagcagggagaggaaucccacccacacuagucccucuuuucccugcgcucuuuucuucagaacacaucauuuucugaucucacacucccguuuuuuuuuuuuuuuuuuuugcuugaggauucuucugugcccagcaaaauacaaacuccaggaggccugagauuuggcccauaauuuuugcauuuaugccuuuaauguuaagagcguugucuggaacagcacugccaauagaaauguaagccacuuauguaauuuaaauuuuucuaggagccacauuuuuaaaaaaguaaaaagaggccuggagugguggcuuacgccuauaaucccagcauuuugggagggcaaggcagguggacugcuugaggccaggaguuccaaggcugcagugagcuaugcuugcaccauugcacuccagccugggugacgagggagagacccugucucuuuaaaaagaaaaaaguacaaagcaacaguaaaauuaaacuuaaauauauuuuaauuuaccugguguuuccaaaaccuauuauuucaauuuauaauaaaaaaaauugagguauuuuacauuuuauguugcuaaguccuuaaucuuguuuuuuccauuuauagcacaucuuaauucuuuguagcuacauuucaaguauucaguagccacauaugacuauuguugacugcauuggacggugcaagucuagaauauaguaggggcucaguagauguuuguugaaugaaugaaggagaggaagaugaguugguuguuaaagguugauuguagaaucgaggaaggguuuuguucucacagugaggcaggagcauauuuuuauguuuaagacagagcugggagagagagaggcggagauaacagaagucagcacgugacugauggaggaaagcccgagcagguguuugguccaggggucugcagccagguagaugggaggagagaugccuugcuaguuacuucccugaaggauaaucuucaguuacauuuuaagagacuuaacuccaguuuguuuggcauaaacuucucauugaaauguauuauaacucuuccuuccccacauuuuaggugcugguuaguugagggucauuuuuaaagucuuaagguguuucccuagugacuuaacaaaagaaaggaaaauaaaagccucuuuuuuuacguacaaaauaggaaaagucuuauugguguaucucaacaucuuuacuuugguaucacucagcuagaaaaauaaguacuuucuauacuaaaaauugauuuacugaaucugauuuuuagcauuauuauauuuggaguuguauaaauuauauauuuugcagucaauauaaaauaagguuauuuuccccacuguugucccucagucuuuacauacuugaguccucaaucuccuacauugucuuucauauuaugagauguagucuccuuuuuuuuuuuuuuuuuuuuuuuuugagacaaggucucacuguguugcccaggcuguagugcaguagugugaucacagcucacugcagccucgaccuccugggcucaaacgauucuccuaccucagccugccaaauagcugggacuauaggcgugcgcuaccaugccuggcugauuuuuaacguuuuuguagagaugggaucucucuguguugcucagguuggucuuuuaacuccugggcucaaaccauccuucugccucggccucccaaagugccggauuguaaguguaagccaccguaccugaucuccauuacuuugaguaacaaagucuuauuugagguugacacauagacauggagcaaccucugucaauaguaguuuuggaugcuuauggaggucacuugauggaaugagucuaaaaagugaagcaaugaaauguaacagauuuuuuagguuaugaccucacauuuucagguaaugauauucuaaaucuuucaaaaaaucauuuuaaaaaguauuguuguaagugaaaauaauuaauguaccuauuggguuaauggaaaacaccaccuuucugauguuaaaaaauuuuaucucauuguuacuugagauaaaauauccaguuauaguauuuuacagggauucaguaaguguuguaucuaaaacaacuuagaaguuaagauuaugugcugcggaaaaccagaugacuuaaagaggauuuaaugacgacaaagaugcugauguuaaagauggaguaggcuuuccacuauauugagaagggcaccuuauccagacagauuuuaauaagugagauuggucuuaucucuuugcuuuugggacagcuuuauauuccugagugugcugugcucagccagaugugauaaugucaaagccgguagugauuguaaagaugguuauucagggguggucaccuuuuuuuuuuuuuuuuuuucgugccccagcauacuugagcagguuagguuacauucuggcaaaaaacaggcucccaggacaauucuugggagaugggggagggagagagugguguauauauuuugaagaggucuuaacuacacagugauucuaccccugugugugagggccugggcucuuuggacagaugacauguuuuuuccaguguuauggaguuaaccuuagagcugggaccagaacccuggacuugcuccuugugccaguuuuaauuuucucagccacacccuuuucuuuccuuuuauuuuguacccuuuuuucuuacuauuuucaauagaauuuuaaaugucauauguuuaauaagauggaaacugcugauauaaaucaagaagcagucuuuaaauuuuaaauaaugguacauuuauggagacauuaucaacuaauuuaauuucuuuuucugacuuuuuaagucaccucuuuuuuccaagucaccauggcuuggaaccgcugagucauucuugaauccagcugucucuuaucugucguccguauugaaacagguuuugaaguccugucagucugcucucagagugucucuucaugcaucuccuuccuuucuuuugcugacaauucccuccuuaagggcucucaccgucccgugcuugggcuggugcaguaagcaacugauagaucucuauuugugguuccuccugguuccaguccaccuuacacauucguucuaucauuuagcauuugccauuugccagguaccauuuuaaacauuaacucuuuacuguucuuaguaccuugagguuuaaguacuguuauaaacccauucugcagauggaaagggagguauggauuuaauugauuugcccaaagcgacacagaaguugguagcuagcuaguaaauggcaaaauugaauccagacuccuuaugguguuaauugcuauagcuaaagaugaaacuggaguugugccacuccuugcacacuuuuaucugucacccucuuaggcuguuuuagaaaaucccauguuuuagcuugccauucuguugacccagccugccuuucuagccuuaacuuaccccucugucuauauucuauuuuccagccaaauaugaggugacguuuaagcugcuacuugaaagagaagugggaguuaggcagagcaguaggggaaucauguuuggggaagagugaagaguguacuugagagaguguggaggugccuuggaggagcuggagcccagaggugccccaugagaacaacacaggaggcugcagguggaggugggugccugauuguagaaugcuuucuaguugucuuccacaggacauuuuugggagcuauucacaagauucauggcuaccgugcucuaaaauuugaugugaaguucauuuuuccuggacuucuuacuuaauuccucugucuuuuggcccagccaccccuuugccaguuuacacgggugaugagcaggcuguuuggaaagaacguccucgagcagggugcuguuuccuaacccugcgucuuuuuccccucugagaucaguuuaucuuuauucacuugcagguguucaacaaucuugucuuuuauggggaauuucuaaugugucuugagcacuuucccacccuccuaucuuggaggcaugguucagaguggaaaagggcgcgggcccaccuaccucuggccuucccaccucagccaccaugcuuagggccgugguggagugcuugaccucuuuguguguacaaugcaauacaugcuggaauaaugccaccuuaugcauagggcuuuuguggguguaagggcauaccggaacaaguuggcauagaauaagaguucagugaauguugucacuacuuuuuauuacuuuuuaauugugaaaaacucacagauucuguaauaaagggucauagaaaccugcuuuauccauacuaucauuacugagaauacuuucugguuuggaaaauuugcuugagagguaaaaagaaaauuuacuuacuuacuuacuuacuuacuuauuuauuuauuuauuuauuuauuuauuuauuuauuuauuuauuuaguagagacagaaucucgcucuguugcucaggcuggagugcaguagcacgauccuggcucacugcaaacugacuccuggguucaggugacucuugucucagacuccggaguagcugggacuacaaaugcaugccaccacaccuggcuaauuuuuguaucccccccgcaagacagagucucacucuguugcccagacuggagugcaggggcacggacucggcucacugcaaccuccaccucccggguucaagcuauucuccugccucagccucccuagcugagaccacaggcguguaccaccaugaucgccuaauuguguguguguguguguuuaguagaggugggguuucgccauguugaccagucuggucucgaacuccucgccucaagugauccgccugccucagccucccaaagugcugggauuacaggcaugugccaccgcggcuggccuuuuguguuuaacuuuuaaagcgucucuggucagaugaauauuuugccuuuuggguauuuuuaaauggaaaauuuauguaaauaaucaguguuuuaauuagaaucacaaagccaaaugauugccucauuggauaauuuuaaguauuaugcugcaauucaauauagguaccaaguacuuaacuagacuuaaaaauaucuuguauguuuaacagcuguuuagcuagaacuaaaaaagagcaaguccucuauguguaugcuucuccccuuuucucccugggaugggagaaggaaaaaguuaauuuuuuucccccuugacugcuguugcugugccugcuuuagaagaagacagagguaaagaucagggaaggcaacuuuguuuccaaagaaacauuaugugccugaaacuuaguaacaccuucagacacuucuuaaaauggcuugguuauggcauagcugaaggucugaggcugugguagguaaccuucugccuguguuguauuccuggccgccucuguguguucugacccugcuccucuagagaggaaagcagcuaagcaggcaccuuucaacuuuugaauggcuucauaguauuacagcauuuagauguguugugccauucccccucuuuuuguacuuacggguuucuuggaagacagcuguaauaugccuguaggcacgcuagacaaaguuauggucaagggggcgguaggggagggcaucuggguaauuuacuguguguguguguguguguguguguguguguguguguguacauauacauauguauuauauuuuaaaaauuuuacauaacuaguauuucacuaucuuuuugauuuugaaaaaaaugaacuaaguugaacuuuaaccaccauuuauuaaaacauuucuuuuaagcucuaaacagaggcuccagaucgucuuugaggcacauuuccuguccccuggcaacucuguguguaacguuucaaacccaaggcauuguacaagggagaggaguacuuuggguuuacaugguugagggugaugaugaauccucuuauuucauguguaagaagaccggguuauuuguugccaugccccacacugaugcuggggccaaggcaagcaaaaggggacgccuaaguccuagccuaaugucugucuucuguagagcaagcugaacuuucaaagguauuucucguuuuaccuguuuuguaaaugaauaugcuaacuuugcacgccgcagaggaaugugagauauagagagcaggccgagguccauggggcuucauaaagggcauuuugagcagcuggaggcuugugguuaccauguccaggcucuuccccugcucuccuuaacuauccuacagaugccucugaccugggaggaaggaagagaagcccucaucuccugacugagagugggaaguggcagucacugaaugugcuugccgugugacauuacugcaugucaggcuggcaguucacuguuuuguguguggaggacuguuucugaugcucucugcuauuugcuaagccauaaauaaggauauaccgucugacaacuacuauaauaguaugaaggacagcuuugaaaucaagacgucugauaaccuuaagcuguggucacugucauuuuucucuugaaagauccuggacucucaggaucuggcuuaccaucuuugauggacaaucauuuuauuagcuugcuugaaagaauuaguuccucuguuauaaucacuguagugucaguuggaaugacuugagccauuuuuguaaaacuugugaaaucuuuauguauuuaugaaaguuaaacuuacugaaggcugaaugacugcagugaaaguaugaauccuuuaauuaaauaagugguuagcauuuauauaagcagucuaauuaggaccccaaauauuuguucauuuucuuuagggcuacuaaccuggaugcccgauggaguaaucaucacuguccuguguagaucuuguagauuuuugaaaguacuuucugucucacaguggugguagauuuuguuuauuuaauuauuuagggggcauguuuucaguuuagccugauuaguuaccugcugaauaaauaauguuauucuaauacccugcuaggaagaaauuuauguaauugaaauucugauuucuauguaacguucuguuuucguauugagacaugauacugccugacagggcugcuucagcagcugucaucugguuuguuguuucuuguguuguuauauggauucugcuagccuaaaaggcauucuucucugugucucugcagggcuguccagugagucaucuaaaauuaaacuuugaucagaaauaaguuucguuuuuuucccgcaaaggacuggagugagugggcuugagaauacuuguaugcaaauuaaaaauauauauauucauaaauauuugggagcauuaggucaagugccaauuaagucaggaaggauccugcagccauagucaugaagauaaacuuuuuaaauugcauuugcucaaacuuaaacauguuugugaguauuuuguauaagcgaccauuauuucaguugcuauguuagauuuguugcuuucuuuagcauggauuuuuuuuuuuugguaaaguguuaguuuuuaauguuucaaaagauuuuuuuugcagucauuuaaaaucaauugucaguuaauaccuaaaauucggcagauuguauguuuuauuuauugcaacauguugagaaucuuuuguuuccuguugacauuuuaaaaaucuccuaauggcagauugauuugucugugcucuuuuuguauuauuaagucaggcagcagauacuuagagagcuucugcuguuuuaagccauggggaggcaguagcgaacaaaaggggugggggagucuugcggcguucacaucucagaaauguuacugcgcuaugagggagacuuuggccucuaauccacuguuagccacuagccuccagucaaaguuagagaaccaccggucuucauucuuuucauuaagugguuggacuugucuaaaaagguuuaauuucaccuccagacuuugucuugagacauugcgugucuuuguuuaccugucuuuuguuuccaaacgucccuacgcucauuccuagauuuaauuaagggcucaaagacugcucaauaccuuguuuuguacuaaguagggaagaauuuuaauuuaaauagguuucauuacugauuauuaauuuaaaauuuaugggcacuacaagaaaaacuauuucucuaccuggaauuuucaugacugccaauaacuuaguacuaggugguauuaucugcuuuauucauucuuauuauuuaaaauauuuuauaacuuuaggauauuaaagaaaauauaaauuuacccauauuauauguuauccucuguacaauaugauaauuuauggaauccagcagcuauauguuggauuacuauuuuaaucuuuucugucuuccagaugguauuaccaaaaauaaauccuuggccuccuauuucagcuguaagaauuuggcuuaccuuuuguaaucaagagugguaagggcccuuuuacuguaggguuaaguaagauuuucuguuauuuaguuguugaggauaguacaguuccuaaaaaaugauacgugcuuguuaaauacagaaugaaugaaaagcacacaucugcauauuagucuuaaaguuuuaagaugauuauuuuugauuuucaaauauagguaguauuucauuuuauuuaaguuauacauuuauuuaaauuaucuaaguuauaauaaaauggcaaaaccacaacuacuuuuacaccaaccgaauacuuacauuuauuucuccuguccuuugugcugugauuguuuuauuuauauguaauaaacuccacaauguuauuuuugcuuugaacagucaguuggcuuucaaaaauauuaagaaaaaaugucuuuuauauuuaucuacauacauauuuacauuucuggugcucuuuauuccuuugugugaaucucaguuucugucuggaaucauuuuccuucugugaacuugugugaacauuuuuugagggcggaucuacuguugacaaauucuuucacuuucaugggucugaaaaaguauuuugccuucguuuuugaaggguguucucaccggauauagauuuguagguuaaaggucuuuuuuauuuucaucauuuaaagauguuuuauuuucuucuggcggugcacaugguuucuggugagaaaguggugacuccccuauauggaaacagguguuuuugucucuggcugcuuuuacaauuuuuuucuucaucauugguuuucagcaguuugguugaguugccucagugugauuuuugugugacuuuuuccuuuuuuuuuuuuuuuuaaacuuguuuucaguuugguuaauuuauauugcuuuguuuuuccauucacuuaucuuuucuucugcggugucugaacugcuauuagguccguucagugaauuuuucauuugaguuauuuuguuucucauuuuuagaauuuccauuuaguuccuuuucguagauucuauuucucuauuaagauucacuauucccuuauuuuguccauguuuuccuuuauauuuuaaaacauucauaauagugguuuuggucugcuaacuucacucuuucugucauuucugagucuuaaauggauuuuuuccucccgaauacagaccacauuuucuugcuucuugcugugccuagugaauugggcuggcuauggggaugaggaaugcuggcccgugaguguuuggauuuuguuguucucuuuaaagaguguugaaugucguccuggcaggcuguuaauucacuugcagaccaucuugauccuuugagguuuguuucagucucuguuagaacaggggccagccuuuacuguagggcuggauuagcccuagcccuaaauguggauuuucuggggucucuguugaaugucuguggguuucuccacuguagccuguuugaacacucaaugucuuacagucuugugugaauuuuaguaguuauucaguucacaguucccugguaguuguucugugccuggcuucaugguccuucucccagugcuugugcagcuuagcauuuggccaaagagucaaggagaacccuauguacggauugauggagcuccuucucuuuuuguuaccugcugcacaaauuccagccaauucaguggccuugaacucuuccuucugucucugcagcacagugagauugcuguguucuguuugggcucccccuuccuauauuguacccuggaaagugccucuagauaggaaaccagggggauuguagggcucaccaagagugauuucuuuuuucagucaucacgauucugcacugccuguuguccaguguuugaaaacgguuauuucguauguuuugacuaguucuuuaguuguuuaugaugaaugagggagucugguaccagguacucuacaaaggucauaaguggaaaucugauaauacaaauuccuaaggguaacauguuuuuauccauaacccauuguuacuaacaauuuuaauauauagauucaguuaaucuuucaugcugaaaaaccugagauuuuauuuacgucuuauaugagcaauuucauuguguuucuagauaauugaguaugcucuuuuggcuaguggguugacaagcuugugugugcauguguguguguguguguuuaauguuggcacguguguguguguguguguguguguguguguauccuguaguaacacauauuggccacuagaggguaauaagaaagcaguucauuuguucuuauuggcucacuguuacuaaauaguccuuaucauuagacuuuuugcauagucacagucauugcuuacuuucacuuuaauauauauuuauuuaacaccuucuguggagccaggcacugcacugugugcuugggauauaaaaaugaguaagagcaguugacugagcaauagcuguagccugugcuauaagacuuuucucugcuuuugauucaagaaccccucauuuaaaaaauacuacauucauccuuaccucccgugcaguccccucccucccucucucaaugauuucuucacagucuaaauauuccugauggauucaguucauuccuuuauugcacagauauuuauugaaugcaggccaugugccaggcacuguucuuggugcugaugauaaaaucgugaacaaagcuuacucauggacuuucguucacuuacccucuuaaucaugugccuuuauuuccggccaucauuagaggugcaauucauuuuggaugugccuuguugcuagggaccucguggguuuuugcccacauaagcuugguugcccuccucauuucuuaguggauucugucuuagaaccucagccucauaaguuuccacauuuagaugcuauaguuuuaauuaaauuauuuucauuuacuuuuuguucuuuaauauuguucuuugauuuaacuguuucucuuuaaaaucuacuaucaauuaauacugucacaggaaugguccccuguuaacacauuacuaacaaagaaauucagguuagguaagaauaacauucagaucuacaaguagagcuacguguggguuauguaucagagaugauggcuucugauacuuguuauuuuuacuuuuuuguuuuuaaacuuagggucuuuucucaugcuuuuuguauuugcuguuuccucuguguuuaccacuaucuuuuugaaucuuaugucccagucuuugagauguguuguuuaugaaauauuucucuguagaaucagugcugauccauacugguaauauggucucuaguuauuauaguuccuugcuagaacauaguaacguggcugaaguaagaaagcugcuucauuuuucuuuuaguaaaauauugaauuuuucccaaguuuagcaaaguuacagaaacaugcucaugguaaaaaugauccauacaguucagaagcacguaaagacagaacuccacaugcaugauuuucuccaacaugcuuuccauacuguuugacagcaguugaaaauacuuuggaacugcacuccaaaugaugauuuuagauagcuuugaauuauuuguuaaguucaucauuaaauuauaacauuaucugauguuaaaacauguauugugauacauucuuaagcuaagauauuauuauacugaguugaauaaagauuauauaauacgguagauaguagguugaaccauaugaaauuacuguuuuuguaagccaaggguagucagaaaucuaucagcaguuucauaugguuccgcauaauacuuuauaugaucaucccuguuacaggaugaacugagucauuuuuuccauuaacauuugcauuaaaauuuuaggaagauagaaacuuaagaguaaaaacauggguaauuugcuuaauuaugaaaucagguuaacuagaaauacgcauauuaguuuuguccccuuggaaucuuaucauaggaaaggaaugaaugaauggauaacuuaaauacuuuuugguguugcaggaggaaauuaaacuuagguuuauucugaauuucauacacagcagucgaguuaagaaaggagacaaugagcauguggcaagcacaccucguuuauauaccauguuuaccagcaguccuccuguacugguggcuuaaucuuucuucacuuucacuaaauaacugauaaugucacuaacuaguuaugauagguguuauaauacauagcuaaaaagguaccagaagugaaaaaguuuuuucuugccaauucacauucagaucauccacagcaaauuccaaaaagaacaucagauucuuugucaccuagcauaucaccguuaugcaugggaauguguauuauucucccuaaaaaaaguuucaacuuuauaacuagaaaaguaaaucuauuggggaaaaaaaacccucuaguguauuguuuagauagacuauaacuuauuuuuggauuauccacuacuugaauuaguuggagaacagcuuucuuuuauuaaggugaccaaugcuuuucaaaauaguauuggcaucaucugaugacuuguuagaaauguugacccuuggccaggcaugguggcucaugccuguaauccuagcacuuugggaggccaaagugaguggaucaccugaggucaggaguucaagaccagccuggccaacauggugaaacucugucucuacuaaaaauacaaaaauuagcuaugggugguggcgggugccuguaaucccagcuaguugggaggcugaggcaggagaauugcuugacccuaggagacaaagguggcagugagccaagagugcaccacugcccuccagccuggguaacagcgcaagacucugucucagaaaaaaaaaaggaaauguugacuuucaagcucuacugaaucagaaccgucauuuuuaaaaagauugaaaaacaauuugcaggcacauuaaaguccaagaagugcuguuacagauuaugaauggcauugucaccuccgcaagacagugcugaugcagccccucaguaagugcuuguugaauuuaaugcauauaauucacucaaucuagauucaaaaaaugaaacaaguauuucaggaggguagugauaacagcaguaaucaagggaacuaccuguuucuuuguaauucuuucauagcuaucuggaugucacagaauuacccaucuuuccuuccagaugcaucuuucagucugauucuauccaugcuggauggucauuuggaugucuugugaauacaguagauauacacacauauguguauggaugagagagcaacagaauuaaaacagaaaucaacauaguggaugaguuuagggaguaauuagauuuugauuagucaaggaugcauaaucuuuuguaauauuguaauauauaagguaacuaaaaaauaaaaauauggggagaugauauaaaaaauuccagcaaaagauaagaaaggaaaaggaacauaaaacaguuggaacaaauagauuguuaguguucauuuauagauacagcucaaccacauacucuuuacaagagauaaaccuaaaauacaaggaaacagaagaagguaaagguaaaaagauggacaaaagacauaccauacaaaaauugaugcagagaaggcuugguguagucagacugauaacagauaaagcaaaaagcuuuacuagaaauaaagagggcaguuuaugaugauaaaagguauuauucaucaggaaggcauaacaacccugaauuuguauuauccaguauaacacuuuaaguaggagauuuuuaauacauuguuguugguaacugauagaacaagaugagaccaaaauuuaaaaaaaaauaccuauauaagacagcauacuuaauaaaauuaaaccuuugaugaggcggaccaugaagaaagagaagaccucauuaaccaauguugaggugaagaggauaucacaaaagcuuaugagaagauauuauaaaaacuugaugucaguccauuugaaauuuagaugaaguuauacuauuagaaaacuacaacuuaacagacacagcagaaaauagaaaaucugaauaguccuauuaaacaugauccuuaguggaaagagcuacccacuaguuuugaagucuuugggauuuacaaaagaaaaaaaaaaaaaaacaaaacaaaaaaacggaaacuauccacaagcaaaacuccugguccagaagguuucaccagugaaucuaccacacacgcauaaaaucaugaccaaaucgcauuccagaaauggaaaaucuuuuuuuguuuguuuucacaggaucuugcccugggcuagagugcaaguggugcaaucauggcucacugcacccuccuccuccugggcccaggugauccucuaaccucagccuccugaguaacugggaccauaggcaugugccaccacacccuacuaauguuuuaauuuuuuuguagagauggggucucacuauguugucuaggcuggucucaaacuccugggcucaagugauuuucccaccuuggccuccagauugcugggauuacuggugggaaccaccaugcuuggcucaaggaaagucguuuaucauuucaaaaaucaaucagcgucauucaccacaucaacagaguaaaucagaaaggucaucucauuucaguagauacagaaagagcauuuaauaaaagucagcaucuauucaugaggaaaaggucuuagaaaacuagcaguagaaggaaacuuuguuaaucugggaauaguaucuguuaaaaaccugcagcaaccauaauacuggagaaauguugaaagcuuucuuucuaagaaagcuguauuuccaagauugagaauaugugagaguagugucuguuaccuccuuuuuaaaucaucacuguacuaaaggucccagcaaguagaauaaggcaagggaaagaauaaggauuggaaaagaaaaauaaaauuguucagaugcucacuagccacauguggcuauuugcuacauuacugauacagguaaauccaucauugcggaaaauucuguugggcaccaccauucuauagagaucaaugcaauuucaauuucaacaucccaacauggauuuguuuugguggauuugaugaggugaaucaggaacuuacauggaauagccaaacuuacuuacuuuuuuuuucuuuuagagguaaggucucuguuacccaggcuggagcacauacaguggcacaaucauaacucacugcagccuugaaaucuugggcucaggcaguccucccacccgagccuccugaguaauuggaacuacaggugugcgucaccaugccuggcuuuuuuuuuuucuuacagagaugagguggugguguguuucccaggcuggucucagacucucgggcucaagugauucccgccuuggccucccaaagcccugcaauuacaggcaugagccccugcgccuggccugccaaaacauucuugaagaagaacagaauuuccuguuggaucuuaaaauuuuuaaagcuauuguaauuuagguaguguccaguucuugaacagagaccuagguagguaagucuguauccaguagaacagaauaggcaguccaaaacuagauccaagcauaaagggaaaugugauuuaugauaaggaugggguuacagagcaguggagaauguuugucuuuuaaauaauugguuaaggaucaauuggauguuaauuuggagggggaaaugaaacuugauuccuauuuuacacagaagucaaaugcaaauggauuuugcauuuagaugugagagagaaagcccaguguuuagaagguaauagauuuuuuucaugacuuugauauaaggaaaaauuucuuagauuccaaaaguauaguacuaauuguaaagcaaaaguugauaaaauuaagaacuuuuauucaucaaaguauaccauuaagagggugacaaggcaagcugccuguaaccaauaggggcucgaucauauucagaauauggauuuuuaaaaauccuagaaauuuguaagaaaugggcuuacaauucaguagaaaaaauagaaaagcaaccugaauguacauuucacgaugugauguauaaguggccaauagacaugcaaaaaugcucagaguaacuaggaaaaugcaaauuaaaaaccacauuggaguaccacagcacaaauacacuuagcauaauggcugaaauuagacugaugauugcaugccauagugaaggaguggagcgugagaauuuuucauaaacugcuaguggauaaauugauuggaacaaaaaaagaccagaaaaacaacaggacagcaucucuguguauaccaaacgaugcauaacaagaagcuuacaaguggcaguguucauaguagccccaaacuggaaauaauccaggugucggucaguaguagaauggauaaauuaucauuuguccauauuguuguaaagcaagguaauggacaaacugcaguuuauaggcauaagaugaaguaaacaauucuacucuauuacauuaguuuguacuugcccugcuauaaauaaauaccugagacugggcaauuuauaaagaaaggagguuuaguuggcucaugguucuuucuucaggcuguacaggaagcaugaaagccucuggggaggcuucaggaagacuuucaaucauggcagaaggcguuggagaagcaggcaugucuuacauggccugcaaagucaggcaaaagggggaggugccacacaguuuuaaacagccuuuuuucgugagaacucuuaucacgaggauagcacuaggggggauggugcuaaaccauuagaaaccacccuccuaauccaauaaccuccuaccggggcccuccuccaauauuggggauuacaguucgacaugagaauuaggcagggacacagauccaaacuguaucaccugcuuauaugaaaacaucacgccuguaaucccagcacuuugggaggcugaggcggguggaucacgaggucaggagaucgagaccauccuggcuaacauggugaaacccugucucuacuaaaaauacaaaaaauuagccagcgugguggugggcaccuguagucccagcuccucgggaggcugaggcaggagaauggcgugaaccugggaggcggagcuugcagugagccgagauugugccacugcacuccagccugggugacagagcgagacucugucucaaaaauaaauaaauaaaaacaaaucggguuuuggaggucaggauaguaguaacuuuugaggaagaggaaggagguguugguuagaaagggucauagaguggugugguggguuucugggaugcuggccauuuuuuccccguuucgugacacagauugauuuuaugauaguaauuuaagcuuugugcuaaugauuuuuauccucuuuucuacaauauugcauugaauaaguuuaaacauaguauauaacagugacauagauaauaaaaacagaagcuaacauuuuuauaaaaaguguuuggugugugucacagguuucauucugugugccuguuggugguaucucauuuaaacuuuguaacaaggaauagggucaguauaguaauaccucugcuucauagauagggaaucuaaggcuuugaaugguuaagaaauuugccagucacagccuuagucuuuuacuguuuauaagaacuuuuuauauauuaaggaccucaauucuuuuuauuuauauuccuuccuaccuuuuucuuuuuaauguucagauuuaaaagcccucaucacccccaguauuugaauuuagauuuucaauguuuugcuuuuacaaacaacaccaggauaaacaugcuuggcaucuuugugcacaucauugauuauugccuuaguguaaguuuguagaaguucuuuuaaaaagugaacaagguuguuuuacagaauugaauugaaugaaaguauuuuugacuaugaaugaugaaauguuuagaaaaguuggccaucuuucaccacaguuguacuauccuuuuacuuauuuaauaaacauuauuaaucauguagauugggaaaguuaaggaccucacuguaauggggagagacagaagagaaucuaaagucugaaagcaaugcuaggggcaguugacauuccagcuucagcagggguagaggacuugagauuuguauuuuagaaaggucacuuuagccauguuauugaguagauccagaauugaaaauagaauaaagacagcuauuaggaaucuguuuugguaaucuuaaguguuauauguggugauguagaugaaaagguuguguuugaguauucuguuaggagagggaaugagcaagauugggcagcuguaagggaagaacucuaacaugacugccagaguguugagucucguugacugcguaggaaauggugucauucccugugguggaaaguagagguggaacuuauguuuggggagcuuuguucucuuuguuuugcagagugugugccacauucagguagagaugguaugcuccacaaggugggcacuggccccaugagccuuuacugcacauugacugugcauuacucuacaguacuugcagauaacauugggccauuuauuaauugccagagcuguucugaguauguuguauguacuaaagcacuaaaccuucauaacaaccuuuucagguagguauuauuaucauuaucaggauauuagguaugcauggccauacagcuggucaccgguagugcugggaucuccaaccccagcaaccuggcugagagucugugcccuucacuguuggaccaccauuauugugugucuugaaaaugguagaagucggaaguauuuugcuacugagcguuauggucgguuguguuguggcuguuagcugguucauucaggaggacaggcacaaguauuuugaaucuagucauucuuguugaccaagguuuuaggcuuuagucugugauuacaaauuuggcugaauuuaagaaaaaucuuuuuuuuauccuuuucuuaaagaauuaccuuuuauuagauaccauuacuuuuauggaccaaaguguuaauuuuucauuuccaccauggauaucaugaucaugguucauccuacccguaggauaauuauugguuauuuuuucuuuguggugagcuugccaggucuagauucccuuaggacuguuugaaaggugcagagaaauccaacgaccuuggguugagaaguuuaguucuguguuuuauguuuguuuuccuguuuuuauauccaaccuuugauugccugugucaguggagagcaccauaagguuucaccugguuuggggaaugcuggcgauguuguuugccguaaaccuggcagcaggugcaaaauagcaucucagaaauguuccuuugaguugguuugugaggagcuggucuguuggagaagucccucaauaauuaaaagauuacuuauuuaacuuguauuaugguucuuaauuuaugaaaaucucguaggugaaaguaagucuuaaagguuguugcuguugcuuuacaaaaagauuuucugaagauuuucucaauacaaguuuauauucauuuuaaucacuauggaucuucuauaccauuaaaaacauaacuguuguguugaguaacauauaccuguuuguaguuagaaaaguuuuuuaauauugaauauccuaaaguucuuauuuaaggaaccauuagauaugucaaaugauacaaacauuaggauaugaauauuuccuuuaaaccucacuuaucuucuuguaggaggagagacuucagcaugcaaaccuucaucuguucggcuugcaccgucauuuucauuccaugcugcuggccuucagauggcuggacagaugccccauucacaucaguacagugaccgucgccagccaaacauaagugaccaacagguuucugccuuaucauauucugaccagauucagcaaccucuaacuaaccagguaaguucauggaguaucagaaaugacuauuggaauggcaguuuauuccuuaaaaauguuggaauacuaaguaggcaaaaugcuuuaauggcuuucaguuuuacaugcaacgugggauuauggauugggaaaacauguuaagaaguuugcauuaaauuuuuuuuuuuuaauuuuuacuuguauuucacuuaaacacucauaaacauaaccacagucucucauucuguaauagaaaggggaaaaguuauuucugaagaauauuaaaggaucuugaagaaaaagcuuauuuuuauggaaagguggcuaaguuaaaaccguuacaggaaagcaagucagauuccauuacagcaaacuuacagaaccaauuuuguguuauuuuaaacuaccuuucuacacauuuguaaaaauaaauacaaaacucccuaaaauucaaaagagauguaugcaaauuaaccgugcuauuuauucuaauauucagacaggcuauucaccauuuuucuaugaagugaaugguguaaauagaauacaugcugaacucuugguacucacacacacauacacaugcauauauauguauguguauguauuuuuaauaucuuucuaaauuaacugcaccgucuacguugaguuuugguuugggagacuuaacagcuguaguugugugaaaguuucuugccccacggauauuugaugugugaugagcacugaaaauggcugcuuuuccauggacuuagaaauuugguuugccauucuuuuguuuaggucuuuuaauauauugugugaggauaaaagaguugggagauuuaaaaguaugucuuuuccuggugucuuguuuauauuaaaacguguuuguaauaaaauuuugcuaguaggcugacauaauguuuaaaauauacaacauguuaacauucacaguuaaaucguuacaauaagaugaauuuggcaggacuuaagauuuuauguagugaauugauuucaguuuaguugcguguuugagaauugggacaguuguucagaauguccaaguuuaggaaguguuuaauuguguaccagaagaaaacugccuggaaaucuaauaauaauaacacgaugauccauuugcacuuugaggaaaccaaguugauucagauuaauuuucccacuuguucaaaagcagccugucaggcagagugcuguuuuuaauguguuucacagcugaaaggacugcgcucccauuugugacuuuuccgugugugagcaggagacugugggguccagccugggcuuccuucuucuuagauacagugcucuuucaggucuaaccucuggugucuacagcgggcuaggaaaacuuccaguccuuuaaagucauuuuuaucauuauauuauuuuaguaaauaauuuaauuaacaaagcaccuauuuuuauauccaacuaacgucuuauguguauuuggaucauauaaaauaagagauauuucacuuacuauuucuguuuuaagcuaugaaauacuuuuaaagauuugugugauguaaaaagacuaucuuuaaaguaauaauacucagccaaauauuucugccaaaauccaaaaauuucugggccuaauaagggagucauauuagaggaucccuuuccuguaacuaaaguguaggcugcguauuaaguggcauagucuagucauaggaccuggcuucaaggucuuggccggcucaugaucugguuguaggauuugaguuagguuauuuguacccuucauaucuguuccuugggugucaaauuggcaccuccgacuagaacccccaacacauacaaaguaccuuuuagcuguaaacuuacuguaauuucauuauuuaauuuucauuguuucuuguuaaucauccuaucagaugucuuuuaaaagagaaauagagcgaaaguagguguagaagaggaagacugauguuuggaaugcuggcucucugggcuauucuaguuuucacaauaucuuccauaguucuuaaauucuaguacccuggauauguguuauagaugcuauucagcuuuauuaaugcucucaaaauaacaagaaaggcagaauacaguguuucugauucuucauuauauaggaaaacaggagguaaauauaaauaaaaugaaauagguauuauaauggaaaacaguuuuugaaaggaguccuagagcuuauacuaaagaaucuuuucaggacaaaaguuaauuauuguuuuagcucuuauaacugaucuaagcaggagguuuguaaucugggugaaguaaaaggagcaagagaugugagcauugaggguguacuguuucuagcuccuggaggcagauagcugaggcagcaggaggaggucaccucaacuucccuuuuauuagguuacuugccuugcaaaaggggucauuucugcagcuuggugagcuccuggguccucugaacaccauggacuuaacuuuuugcuguagaagguagaagggagcuugcucuauuacuguacauucucuugacuuuggcuagcagaagcaggaaguagagaaagugucagaugcuuagggcuggccuugaguguuaguauagauauauaaguagguauuuggaaaagcugcuuucuaauucuggauauguacuaauggcaucacaauguuccaaaagaaaaaauugguuaauaugaaaucacaaugaaagcauagggaguauuacuugcuuuguagacauuuauuuguucuuuccauguauuuugagcaucucaaugcaggauguuguuugaagcaugaaauauaaacagcuuggccuuguaggcagaguaugaccaguuguggaaaagauuagcaacauuuugugaagugcuaagcacacagcacacacucauauugagugcagaaauuugaucauguaacucauguuuauauccuauuuuguauauguacuguauauuugaaauuuuuuuuugauuauaugugauuuugguguuuuuuagugagcaucauuacuccugaauguaguuacugauucuuuuuucagauguuugaaauaccaguggaauuguaaaugggcaaguuaaaaacuuaaagacauucacaguuuuuugauguaacuaauuuuaauaaaugccuuugcuuauuuuaggcauaccucaauuacuuugcucaacaaauagccuaaaaaugacugcuaagaggguagacuagaggcguaacauugauagggagcuccuggcaagaguguccucguuaagagccugggguuaggcauggacaucuucagcuacaauauuauaguagcugcacuacgauaauauuucggaccacccggauggugauuuuccuguucuuuaacuggcucugggaccuuggucaaguucuuuaacguuggagacucugguuucgcguguguaaaauggucacaggaaugguauuuaucucccuugagauuguugaggggauugcauggaagacuuguaaaaauaugcaugcuaaaaacauguuguucaguaaauaccugcuacuguuauuguuacuuuauuauuaaguuauucgguugacucuaccaaugacuuauacuuccugucaacuuuuauuauagcaguaaugaagcauugcacugauucagauuuugugaaaccucacauuuaggcugcacuccaccagcccaagaaaggggcuuacugaauaaacuaccuacaugaaaacaaugcugggaacuuaaauuaaaaaagaaaagacauuuaagggaaaccuuucaucacccuaaaugcuuacagcauucauucacagaaaaacugacguuuauuacccauauuaauuuaugcauuaaguccuuaaggaauaguauaaaaauauucugugaacuuagcauuagcuacuguuuagaaaaguaagacugucuauuugaaaaauuaaaucagaucaucuucuuaauucugaugauuuuugucagacaaauaguauaaucaccaaggguuccccccccccccaaccuuauuuggaauuaagaagcacaggacuuugagaagagauaguguuauuucaguaaaugggugaauuugcccucuggguaacaacuuuuuagaguuugaguauacaugcagaagaaaccaguguuaauguugguucaugauaaagcgcacguaguaaaguucaugauuuacagcacguaaaaugcuguaacaauucugucuuuucggaccacauggauggugauuuuuccuguucuguccacugguacaaaccuccccucuucucuuuuuugguguggguuagguuaacaauuauaccaugacuccacacauuuuugcgaggucuuaguaugauguguuuacugucacucugccccuccgauugacccgaguguccuuggagagauguugugucagggucuucuggcucauuucccagcacaaauguccagaagaguugggcaggaacacaaagaugggccagggggaauggcugugaccaccuugauggaaauaauugguuuugaggaucuguugauugcaagaacccccauugggaauccuuugacugaggcauggcacuugcuggagcaguggcacuuggacagcaauccaggaucauugaugcuagccacagcacuccugggguguguguauagagggggugcaugccccugcucuaucaucuguuguaauugcuguggaaacggucuagcaggaugcucacgguggaaccccucauugccugucagauggugucgagagccaugaguugggaucagggaaggggacugugagggcaagccuugguuaggggcagauauuugucagagggcagcagggucuggagacauuaggagcugaauuucuucuuauuaggagcaguuggagggaauggugcucugcugccagcccccuuuuuuggugccagcuggguccugaaauccuauguuaaggaagcugaaaguugccucugagggcuggguuuaucuuugucugcuaguugugaaccuggucagguuuuaggaauaauucagaaaaaaauuuucuuugggcuaauugugugguagagaagcccucgugggcaacauccugugugucuccuagauuggcguaugucugcauuucuaccacuuuaaauuuggcggaauaggaucaaagccucaggcagcugggcauauuauccucuaauuucauugauuuguucuagugguugucuuuauuggaauccacaugaaagggaacuuugagagagaauguauaaucaucuaauguguagcugucuuuaaaaaaguagauacaugcagguuacagaagagggaauuuauaucuuauaguuaaagugcuagucuuuucugucuauuuaaggugaugccugauauugucauguuacagaggcggaugccccaaaccuuccgugacccagcaacugcuccccugagaaaacuuucuguugacuugaucaaaacauacaagcauauuaaugagguaagacuugauuuguuauaauaacaucuaucuugcaguaugucauugagaaaaaaagugugaccuauuuacccuaaacuuuuuuuucauuccuaguaguugucauauugaugauuauuaugaagacuaaugauuuagaaauaauauuacaauuauguaaaagauauauuaacaaggacugcagaguauaaagauaauuguggauaacuugauuuuuuuaagguuguauuuaauauacuguuauuucuuuuuuuaauuuuuauuuuuuguuuuuuauuucauuugaguucuguaauaacuuauucaaaacaagaaaggggaauaaggacucuaaaaguauauauguguuagaauuuuugcuagaauuuuuauauauuuguuucugcuuuugccaugggugucaggaagcucugaaauauguuuaauaccuaguuacaggcauuuggccuaguuuauuugaucuaucuauauuucugugauuuuauugucuuuuaacuuuuuauguguguucuuuuaucuauaucuuuuuaugauaagauguccagaagcuuuuuuguuguaaguaaauaagauaaaaaacagacacagcacuuugaauuccuugccuguacuugguguuuugccaccgaaaauuuuucuggugucuuggaccauuggcuucauugccauuugcuuguggcuucaacucugucuccaaaguuaauuauuaaaggagcauuucuggagaagaauccaugcuuucuuuccucuucuagugggagcccugcacccuuucauguugaaggcuuguccuuugccagcuuuagagcugcuuagcugaaaagugaaaagauguucuuagguacaugcaaauuuuauagcaauuuaauguuauuuaaugacaguauuacuacauuacaguggcaguguggcaacguaaaauuagaaugaacucugugaggaacauuucugaguuagauuuuguacacauuuauauauuauaaacauguuccagacuagcuugugauuaucugaauauaucugauaaauuguugauaacaguauauuaauuucaauuuguuauuaucugauaaauuguuaacaaagcuacaguuaaacuguuguuaacaguagcuuucuuggagcuuguuuuuaagugucuuaaccacguuauaaaguagacuuuuucugauguuauuccaugcaguguaauuuauaauuucgccaaaguuaguuuaccaguuaccuggacuguuuccuaguucaucuaguauuuuuuuuuuuuacuagucuuagaaacaguguugguguuuuguuuuuguuuuuguuuuuguuuuuuguuuuuuuuuuuuuuuuuggagacagagucucacuuugucaccaaggcugccagccuggagugcaguggcgcgaucucggcucaccgcaaccuccgccucccagguucauaccuuucuccugccucagccuccugaguagcugggacuacaggugcccgccaccaugcccagcuaauuuuuuguauuuuuaguagagacgggguuucaccguguuagccaggauggucucgaucuccugaccucgugauccacccuccucggccucccaaagugcugggauuacaggugugagccaccgcgccuggcccagaaucaguguuaaagaaaauaacucagccugugauuaaccauaggcguauggucuuugggagugggggcuaagaggccauagcuguuuuucauuaaucguuauauuuuuauagguuuaaaaacugggcaugucucagagggccuauuuauuuuaguaaaacaucacuuggucuacaucugaacuuauuuuaaaaauauguugccauaaaaucaaauauaaauaaauucaugcaaguuacagaagagggaauuuauaucaauaaauucccuuuauaucccaaauauaaaguugggauugacuggaagggggcaugagagaacuugaacuugagggacaugaaaauguuacuuggcuguuuggcauuugguaacuuuugucaaaauuccucauguugaacucuuaagaucugugccaccucacuguauauaaauuauacuucaauuuaacaaauaaauauaaaccagguccuuuuacuuuucuugaauggcauacuuuggacaagucacuuaacauuuuuuguuuacaaagucuauaaacaguauaacuauaaugaauuucacuguauaaauuuuuucauugguuagaucaguauuauuuucuaacucaaaugucaacuguagaaaauaggugugugucaauauacucugauaaugcccuuccucacagugauuuaaauuuuacaguuaacacuauguauucucauuucagguuuacuaugcaaaaaagaagcgaagacaccaacagggccagggagacgauucuagucauaagaaggaacggaagguuuacaaugaugguuaugaugaugauaacuaugauuauauuguaaaaaacggagaaaaguggauggaucguuacgaaauugacuccuugauaggcaaagguuccuuuggacagguaauuuaauggaaaaugcugaauuucauuaguuagaaagaacuucuuagugaaucuuguuguuaacagcccuuccucaagaguguacuuuuaauauuugcaaauagagcucagcaauggauaugcaaguauuuggaugaccauaauucuuuaaagguagugauacugcaucaguaauauaaacuccuuagacuucuaaaaacuuuuauggcuaccaagugcucauuuuacuaaugacuggugaauuuuaaucacuuaauagauaguauugccucuuuguuaugggccuuguauagucuguagaugauuguuaauuacauaugcuagagguauuuaccuucuuguccgauagaccacuucaaagagaaaagaauuaccauguucagguggugcagugggaguccacucacuuuucaggaggcuuuggaaagcuggggguuguucccuggcuuuuucucccacuucauguuguaacuauaucagaccucuaagcaggcaggcagucuuagucucuuguaucagucgcaccaauaccaagaguuuugggucuuucuccuugugcuuuauuuauuuauuuauuuagagacagacuugcacuccugucacccaggcuggagugcaguggugcacucucggcucacugcaacuuccauuucccagguucaagugauucucaugccucagucucccgaguagcugggauuacaggugugugccuguaaccacaccuggcuaauuuuuguauuuuuaguagagacaggguuucaccguguuggccaggcuggucucaaacuccugaccucagguaauccgcucaccuuggccucccaaagugcugggauuucaggcgugagccaccaugccuggccuccuuguauuuuuaaaaauauuuuuucgggucaggcguggugacucacaccuauaaucccagcacuuugggaaucugaagcagaaggaucaccugagcccaguaauuccagaacagccugggcaacauagcaagaccuugucucuauucauuuaaaaaaaaaaaauguuagggggaucucugguuguggucccccagcuguucccaguuguaaguccuucuaucacauugagucacagagcuguguuuuguuugaggugugauuugcugauaaucccagucuccucugccuugcagcccuuguggaaugagaugguuauuaaucugcaguccaaacuuuugacuuuucgaugaugaggauagaaugggaaucaaaaugacuuuuccuaaauugccuuuuuuuguuuucuuaaacuauggaaccugcaugugcuuacuucucuguuccugcccugagagaacacaaaauacaugcuccuuuuuaaccugugaggaaaaagccaucaugcuuaaaacagaaaguguucuguauuaucgggggaaauucagccagauaucgggcaaaauucacccccaauauuucauguagguucuuuucuauuuucccuaagcgucggccgguuugagaaauaaagggacagaguacaaaagagaaauauuuuaaagcugggcaucugggggagacaucacaugucgguagguucucugaugccccacaagccgcaaaaccagcaaguuuuuauuagggauuuucaaaaggggagggaguauacgaauaaggugugggucacagagaucacauacuucacaagguaauauaauaucacaaggcaaauggaggcagggcgagaucgcaggaccacaggaccagggcgaaauuaaaauugcuaaugaaguuuugggcaccacugucauugauaacaucuuaucaggagacaggguuugagagcagacaacuggucugaccaaaauuuauuaggcgggaauuuccuuguccuaauaagccugggggugcuaugggagacuggggcuuauuucaucccuacagucucgaccauagaagacggccacacccaagggggccauuucagagaccuacccucaggggcucauucucuuucucagggauguuccuugcugagaaaaagaauucagcgauauuucucccauuugcuuuugaaagaagagaaauauggcucuguuccgcccgggucaguggucagaauuuaagauuaucucucuuguucccugaacauugcuguuauccuguucuuuuuucaaggugcccagauuucauauuguucaaacacacaugcucuacaauuugugcaguuaaugcaaucaucacaggguccugaggcgacauacauccuccucagcuuacgaaaaugaagggauuaagagauuaaagacaggcauaggaaaucacaaggguauugauuggggaagugauaaguguccaugaaaucuucacaauuuauguuuagagauugcaguaaagacaggcguaagaaauuauaaaaguauuaauuuggggaacuaauaaauguccaugaaaucuucacaauccauguucuucugccguggcuucagcuggucccuccguuuggggucccugacuucccgcaacacucuaugucauuagcagccacaggucuaaauccagaaaaauaaacguguaagcaaauaugaacauuuguguuagaccugugucacuccaguguggcccuaccagucccugaugucacguguauaugucuucuucccaugauuugaaagaauuuugguaauuacacauaauccagggacuuuuuccuugaauuauaaccucuuuuucuucugaggggguuuucagugcuuugggaguccuuuuuuuuguuuuguuuuguuuuguuuuguuuuuuaagagacagggucucacuguaucagccuggcaggagugcaguggaguagugaucaugguucacugccucaaccuccuggguucaagugauccucccacuucagccucuagaguagcugggacuacaggcacgugccaccaugccuggcuaauuuguuguuuuuuuguagaggugaggucuuacuguguugcccaggcuggucuugaacuccugggcucaaccaguccucgcaucucagcuucccacagugcugagauuauaggccugagccaccacaccuggccugggagucccucuugauuaaggucuuccuguuagucagaagcagcuucucugucagccucuuaaggaaaggcauuugugaggcccaguccuuaacuaagggugugaauacccucuacugguucccaacccgggcuacacagcaggaggugaguggucagcaagcauuaccgccugagcuccgccccgucagaucagcagcagcguuagauucucaaaggagcucaaacccaauugugaacugugcaugcgagggaucuagguuguguacuccuuaugaaaaucuaaugccuaaugaugugaggcagaacaguuugauccccaaaccauccaccucaccccuaccuacccuggccgugaaaaaauugacugcugcucuagaccuagagagugcuaccuccgccaugaaaacuucacuaacguuugggcaguugcacucaauaggucccuuuuuuuuuuuuuuuugagauggaguuuugcuuuuguugcccaggcuggagugcaauggugugaucuuggcucauugcacccuccgccuucuggguucaggugauucuccugccucagccucuuggguagcugggauugcaggugccccccaccacaccuggcuaauuuuuauauuuuuaguagagaugggauuucaccacguuggucaggcuggucucgagcuccugaccucaggugauccgccugccuuggccucccaaaucaugcugggauuacaggcaugagcugcuguacagggccuaauagcuuacuuucuaacuuuccugacaucuaccaugcaaauuguagccauacaggcugcucuguaagcugauuggccccugaugacucagucuuugugcucauaguuagguuuuucuucuccccuucaccuuaguuuucucauacucagauuccacagaacaagugagcacaggaacccugugacgauagaguccugcuugacguugaacuccuuuuucccagggcagacugauacuuccccucuugggcugagguguugugcaguguccacguugagguucagguccugucccucaccagaauaguaucuucuguauagacuuggucagacuuucuccacauucugugucagguuauugucaaauaagggauuucuccauuuccguagccaauacuuaccaauccugauugcguauugaaauuucuuggggagcuuacccaaaaaauuacugaugucugggcuccaggccaguuaaauucucuaggcauugauguaaaagaaaaaaaaaaccuuauuaaauuuguaauucauggucaaaaacuggcaguuagccuguuaacuguuuggcaagucaguagauacuugggcccacaugaguguccuuuauccugcagcccaucaggaucugggcacugaacugcaacucuuagugcagucaguacauccagugaagcagaagcauaucagaaccccuuggccacauguuuacaaggguagccucuguuauaaaagaccacagagagugucuuuuagaauugagugaaaccagagauuagugcauuuuuuauuccaaguuugauuucaguugagccauucagaaucugucacaguagauuuagccuugacugaugaagaucugagaacauacguuucauccucuuccugaccuuaugguuucauccugcaccuuggaaucauuuggaguuccuuccccauccccaggcuuuuugaaugugcuagaaaauguaucuaaaagaauuacuuauucagacaauguauaauauuauaaauguaacuucuauuuuauuaguuguaaugguugucacugguuaauaagagauaacauuuucuuuuacuuauauauugauuuuguaauguuuauguaaaucuuuuauaguaguaugaaccucguuuuaaaugagucagauuucaagugagagguguugcauggugaugugugcucaugaacgcugugcuuuccuuagcaguaauucucauuuuaaaacuaucauaaucccccaauuauggcguuuguggcauuguggaacuuuacugguaauuuguguuugauuuuuuuuuagucuaaaccaauuuuucuuuuauauacuuagguuuuuauguaugaaaaucuaauugaaaguuagaaaguuaucugaagccuucugcugauaaacuuuuaaauauuucauacauauucuuaggguucagguaucucucauuaaaagaauaguucgaugaguuguuuuauaguguuauuuaguaagaaagauaaaaaaaccuaagcauuugucaagagucauaauuuauuucugaaggaggaaaauaguuaauuuaauuuuauuaagaaaauuaucuauuuuguggauauuuagaaauauuguacaaaugcaaaaagaaauucaauuuaaaagauugauuuaaaguuacuguguaauaaguggauauauauugaauagaaauagauggcaucucuucuacuuaggaaggucagaaaaauaauuauaaaaacauauaauugagaauuagguaaauguuauaauuaaggugaauuauaaauuauugugaaauuuuugcaauuaaugaaauagagaauuauucaucuucucuuuuagguuguaaaggcauaugaucguguggagcaagaauggguugccauuaaaauaauaaagaacaagaaggcuuuucugaaucaagcacagauagaagugcgacuucuugagcucaugaacaaacaugacacugaaaugaaauacuacauagguaaacaaacaggcaaacagcgcagugugccccaacccacaccaaaacuuugaguuaaugguucuuuucuaucaaaauauuuugauuuuauuuuaaaguggcugauuaaaaauuuguuuauuucuguuggacagcaagauuuauauaagugacuugaucugguaguaauagucuaaaucuuggggaaugugccuuccauguagcauaccauguagaaacaaaugagaauaguguguguguguuuuuuauuugcaacuuacugguaccauuuguuugcuaauaaugaugcauguuuauccauagggucaucuuuccaguaacuuuaaccauuucuaaucuagcucagaaacuaguugugagcuaguauguucuuagugguuguggaaccauuuuuggggcaucugcaacaagaucucaggcuccuccccagucucuucaucagcuuggcagcauuagaagcuauuagauuuacaacuacagaaaagagauaauagccacugcuuauugaauuucuaccacauuccuuaugcuuuucuuccaucaucuguaauaauuuauagcagucuuauaaggaagaugguagaauccuuaaguuaugguugguuuguauaagaagccccauacccagggucauagggcucugcagcuaagauuggaagcugccguacuucugccuacuccaaagucuguuucauucucacauagucuuccuucugaaaacagaaauaggagacagaagaauuaugacaauacugaagucuagggccauuugauacaugggcaaaauaucuucuaguacaccuucuuucgcaguauuuuuuaaucaaaucuaauaugucagugauuguaagacaccaucauuuuauguaccgucaaggaaaaaacuguuaaguauucauauaagaugccaucaaucgaagauacagaccuuaagaucagcacagagccauagucacuuguguucagaaacacugaccuuauuugauacacguaaggcugaguuuuauuuaacagaucuuuuaagaaaacguuaugauucuuugguccaccccaaaaagguagaaacaaauaauggaucuuuaaaaggggcaagcuucagauuguuuagauuuuguuugugaaauacuucucauuccucauuauuaaaauauaaaaugaguuucuauuaauuuuucuuaguuucuuuauagauacugauauaauucauaauaauaccauucuuaucuuaaaaccuugucacacacaaugaaacuuugcuguucacugucaguuauaacuuacaugaggugacccauuuccauucaaggguuuuagaagcacaucaaggacauucuaaggaugauugacuuacacaaugaucucugaacaugccuccugccuucuccucacucuugaguauuugcuuaggggagcagaaaaaauacugguagcauuacuguaacauuuuaauucugcuuuauuuaaaaaagacauagcuggcauauaguuaaguacugaaaaauguuagcuacucaguuauguauaaugcuaguauuuuguuuugaauaaaguugacauuaaugaucauauuauuaauuguauuaguuauuacagauacucuuuggaugaguuuuuaaauucuuauuucagaagauggugaaugcauaacgucucaagaaacugagauucuguuuggaaaacaaaagaacuuuagauuagacaaguucauaucaauugaauugauaccuuaaacuuaagguauccgaaagucauauugauuuuuaugauguaaauuaguuuuaaagugauugaugagucugauuuauucugaugaguuuuauugucuugucuuugaacuuuaaaaaacaucuacuucuuuacuguguagccaaauuucuuaucuggauuauuugguaccugccauggucuaguuaaaagaaaauuuaguugaagucuucaacaaagucuugccagcccuccauucuccccaaaauuugguuaaaaagacugaacaaauaugcuuguuugagcuuucuuugacaaugucuuuagugcucagcacacuguagauacuaaguaaaugaauaaagaauugugaggucaagugaaacuaaguagaucuuucauuggacgaacauugugaucacagagcuucuuaaaggaauuuuuauaaucacauuagaauucugacagcaguuacuuuuugcauucauuuaguggcaccugcuuaaccaggagauuaaaagccauccacagaccaugauugugagguaucauggaacuauguuuuuaguuuuaaaccuauaaacugaagugacuaagagcagauauuuuacauucuuagguaacauuuaaggauuccuuuuguuauuuuuaguaucgaguugugcuguagacuccuauauagccauguaguuauuuuuauuguguuacuuauucuaacuuuagaucaccuauaccaugaaagaucuaaaagcaauauugauguucacugcuuugaggcaggcagcccaggacuauucccaggaaaacacaauguauccacaguucuuagugaucagacauugauuacuaucaguuuauuccagauagaucuguagagaaaccucucauuuuguaauacuauaagauaaaaugaaaaucaccuugacagauggguguuuuaugucauugcaguuguguuacaggugcucaguuugguauauauaagacuuaacagggagggacagcacuuuaucgaauaaccucaucugaugugacgucaguguuaauaguuaaagcacaaucuuugaggcaauuuagugaguauucagccuuuuuagagggucaacagugauagcgaccuauguauucuaugcuguuuccccacucacaagccuccuuaucaucucuucuuguagcugagcuuuauuuugaaguuuuccaaaccuucagucucacacaagaguugucacuuaccaauuugauaaacacaguuaaguccuccaauacuuuuaccaaagcaugauuuucagacauuuguuguauuugccuaaaggguaaaaaaaaaaaaggcuaucaaugaaaauugugacagaaaauuaccagugaaaucuaaaguucagcagugcagauacauuucaaagccuacacagagggcugccaacuacagcauugucacaaaccagagaucccaguagguggagcuuagacauaggaaguugugagguagggcucucgggaaguaaaaagugcuuucuuuuauaaaugaagauaaaauugcugaaauauucucacugcuguuuguccauuugguccuuauguuuucagaucugacuuuuagagaaacaaggcauuuugguagcacugcuuaccuuauaucacuuaccgacauaugcuguaccuguuuaauucagcagaagagcaacuuagauauucuuaacugauugaaaacugcuguuauuacaaaaugcugaucuccaaacuuuaacugaacucugcguuugauguaauaauguuauagaacauuugagagugcauguguuuguuacucucaguuuauugguauauauaauuuaaaaugaaacuguuuucucuuucagugcauuugaaacgccacuuuauguuucgaaaccaucucuguuuaguuuuugaaaugcuguccuacaaccucuaugacuugcugagaaacaccaauuuccgaggggucucuuugaaccuaacacgaaaguuugcgcaacagaugugcacugcacugcuuuuccuugcgacuccagaacuuaguaucauucacugugaucuaaaaccugaaaauauccuucuuuguaaccccaaacgcagugcaaucaagauaguugacuuuggcaguucuugucaguuggggcagaggguaaguauuauuucagaacuugugaauuaaauagaaauuaaauagaaguagguaggacaguguagguauuagguuggcgcaaaaguaauugcgguuuucgccauugcaguugcuguuuuugcaguggcaaaaaccgcaauuacuuuugcgccaaccuaauagauauuugaaauguuaauaagguguauaccauuuagaggcaauuacaggaugcuuauuuaucuuuaaaauguagcacuuaauuaccuuguguugauaucuauuuuggggaaauaccuuuuaaaaugcaaauagcaauacuuugagucaaaagacauugauuuuuuugaaauggguauauuuaaaauuguauguaugcuaaaagauuaagggagagaauaggagauggaaugauuaaauauuaggggauuuguaacuauauuucccaaguaaagguuuuaguauaaauuuugggacuuuccaguacuagaacauugaaucuuugcuguaaaauacuucucugaagauggaucaagauaaaucuuuuuucucaaaaacugaugguucaaaaaaaugcagguaauuuugcauuagucaugguauaaguauagaaaauucaguugauagacuuacuuguuuugauaaauaaguuugucuuauuuuccccacucuuauuuaaaauuuacauaaauucugacacauauccaagcugguuuuuuucagacugcuaaaaacagauguguucguagugcugauaaguuuagcugauuuaggaaagcaguuuuuuccugucauucuuccagcauuaugaaaacuacucuaacagcauuguuuuauguauaaaauagaagugauaggggucuccucuugaaaggaauuagugucaccauuugauaauauuuuacucauuuuaagcacuauucuuuuugcuuuaaguauugaaacuauauuucuucuguuuuaaagaaacccggcuaacauacagauguuaauuuuucuuacugacuuuucuguuucuuauuuuuccaaauuagugaaauuuucugucccguccuacuuuuguccagguuuuaacuauaacagauuaauuuaaucauaaggauuuauagccaauuaauaggacugucuuuuuguuauuuucugcaacuucucaugguagugaggcuaucaaauguuaaaguaauuuuuaaaaauuggaguagggagcaaaguuugcaguuuuagaugccuucaaaaaaucaagagaugcucguaguuaauaugugguagaguauauugugaaugaaaaauacaugcccaucuugacaguaauuugaauagauuauagaguugggaaaauuucccccuauuuaagccaaauuauguauuuuguccuaauauuaaacauuauuauuucugucuagccaaaaugagccaguuaucccuacaauaaguuuuuaacuauucaaguucauuggcaucacaugggaaguuauuucuaaaauagaccugcagugguccugccccuagaucuguuggauuagaaucagaaggugguagggcaaguguguuuuggggaaagcaacugcuuuaaacaaauuagauagggaggugacaaaguucuuggcauaagcugugaaauaaaagucucaggaguggugaguguuugggccuagggaguuaacaaugguauuggcuuauaaaaaccauggaaauguaauacuucuucccaguucuuuuaaauuagacuuucuucucauaguuccuuaagguugguugaccuaccuguggaggccugagauuguucucgaagacuuggcuggagguuucagugggaaccacagaaaauuucaugagcuuucuggcugcaugguuuggguguuaggaaauuuaguuaggauuuuauuucuuuuccacuuuuaauaagugaaacaaauuggucucugaagacauccuaacauuacuucauugaaaauaguccauuucaggauugucuuucuauaagaagucuuggauggagguagagagagaagaugagagaagaagcuauuggucagagacagcucucaauugaaucuuuauguggcaguguuucugggauuuaucugugagacagcaagaguacaaauaucugaauuuuaaauuauauuauauugaaguuacuugacuuuuaacgcugagaaauacauuguuuggguuaauuuaaauacuauuuaguuguaaaguuagugguaaacuaagugccagccauaguaggaagaaauaauuauuagggaaauacauugcuuucaauaguguuuuuuuuuuccuagugaggcauaauuguuuuaagaaauaucaugaugacuagguaggauuagacuaaaugaaagggcuugaaucuuuacguauuaugcauuucacagucagauuaaccaaucccucaaaauguuuaguucuuuaagccguauucguagucuaauguugaaguuaaucaauggaacccuaauucaggaauuagccaauucuuuucuguuaauaucagaucaauguuuuuaauccaaugcugacugcaguuuuaagcaauugaaguaauacuauuuugaaauauauuucagauauaccaguauauucagagucgcuuuuaucggucuccagaggugcuacugggaaugccuuaugaccuugccauugauauguggucccucggguguauuuugguugaaaugcacacuggagaaccucuguucaguggugccaaugagguaaaugauguauugcuuuacaaauucuguuuucauaauuucuuuuugucuuucaucugugacaguguaauuuaaaaguuguuuuuaggcaaagaugucuacuuaaucauucaaaugugaggucaguuugaauauaccuauuuuucauauuugucaguugucauguaaguuuagaauuaugagauaggaguaggauauuuuaaucuacucaugaaggagaacaguuagaaaguguuaaguauuuuggcauacauuuuacagguuuuaaauacaauacagaaagcuuaaagaugauaaagaaugaaggccauccugaagagugauacaaacaucacucuaaauuuugagauuaugauuuggaguugaagaguaaugaucaguaggacugauggauacucagucugaauaauguagaguaaacgagauuauagacuuguagggcuacagagacugugugcaguucugaagucuacagguuuucagucuguguucuggaagauuuuucaaggucagaggcagugaaugggagggcagggacaggccuuaacuucccugcagucagagaaauuagacuuucauuguuuuaaaaacuacaccugugggguuuuguuuguuuuuuaaaagaaaaauugacaauuugcacgucuugaucagucuauuuauaaaugagaagagaaaggccaaaggcauuaaugacuuguaccggauuacacagcuguuaauagguggugucagaaacuuguuucuuccauccuuccuuuuaauucuucuuuuuuuuuuuuuuuuuuuuucccggagauggagucuugcucugucacucaggcuggaguauaguggggcaaucuuggcucccgaguagcuggaauuacaggcaagcgccacuaugccuggcuaauauuuggauuuuuacuagaguugauguuucaccauguuggccaggcugcucucgaacuccugaccucaaguggucugcccgucucagccucccaaagugcugagauuacaggcgugagccacugugcccagccccuuuuaauucauuucaacuugaacuggugagcuacucuuuuauaguaacugucauaguuuguuuuuuuuuuuaguauaaaucuuacuguguaaauuaguaucuuucuugggcuuaaacaauauuaaaaaaacuuugccauguuacucauuguaaaggccgagguccuuugaguaacccacagauuccuacuuccucugaugccaguucucucaccaccaccuggucucuccuucuccccucacucuguggucccuugaaaacgccagcuacaggcccauagcccuuuguauuucuuccuuccugugccuaaaaugcucuuuucugagauacuccuuugcugauguuaguguuugcucugaugucacauucucggugaaaccauauaccccacuuacgguugcaguaccccuucuccucaucccauaguucuuagccagcaucugacaucauguauuuaauuauuuauugauaaugccgggcgcaguggcucacaccuguagucgcagcacuuugggaggcugaagcaggcagaucacuugaggucaggaguucgagacuggcccugccaauauggugaaaccccgucucuacuaaaaauagaaaaauuagccuagugugguguugcgugccuguaaucccaguuacuugggaggcugaggcaggagaauggcuugaacccaggaggcagagcuugcagugagccgagaucacgccacugcccucuagcuugggagacagaacaagacuccauuaaaaaaaaaaaaaaauuguguguuuguguguauauguauuugcugucuucccacuauaacauaaacuucuuuuuggcaggaauuuuuauguuuuguuuauuauuuucuaccacugaauaugguuccuagcauauaauaggcacacucauuuaaaguacuuaaaaaaguacuuuauuagguccauacuuuauuaagccucugggauuuugugugugugugugugugugugugugugugugugugugugugugugugugguuauuuaacaugcucugaaaacuggguugggugccguaccucacgccuguaaucccagcacuuugggaggucaaggugggaggauugcuuuaucccaggaguuugagacuagcauaggcaacaugguaaaaccccaucuccacaaaaacuuuuaaaaauuagcugggcauggggccgggcacgguggcucacaccuguaaucccagcacuuugggaggccaagguggacagaucauuugaggucaagaguuuaagaccagucugaccaacauggugaaacccugucucuacugaaaaauaugccuguagucccaguuacucaggaggcugaggcaggagaauugccugaaccugggagguggagguugcagugagccgagauugcgccaccgcacuucagcuugggugacagagcgagacuccaucuaaaaaacaaauagccgggcauggugguacaugccuguagucccagcuacucaggaagcugaggugagaggaucacuugagccugggaggaggucaaggcugcagugagcucugagugcaccacuguacuccagccugggugacagagacccugucucaaaaauaaguaaauaaaaaaaauuuuuuuaauaaaauucucccaaaacagaaacuuuaaaacuuccucucaucuuuccuuacuguucaacauuguauccauggcuaccugacauaauauguuuguuaauugacugucuucccuucugugggguauuugacucaaggaagguagggccuuucuuguguuuguucauuacuguaugcuggaugucuagaggagugccagacacacaggaggugugcaauuuauuuaugaaugaaugacuugaugagcaggaguagauguacaguagaaauuacagguuuuguuguuuuuauuuuuaauacagguagaucagaugaauaaaauaguggaaguucuggguauuccaccugcucauauucuugaccaagcaccaaaagcaagaaaguucuuugagaaguugccagauggcacuuggaacuuaaagaagaccaaagauggaaaacggguaaaauaaggauauaucuguuuugagccuuuauuaaauuucuuuaucauaccugucuuuuuauagcucauuuugcauuuacuugaaaucaguguguuucaguuaacgauuuuauugauaccuuacauagauauuuuguucagaaguugaguauaguuugaccugaacuaucagguauggaccaguguuugauuaauggucagaguuaucuuuaaaacuucauauuaaaaacuguaugccugcauuuugaggcagcugaucacaucaccauacuugguuucaacaguagaauuaauaaauuugaucuuuguuucucacagcuugggcauguaaugaggucacaguuaauacugcagcugugaacagaagucacaauuggaguaaaugauuuuuuuuuuuuaaguucaguugguaaauuaugucagaagaugauuuuuggcuuaaguaguaugugauuuuuuuccaaggauauuaacugacuagaugguccuuugauagacuucagauuccuagcucauugacuuggauagcaaaaauuucacaucuccaaaaucuuuuaaagugagguuuuuaaaacauuugguuuguuuuaguaauuuucuuuuaucugaggacuuuuuaaaagauaccuaaacuaugucaguuuaauagaguaaaugaugccaauuuugcaucuugauuuuuuacuuuuguuuuauagaucuguaaauaaucauguuuuguaauuuacuuugguccuaguauugaaugaauguaauguauaaauaugugauugaauaugacccccacacacacauguacauacagaagucaccuugagaucauaguuuugcauuuuauaacauuuaagaguuuauuuuuguuucaguuauuauuuugccuuguauuuuagcggacgcugccaccaggugucauuuucagugaacugaagaugaugguugaucgccuuaauucaccuccacacagcuauggagucauaacuuuuaauaucagaugauuuucuuuuagaauauuuaaaagcacauacguaguuguaucuuucaaaacugauuuguaaguucuuguguucugccauauucacuaaagcuauaggcagugcaguuuccagcugcuaaauuaugccuauuccccauaaggaaaggauggaaaaugccaucgagaccuccugggcucuuguuuuuucuuuacccacauagcucauuaaucguggcccauuuuccauguaaccaaaaacuuagucugggaauccuuacuagcuucaccagcauuuaaaggcguuccuaccaguuugaauuagcauggagaggaaauuaaaucuuuuuuauguugucucucucugugauacaggcugcugcuuucuccauuucagauugauuuauuuauauuuugcuucugcuauuuuuuuuccucaauaaaacaucccauuccaucuccuaaaucucugccuuacaaaaaccacagugaccuaucauuucuuucaaauugaucuauagguauuacuauuuuuaguuauuuggggugggggcauuucagaaaugaguagauugucuuuucccuuuuaaaauuggaaguggauaucuuaacauacauuuaauacaugugaauuaacuagauuuuuaugagauuuauuuuagucgcacuuagcaauugacuuaagcaacuuaauuuuuaaaaauaugaaauaauuauuuugcuuuuaagagauaaauuuuguaacaaaaagucaaauucauaaucaaauaauuacauuacaaaugguacacuaagaauuuugacuagagauacaaauagaugugcauauacuuucauuggcuaucucuuugugguuuguuuacugauuuuauuuuuacuuuuaauuuuucauuuuacauuucaaaagccccauauuaggguuuuccaauaaugaaauaaauacuauauauuuuuuuccugguggaggugcagaaugaagaagacaauaaaugaugcuuuuuuugaaguacaguuuauauaagauacauauuuuaaguguugaguuuguuuucaccuuuguguacagcagugucccccaucuaaaccaauaugaaagauuucuaucauuccaaauccucuugugaccuuuucuguuaucccacuacuuucugauuucuaucaucaaagacuagcuuugcuuuuucauuggcaaacuuaguauaauuggagccuuauaguauuuauuguuuaguuuuggguuuucuucacucagcaaauguauuguuuuuggaaaaucaucaauauuguaugucucaggaauuaauuuuuuuuuauugcuucaacauauuucauugaaugaacaugccauaauuuauauucaccugucaguggucauuugguuuguucccaguuugggacuauuaugaauaaggcugcagggaacagucuuuuauacauauguuuucaucucucugacagcacagucuaagaguagaauugccaggucaugggguauguguuuaccuucacaagaaaacaccaguucuccaaaguuguuuuauuuuauauucccaugauguaugaggguuccaguugcgugacauccucaccauuuuguaugguuugucuguuggguuuuagccauucuguaguggauauguagugguuugcauuugcauuucuucauggcuaauaccaccuuuucauaugcuuauuagccuuucauacauauucuuugucacaggucuuucccaucuuuugcuuguguuacuggguuguuuaauaauugaguaguccuuugucauuaaguuuuuugucacauguaugucaguguauuucccuagacuguggcuuugccuuuuccuuucuuaauaugguaucuuuugaugaauagggaguuuuaauauugaugaaguuguauuugucaacuuuuuuuguuugguacuuuuuuuauccugaaaaaucuuugccaucuccaaguuugugaagauauucuguguuuucuucuaaaaguuuuuuauuuuuauuuuuuagucugcuuuuacaguuaggauucugugguccaucuugaauuaauuuuugagcguggaacagggugaagggguugaaguucauuuucuuccauaugcuuaccuaguaguuacagcagcauuugcugaaagcaauuacuuuacccuguugauauguuuucuauucuagguccuuucuuuucacauauggauuuuuagaaucagcuuguaaauuucuaccaaaaaaauggugcuagcauuuugauuuggguugcaguugggauugcauucaggaaaauggacaucuuaacaauauuaagucuuccacucuguaaagauggguuaucucuccauuuauuuagggcuuaaaaucucucagcaguguuuuauaguuuuuaaugcagaagucuuacauauuuuguucacuuuauuccuuaguuuuuaauuuuuuagaugcuauuuuaaauggcauuuaaaauguauaauuucauaauuuuucauuuuugguauacagaaauacaacugauuuuuguauauugauuuuguauccuaagaccuugcuaaauucaccuauucuaguacaguugacccuugaacaauacagguuugaacugcacagguccacuuguaugcacauuuuuuucugacaaauagagucagcccucuguaucugaagguuccacaucugcagucaaauguggaucaaaaauacaguauucccuggaugugaaaccuguguaugagggccaacuuuucacauauguggguuccgcauggccuccuuguggagcuugaguauguguggauuucagcauauuuggggggguccuggaaccaacccccugcguauacugagggaugacuguauuuuuguuguugaaauuugauagggcuuuguacuuaaacagucuuaaugcuccaugaaugaagacaguuuuguuuuuucaacuguaugucuuuuuugcuuuuuuaauaucaugaguggguuuugaauauugucauguuuuuucugcacguauagagaucaucauaugauuuuucuccuguuuugugguaaaaugcauuaauuuuuugaauguuaagccccacccugugauaaccuacacuuggccuugauauacuauucccuuauauauauugcucaguucaauuugcuaaucucuugguaaggaauuuuguuucuaugucauuaauggauauuugcauaacauuuuauuaauaaaaccaucauugggguuugauuuuaggauugugcuggacuugugaaacuauuaggaaauauuuuuucuugauuuucugaaaaaauuuguauaugauugguuggcauuauuucuuuugugauguuuaguagaggucauugaugaaaccuucagaaccugcgacauuuuuuguuagaagguuauuuaauuauaauuuauguuuuuugaugaaaauaugguuauccaaauuuuuuuuaaguuaguuuugguaaguuguaucuuucaagaaacuuuucuuucucaucuaaauuguugaauuuguuggcguaaacuuaucaauaauauuuuacuauaauuuuuuuuuaauaucuagagaaucuguagugauagucucucuuuuauuccugauauuggccauuuguacuuucuguuuuuuccgcaaguagucuugccucaggguugaucaaguuuauuaaucuuugcagacaaccagcuuuugacuuuguugauuucuuuuuuuuuucuuuucuuuuucuauucuugaucuaguuucuauucuguuuuuugcucuucauuauguccauuuacuuggguugaauuuacuccuuuuccagcuucuuaaagguggaaacuagaucauuaauuuuuaagccucuuugcuacuauagaauuuaaugguauaaauuucccuccaagcacugcuuuagcugcauucugcagcuuuuuauauguuuuuuuuguuguuguugguuuuuuuuuuuuuuuuuuuuuuuaagacggagucucgcucuguugccaggcuggagugcaguggugugaucucggcucacugcaacuuccgccucccagggucaagcaacucuccugccucaaccucccaaguagcugggacuacaggcacccaccaccacacccagcuaauuuuuguauuuuuaguagagacgggguuucaccauaugaccaggauggucuugaucucuuaaccucgugacccaccugccuuguccucccaaagugcugggguuacaggcaugagccaccacacccggccacuuuuuauauguuuuaacagucauucugaaauguuucuaacuugugauuucuucuuuaaccugucauuagaauuuuguuacauaauuucaaaauauuugaggauuuucuagaugucuuauugaguucuaguuuaguagcaguuuggucacagaacgugauuuuaguccuuuaaaaucgagacuuguuuuauggccuagcaucuaaugugucuuugugaauguuuuaugugugcuugauaagaauuguauuuuguguuuguuuggcguaguggucuccagcuaucaauguagaucaaauuguuugauauuuuucuucauaucuuuuauaucuuuguguguauuuguguauauucugucaguaauugagagaagagucuucauugauaaguuuggauuugucuuagacucccuuuguaacauugcuuuaugguuuuugaagcuuuguuaauagguauaugcauguuugauauuguuacgacuuauugauaaauugacccuuuuaucauccugaaaugucccucuuugucucuagucauguuugucuuuaagucugcuuuguccgauaucacuauagucuuaccaguguucuuauucuugauauuuucaugguguguguguguagauaugaaagauaugaagaaaaauaugcaacauguguagacacacacacacacacuuuuacccuuuuacuguaaaccugugccuaccuuuauauuuaaagaauuauuuuuguguugugugcaacauaugaucaagucguuuuuuuaaucuagucuguuagugguuaacccauuauucagaguuuuggguuuaagacuugucuuauuuguguucuguuugucuuuccuguucuuuguuuccuauuccuucuuuccugccuuuugcggggagguuuguugaauacuuuuuggcauuuuauuuuaucucuuguacugauuuuuuuacuuauuccucuaugugucauguuuaguguuccuuuuauaauaugcacguuuaacauuaguuuaccuucaaauaauaauauauugcuuguuaaacagugugauaaccaugugauucuaucuaccucuugugcacuuguuguauuacuuuugcauguuauaaaccucacaacacauuguuggcuguuuaaauaaaaaauagauuuaacacaaaaaagaaauuuaaaaagacauaaaauaaggauaauagaucuuuuauauuuauccuuauauuugcucuuuucugguguuauucauuccuuuuugcaauuccuagcuuccaucugguauuauuucuucagccucaagaccuuccuuuaacuuuuauuuuguaaugaauaagcuaucccgauaaauucucucagcagguguugaucugaaaauacuuguuuaccuuuauuuuuuggaagauauuuucagugaauauagaauuauagauuaacuucuuucuuucagugaaagaaaaagauguuacgauauagcuuaaagauguauugacuuuuuuucuggauuacacuguuucgguagagaagucagugguuauucuuagcauuguuccccugcauauaauauuuucccccucuucccucuggcugauuuuaauauuuucucuuuguuugauuuccgcaguuugacuauuuaccuagguaugauuuucuuuguauuuuuucuccugggaguucacugaguuucuuggaucuguggguugaucucuaucaucaguuuuugaaaauccucagauacagucuugccaaauauuuguucugcuuucgucuuucuucuaguucuccagugauguguauguuacagugcugaauauuaucccagaggucucugucugguuuauucauucuguuuucuguuuguguuuuuaauuuggauaauuucuuuuucugucuucuuguucacugauuucuuuuuuuuccuugugcugaguccagucuguuguugaauccauuaaauggauucaugugauguuauuguuauuuuugagacagguucucacucugucacccaggcuagagugcaauggugugaucauggcugauuacagccuugacuuccuuggcucaagcaguucuucuaccucagccucccaagaagcucggacuacaggaguggugcaaccaccauacccagcuauuaaaauuuuuuguaggaacggggucuggcuauguugccuuggcuggucuugaacuccuggacucaagcagucuucccaccucaaccuggguguagagacaugagcccagccuauauuuuuuaguucuagcauuucuauuuuguuuuaaauauaguuuuucucuucugaaauucuacaucuauucauauguuguccacuuuugaacuaaauuguuuaucauaauuuaucagaaguaauuuaucauaauuauuuuaaaguuccagucugcuauuuucaacaucugcaccauuuauuuauguguaucuucuauuggguuuuuuucuuucaugugauuguggacgucauuuuuaaaaaauguuuguaauuuuuaaaugugugacaaauuuucuuugcuuaagaacaguuaaagauggaagugagucauauuuucccucagaaagaggccucucaacucugucaggccccucauguggggcugaguugaucucuuuuguagcuuagcugacucugggcuuugcuuguuugacuuagauucuacuccccacuguuuucauauguuuugagcugggaucaggacauucccuucagcaguguuugugucuuuagaaucagggaaaaucuaguggucucuauacauuacugcccagucagcagccccacuccuaacucucugugccugggagaucgccuuccuccugcuguacugccccauccuucugucuguccacuccuggccgucagaaguugguucagacuugggcuggagucuucucgcucaucuguggcuuacuugcgccuucucccacugcaggucucuuccaggagaggcuuuucauuuuguagaauucaggagauuuuuguuccaacuuuggauccucauacagcucucugaugggucuuuaaaaggcagugauuuuaugacuuauuagaggaggaacaaucaucucacacauuucugcauuguaacagaagucaaagucuggugaugcuauucuuaaauucaauauuuauagagaucuugaggguuauaguauuaucugucaaaaaugaguuuucaggaaaucucaacacacguuaguuuauuauuacauagauuuucuaaagggaagcauacauaauuuucucuuuuucuaccaugagcagguaggguuaggccagugccuuuuuauguagaacauccuuggugucauugccauagcuuucuugggcugcuguugcugaaggaaguguaacaggugcugcgggugcacaguuagguaggaaagaggcucccagccagggugagcaggggcaugcauguucucuguaaaagaugagagaaaaugcuuuuagccuuguggaccucuguugcauauuuuuuguuuuugguugcuuguuuuuacaaccuuugaaaacagaaaaaccauuuguagcuggagcuguagaaaaccaggcucuggaucaggccauaguuuacugaccccugggcuaaaugaucuuuauagccauuuuuggucucagaauuaauguugaacuguaacuaccaugcauuugggauaguaaugugugaaaaggcagaggauuuaacuaugaaguguccuuuuuaauaaaggccucaacauauauauuuaaacauauuugaaauucaauuaugugaguguuuacguauuccaccaaauuuagagaaagccuuucaucuucucucuuacaggaguacaaaccaccaggaacccguaaacuucauaacauucuuggaguggaaacaggaggaccuggugggcgacgugcuggggagucaggucauacggucgcugacuacuugaaguucaaagaccucauuuuaaggaugcuugauuaugaccccaaaacucgaauucaaccuuauuaugcucugcagcacaguuucuucaagaaaacagcugaugaagguacaaauacaaguaauaguguaucuacaagccccgccauggagcagucucagucuucgggcaccaccuccaguacaucgucaagcucaggucugugcugcugcgguuagauuaggcuugggaauguuuuguguuuucuuuaugaagugggauuauuuuaaaguguugauuaaauuuguuaauagaguggggagcaguuacuuuacuuaaaucuguucuuuguaguuaguaguaaauucaucucccccaaagcuccaauauuuaguuacgcauguaauaaaaucugcuuggcaguuggaaaucuguuuacuaaccagcauuuuaaauuacuucuuaaauggaauuuuuguccacauugcuugaguuuuccccuaccuuaaccagacuucauuguauuuuaguuaagugguggacgagagagaaccugguuuuagucagagaauaugaagacuuugugauauacuuucaaguuaauauuagagauuuuguaugugugugugugaguacuuucaguuuuaaugguauagcuucagaguauaaauuugaacaaaaugaauuuuaaacucacaguuguauuguuuuguguugugauauuucagguggcucaucggggacaagcaacagugggagagcccggucggauccgacgcaccagcaucggcacaguggugggcacuucacagcugccgugcaggccauggacugcgagacacacaguccccaggugagcucgcacgugguucauuugcuugugucaccugccauucucagguggagcagcacuggaugccaggugccuuuagaaugaccguaucauuuacccuagagguucaugacguuccugucuaaggaaauguaaguauuuaucauagagaagcacauucuugcaguuuuccuccuccuugucuagaaguggcuaacacuuauugggggcauaacaguuguuguuuugaacaguuuuuuuccuguguuuaucucauuuaccaaagcagcguuuugagccucaugcuuuuuugauucccauuuuacaguggaaacugagacuucaugggcuaaguaaauuucccugggucaugaucugaaugacucgacucugcuuccucccaugauuuuuuagcauuuauaguccuggauucugaaucaauuucugauuugauuuuagccuuuuuguuguuguuuuguuuguuuucuguuuuuaaaccuguugaagaggaucuaauuaaguacuuuuucaaaauuggagugaagcagauggugaugguaaaaauauuuaaauaaucuaauaaaguuguaaguugguucauaccgaguuuugcgugaugguguuugaaggugagaggccaguguaguauuugauggaugaguaaacugcuguugauuaagagugcucuccauucuugugacuagggcagcugaauggugcuggagaaaaucccacaugcagcuguuugucagcacuguuaauacucaccaaccucugcugggcagucuuacauguuuuccaaguugucccauccucuccuauucucuuuaauaauaguuucaaacuuuucuacucuuagaaaccuuugcccuccccuucucuguucuuacccacucuuugcuuuguaaggaaaagagucuucagacaggaacucucuccacuuuguaacauugaauacaugauccugccuaugugugcacuguccacuucuccucuaccccuuuuuuguuagaagcaguguguuucuuucugccuaaggccaagcccacucauugcccugauccccucucuccugccaucaugggggcuuugcccuuuggucucccucagcuccggugucuucacucucuccucuuuuggcuuuuucuguugaucagcauuuccucauccucaggccucucccaucuuaagcagcaccuuugcgugucccccuuucuuucccuauacuucugcuaccuguggucuuugucucuuuacccugaagaccucuuugcuuguuccacuuagguccugcccuccaacucuccugccggugucagcggugaccuuuauucauggguccaguggacacccuaaugcugucuuucugcauucuacaacuucauuuggcaguguugacuuuuccccacucuuugaaacacucacugcugguuuccuuggcaggauguucuucuuucccuccccccaccccuuuucuuugcccuuuccuucacugucuguuucguuuuuuuucuucuacccagcacugaaaccuggguguuccucgaggcaugaccugugucccuucccuacuccgcuuaauguuuccuggaugauuucagccacaccugccagggccugcagucaccauccucaugcuaguugcuccuaagucuugacuucugacuuagacuucacuucugaaccccuggggccuuucuaauuguuuacuauaaaugucaccuugaaagucucaacaauaugugcacacacagcacauaaacugaagucaucauuuucacuuccuucccaacgcuucuacuuuugccauucuuuguaaaaauggcccuaaauuuacccauuugcucaaguuguaaauuugggggcacuccucucucccucuuuccccacacugaaucagacaguaaauuaucuggauucaccacaucuuaauacguuuuuauucuccaccuuucacuuuaccucauuguuaugacuugucuuauuagaauggagugucucauuccauucaccugucagcaccauucucuucccugcagccaagugagcuuucacuaaaguggucuguucuugcuauuuucccuacuuuuuuucuccccugcugagacggagucuugcucugucgcccaggcugggguggaauggaacaaucucugcucauugcaacuuccgccucccugguucaagcgagucuccugccucagccuccugaguagcugggauuacagacgcacaucaccaugcuggcuaauuuuuguauuuguaguagagacgggguuuugccacguuggccaggcuggucaugaacucccgaccucagguuaucuggccaucucggccucccaaaguguggggauuacaggcaugagccacugcaccuggccuguuuuccuuacuuuaaaccaguuuugacuugcccuucuaccugaagugaaauguagacuuauuaucaaggcgucggugcuuuccaggaucugguccccaccgaggccauucuuucuccucuucacucacccuagucacacuaauucauuuuucacuuuguguaauaugccacauucucucuuacuuuucuuacauuuccugugcucucagccuggaacacucuuuuccuccuccuuuuguuuugguaacuacuauuuaugcuucaggucuuaaguaucacuacucccaggggcucucucuaaaucuuuagaccauccgccugucuugucuucuucccuuucuuucuuccagaucuauuccauaccgcaaacacauacaagaguagcauaagacaccgcguucuucccaccuggauuucacagaggucaagauuuugcuucaaauccuuuuuuguuacuuaauuuuugagugguugauauagucacaugguuuuaaaaauaaguaaauauaaaagggaauucagcgaaagguuuuccuuccuuccaugccuucuagccccucaauuucuaaaccaguguuauuaguuuauuaguuuuuuguauacuuuuugagauauuuuauacauauucaagcaaauacaaauacauauucuucauccacccuuuguacacaaauaguaccauaccaggcaaacgcuuucagaacaucuugguuuuucuagucuugacauauauuuuggagcacuuucuguauaucaguaaauagagagcuuuuucauucuuuuauuuauuugcacaguaucccguuguuuagauauuccauaagucuuuucaccauuccccuauuguuuguuuauucauuuuuaaauuuauuuuuagagcuagggucuugcucuuuagcccaggcuggagugcacucgugucaucacagcucacugcagccuugagcaccugggcucaagugauccucccaccccagccuccugaguaacuaggccuaugauugugucccagcacacccugcagugaggucucacuauguuucucaggcuggucuugaacuccugggcugaagugauccucccaccucagccuuccaaacugcugggauuaccgaugugagccgucuuggccaccgguccccuauuuauuaauggacauuuaguucauuuccaaccuuuuuuacuauuuacaaaugguaguuuaauaaauaacccuguacgguagugucccuucuuauccacaguuccaguuauucagucagucacgguccaaaaauauaaaguggaaaauuucagaagcaauucguaaguuuuaaauucuguuaugaguagcacgaugaaaucucaugcugucccacccugggcaugacucaucccuucgucuagcauguccacacaguagauaaguuacuuugcuuuguagccaucuagauuaucagaucaaaaaacauaguauauagaggguuuaguccucugcaguuucaggcauccaguggggaucuuggacuguaucucuuguggauaaggaggcaccacuguacaugucucauucacacauagacauuuuaucugugauauaaauuccugaaagcagaaugacuguuucaaaggguaaugugauuuauaauuuugauaacuauugccagauugccccccaugugauuuucuaauccaguaacuugauuaacuucauauaaaaaccauauaguauuuucugagaacucacugccagcuuuucuacugauuguuuucaguaguaucucuuaaaaguuugguucucagaccaccuuuguugaauaaacccuuaacaauuugugccagccacuggauagagacugagccuuuugccuuccuagagcuuacagugacacaaguaaauaaaaugaacaugaagaaaaauggcaaguagcauuagcuguuaaaaagaaaauaaggauaauuugguagagaaagacuguuuguuggauaggauguauuaauuagaauaggccaaacucugauauaacagacccccaaaauaugguagcuuaaagaguaccaaguuuccuucauuuuugugcaacaguccagaauagguguucagguuaguggcuaggccgucuuccagguccugaucuccuaccaucuugugguuccaccuugcccuagggccuacuugucuacuguguccagcaggcagaaggacuugggagguauuaucuugugugccaggcuagcagugacacaagcuuucauucacauuccauugacagcuuagacauauggccaucaguaaguacaagggaggcugggaaguguuguguagccaugugcucaggaacgagaagaauauugugcacaaccaguagcuucugccacaguuguugaggcagcaucagccagaguggucagggaaggcucuggaacugaagcgaugaaaaagagacauccaagcaauaagaaaauccaagaaauaacauuucuaggcagaagggagcagcguguuacuaguacacugaggcauuugagagauuuugacccaggggaggaauggaaggcaggucuucuuuguuuggaacucagguagccagggauaggauggguggagaaagagguuagagaagugggcauuggccagaugaugcagaucguuguauccauuuggguuuauuuuguuuuucuaagugcagugagaagucauuaaaggauuuuaaauagggaagugauuggauuuguguuaagaaaagauuguuccugcuacccuuuggagaagggcaaggauggaaacaaggaguucauuuaaggggcuguuguguuagcguaggcaagagaugauggggaugaagagaagaggccaaauuuggaaucuguuucacagguagacucauaaguucuugcucauggguuggacagaggcauuguugagcagcuagguagauaguaguccuuuauugaaagaagaaagauggagagaggaaggacaugagggaaaaguaaagacuuccuuuuggaccugcccagaauacuguccagcccuuuucaggaaauauuugcugaccccuggcauaaacagggcucccaaggaaggacaguggcuagugaaauagaugaaccuauuuaaggauauaacuuccuaaaaauugcagcuuucaugaugaaauuuuuugcccuugaauguauuugggauuuuguguuauaaaacugucuuaacacauuaaaaguuucaaaaaccguuucccccugauuaauaugaugcuaguuuguuagugucauggcuuuugauggaagauuaaagcuuggaaacaguccucugaaaaauccuuuuaaaaaucuguucuuucaggugcgucagcaauuuccugcuccucuugguuggucaggcacugaagcuccuacacaggucacuguugaaacucauccuguucaagaaacaaccuuucauguagccccucaacagaaugcauugcaucaucaccaugguaacaguucccaucaccaucaccaccaccaccaccaucaccaccaccauggacaacaagccuuggguaaccggaccaggccaagggucuacaauucuccaacgaauagcuccucuacccaagauucuauggagguuggccacagucaccacuccaugacaucccugucuuccucaacgacuucuuccucgacaucuuccuccucuacugguaaccaaggcaaucaggccuaccagaaucgcccaguggcugcuaauaccuuggacuuuggacagaauggagcuauggacguuaauuugaccgucuacuccaauccccgccaagagacuggcauagcuggacauccaacauaccaauuuucugcuaauacagguccugcacauuacaugacugaaggacaucugacaaugaggcaaggggcugauagagaagagucccccaugacaggaguuugugugcaacagaguccuguagcuagcucgugacuacauugaaacuugaguuuguuucuuguguguuuuuauagaagugguguuuuuuuuccaaaaacaaagugcaaagcugcuugaaucaggaggagauuaacacacugaaccgcuacaagagggcaaagcugauuuuuuuuuuaacuugaaaagauugcaaagggacauugaaguguuuaaaagagccauguccaaacccaucuucauggauagcucagagguauccucuuuuugcucccccauuuuaacuugccacaucccagucacagugggguuuuuuugucuuucuauucagcaaaaguuaauauucagauguuggucuuggucauuugccaacuaauuuuaaaguaaaaggcacugcacauaauuugcauaaagggccccaugaggguguuuuuuuuuuuucuuuuugucccccccaucccccuuuuuuuuuguuuuguucuguuuuguuuugggugggagggugggaaauuuggguuuuuaaguccucuaaacacacuugggcacggaaaugcaguacuguaaggaagagggaccuccagcuuccacaaacaccaucuucagcuguaugaaagggacgguuguggugaaguuugucaggcacaguaagcaugcugaguggcggggaucagaacucuccuaucugaaccuacugaggagcaaagcagcaauuacaugggauccuguggcucucccguugcagaggccacaggaagauaggauggaacgugacuggucuccuaaccaaggugcacugagaagcaaucaacgggucggucguggccaguccuggggaggucugagugguggucuuugggauaaccuuuggccuuauggauuuggacucgaaauuagaagagccuaccauuucagaugcaaucacuuuuggacaugcuuuugcagacaguccuuaaugcugaaaacacagagaauggguaauucaagaggccuuucuuuuaaaauagacuuuugugacccacuaauuguaagguauugcaaggucacuuugcgugugucauaaaguugacuuccuuauugguugaaggucacagaaguagugguuugcuuugauggaaauagcuacagcugugucccuuccugcuuuuuacuuuuucuuuugcuuuuucucggcacgugguaucuccaccauuucuucugcacaaagaugucuucuguucauccugaacauuuuuaaaaaaugcagaauuuuaugugacugcuuuuuugccucacaauuaugcugugaauuuuacaaaaauuuauuuucuuuuuugauaauuuauuguaccaaagcuguuuuuauagcacauagaugucuguaaccaauaauguagcaguucugcacuuugacacaagguguaacuagaccauuuuuaaaugucaguugaaaauuauggcuguacuauugcuuaaacaaaacuggaacuguuguugaauccauagccaauacauuuacagcaaucuguguacugaacauaguagauugacaucuaauucaagauuacaacaucuguuacauucuaaguguguucaggcuucugaagguaaagggacacuggauccagaagcuauggaaccagcaguugauucuuguauuccugauuaaccuacuuguaaacuugaaagcaagaccuugauugcaccaacagguccagaguaugagugcaagcaaagcagaacucucaugcgugaccugagcagacaggcugguauuuaacaggugccucguguugagauuacgcugccuuaauguaacacagucuggcaguugcuaaauuuguguucccauuuuaaauugaccaauuuuggggugugacacuuuugagcgguugaauugggagaaugaagauaaguaauuuaccuguccaggaucaaaagaagccuagaaaagaagcaguaaucuaccucugccgauaaccuguuuaagaugacucagcagaacaccgcguuucauucuauuggucaauuccauguggcugacuaggucaauuuuuuuucugaacaaaagcagguuuuuauauguaaacagugagaaaagaaaggcuaaacacuauguaaaugugaauggaaacuuggaaauacucguuuuuauaaacuacaaaaacuuuuuguuguuuaucaggaaauccauauuuauuuuguaauuaacugucaagccuguggaugauuuuuuugaacuugguaguucauaaagguuuacagugaauaaaaggauaucaucuugaguauagcaauaucaaaaggaauucaguaguuacugcuguuuaggaauauaagguuaagauaucauaugggucaggucauuuuuuuuuucugugcugguugccacaucuuagcaagcaccaaaaaacuaaagcaguuuuuaaaccgauauuuacguaaagaaaaucauaaaauccaaugcuucugcauacuguguuauguuacaguccaguuuugugugcuuuacuacacaguuugguuacaggacuucugugcauuguaaacauaaacagcauggaaaagguuaaauaccuguguucagauuguaagaucuaguccggacuugcuguguauauuguaacguuaaaugaaaaaagaaccccccuuuguauuauagucaugcggucuuauguaugauaaacaguugaauaauuuguccucagacucuuuacuaugcuuuuuuaaaaauuaauuuaagaaaaauguaaacauaguaaaaaucuuccuaugcaauuaaacugguccaggucugguagguauaguaucaaaguugaguuaaauguguaaaaaggaaacuauuugagauacauugacauaggcaucagcaaucucugaaaguaaaaauuggagguuuaacagaucauuuugauuuuucacauugauuuuuuuauuugaauguuuacauaauuuugugauucaaaaugcucauauuuuaguugguagcauuucgacuggaugugagggucugaugguuuucucugauaugcuuugacgugcuuggaugaaggaaggaauacgaauacucauucuuccuucccuaacuccucguacggggccauaucagaauucuagaauucuugccacugugauucaauugcuaaccuaaagucuucucuuuuuacaaauucaccugcuucaguauauauuaagguggcuuucgagaggcaagaugcuuauuuaaaaguuaagcgugaaucuguaaaauuaagguugguugcguaaaguugaaguuaaccacauguaagaaaggaaaacuuccauuaguuuucuucuuagggugugagaauuuuaccuaggcacauggauauugggcugaaaaaaaaaaaccgac

SEQ ID NO: 18179 - RNA, 1389 nt, Homo sapiens
gggaaggggaggagagagaagaggaggggaagggagguaggcaggauggggagaagcgggaggagagggaagggggcagcaggaggguugggggagcggagggagaggagagggaacgcacgaggggagagaagaggagggcggaggcggcgagggagcgcggggcggggcugacaccuuccggcccaaccuucccuccgccuccugcugucacucggcugggucccucgccggcuggcccugaggccccgggagcagggccucggccccacgugcgcgcgagugugcgcccugggagccgggcggagacuuuccguggagcgcucggcguccucucuggggccaaggcccuaacgccaaaccugccuuuggaauuccgcagcgacggagcaguggugcugguggcaccgaagggcagccgggcuuggguaauaaggcccugaaauugagccgaccccauucuugaaccucugaaugggcuuaggacuaaugaucauucuaucacaaaaaggcuccaaaugaggcgcuuccuguagaaaccgggcccuggcuguguccccgagucguggugcugaucgcgcugcucccgggaagccccgaucccgcaggcuccgcgggaguggcgcccucuggagcugagcggugcccagauagcgacccgccuuggccgcgcuucaaucugggcugggcacuccacgcacaucaucgucacucucggaggacuugcggcucccacuuuacacaggugggaacugaaccuuaggaugaauaaccugccacgucagauugaugagaaauucaagguggaaaccugaguuuaucugacuccgaaacccuggucaaaaccacccccuacacugugguuuccguuuuuaucagaaggugcuugaguccauggcuguuuggacucaggucacaugcucaauauuuugcaggaaaguuuagauuccugaaguuguggaugaaauaggaaaccccagcuuaggcgaggccacggggcugaaagcugcucacaucucaagaacugcggcaccaccgggaagggagaggaauggcccagcuucucugugacucaggguucuagguuuccauggugacucuaggucuagaguuauccggauaauugagauaucggugcaccuuaauguuucuggguccccgaaggucuccggguaucaccguggcaugagucacagucagaaucuauacggcugaaacaaucacguauaggggaagugauuauuucuuggagacugaauugauucugauggcuucucaguguauauucaggcccagauuagagaacacagauaggucaagaaagaguuccauaaauggaauacagauccauaguaaguuaccauggagacaugaguauguuacuauuuu

SEQ ID NO: 18180 - RNA, 3301 nt, Homo sapiens
gcaacagguugggaguauuauuuauucaaauaaacaaaaauguuuuauuucccuuucaaugguauauaucuuaaauugcuggaacauacaaguauaaaaauaagauuauuuuagaaaacuccaguuuugaagggcacgacaauaguucagacauuugucaguagcuaugaagccacuuuuaacauggaaugaauaucccuuuacuccaacucuuggucuuauuacauuuuuaaaucaaaucagcgugcuggaaauagagaaaaauucccaaagggaaauauaaaauaauuuuaagcauuuucagaaauacaaguuacacuuaagaaacuuguauuaaaggauguuaaucugagauaaacagaaaacaaacguuuugcaaagcacuacuuuuugcaucuguuugaggauacacaguuugcagcucuccugccagaagcaaaauacugacucuagcacagcagaaaaggcaucaacuuuaagaaaaaaaugaguggucgcuuucaaugacugaacauaacauauuaaacuuuaagaauuuuuaacaaugcaaauuaacagcaauaguagaaaauacaucauuuuagauuacaaaaauucagcuuuuauuagcacaugacaaaucucauucauucgcugcccucucauaugugcugaguaacugcuacacagaauuucaaaccucacugauauaaaugugagagaugacaucuacaaugagaaaaaugagggaaaaaaaucucguuuuauaccacuagcaacaaagaacacaaaauuguauuaaauuuguuaagaaauguuauuuugugcaauuuucaugauagauuaauuagcuuuguucacuuuuuuuccuccaucuuaaaaagagauaaucuuuuaauguuuucuuaacauuucauucaggaacacuaaucuuagaaaugcgaggcuuguguaaaauuuuacuuuaauaggcacaauguagcaagcgaaaccauacucauaucagggaacuugcaaugaccuccacauauagcacucaacagaaaaacauauguccugaccuuuggagacacuucccugcuuaugauauucuuaucugucugugccuugugaauaaaaaugcauuuuuauuccaacccaaaugaagaaaauccuauggaaaaacaucaaugucaaaggcuagguugccaaggacacccaagguuucuagccuuuuauugauaccacgaaagugacagcugugcccaacuuacugaagucuauauuauaaaucugucauuucuaauuauaaaucuacauuggaaaaaauauuuuacucagauggcuaugugugaggcacacguguguucuacacaguuuggacuuuaucugguuggucuuacacaaacaauuauccaucuguaaagggaacugcucacuucucagggcugcccugauucccagaggagagacagauauuuuaccaucacagcguuccccaagaugcuggcagagacaccaggauggcugcucucacaauaguguccaagaaguacccgaggcucaacggggcacccaagcaucagggaccagguacccgcacgucgcucuugccguggcuggauucaaauuuaucaggaagcuuugugaugucucuuggcccagucacuacccacggugugcuuuuuaagcacacaagugugauguaaaaguuacacaguacaauuuaguuuagaagcacuggacaucuguguguaauagcugcugauaagaaacccagaggaagcucagggcagggaagaaaauacuggauuuauugcugggaguuacguauccccaacagcugugauagauuccagccacugaugcaaccugagguucgcuggcagcacuaagcagcguggcuauguucugccuuccacauuccgcagauguggcuaacagggugacaccaagagcccagggagccugcucacgucugaaagccgugguuucugcucugcagccucaccuggggagcuuacugaaaugcagauucccuguucccuccugcacugacccugaauggggcugggugugcuccaggacaagauggaccuuccggggacguggagccuggggagcagggcucccacgcugacagcagugagacaggagggagcuccuuuccuggaagucucugacagaagacauucuggagaaagaagcugucggauguucggaaugcaugggcugggcuggcucagcagagcuggcggaaacggugagggcccagcugccgugccccucaacgacacugucagguaacugcugccaggagccuuccagaugcucagaccccagaagccacuuuaccggcccccuuuggccucaguugcuugacccuccccuacaaauuuccaggugcaugaccuugaaccugccuguguccugcgugggccuugaggcaucucuaguuugauuaggacagacguguuuuacacauggcugucaagcaaguuucucuuggccuaauuguuccucuggcaaauaaucaauccugagaaguuccuuuacaaaauaccuaaaaaguagacugugccaaaaacguggggugaaaugaggugcccacggcauccuggggacguucuuggcugaugcggaccuccgugccccacugccaacugaggggugggaccucucuucuggcuccuucuugcccugcccucuuuucagauucuggaacuucccaggucccagccauccuguacucuccauccguugaaugaaccaauccuugcuccgcgugggcaacacccgggccacccagccacagucucucuuugucaaagcugucacuuacacaugacucccgcuugaauauuccugaaguuuggaauugguggaucugcaaaauaaaucacaucuccaauggauucagccacuuuaaggggaaaagaaaucuaaggauggcuggaaugaaacugcauuuucuuuccuuuuuugagacggagucuugcucuguugcccaggcuggagugcaguggcgcaaucuuggcucacuacaaccucugccuccccgguucaagcgauucuccugccucagccuccagaguagcugggauuacagacaggcaucaccaucguuggcuaauuuuuuguauuuuuaguagagacgggguuucaccauguuguccaggcuggucucaaacuccugaccucaggugauccaccugccucggccucccaaagugcugggauuacaggcacgagcuaccgugccuggccuaaacugcauuuucuaaaaaaauauguacugcuuauuuuguuagcauacuuuuaauuauauucuuauucuuucuac

SEQ ID NO: 18181 - RNA, 356 nt, Homo sapiens
aauaguccagcauuuggcauagcgacguaggcuuuccuacaauacagcuucuaacaaaacuaggcuguccugaaccccugguaauagaauuguucaccuuuauaccaagaagguugggaaagcaccaaaaucugcaugugguguguacccaggccgacuucgagggguucgugcuguaagaccuaaaguucuuaugagauuguccaaaacaaagaaacaugucagcagggccuauggugguuccaugugugcuaaacguguucgugacagggucaagcgugcuuuccuuaucaaggagcagaaaaucguugugaaaguauugaaggcauaagcacagagucggaaagcuaaauaaa

SEQ ID NO: 18182 - RNA, 1333 nt, Homo sapiens
auaggaagauacagcuaugaaaagguagcuuaaauuaaaaugaauuuuugccuuaccaauuucuuuuucaguuugcaguuuucuuuauaaaccaguaugacggcucucuuaaaaacuaaagaaaggaaaagagaaagaaagucuuuauuuuaugcaaacucuuccaagguuaaacuagagcugaacgucuuaacagaguaacacucuccaaacguaugagucucuaagaccucacucugccaacaugagugaauaaaugguacuucccuuucgcucauauuugaacuaugcagaagcaccugcuuauuuaaaagcuacuauuagaaguugaucuuggcuuuuuuaaacucuuuguuuuauugaaagcugaggacacuguguucaucucagugacaauauacugucacuuguucucccaacucucagaauuaaaacauuugaaauacagcagacuauuaagauagcagguuucuggccaggcacgguggcuaaugccuguaaucccagcacuccaggaggcugaggcagguggaucaccugaggucaggaguucgagaccagucuggccagcauggugaaaccccaucucuacuaaaaauacaaaaaucagccgggcgugguggcgagcaccuguaaucccagcuacucaggaggcuuaggcaggggaauagcuugaaccugggagguggagguugcagugagcagagaucacaccauugcacuccagccugggcaacaagagcaaaaccucgucucagaaaaagaaaaagaaaaagauagcagguuucaaaauagccgcagggaucuguuccuguaacacuuggccugagccaagcagcagaagggagaacaagauaaugaggaugcagagcgaugccggaguuucaaauaguugggggcuggcccuguuaaguccccaaccauuauagcaauucugacuccuggagcucaggagugagcuggacuggugcggcuagugaaguucuuccguaaucccagccucuguucagucugcauucuucugaauggaauacuaaccaaauacugugagcucaagguccuuucuagcuuuuccuagagacagaaauggauucaaccaggaaaccguagagugcaucagaagcucucccaucgaaaguucuguuaccuagauuguaaaaacaggagguaaggaagauacggaaaucccaggcuagaugaucucuuguuagauagugauguacacacagucauugcuaaaaugcaagcacagcugguuuaauuuuuaugauaccuguaaacauggggccuuaaacgguggagcuuuugaaaauaugaguuaagcacccaagug

SEQ ID NO: 18183 - RNA, 1103 nt, Homo sapiens
ggggccuacauagaacaucgacuuuuauaucccugaaaauggcccauguuuguuccauaaacauagucugugaaacuuugguuuauuuucaaaugccuuuuaccuucacucagaaaaaagcaaagccuagcuguggauaccauaugccauugguuuaccauucagaggcagcgucagggcguggaagcuuuggcugcuguucuugcuuugagaccuguaacugcuucugaaccacaacucugccuccgcaccuucccuagcaugugaggucuuugagaacugggugcguagcugauugacuucugugcccugaacacccacauggcugcucggagacucgcccacagggagaacauaaacuucuauucacugugcacacauccucccucagugacagcuucccuaacacuuuucuuggugggccuucauguuacagcccucgaauucccggccugcacacaacucuacugacuuggacccauuuaaauuccgcugguugauccccaucuccgcgcuucaagucagacuggggaauccagcagguaacuguuucgugcaguaugaugccagaaaaagcauuuuaguagacuuaacuguggaauguaaauuaagaaaggaccuuggggauaauuuuuggugccuuuuauuuuauagacaaggaaaaugaggacaagagagguuguuuugauguuccuuagcagacuucugggagaaacuaaaugcugguggauagcuuuuucuuugccaaaugccuuucauuguuuccuuauuuucccuaucaauaguuuucaacauuuuccuuucugccuugauacccuaaaauguguuagaagaacaaagauccacaaauuuauguuuuuacaaauuuagaauauagcagaaaauuccuuaagguuagguaguacuguaggugauauaaaaagaaaaaaaucuuugacucuggaaaauguucagagauccuuccagaguaaccuuguuuuggugacagguaucuggugacagaagaggccagcaggcugagucaugcagugaccugcugggcuucuguuuaacuuuugucagaagugcuuauguuuucgagaaaaugaccacauuuggggcag

SEQ ID NO: 18184 - RNA, 662 nt, Homo sapiens
uuuacacauaauccuucagauuguguguggaauuguucucgagcuguguguuagagauaggcugcugugugggugggucgagucuagcuucuggauuccuuuuuauacaggaggugcagaaaaucaugccagagauaaacaacagcauugcagaaaugaauccgauauagauagcuccuccagguucauguuuguugcuuucuggaacugucagauccagaaaguuugcuaugaucuccuuuguguaccacacugucgagauuaaacuagagauuccugcagacaugaaacagacuccuccagcaaaggaagcauggcucuugguuucucuguccccuccuaagcgaguacauuucauuccuacuguggaagugcagauccccaaagcagacagaacacacgccaggaccaugguggcucucgcagccugcacguggauggggagggacagaauggaguguuucagggcacagcugaacaucccagugcuguaccacguacaguccauccagagcccgugcagcuguacaauggcuguuaugauguuggaguccacauccacauucaccuuccaguugggcagcagaguggcugugagcacuccagagaccccagauaaggccaggaugaaagcaaggagcuggaguccugcugaggccaug

SEQ ID NO: 18185 - RNA, 551 nt, Homo sapiens
ugcaggccaccauccucacggucaucaccauggaaggcaagggccacagggauuuccugcaacuucaggaagaucgcugcagagcggaaaguccugcagaaaacccucggcagcccgcacauuuccacagaaaaagcaagcguuuggaggcgcuucaaaccccaacuaaguuucugaccuaaggcaaguuacuugaagcuucugagccuguucccguuacuguaaacggggacaaagaugcauuaucacgguagccuauuuuuaggauuaaauaagugaauguacggcuagcucuuggcacgaaacagacauuucauaaaugcacuuugucauguggguacuguguauuuuuccuaaaugcuauuuggaaaugaucacuguaaucgucacaguucagggaaaaacauuccaugacagaaaacacccagaaaaggaauggccaacguaaccgugcuuuucuggcagcuuuaaacauccucagucucugaaaacagcugcugugagcagggaagggaggugugcgcuuggcucagggaaagcccgaauucaga

SEQ ID NO: 18186 - RNA, 1341 nt, Homo sapiens
aaauauuuuaaaaaucugguccuagcaauaguauuuggaaccauuucaaaaucaauugguuuuuauaucagaucugaaucccccaagauguuaaaguuugcauucuaguaaugcuucuccagaucaucuacaucaauaggcacacacugguagaaucaagugagaaacuccauagagagucaaggaaggccuggcucugugggugcccuaagugccgagugaguauucggaccucaccgugucuguggucugcugggacauccgccucgucuagucgggcuccuggcagcuggcugggaaguugugccuucacugagauugagacucugcccucguugguuuuuacagccgguuuaauggugaaaaagucggcuucagaugcguccaucuccuccggcacccauggacaguauucaauuuugcagacggcaagacuucuaccaggagcaccucagcaaccugugaguucuucugcauacauuucaaucccaaggguuuugcccccgggauagugugggaucucucuucucagugaauauauagauuuaugugucuuuaacccucuaccugcucaccaucucaucuccaaaccccauaacccuuccucgcagguucuccauagggcuuuuaaaugguuguauggaguguucuagaaaaaaucacuuuugaugaaaaaucccaaauaucccugguuuccauacucauccauuucucucucuucccauucuugccucugaccuugguguaugggcagagcauugcuugguagaagggaaaaugggagaaauucaggucguuauccugggaaaaugaugaucauucuggagugaaguugguugagagaagaggcuaaaaagagauguaaauaaugaaguuggggaacacacuaggaagacuaacagccauagaggauuguggaggugccugguuccagaggguaccaugagcugcuggggaagagagcaggugaaggcagggaaguagaggggagagaggggaagcugggugcuagggggaaacugcuaugaccgggaugccucuggggugcugggccugguuaagugcuugugcggccccagcagguggaggggugacuggaggccaguguuuuacaguagugaaaauaggucauaaaggcaacccacaugcuggaugaagaaguagaaaaagcacuuuuaaggaagguauuuuaacaacucagugggaccauggaaagaguggccucuuauuuugcuuucuggcuuucaccugguuauugaaaaaaagauagaagauggucuguccauaugcaaaaaucuguaaucacccggcuuugaagaccagggucaucaggucuaagua

SEQ ID NO: 18187 - RNA, 6333 nt, Homo sapiens
gacggaugagucuuuuaauagaaaaacacacgugcaacaguaucaacacacaucucucgcaauccugacagcgcugaacuucaguucuucaccuugggggguggccugugagaggaagauaggugaugaaggaggguccccaggaucauggcacucggggugcaagggacagagaugucugucuugguguauugcugggccccugcucaccuguacacucccacgaccacggcauggucucuuucauauggcucaagggucaacugcuccugcggcuucauguucuccuguugcaucuuuuucacuucggaggcaaacacggccucggcugaggcuguggagucaaugcaguuggccuaaagaggagaaaggacuaaugucuacaacagggcuuugggcuguuuuucucuugugugcucuuuaaaccagauguuuucauuauuaauucaaguaaaacucagugcuaugguucuagugugucccccaaaguucauguguuggaaacguaacccuuaaaugcaagaguugagaggugggaccuucgagagaugauucaggucaugaggccucugccuuccugaauagaguaaugcuauuaucacaagaguggguugcugauuaaaaggaugauuaugcccccuuucuaucuugcucucacccuucugccaauggaugacagcaagaaggcccucgccagauucagaccuccaaucuuggacuuuccagccuuuggaacugggagccaaauaaauuuccauucauuauaaauuacccagucuaaggcugggcgugguggcucacgccuguaaucccagcacuuugggaggccgagguggcucaaucacgaaaucaggagauugagaccauccuggccaacacggugaaacccuaucucuacuaaaaauacaaaaauuagucgggugugguggcgcacaccuguagucccaccuacucgggaagcugacgcaggagaaucgcuugaacccaggaacuggagguugcagugagccgagaucguaccacugcacuccaaccuggugacagaguaagacuccaucucaaaaaaauaaaaauaaaaauaaaaauaaauaaauuacccagucuauagcauucugugauagcugcauaaaaugggcuaagacacucggguuuaggaaaugugauaaaaggcuuaaugaaaguuuuuggcugggugcaguggcucgugccuguaauccuagcacuuugggagccugagacaggcagauugccugagcucaggagcuccagagcagccugagcaacauggcaaaaccccgucuccacuaaaaauauaaaaguuagccaggugugguggcacacgccuguagucccagcuacuuaggaggcugaggcagaagaauugcuugaaccugggaggcagagguugcagugagcugagauugcaccacuucacgccagccuuggugacagagcgagacucugucucaaauuaaaaaaaaaaaaaguuuuuaguuuuguuuuggauuugaagcaggaagccuuaaacaguccuauuuaucuaaaagccagugcuuaaauuuuauacccaggaauuguuuggcuuauuucuacuuccucuucuuuaauaauaguaauaaugcaguugagaauaauaaaacaaauguagcaaaaggcuaacaaauggugaaccuugugaagggugcaugggagaguucuccauuauuuccaaauaaaaaugcugugaaagaugcaccuagcuuuuaucuaguaucuauucuaugccaggaucuuuucuaaacacuucauauuauauugacuaauuugauccugucaucuacccugaaaaagacuagacaauauuucuauuucauaagugaggaaacugaggcauauagguuaaguaacuugcucagucacacagcaggcugggauuaaacucagauggucagacucaauuuugcacuugaccgcugcacucuccugccucuuuaaauccaaagcuauaguuuugcagacuuggccccucuguuuuggguggcuauuugacagauacagauagagaagauaccucccuagaacacugccaccccaucuuagacucuuccaaaccccgcaccuuaauggaaaucacaaaguguccuccauuacgcaggaaggugugggcauucagggccacaauccgggucuggucuggcugggccacaucagcaaagaucacauccaccauugcuaaggagaaaggagcagcaguuaaaaguuggagucacagggaucaccccagauccucccauggggccuaugcccaucaccagcagguuccugggagauucucccugccuccaguuucacuccccaccuccacuggucccccucccuccagugucccaagaugaguccaaaacccacagucacaucauucauccacucuucuuguaaaccaugguugccaccuacucuguggccagcccugggccgggcgugggggacauagagacgagucagacccggacccugcccucgagacgcucccaggucugguggggagacagacacgucaucaaaaagacaaguaagagugagugagcacuuauaggcaagaguguccgcaggacugugaaaugaaaacaaguugcagaacaaaggggaugguaugagugcaugggaaaaauaaaacacagaaagaaaaaggagcagaaugaaaaauaauguuuuuaagccagugugacuuuucaaaaaaugaaaaggugguauaaugaaaacugauuauuuaaaaccugggaaaagcagacaucaaauuguucucaucaguuacuucuggcggugguuuauaaggcuuuucaacuuuuauauuauaucuuugaauguuuuuuuaaacaaaguaauuaauauucacagugggccccuccagaucaagccaugcuuaguuuucugggauaugcucucaccagacaaugauuaggacccccaaaaggaggcuuuuuauggagggguaguguaauaaauacaagaggcaggaaguacaggagaccuaggagauggggaggagacugaaggagaagagguuggcccuccaaggguggcuuccaagacucugaagccaagcugccaccuccacaaccucaccuagcuccccuuaccccuuucuauuccugcagacucaagaggucugcucauccacuccaacuccauccgaaucagagauccacuggcuucuuccagaagccugcgguggccuguccuaccccaccggggccacccccagaccccucaccgaugagcaugcgguauuugugugggugucgagcauccucgaucacaggaaugauguugguccucuucuuggccaaguuaaugaggucacggccagagcggugggagaacucgacugcauagacuagaccauccuaaaauaaauuaaaaauuaaugaacagugaugcuaguucucaugcauggagugccuacuuuaggcccauacacuauacacagcaucucuuccaacccccaaaucaaaacccuaccaucuaaugacuauugcuaucauguccauuuuucacaugaauaaacugagguccagacauaaagucacuggccaagaguuauucagcaaguagcaaaaguacccaaucccaucugccugagagcccagguucccaacagaggcuuaaaaccaggaagccaaggcacagagaugauguaacaaugggccaaccacugcucuaagcaccuuucagaaauuaacucauuuaaucuucacaagucuauguuccagacagguaaacugaggcuuggauggguuagguaacuugccugauuaaagccugagguuuuuuuuuuuuuuuuuuuugagucucacucuguugcccaggauggagugcaguugugcgaucucagcuuagugcaacguccgccuccuggguucaagcaauucuccugucucagccucccaaguaggugggacuacaggcacacgucaccacacccagcuaauuuuuguauuuuuaguagagaugggguuuuaccauauuggucaggcuggucucgaacuccugaccucaggugauccaccugccucggccuccgaaaguguugagauuaaaggcaugagccaccucgucuggccaaagccugagguuuuaaggcacuacacuuaacagcuuauaaacacauaaaguaacaaaggguaacagagugggacacgugggugccaggggcccucuaaaugggaagccuauacaggcucagaaaccaugaagaucuccugguucuuucuaaagaaaccagaagagcagguuuuagcagcauaaaauuuuaaagaggcccaucaaaucaaauagucugguaucuauacuccccguugucucucuaagguuggucaccccacacccacgucucuucccuugaggccaagaacccaggagugagguugaaugacauuaucugguucaagccacuccuuuuacucacaggcacagugacagaaaagggccuggcccuaagucacacagcgcaggcaagcagucaaacccugauauuccagguuggcagaagggaggcagccuuuaccuccugccugacucuccaucuacucacucaccggaccaacgaugucagagacaugggagaccguggugcccgaggcagccccgagguagagaaccuuagcccccgguuugauguggaucugguccacaccacccaggauugcugcugcuagcuuggagcggaagggguuccaggcucgguacucaauuuugucaucuccuuccuagaugagagauggggacagaagucagugcuaggcucuucugcaggaccucacugccuuuaacccuaggagccuugaaaggaacugggcuguccuaucacugcacaagaacucaacaugaguaaagagcagugaccaugcacaugcagucgcugcccucucauggaggugacugacccaaagggcagcaaaagagaauaaacacaaacaguaacaguaaaaccagcacuuguucaacaaacaugcacugugccagcaccuacugugugccagacccugcucuaggcgcuggggauacaaaacaaggaucccugcccagaagguguaaguauucaccgaacuaacuaaauacaacauggcauaugagauggugacagguguuaaggagagaagacaaagccaggagagaagauacggaguuugggaagcagggcaaggagcaggugaaaaugggaaaaggggccagggaggggcugaaaggcagauuccaaaucagaccugaaggaggcaaggggccauucaaguuaucugaggaaggacauucccacgagagggagagcgauuaggaaggccccaaggcaggcacacccuggccucaaagaaaaugacacaggauaacaggacaggggagggcggugagggaugccuugacccgcagaguggugugacgcagccuggagaagcagaugauaaggacgcagccucccacagagcugggagugggaacagcaaggccaggguggcuggaggacacuuggucagagaguuagugaaggagacaaagccagggggcagggagggggaacuggaaugcacagggucuuggaggccugagugaagacucaggagucuaacuggaaggccguggggagucacagaaggcggaugagggagcagacagugugguuuacauauuaugacaauccuccagcugucacgugcaggacacauggugagggcagacacagacuacuggcuacacccucagcugcgacccugguggcuuggacaggggcccaguucucaccgaaaucgagacucucuucucuccauaaacugauuccccagggaccagguucuuggugaccagugcaucuuccuuuccucgacaaaugaagacaccugggugaggggaucagagcaggggugaggacccccagccucucccugccccgaagcucagccggcucccugccuuccucacucacccucaugccgaugcggcuccaccaucacauucuuccccgacugguuuccucuuuuuccuccccgaccacgaccccgguugccaccagaauggaagccuccaccuauaaaggagagguacaacaggagagaaagauccugaaucuccgcccuccccacuccccaccucaggaaggccuccucuguaaccccuagccaaucuuaccaccucuuccuccuccuccaccgccgccgccgccuccaccuccuccucguccacgaccucuaaagccuccgccucgaccucggcccccgccaaagcccccucggccuccacgaccaccacggucaccaaagcccccucggccgccaaagccacccccacggggacugaauccug

SEQ ID NO: 18188 - RNA, 1312 nt, Homo sapiens
uccuucacugauuuagcaaauuacauuucuucaaguguggagauggaguagcugcccgacuuuucaguucagcaacugaaucugcaucauaguuggguaggaggagguucuagcuuguucauuuugauuugccacucuacaagguaaaaucacagaggaccacccuggucaacaaaguauaagaccacaccugcagcaacugugcccauguuuaugcucugauccuuguauugcagucuuaagacuucuucuucuuccagaaucccaaaguaggaguaauuauuauuuaggucgcagguaguuccauaaacacgggcguugaggacgcuggcuguugucaggaauaggagucucugggguugaaaucugggggcucugcugccugcccuuugccucggaggguguggaagacccuccgauaggagcuccugaagguggggcuggagaagcaguauaccacgggguugagcacacugugcagguaggugaggcugcccgugacauccgagguaugagccacugcacaaagggcccugcagcuccccagauucuggaagaugugcaucaggacucuggccaggaagcagggcagaaagcacagagcaaacagcaccaccaccaaggugaccagugccugggcccgcugaagcuugggcuguuucucaggcucccggagucuuuucuggagagcccugaugaugccugcauugcagaacacgaugaggccaaaggggaggacaaacugaaggcaggagagugcuuccugccagaugaugcugaaggagccgucugcccuggaguagaaacuguggcaccugguggaguucugggcggccucagagaugagcaagcccgggcaggugagggcgaccaucaggagccagacgaggcccgagacccccagggccgccugaggagacagcagguugaccuuaagccgaggguggaccacacggagguaccgguccaaagccacggcggccaggaaggccauccccacgcugcggcugagguccagcaggaagugcagggcccagcagcccacacggcccagaugccaagccuggaggcucagguagaaggcggccaggaaaggcaggcacgcagccaacagcaggucagccagggccagguugagcagguagacagcguacggcuuccacacccugacccggaacaggaagguccacagcgccaccgcguugcccagcagacccagcccacacuccagccccagcaagacacccacagcuguggccaccacagugcugggggcugagcaguuugggaauggcaucacccggccgugagg

SEQ ID NO: 18189 - RNA, 3848 nt, Homo sapiens
gauggcggaaauggauccgguagccgaguucccccagccucccggugcugcgcgcugggcugagguuauggcucgcuucgcggccaggcugggcgcgcagggccggcgggugguguugguuacgucaggcggcaccaaggucccacuggaagcgcggccggugcgcuuccuggacaacuucagcagcgggcggcgcggugcaaccucggccgaggccuuccuagccgccggcuacgggguccuguucuuguaucgcgcucgcucugccuuccccuaugcccaccgcuucccaccccagacuuggcuguccgcucugcggccuucgggcccagcccuuucgggcuugcugagccuggaggccgaggagaaugcacuuccggguuuugcugaggcucugaggagcuaccaggaggcugcggcugcaggcaccuuccuggcaguagaguucaccacuuuggcggacuauuugcaucuguugcaggcugcggcccaggcacucaauccgcuaggugcgugcccuaggaguaccccuuuugccuggaagcacagccuuucuuuccagccacuuauccccuuaccuccugcuuacccacggaucucagcuggggaacccgaguugagaaggagcugauccuauaucguaccucgccgauuuguuaacaccuuguguuucucuuugcaggcccuucugcgauguuuuaccuggcugcggcugugucagauuucuauguuccugucucugaaaugccugaacacaagauccagucaucugggggcccacugcaggugaugggcgcuucucuuccagagaucuaaucccauauaaccaaucuuggguuaauuuccucuugaucuggagauggccuuucugcaucuguauucgcuaggcacaggggauacagagaugaauaagacaccgcccucccucauggaccucacaaucuagugagggagcuggacacagacauaauuacaauacagagugauaaaugcucuaguggagguauguacaaagugcagucagaucauggggcgagugaauccugggggagucgaugaagcuucuuggaggagaugaauugaacuggguuuuaaaagaugagcagaaccgagcgcgguggcucacgccuguaaucccagcacuuugggaggccaaggagggcagaucgccugaggucaggaguucgagaccagccuggccaacauggugaaaccccgucucuacuaaaaaaauacaaaaauuagccgggcgugguggcaggcgccuguaaucccagcuacucgggaggcugaggcagaagaaucgcuugaaaccaggaggcggagguugcagugagcugagaucucgccauugcacuccagcccgggcgacgagagcgauacuccgucgcaaaaaaaaaaaaaaacaccaaaaaucaaaacaaaaugagcagaggguguacgaagugggaaaggucauuccagguggaguauggcaguaggaauuugaaagugggcagugggcugugaaccgaagugcuuugguaaggcuggagagcugacugaagagauggcuugcuuuguagaagacuuuauuuuccuuuuuuaaggagcuuggacuuuuucuuguggagcuaagggacacauaaguaggagaaugagauaaaguuuuuguuugagaacaacauucuggcaucaguaugaaagacgaaguagagaaggagaaaguggaguggguagauuaguugggggcuauuguagguuaaggaagaaauauggauaagguaggugugguugugauuuuagauuuuuggaaccuucaggaguucuuagucauuuauugggugauacagguaggauuuuauuaggagaaacucuuaucuguggggcauuugccgacuuuguagaauaguuuauugagguccuacacugcuguaggacuuagagaugaaagcagugaaaagaaacauacccugccuuuguguugcuuccucugcagaggagacaauaaauaagucaaauacauaacucguuuaguagugauaaaugcuaaggagaaaaauaaaguauaaauaaacugguauaugaucccuaucacacuaacagcuuuuuuuuagggcaaagucugaugauuagcuuagugauuucacgcuuuuuaaucucugggaucuuuaguuuaucccacaguuuuuaguucuaucuugaaaguaacaaagcaacugaacauuacccugagaagggauuggggaugagguacuaggaguuuuggucaagugaaaauaaaaucaguuuccucacugcuaaguuguguuacaugugacaauuuaaaaauggaaucuaauagccauucuaccaaugcaagaaauauuuuaggcugagagguuuaaaaacccaacuuuauuuaggcuucugccaaauauuuguaugaacagauuauuuguaucuguuuauuugaggguuugguucaaaaauaaagggacaugcuugagaaaauauuaauggugguaagguuggcagagcauggcagggcuuauucagaaggcaugguuugccccagaauauguauggagccuugaauuuaggcaucgcugugaacucuacagagccaaggcuuuuuuuuuuuuuuuuuuuuuuugugagacaaggugucgcucuguugcccaggcugaagugcaguggcaugaacacagcucacugcagccucaaccuuccaggcucaagugaucuucccaucucagccuccugaguagcugggacuacaggugggugccaccaugcuuggcuaauuuuuguauuuuuuuguagagacaugguuuugccauguugcccaggcuggucuugaacugggcucaagcgauccacccauccuggccuuccaaagugcugggauuacaggccaagccacuguguuccccuaagacuuuuuaaacuaaacauuuaacugaaaaguuugaugguugagaaaucccacuuaaauuuaauuccuuaguuucccaugagauugaccugguagguaaugaccauuguuugcuuauuaagcuuuucuuuuuccaauacagauaacaaugaagauggugccaaaacugcuuucuccuuugguuaaagauugggcucccaaagcauuuauaauuuccuuuaaguuggagacugaccccgccauuguaauuaaucgagcucggaaggcuuuggaaauuuaucagcaucaaguggugguggcuaauauccuugagucacgacaguccuuuguguuuauuguaaccaaagacucggaaaccaaguuauugcuaucagaggaagaaauagaaaaaggcguagagauagaagagaagauaguggauaaucuucagucucgacacacagcuuuuauaggugacagaaacugaaguaaaaagcccuuauaggaucaaaaauuguucagggcucuuagagauggugaaaacuacaaaaaaaaccauggcuuucauauggacagauaaaaugaaagaaagggaaaaggcagugguguguaggcaaauaugguuuggcauuugucuuuuaaugacaccugauaugaugucauuuugauuuugaaauugaacacuagaacuguuaaucaccuuuaaaaagaagagcuuauugggaauuauauauuccuuaaaauauacaugggggccugaaugucagccaucuuuauacuauagaaaaaggauuauggaugcaugaauggucaugcuuuggagaucaaauauugguugaaugccuauguaugucaggcccugugcugagccaugaggauuaaaaagaugaauaaacauaucuuguuuaggaaauggauguauaaaaaaaucaagugcaauaaaguguguguccaaaagcugacacaauggaaa

SEQ ID NO: 18190 - RNA, 3848 nt, Homo sapiens
uuuccauugugucagcuuuuggacacacacuuuauugcacuugauuuuuuuauacauccauuuccuaaacaagauauguuuauucaucuuuuuaauccucauggcucagcacagggccugacauacauaggcauucaaccaauauuugaucuccaaagcaugaccauucaugcauccauaauccuuuuucuauaguauaaagauggcugacauucaggcccccauguauauuuuaaggaauauauaauucccaauaagcucuucuuuuuaaaggugauuaacaguucuaguguucaauuucaaaaucaaaaugacaucauaucaggugucauuaaaagacaaaugccaaaccauauuugccuacacaccacugccuuuucccuuucuuucauuuuaucuguccauaugaaagccaugguuuuuuuuguaguuuucaccaucucuaagagcccugaacaauuuuugauccuauaagggcuuuuuacuucaguuucugucaccuauaaaagcugugugucgagacugaagauuauccacuaucuucucuucuaucucuacgccuuuuucuauuucuuccucugauagcaauaacuugguuuccgagucuuugguuacaauaaacacaaaggacugucgugacucaaggauauuagccaccaccacuugaugcugauaaauuuccaaagccuuccgagcucgauuaauuacaauggcggggucagucuccaacuuaaaggaaauuauaaaugcuuugggagcccaaucuuuaaccaaaggagaaagcaguuuuggcaccaucuucauuguuaucuguauuggaaaaagaaaagcuuaauaagcaaacaauggucauuaccuaccaggucaaucucaugggaaacuaaggaauuaaauuuaagugggauuucucaaccaucaaacuuuucaguuaaauguuuaguuuaaaaagucuuaggggaacacaguggcuuggccuguaaucccagcacuuuggaaggccaggauggguggaucgcuugagcccaguucaagaccagccugggcaacauggcaaaaccaugucucuacaaaaaaauacaaaaauuagccaagcaugguggcacccaccuguagucccagcuacucaggaggcugagaugggaagaucacuugagccuggaagguugaggcugcagugagcuguguucaugccacugcacuucagccugggcaacagagcgacaccuugucucacaaaaaaaaaaaaaaaaaaaaaaagccuuggcucuguagaguucacagcgaugccuaaauucaaggcuccauacauauucuggggcaaaccaugccuucugaauaagcccugccaugcucugccaaccuuaccaccauuaauauuuucucaagcaugucccuuuauuuuugaaccaaacccucaaauaaacagauacaaauaaucuguucauacaaauauuuggcagaagccuaaauaaaguuggguuuuuaaaccucucagccuaaaauauuucuugcauugguagaauggcuauuagauuccauuuuuaaauugucacauguaacacaacuuagcagugaggaaacugauuuuauuuucacuugaccaaaacuccuaguaccucauccccaaucccuucucaggguaauguucaguugcuuuguuacuuucaagauagaacuaaaaacugugggauaaacuaaagaucccagagauuaaaaagcgugaaaucacuaagcuaaucaucagacuuugcccuaaaaaaaagcuguuagugugauagggaucauauaccaguuuauuuauacuuuauuuuucuccuuagcauuuaucacuacuaaacgaguuauguauuugacuuauuuauugucuccucugcagaggaagcaacacaaaggcaggguauguuucuuuucacugcuuucaucucuaaguccuacagcaguguaggaccucaauaaacuauucuacaaagucggcaaaugccccacagauaagaguuucuccuaauaaaauccuaccuguaucacccaauaaaugacuaagaacuccugaagguuccaaaaaucuaaaaucacaaccacaccuaccuuauccauauuucuuccuuaaccuacaauagcccccaacuaaucuacccacuccacuuucuccuucucuacuucgucuuucauacugaugccagaauguuguucucaaacaaaaacuuuaucucauucuccuacuuaugugucccuuagcuccacaagaaaaaguccaagcuccuuaaaaaaggaaaauaaagucuucuacaaagcaagccaucucuucagucagcucuccagccuuaccaaagcacuucgguucacagcccacugcccacuuucaaauuccuacugccauacuccaccuggaaugaccuuucccacuucguacacccucugcucauuuuguuuugauuuuugguguuuuuuuuuuuuuuugcgacggaguaucgcucucgucgcccgggcuggagugcaauggcgagaucucagcucacugcaaccuccgccuccugguuucaagcgauucuucugccucagccucccgaguagcugggauuacaggcgccugccaccacgcccggcuaauuuuuguauuuuuuuaguagagacgggguuucaccauguuggccaggcuggucucgaacuccugaccucaggcgaucugcccuccuuggccucccaaagugcugggauuacaggcgugagccaccgcgcucgguucugcucaucuuuuaaaacccaguucaauucaucuccuccaagaagcuucaucgacucccccaggauucacucgccccaugaucugacugcacuuuguacauaccuccacuagagcauuuaucacucuguauuguaauuaugucuguguccagcucccucacuagauugugagguccaugagggagggcggugucuuauucaucucuguauccccugugccuagcgaauacagaugcagaaaggccaucuccagaucaagaggaaauuaacccaagauugguuauaugggauuagaucucuggaagagaagcgcccaucaccugcagugggcccccagaugacuggaucuuguguucaggcauuucagagacaggaacauagaaaucugacacagccgcagccagguaaaacaucgcagaagggccugcaaagagaaacacaagguguuaacaaaucggcgagguacgauauaggaucagcuccuucucaacucggguuccccagcugagauccguggguaagcaggagguaaggggauaaguggcuggaaagaaaggcugugcuuccaggcaaaagggguacuccuagggcacgcaccuagcggauugagugccugggccgcagccugcaacagaugcaaauaguccgccaaaguggugaacucuacugccaggaaggugccugcagccgcagccuccugguagcuccucagagccucagcaaaacccggaagugcauucuccucggccuccaggcucagcaagcccgaaagggcugggcccgaaggccgcagagcggacagccaagucuggggugggaagcggugggcauaggggaaggcagagcgagcgcgauacaagaacaggaccccguagccggcggcuaggaaggccucggccgagguugcaccgcgccgcccgcugcugaaguuguccaggaagcgcaccggccgcgcuuccagugggaccuuggugccgccugacguaaccaacaccacccgccggcccugcgcgcccagccuggccgcgaagcgagccauaaccucagcccagcgcgcagcaccgggaggcugggggaacucggcuaccggauccauuuccgccauc

SEQ ID NO: 18191 - RNA, 2583 nt, Homo sapiens
agaaagacuauuaguaaaauugaugauuuuucuuuuuuucacuguuuaagaaauuuuuauuaaagcaagaauuuuauaauccaaaccauguuuccuugcucaguuaucaauucuguuacuuaaaacagaauggacauuuugagcuauuccacaguaaagaauuaaaaaauuaaaggaaugcuuuaaauuuuuguacuuugcugaaaauucuuuucccagggucuacaaaacauuaacugguuuuuguauuuuacgauuuuuuguuuuuaaaucaaaauuaaguaaucuuuuuuuuguuuuuaaaucaauaaguaaucuaggacuagcauuauauuugcuagaccuugcauuugcucgguacauaagguucaaaguuuccuuuccauuuuuuauuuuagauuuugcauuuuuuauuuuagauuuugcaauuuuuuuucccauaguuucucgauguuuagauauuuuucuucggugaagcacaaauuucuuuucguggucucugaucaauuuuaaacaguuggaacaccgguagcacuguuaacugcuuucuggguagccucuuuagcuuggugggcuuguaguacagcuacagcuucaucaaccuuagaacggagugacucuggagacucgagcauauaaagaaguucugaauuaucaaucuccaacaacaugccagugauuuucccagcaagaguagggugcauggcuugaauaagaggaaagagccguucaccuaacauuugcuuuugcuuuugaggaggggcagaugccaaccuggaggcagucaaaguuuccugaccuuguacaugaacagcaagcuguugcauuguaacuuguggcugugcauuacgauguugcugaggauugcgaacucccgcagcauauuuauaccguggaaccgugcgcacagcagggguagcugcagcagcagcagcagcugcaggacguggacccacugucuguguugauguguuagcaacacgcugcguugacaugacucguggaaccugugaagaagcuggucucauaguacuaaaugguacucuaggagcaccugggcggauagcacugggcuuauuuuggaauggaugaggucuggcacccugagcaguccagcgaggacuuggucuuagucgagcaauuuggcuaggaggauaguaugcagcaugguucugagucugugggacagcugucaugaaguaaccugaaggaggugcucgcugguugggcacagcucguacacuugccauucucugcauauacucguuagugagguaagccuggcgcucuucuuugcgcugagcuaaagcuacauacaauggcuuuguggccacaauucuaccguucauuucuguaacugcuuuaguggcuucuucuggggaggagaaacauacaaaaccaaacccuuugcugcgaccaccuuccaucauaaccuuugcacuagugauuguaccaaauggagaaaacgcuuuccggagacguucaucaucaauaccaucaucaagauuuuucacauaaagauuaacaaccugguaucuggugauccuaucuugcuucaucuguucaaaugugcgcuuaaguuccgucugccguuccacuuuuuucugagcucgaccaacguaaauuuguuuuccauugagcuccuuuccauucaucucaucuacagcuuucugugcaucuucaugccuuucaaagcuuacaaauccaaauccuuuggauuuuccacuuucaucggucauuacuuucacacuuaaggcgggcccgaacuugccaaagagauccuuaaggcgcucaucauccaugucuucuccaaaauucuugauguaaacauuggggaacucuuuugcccuagcuccaaguucagcuucucguucuuuacgagacuuaaauuguccaacaaauacuuugcgaccauuuaggagcauuccguucauuuuuuuaauagcucuuucagcugcuucgugugucucaaaguguacaaauccauaacccuuggaaccauuuucaucacaaaccacguuacacgaaaggauguuaccaaaagcagaaacuguaucauacagugcuuuauuauuaauggacuuauccagauuuuuaacgaauauguugcccacuccacuuuuucgaagugauggaucacgcugagaccacaugaugcguacuggcuugcccuuuauaacaucaaaauucaugguguccagagcaugcuccgcguccuucguaugcuggaaguucacauacgcguaguuggaggagccgcuggugaucaagucccugcagauccggauggagaggaugggcccugccgggcugaacuucucguagagcaucgccucagucacgucgggguggaggucccccacguagagcgaggccguuggguagcugggggugcugggguucauucucggcacggcugcccgcaggcacacaagccgcgaccuuuccguuacaggaguagagcgcgugccggggccgggggcguagccggagggaggggagcgggggcaagcgcagagggacaaaaaucagccgaaaucgaaaacuacucaacggccgcagaacggggucgauccgcugccg

SEQ ID NO: 18192 - RNA, 4267 nt, Homo sapiens
uuuuagcuugggggccggggcggguguggguguaggugcaguagagaugggaacaaaguagccuuuguuugaggcauucuucucuugccacuugccuuucagcaucugcauuacuaauuccacaccuuauuuuuccuucuccaaaauaaucacugucugcucacagcaucgaguaaaaagauacauugucaugguauauaccuggagaaaccaguuugauucuuuguugaaccauuucuuuuaauuucuguaaauaaguaauuuuauggucacauuguaaagcagagaaacuguugauauuuuaccuuuauuuagauuuuuguuuuaacuugaccuuuuuccuuuggaaagcguugaacuuguuuagcuaacuacuccuauuaggggagcuuaacuuggguaaagucaaaggcccacuggcuguuucucaugguggccugaagccccgcugcuuuccagugaggaaaagaacccucagcacguuacugagcuuuccucagguauuuuuuucucugucaccuacuuuacaaauacagucagacuaaaacauuaaacaagaaguuuaagggggaauaacauugggauuugaaaaguuguaugugauuaauuucuugcaugcaaaucaauuuaagauuucuuaaauaucuucaugcuuuucuuggcuggaacuuggguaaauuaaccuguaauuaugaauuauuuaguuuaacucaaggugcauuuuuauuucacagauugauacuugcuuuuuucugugaaacaguucuccuagauaccaaaauccucaggaugaauuuuugcauuuguaaauaacaauuuaucuuuguaaauuacauuuuauuuauuuagaguucuaaaauugagggcugaaaugaaugacauguaauagaagacaaaacuguaccaauacgcuguuaaccaaucagacuguccagguauucucauuucauaaauauguauacacacauauaaauacacagaguaguguuagcugaugugagugauaacagcgaaucaccauugagauggucauuuggaucauguaaacaaaccgugucaugucucugaugggagcgguggguaguguacuguuagguggacaggucuuuuaacaugcuacuauuuguaaaaguuuccguugccauaacaguucauguaguagucugugaaaauucgaagcugucugucaagcugcuaauauacaaguugucaugguaccauguaacuuaaauugaugaauuucuaugcaauuuacuauucucugaagccuaugaaugcagccucaucucauuuucaguuaaggguacuuuauguauaauuaugucauugcugccuuuuauguaggaaauguaaaaaaguuuuaaaaggcgaaaauaacauuacagauuucauuuuuauacagguuacaauauuaaacaugaaacuaccaaauuccaagaauaguaaaauucuagagucaguugauugauugaaacuauuugacaaaacaguugaaagcugagcuuucagucaagaaguuggugaaauuaauguccuuaaacuuuuccuuuaggcaaaaugucagggaaaacuuaacaugaaaguaguuacucccauacgcaccagugcaguagcuccagguguaagaggucacgaaggcacccugcccauaaaaccaggaugugcauacguacacacaaucggugucugguuaugguuuucuaaacacuacauaaggaucugaauuuuuuagugugccaaaagcaaacgauagguuuaaaugaaauugcucacuaccaaaucaagacucuucauauauauacguguguguauauauauaugucauaacacuuucacgugugacagccuaagguuucuuuaguuuuaggaugggguggggugggagugguuuugcauguuugaccaggaugugaugccugucuuuauuccuugauaagaaguagcuguuacagcauuucaagcaaauuauuuuagguagaauagaacuuacugccaaaugauuauuuauuuagcaaaaauuauucuccaacuuuucgaauucacaauuuuucuaagugcauagaguaguuuuuuacauugucacgaauuccuuaauaccuuuauuuaaaauggaaaaaauauggacaauauuuuagaaauaugugcuacacaucuaauuuuaucuguaguuuaagugaucuaaauugagaugccuuugauaugaagagauuuaccaacauuauaugcacucgugccuucaauguggaaucaaacugguuaaccucagcacaguccucucguuucuguguuucugcugcacuaauugccagggggugggggagaaggcgaaugaauuaauucauaguagaaggaggcgauaggugcagcaaagggcagccacaguguugauuccacauuauaauguuguugccucuucuuggcaaaagacaccacauugugggaagaucucagcuuccaggguaaaaguuaauuuauaacuuaaaagugcuauuaaguuuuuauuaccaaauauaucuuuuaugguuuauauuguagugguauguaugaaacauuuaaaauuuuacuguggaaauuguguauauauauauauauagucgaaauagguguucacaggucacaugugaacggagaacugcaugaccguacaugaaaugcaauaaaccaacuggaaaaagugcaugugcuucauccucucaagccaacugcagcuggaaagugcugcuuauccuccacccccagaaaaugcauguaucaauaugagaauaaagaacgcacacuuucaauuuuauugaggcuuucaacacuauuuaaaagaaaauguaagaauuugacauucuggaguuauuauaacauuagaaaaugagcauaacauucacucugauuuuagccauuaagggagauuaguaaacagacugcuacaguguuccauaguuggacugugcauccaaaacauuuuuuuaucuuuaauaaaugguacaguuuuuauguaguuuucgaauguaagaagaaaggaaugcugaccaaaacuugauuucaucagcuucaugaaaaggacuagugucauuaaccuguugaacagaauugguuuauuaaaaaaaucauuuccaguagugugaaaccuuuacgagucuuuaacaucuaaauguuaugacuccuuguaccuuaaguuuuccagucuuucuuauuuauaucaucuccaaguaccucuggcuccuuuccucuugcucaccggaaccuuaguuuuccucaacagaaugcuuuguuaaaguagcccacaguugcaggauccauagcaccgucgugcagacuagcagcccaaagguguguuugguuuggcuuauacgguguuuugcuuuuuaaacuacuugccauaauuuaaaaguggcaacacuagacuuaaaaaaaaaaaagucugauugcccauauuagauuuuuuuuuuaauucuucacaaaaucugcucuuccugaaagaucaaagugucuagaaagcccaaacauguauucuuaacauaguaggcaccagcugaaacugaguaauuaaacgguccccugaagccaaguauucccugguuagucgccaccccaccacuccuuccugucucuagugucacacuugggcuguugauuuucuuacucuucucuugcuuuaauccuuccccccggcucucuggcuccuguggauaucugugcuuguuuccugguccaggauggugaucugacuuucaaaccagcuucucaaaaggggugacauaaaaucaguuuugauguuuuuccuccugaaaaaucagaugaauauuuuagucacuguuacucaugcacauuguguucuuauguuuacagaagugcuuaagugaauggaagcacuagacauuuggauuuccuuccuaacguaauuuuuaaugauuaccccuuuuauacaguaauuuguggucuuuagaaagcaguuaaacuaauugaccaucuaauaguuguacuauacauaugucuaaaauaauagucaugguaaguuuggcaucauaucuuccccaaaaaauguuuauuaaaauuagauuauuccaguuuaaugcuauuuugugaacuguauacccucugaaagcgcuuauuuuuacaugcuacacaacaguuccaauuuuaaggagugucuccuaaaauugggaugaaaaucuacuguagucuguuuuaaaguaugcuauacuauguucauugguuacuuaacuggauauuaauauaaagguuauuacaagaaaaaugaugaagagcaaaagga

SEQ ID NO: 18193 - RNA, 161345 nt, Homo sapiens
gcaucaaaaccuugauuuugauuuuucuagguacugaaacagccuucauuacuuagagaccauagcuuuuuugcaaguuacuauucccugcauuuagaaaguucaucuuuaaacaggcaauucaguaaguaaauauucuauggcucuaaaacagauacggcuguuggagacuuuaaaacaucugacaguuacauuuuuaauguugucuaccaaggcuauuacauuuccucugucaaaguaacuuaauuuuaaaaacgaacucugugcuuguuaaacgaaaaggccagaaggcuacuggcuacucagcguucauuugaaauucuuauagugccuucaguacaauucaaacuuagaggugauucucacaauucaugugaagcaacauuuuacaaaaaaaaucaccuacguucacuguuaagucagaagacagaaugauuaacaaaaucucagccgcgaauuacucucacgauggccaacuggauauuaaauaacucugcauuauuuuaauggaauguuauaaaggauuugcaacaaaaugcagacguagauuuagggacugccgacuucuauagaucaaggacuucauuggugcagcugaggaaauucuuccaaacaagucuaaauguuggaaauccaccaaacugcagagaaagaccucuugccuccguauucuuucuucaucuguaaaaauguugacuucugcuuuucagacuacgcgcacagccucuuuauuuccuacugcggcuucauucccucacggaacacugacgccaucgcgaaggaagcauuucgagcacgacugacgcuccccuuauuauuugcuaagccgcugcgcucgggucuggcuacgauuugcuuucagaauaacgggaaggugcaacaagaucgcuucccuagaggcgcgucgcccgcguggcccggaccccccacgcccgcccgccgccccgugggugcgcacgcguguccgcgcaggcuucccgccuggcgagugcaaggcuccucuccgccgugcugcuuuccagccucucagcaaaucacgaacaccgaaagaagccacggcggcgacgggaggggcgucgcgcgugcuucccucggcgacaaagcgggagccgggcgcgccggccgagggcgcccggcgcagagucccgcagaggcggacgccgcggcacgcgccucgaaaagccucaaacucuuauccucggcucucccgccccaccuccgccccgcagccaagacccgcgccguggcgggcccgacggccaaggaaagcccaccagcccuccgcaccgugggcgacgggccaagacccggcccuaaacggccagacccagccccuagucggcugccgcccccgccccacgcaggcgcgcuccggggcccuccccucccccaccgcgcgcucgcggggcccgacgggggcggagcgacccucggaaggggcguggcgaccgggcucgacgcgcgcacgcgcucuggagccccacggcuacgugucgggccacgugaugcccaccccgaaagucccccgugaagcaacaggacguuaaaaaaaaauuucucuucugcgggguggauaagagguucugaaaaaacuauaguaacgggaggcgaggcggaggcagcgcuggcgcgucccgcuggaauuccucucgccugccgcgccagccccgaccgcgcccgcagccccacccgccccgugccguggaaagccccgcgccccccccgcggccgucggccccgcagcccacacccacccgccccgggcgccccgcacggcggcgacccaguccuugcgcccaggcccgccgagcgccgcaguccgucacacucccguugcccccgucgcccgccccgccggggaggcagggaggagggggcgcggcgccggcggcugccccggucgcggggcggcgggcagcaggcagcgggagcgcgccggccgggacccgcuaacggccgcccugcgcggccccgcccgccgcccgcccccggcccuccccgcgccgcugccccuccccccgccgccgccgcugcugccgccgccgcuggcagcgccgccugaacugaggcgaacuccgccgccaagugagugaggaggaggaggaggagaaggaggaggaggaagaggaggagcgcagucggagcgcggcggcagcggcagaggcgccgcggcggggaccagcccagagagaccccccgagcccgcggcacaggcggcggcggcgcugagcgggcucgaccagccgagcgagcggcggccccggcuccuccucguccggcgccagcagcccgcgccccgcgcccgcacucggccagccgagacccgccucccgcccgcccgccggccucgugagggacgcgccgagccgggcggccgagagcggcggcggcugggagcgcgucgggcccgggcggaaagugccugcggggggcgggcgagcgcgcggugccggccgccccggggcucggcgcgggagccagagcgggagccggcgcggagcgggacgccgggucccgagcggcccgcggccggggcucgcccccgccccucccuccucuccggcggcggcggcggcggcggcgggcggagugagcugcggagccuggaauauggucggggaaauggaaacgaaggagaagccgaagcccaccccagauuaccugaugcagcugaugaacgacaagaagcucaugagcagccugcccaacuucugcgggaucuucaaccaccucgagcggcugcuggacgaaggugagcgucuccagggccccggccccggcccgacccccgccggggcggccccuuuccccgcuugggaugguggggagggcgggaaggucacggccgggcgggaccgagcgccggggggacugggaggccaggagggcgcacaaaggaggugccgggccgggcuugcggcgggcgggcgggccgggguggacccgccggugccggacgcccccugcccggccgggaccccgcgccgcuggcguccaaguuggcgcguugcggagggcugcggggugagcccugcggccccucuagcuucggcggucacauuuccgagaggucggcgggggcugcgcggacucggugguccucgccgagcccucccgagagcaggcccacgccgcgccgccggccuggaggacgcgugugcccggcgcgggccccgcuccuccgcucggccucccgagccugcucugcgcggacccccaccgccccgcguucgggagcucuccccucccgugaggacuaaagcgggguuucgugguuggggaguuggugcagcuguucaauacuaaguggaagucaguguggggcucguuaguuuaaagaaauuccguaggagaccgaaauuaugcuggcguagccgacaaggaggacuaagugacggcgaaaagcacuuuuuucccuuuuguuuggggaagcgagaacuguuagggaguugaacuucacuuuucgggggugggggggggggggguggagugcgaaauaacgcgaugacagaucggagcgcagccugaguuagaagaacuugggcggaggguuugcucccggggacgcagccgccugaguuuguaggacaggguuucgagacguuuggaaagggcgaaauaaaauugagccaaaguuuccaaaaagcuguauggagcgcuguggggagugaagaaugacaagaagauuaauguugaccaacuuuggaauuuccuuaagaaguucucauagcaguaccugaaguauuaauuucuaguagcuguggguuucuguggacgccuagagaaaaaaaagaccacaaaaaaagucuguuucgaaaaucgacuggccaggaguuuguuuguuuuuuuuuccugcuuagaggcaccaccggaggacuguguaaaggaaacugaaaacuacagguugaagagaugaacaauggaguuuagauuuuucgcaagaauuucgagauuuuaaaaauagagucggggaacaggaguuugaagcuuggggaguuggaaugucacuagagaacaaaaggccggaaauguuuccaugauaaaaaaugguuaaagaaaaaucccaggaguucuguugucuugaaagucauagaaacaacuuaaaaguagaaaaugguuagguguuacggcuuucucgucguuuugcuuccguauguuaaacauacagcacucaccaacguugaaaugggcauuuuccgcuguuggaacagcaaaucuguuaauuucaaguugcuccagagaaaaccugagcugucccuuuaagggguucugcuuuuccuauuuguguuggcauuugaaagauuguggaggcagaaaacuuucuggaaugucaaaaaaaaaaaaaaaaugcuggaacucuuaaauugaguauuuccaaaugugagcgcuaaggggcgccaguuauuuuuuaaccauggaaaugguuggaacaaaauguguaacauacucaaucugacugaccuauauuaaauuuaguugaaacuuaaguuauagauuauuugauuugucauaauguguuuauauaguguuuucgaacauugaaaauacuuuccuuaaaauuauuggcacaacuuuaugacguuucaaaauaacacucuuacugucuucuccuuggcauauuuugguuaaguuaaaguuuuaguaguauuaguaacaauuucuggugaaaguuuguuuucuugagugcaguuguuuagaaggaauccuuuaucgacgauaaaaugaaaauaggccuuggcaauauuuaggguuaauuaaaauuaaauugcauuccugaaaugucgaauucaaagacuauaggagauuccaaaaaaaaguuugaaaauacuuucaccuuauguauacuauuuaaaaagcugcauacuuuugcguucuuuaguuuuaaaaggcuucuugugcuuuuauguugaucuaaaaucucuaaauuuagagcugauuccuuguuaucaaguuuccaaccuuaggcuuuaauaauuuuuaaucuuucaaauccagaaauuucaauuaugucauugucucugacaaaggcuuauuucucucugguuggaaauaguacucguuugcguuuuaaauguaagagaccacuaugauaucuccuagauaauguuuguuuccccuuccccuuuuaaugugguuuacuccaucucuugucuugcuaucuuuaguuuuagccuugucaauuccccaguguaaagauugcuucuguguggcauauaguauguuuaaaaugggcaauauaaugacgaggaaguuugauuguuuuuuaucagaccaguacaaacaugcaggaaaaagggcuauuccuuaguguggaauaagcggcuuccuguaauuguuagccuuguuauaaacuuaauuugacuuaagaaaaauauugguuucugaaguccaucacauuuuuuuuucuggaugauuuaauugugaaauuuggcaucuugugcuuuaccccuuugugguuugucauuguccaaaacaaauugaucaugacuuuuguuucugguuaggcauuacuuuuuuuuuuuugccuauaaugcuuggcugaaaaauuacuuuuaaauuuagauaaaauuuaguaaaaauuuuacuuuagugauugguuugaugaaguuaacaucgugcuuagaguagauguauuuucugauaauuaggaauuuuaaaugagauuuuaaauuuuuuauuuuaaaauauuuuucaaagaauaagcuuuuuaaaaauaugcuugucagccuaagaauuuccauuuggcuaguuacaaauuugaggauuaagugugcugguuuucccaguugaugaagacuuggauguuuuagaaugaguauuuuaauuccuugccaaguuaaccuuuagucuguaucuugacuguggacaguccuuuuguuuuacugcuuguuuuuguuuuguuuuguuuuuugcuguugcugguggugggggugugugugccagcucuuccacugaaguaucuucaacacgguuguuuuuuaaaguugugaauacauuuuagguugggcccaucauaaaauauaaaggacauaaacuugaguuugaaaccuuuuauugaagauagagaugauuauaggauuacacauaaaaccuaggucuuaaacugcucuaccuuuagagagacguuuucaacugaacccuuagagcaguuaauauaugguuuuuaaaaaaacagacuuuucuugucaugagaaugaaacaacaguaguugaaugcaaauuguuauaauaaaguuuuguaauuuagaaucgagaaggugaagaguacggucuauuagacuuaacaauccuguauuaggggaaaauggagaacuaguauuuuaaaagcugauuuugaguuuucaauuuuuuagguggaggugggcuuaaagcugcugauagggaaauaaaaaauguguaaugaggaagaacagucaaucuuuuuaucguggauaucagaaaaauuaguguguggcucagaaaaagagagcagauggauuagaaugccguauuacugauuugaaaauauauuuucauuuucugauggucuuuuuguguuuacaguaaacuuucugucugaccucaguuuaguuuauacccugccugcucccucuccuuuaaauauaugaguaaaaauauuucguuaaaacuugcuuaaauaguugcuauuuuuucauguuaauguuuauuuucacuucuucugccucuguuauuggauguaucauaagguuuucuuaccauaauuuuuuuuuuuccugagaauucauuuacaaaagccuugacuuaagaauuauauggugguugguauugagaggacucuugcuauacagauuucuuacaaaaagguuuucuuuuugucugaagaagcaauuacuguugucaguaaucaucaucuguaacaaacagauuuuaaggugaaauaaucuguucuuuagaaacuaagauauugcuuuuguacacaguccuugaauuaguuguagcaagaaggaagcuacuauuuauaaucacuucuuuccauuaucuuuucucacccaggaggugucagcagcuauauauuggcagucacggaaaagaucaguuguaucauuauggggcauuuauuaaacauucauucuguacuuuuaaagcuaaauuccccuguagguggaacgugauuccuuuggaaacuguauccaguuuacauguuuuguaguaaaaguuguauccgacuguaacacaguugaguugauagaaauaggucucuuugcuagucacauuuacgaguguauuuugggaugaacacuuuuucuuaaaugacugagaaugucaaguuaaaucaaguuaauuugacuucuuaaaugcuuuaugcacauuauauuucuguuaaugcuucacuagucacugucgcuguccuggagcugauugaaauuggucaguuucccauaagagcaaaugguuuuugguuuccuuuuucagggaaauagauuucugugaugaaagaagugaaguauaauaaaacccucaugcuuugaccuggccuucaccgaagcaugauucagauucuuuuuuugaggccaauauacuuagacauguaagggcuuuucuuuucuuuucuuuuuuuuuuuuuuuuuuggugguuuuuuucuuuccuuuuuuuuuuuuaugguuugguuugguuuuuauaucaagggaauuacaccagugugaucauaggagcaacuuuuuauaaacuggaacuacaguuuaauuuacuugagaaauucgguguagcuaauacauuuguuugauuuauuuguuugauguugcaguuguaagcaaaacuugcccuucucuguuggagauggaaaaugcugugacauuguugguuuuuguuuguugauaacuuaaaaggcagcccacugagcaacuuucugcuauugguaugucagcuguuaugaacauauccaagguucuauuuuaaggccaagggauggggaguggugagugggccuauguuaggaggucacacagauauauaccagcuuuuuauuuacaugaucaacgggacuucauuuuuuucuccagucccuccuguguuugacauuaagacagcuuaaugugaauuuuaagugcaauaauguguuguuuacccuuaaugauaacuuuuagggaauauuuauaccccuuuaaaaaaguuuugggcccacaauagcuagauuauuucguguuuuacaguuauauuuuuuacuuaacagaaaaucacaacuaacaauaaacuuuuauggugaauauaguuuguuaucuuagugggacuguuaagaaauuuguuuauaaccccagucuguguuagguacuaccuucuauggagugaucauuauaguuagcauuggaauauuauuaccugucugcccucuuaaaauuacuuucuugaaggugccuaccuuagagccuggcauacacuucucagauguuuguugaauuaaacauguugacaucuuaccuccuuuuuugauuucuaguuucucaaagauaggguaugugcacaugguuuaaaaaaaaaugaaaaucugaaagugacauuagaaauauugucuaauaauuuuaagaaaugaagcaguugugugauuguugauaguuuugugcccuuagaggaaaaggcacuuauauguuuucuuaaaaacaacuuaaaaacaugucauguuauuuguaguacuugcugccaaggugcuuaauuuuacuuuacugucauuguugggaaggagauuuaggaagauaaaauugcuuuacuuaaauaguauaguuucuugucaguccuuauaccaaaggguaucaauucauaagcagagaaaaacuaccagugcucaucucagcucuuggaaaauuuuggcauuuauggaauuauauagguaaacuccccaccccguuaguuacccuuuuaaaaguccccacauauauaguucuuguacuccaugcagggcacaauagauaggaaugauuucuugucccuaagugcugcuuugguguguucaggauaacgacuguauuugauugagugauuuuaguuuaaaagaaagcugaguauaaucauauguggcugauugucauuuaacacaaauagcuauguuuuuaaacacaggugugucuuuuaauuuuaaacagugccauuacuuagaaaacugauaaauugaaguuuucacuuagcugaaacuaagcucuuuuauuucuuuuuucuuuuuuuuuuuucaguuggagucucgcucugucacccaggcuggaaugcaguggcgugcucucggcucacugcaaccucugccuccuggguucaaacaguucuccucccucagccucccgaguagcugggauuacaggcgcccgccaccacgcccggcuaauuuuuguauuuuuaguagagacgggguuucaccauguuggccaggcugaucuugaacucuugaccccaugaucugaccgccucggcucuugaccccaugaucugaccgccucggccucccaaagugcugggauuacaggcgugagccaccaagcucuaaacuguuuauuacugugcuuuagcaguaacaguguuugaaaaucugugaugaauuuuuaaaaaauauauugcagaagugauuuaucuagaauucuuacaauuagcaagaaaaggacugcacuuaauguuuucgucuucaguuucuugaugcggaaacucuaguuugaaaauccggcaauccuaucaagucuaacaaaauaaauuauguucauaaaguugcuucauguauuagucuaauauuuuuguagaacuaaauuuugaggcuggggaaaugaaucgauuguaagauuuauaucacauuauuuauuauaagcagaaugugucauauucugcuuagcagauaagcagauauugaaguaucggaaagaacauaauuagucggaugugguggugugugccuguagucccagcuacuugggacgcuaaggagcgaggauugcuugagcccaggaggucaaggcugcaguguuaugaucaugcuacugcgcuccaccuugggcaacagugagacccugucuuaaaaaauaaaacaucaaaaugcaguuacauccauaaaguggcuccacauaauggucacaauguaaguaaagggcaugugugugcaggcauuuauaucuguaagugaagacaugcagugaaugugagcugggcuuugugaguacuggggcugguuaaguuccagcugagaaagguuggccccgggauugaauaaguagcuggccuuaaguaagcaccucgcuuuugcuuuagugcaggagaggucauuguagagacugggccugaucuccuggucaguagcaaaucauuggggagcccuugguuuuuaagcugauuuuauaguuugaaauauauaggaaaaaacaaacaaaaaauaauacauuuuaagaguagaauuagggaaaugcauaguaagaaaacaaacaugcaauuuuaaaauuugaaaccgagccuggugagguggcucaugccuguaaucccagcacuuugggaggccgaggcagguggaucacgaggucaagauuucgagacuagccuggccaauauggugaaacccugucucugcuaaaaauuagccgggcaugguagagugugccuacagugccagcuacuugggaggcugaagcagaagaaucgcuugaaccugguaggcggcgguugcagggagaggagauugcgccacugcacuccagccugggugacagagcgagauuccaucucaaaaacaaauaaaauuuggaaccuuuuuuguaaacucuucaaugucauaguuuuacagggucucaaacuuacuuugcagauuauaucagagaauuguguuuuagagcugcaggggaccugagaguugggaguauauguucauuucauaggugcaaagacaagugggcagcagagcuagagcaagacacucacuucugcccucuguuccauuuuguggcgugccucuccacaaggggaacuggagggaaaaaccuggaauauuuccauaugcuaaaaaucugcugcuguugccucaaguugugaagguaaagaagacaaaccaaaugauuuuuugcuaauucugugauaugcugguuuugaacaaaugauggucagauucuuagaacuagaauuuauuuuuaacgauaacuuucuaauuaagaggcuaaaagugagaaagccauuuuuagaggauuucagcucauucacuucuuuguaagcaaaggcuagagccucaguuuuuugaauaauguaaaaauuguugcugcuauuauuuuuacuacucaagaggaaacauuuuuggcugggugauuuaauagagaaguaugcuauugcuaagugauucaaguuaggaauguauacuuguaucaguuuuagaucagccugggguaaacagcccaaugauauaucagguagauaacugaagagugacacccaggagguggaugguuaugaauugaauggaaacggugcugcaccagauagccaccagguagcuacuauaucguauuccugaugccagcaucugggggaugauugcucauuucaaauaauucaaacaaauuaaauguaagccacaguucuuugcuauguuacagcaauuauaucccuuugauacaguuguuacauggcaggugaauacauuuuuuuaagaaaaaaaaauuucaaacugggaucaaaaaaauuacccugaaaccgcaucuaauugucuauugucgcugauuccaccgugguugcagugaugccauuaucaugagaguauucaaguuuuaacucuguaugugugugccugcacaugcgugagccagcauaaagaugaaaugaauuuauguuuuugugcauaugcuaaugagacccugugaugaagugguaagcauucuuguacuauagaccugggaucuaaucaugacuccgcaauuaacugguuuggugaucuugggugagauaacuaaugucucugaaccucaagcuucuucaucugugaaugaaauuaucaacugcccugccaaccucaaauccaaauacucugaaguugauggguauucagaagagccucucauacuauaaaguagcagcaucacugcuugguuuuuaauuuuuuuuuuuuuuuuaauuuugugugagucuuucucuguugccaaagcacuggaucuuggcucacugcaaccucugucucccagguucaagugauucuccugccucagccucccgaguagcugggauuacaggcgugcaccuccacacccggcuaauugcuguauuuuaguagagacaggguuucaccauguuagccaggcuggucuccaacuccugaccucagguaauaugccugccucagccucccaaaguucugggauuacagguguuagccacugcccccggccugcgucaucugcuuucuaucaacauuuuaaaaucgcuuaugauaggauaaacaauuaaauaagcaaaacagcuuuuagagaaugagaaaagaaaaagaaagaugauguauccauguagguucagcuaguuuuuaugugcaugagagucacuacuaacauucugguaguuuagaggaugucacuuugagcugaacuaucuaguuauguuuauuugagaaguggaaccugaguugauauuaacagcugguaugauuuaaugaggugaaugggaagguggaggauguuccaggagaagggaaggugcagcauugccagcaccauggugaugggcaaggcuuaggaaauagguacggauuuaguuaguuggaauggcaaaugcauagauagaaguagugggaauagauagagacuacagaaagcagaccagguuagggcuagauuguggugggccuugaaggccagaauacauagucugaauuuuauucugaagguuguagggaaucuuuaaggcuuggauuauuugggggugucagaaugaacucuuugugcauaaacugagaauguauacaauauauauggguuuaaaguagacauuggaugaagugugaagagucaaacuauuauauacguggcuaacccuuuaggaaaauuuuuugaguagugauauuuucucaaaauaguauuaauaaaaauauuuauauugaguuuucuguauuuuaaacuccuuaaagauuuuuuaaauuuuguuuuaacuagaaacaagucuuuguuuuccuuaccuacagguuaguguauucauccugaaggauugagaacauguggggcucauuuguuuagcugucagagcccaauuuuuaguuagagaauugagcuuuuauuucuauaugagcuaaagacaauugaagagacucuuggagaaaaucuuaggaauucuugaauuaauuugccuugaagaaaauuuugucccaauuucagagauccuuuaaauauguuuuaccaaguuugaugcgggcuuuuaaaauuuaauuguauuaauuuuuguguuuauuuuagguaaaugagagauaucuugacauucuaucccuagagagauacauauuuguguaucuuuaaaaguuaacacuuccuuacauagugacauuacacugagcaagauggauuaauccuacagauaacguaauaaccaguccauauucagauuucuguaguggauccccugauauucuuuauagcuggauuguucaaaccagaaucuuacucaauacugcucauuaaaucugguuguuacgccuuuuuaaaucuagaaccaucucuuuuuuuuuuuuuuucaaaugacauugauuuaacuuguucagggcuuguuccuuuaugcccuguguaucuauuaacauuggaagcuaguucuaaaguagguucaagaauagcaucuuccacuggaguacuucauaggugcugcuguguacuuuguuaucuuacaucaggaggcacaguaacuggcucugccaucagauaaggaaagauugauaccuggauuagaguggugauagauggauccuuguacuuuaaagguaguuuuuuuuguuuuguuuuguuuuguuuccccacuuggaaccagaaggugccccaucgaccaaaggugccccgucaacauucacaccugguuuugaccaguuuuuugccugaaucaguuucaucagagcuugcaccaugaugauacuuuaauucugccauucuuucugcaauuacuuggcauccuuugaaagguacagcuuucugaccccaacacggaaauacauugcgauuuugaagugaguuucuaauggggcaagccagauauaugcugcugcuuauuauuacuugguucucaaaguaaaguguugguuugcuaguugcuucaaauggagaccaaugaauuuuuucucucuuuucuaaucaucuuuguagacucauggauuucauagauucaauguacuuaagucaacuauaauuaauuuugauguuaaaauuauuacaacuuuagccauugauaauuaaacuggcuccugugucuguugaacugcugcuugcuuucuggggcacaaggcuucccuugugccuugucugccuugccuguucuggagcuacacuuggccauuucuccaauaggaaugguaugaaauacuugaauuuagguguuaaacauguucauuacucucaggaugugauuacuucugagccauuuucuauggacaguauugacuuuaaaauucauucauucauuuuuauauuuucaauucaauuuuuuaacguuacuguuaauuuuauacucguaccuuuuuuuuuuuuuuuuuuuuuugcuggccacagcuaaacuaauguuguucuugauggugacauacuuauuugcuuuauucuacaauauuaaggaaaauacuuucaaaauaacaaaauuaauaauauuacuaauagcaguaaaacuaucuuuaaaauuuuuaaauuuguuuuagacauguuaccaauaauauagccagugacccauuuuucugguugaugacaauuauuuuccuuuuuugguggggggguccucauucuguguauacuaaguuuuaauuucuacugaaucuuguuuuugacuuuuugaugcugucauuuauuagcuguguucuuuuguuguacuuacugcuucuauuagcuuuuaccuuaugcucagcagacauggaaaauacacauauauuuuaaugucaggugcgugcgugugugugccugcaugugugugcgcgcgugugugugugauggcaauaugauccagaaagauaacuuacaaggagaugguuguuuauacuagugcuuuguaucuuaagcacgaaggguagggaaaaaagaauaugacaggcaaaauguuucaauuuagugaauucuucugaauaauaucaguaaaaauauauauagaucuuuaaagcuuuuaaagucauaugaaguaggggaaaccucauagguagaaaguaagucuuaaaauuguauuucuuaguaguugcaaaaucucuagugcaaacuuguugucauuaagaacuuuuaguaguaaggaacuuauguuccagcagauggggauguuaguacacaaaagagagcacucagugauuaaaauguguugagaaauaacccuuuugccagaauaggaaaauguucuccuuuaaauuguaagggaagaguugcucaggaaugugacaaauaacaguuaccuaauugaguauuuucauuggcaugugaaaaaguugucauaguucuuuaaagaacuugucuuuuuaagagacuauauguugguauguugaccauauuaaauguaacuaguuuaguacaucagauugauugcagcuauuuucugaaauaguuucugccuuuacaacucaguuguuugaaggguuuuuguuuuggugggugacugagucacauauauugagagguauccuguuuguacguuuucuuuguaauuauaaagucuuuaggcaguuuauuucuguuuauuaaaauaaaucagaagaaaaugugucauaguuuacuauauguuauaugaagagaaaguucuuuuggggaucauaguuuuaucauaguaauaaaaaauuaucagcaguaaaaaagauagucuuaucucacuuuuauuauaguuuauagcauuacgacauacuguuagcuuuuuuaguagguaaauacuacauagauugcuuuaacauaugcuuugcaauuguugaaauacugcucauuuaaguuccuucuuagaugugauucagaaguguacuuuaauguauuuaaguuauauuuuccuaguucaguuauauugagcuuuuuuuuuuuuuaaacugucaaggcaauuuaaaauacucuugccuucagugacuugaaauugaacucugcacaggagagaagaauaugucuuguuucuauauagagaaccaaggaggaagagauugacuuugccaccuuuguaacugauaauaacuugcauuuuagucccugcuccccagccccacuuuuuuccuuuucuguuauuccuaaaauguagagaauuggagaucgauccacagauuuucaguucaucuuuggcaguagcaugguuuguaacuuuuuucauuccuggaagaagcaguggugagggcacagagauagcguagcacauugucuuugaaccuuaaugggaauuacuucuuuucagggaaauauagcaauggccaauuuugucuauacauuuuaagauuguuucuuauaguuguuagagauuuuaugagaagcuugaauuucuuucaguaauccuaaagaacuguuauaaagaacuuauuuaucagaagaaauauuccuuauugggaaaaacuaaaauauaucaauuaaaaaguuaaaaguacucaucaugcacugauagcugcucuuaauguuuccuuguaguccccccccaccaguguuuauggauguagcaaaauuggaauuacgguuuuuaaaaaaaauuauaucaugagcaaaauuuuuccuugccauuucauauucuuugcaaauauaauguuuauaguaauauauuucaugcugucgagguauauuauaauuuacuuaacuaaucuguuggacuugccacuuugcuuucaggaaauguguguaaugauagcauuaaguggcuuuagaaguuacuuuuuuaaaagccuuaaguuacaaaauacuguaacugggaauuaugaauaccaaacucuuauuuuugcaaugcaguuaaucugaaauaagcauuuuauguugcauugcaguagaaacugguuguuaggaugcaacgugauuuucgaauaaugucagaguugcauauuucauguauuaguuuuuagugacuuaacauacuuaauugaaacuuuucauucuauucuaggcuguuugguuguaugcuauuaauaugugugcgauguuaugagggacacacuaaagcuucaaauucauuccuucaaguuaucucaguaguuggaaagaauaugaaaauaagaguaacaaaggaaauagaaacauaccaagaagacuaaagacuggugcuaaagaggguguuuuuggcugaggaggcuauggaauguuucaggagaggagguaaaauuucaucuggcucuuaaaggacagguaggauugaaguggagaacagguaagggaguggcguucuagacacagggaacgguguucuugaaugugggaacauucugaguaggaagguguaaauaauucucuauuagagagagcuuuuuauaccuuuggucuuagcuuuuuccuuuaucugccuccauauuucuguuuuuaguccagauuuucuuaucucuauccuguacaggcauuacauuauagagugauauauuaaugugguagauugcugugauugcugcuguccuucucuucccuucauuuucagauguucuuuuuucuugacuuugacucucuuuagguuuuuggagaagagggguaucuuacugccuaacuuuuaauuuuaacuauuguuuaucuguaugcuuaauuuggcuuuuuauuuuuuuuguuuuccuagugcauuuggauuuuacuuagcuuuuauuaugaagccauguguuucaguuuuuuucuguauguguaggugauugggcuuaugaauugaucaggagcauggaggaauagguacaucuggauuagcgagugugugaauucuugagcugaugggccuaagcucuaaaggauagauuaguugucagcauauucuggucuagauaguauggcauaguuuuuaccaguaugcuuucuuuuccccaucuucccaguuugcuuuuuacucuaauggcuugaaaaaguauagguuagguuggaagugagagaacaaaaaucugcuaauuuaacucugaacaaggaaggcuuuaggcugauguuugaaaaguguguuccauggaauacuggucuccugagguagucugagaaaagaaggguccuguaguccaggaaguucugcauacuccuuuugugaauucaggauguguugccauauuaagucuccaggauuugcagucaagaaaguuaacuugguuuaacugagcauuuucugaaauuacuugguuaaggaaauacgguuuuucuuucuuuuauucuugguacuaguucugaggauauguuaagggaaauuuuaggggauuguuaaagaucuguggauccuuggguggaggcagguuuaaacaauaauuguuugggaaucuuaauuuugaaugagagugcuggcucaagucaaaucaaaguaccccuuggaaaaaaaaaaguuauauuauuccacuuagguugggcuucagguuucaauugaaaggaagcaagaaaacuguccuugucuggcuuucauuaaauaacaauucagucaaaugauuucaguaaugaauuuugucuaacucaaaugcauuuguuauuuaaauaaaaauuaagaugugcuguuuuuuaaaaauguaauucucuaaauaaaaaaaauuaacauagaauccugccagcuuaaacaucaaacugaaacuuacuuuaaaauagguauauacagagaaauaugcucauguuguaacucaugccugguuuacaucuacauuuuuuaaauuugggaaugacugaauugugaggugaagaggaauuaguaaauuuuggaaagaaaaauacuuaucuuuguuaggucauuuaaacaaacauuaagaugcaauuuugugagaucugucaguaacaccgguuguuuucugugaacuuagauuuuaaucuauuaauagaauauauuaucuccccucauucaguuauaucauaaaguuuuggugaccuuuguagccuuuauaaaagggaagucuaaggguggauaguagaauagcauuuuauuuggaaggcccuaaagauuuuuguaaaaaaaaaaaaacaaaaaacuguucuuauuaaaaaaaaaaaaaaacccuguaauucugcaauuuuaaagcggguguggauuugagagaucguagacccauucuucauuauauauguaaaugcuguuccuuuacaaaggauaugaauacauuuuauauuuuggaaacugcugguuucaggcauguuagaucauuuggcucuugggacagaaauauauuuaaguuacauuauuaacaaguaagaguaccuuugggccugauccccucuaagcagaauaaugucaugacugauaauuguguaauguggcuaccuucuguugugaauagucuuaauuaauuuaauucuguuuuguugcuggaaguaucuacccaggguauuuuaaauucuuccuccaaauaagaauacaaucaagcaucuaaugcacagucauauuaucauuaaauugauguuaaaccaaagacaaaggcucuccuagguaguguccauuagcauuuuccagcagggugaaucuaggucuaggaacaauucacugaauauuugccuaaggguuuucacuuuccauguuuuacacaauauaaauaauuuaaaauccccccccuuuuuuuuuuuuuaaagagaugggguuucacccugucuaggcuagagggcaguggugcuaucauagcucacugcauccucuaacuccugggcucaagcgauccuccugccucagccuccagagagguaggacugcaggggugagccaccaugccuggauaauuaaaaaaaauuuuuuuuuugguaagagacagggucucacgauauugcccagccuggucuuaaacuuaaggccucaagugauccuccugugucaggugucagccaguaauuuaaaauguuuuguuaagaguagucucucucuuuccccacuuuguuauagaucugagucauuugcuuuggaauaaugugauaaaagucuaagauaaaggauugcuagacuaauauuuagacauguuuguguugauguucuguacagguuguaguuuuauaggcuagaauagacuaaauuuugaagggugauuaguuaagaauagacuaaauuuugaagggugaucugaaaagacuuuauauuguucuuuuguaaaucuugaguaaaagaaaauaaccaaacaggguagugaguagagagauaaaugaaucccuuaagagaaugauaguaauaaaggcagguggaaguaagaucagaguuagaaaaucuuagauuuguuuuagguuauaggaaaauugauuuauuuuacauguugguaaaaggcacaagaggcuucuuuuuacauuuuacuuuaucaaagugaaacuuuuucauuugauuuuuaaauuggaacacauuaacugaauggcauaggauauaucauagugauguuguuuagguacaugguaacugcagauaggucucaaguugaccacauuugaauguuacauuauuacuuuguggauauuuaaagacagauggcuugaagccugagaagggggaaggagugaaaguauaggagcaaguggugguaauuuaagaagauccucaaguagaagucugauuuugugauuucagagucucuuuaauuguuaauguuacuauuauuaaauaacagguacauauauccuaacaguauaaauaugaaccagaaaaauaguauaagaaugaaccacaggccgggcacgguggcucaugccuguaaucccagcauuuugggagaccgaggugggcagaucacgaggucaggaguuugaggccagccuggccaacauagugaaaucccaucucuacuaaaaauauacaaaaauuagccgggugugguggcacgugccuguagucccagcuacuggggaggcugaggugggagaaucgcuugaaccugggaggcagagguugcagugagcugagaccacgccauugcacuccagccugggcaacagagugagacuccucucauaaaaaaaaaagaaugaaccacgaaagguagcaugccuugcacuuuuaaaaugcuaccuauaagguuaaauauuuuguuaugaacuuaaaauguguacauacacauuuauauaacucaacaauugaaaugaaaguuucaugaaauaauacuugucuguacugccugugaugcaguauacuauuuuucuauucuguuucauuuuuaaaaagguugguugugauugauaauauugauuuaguggcuugugugcugugcagucuuagcaaaaccgaugucgauuccugcuguaauuuaguuuucaacaaacuuuuuuuuuuaauccagcucuuugcugggugcuggggggauacaaagauggauaagacauagucuagugcucaaggagccacacaauggcauggagaguaaugaaaauagaagcugcaaugcuguaacugcccuaacagaggcaugcccagccugagauggaaggggccacaucauuuccuagcaggaagauggcaguuucuucuagguucacagauuacuacugcguauaaucugauaaucccucuuaugacgggcuuaccuugaugggaaaguuaguuuuuuaccuagauuuuauaaaaacuaaacaauaaucaaguuuacuugaaaauaagauauuuuugaacuuuuagcuuacuggccaaguuuguuaaaaaauaaauauuaaucuuggcacuuugggaggcugaggcgggcggaucaugaggucaggagaucgagaccauccuggcuaacacagugaaacccccucucuacuaaaaauacaaaaaauuagccgggcgugguggugggcgccuguaaucccagcuacuugggauguugaggcaggaaaauggugugaacccaggaggcggagcuugcagugagccaggaucgugccacugcacuccagccugggcaacagugugagacucucaaaaaaaaaauuaauaaauaagauaaauguuaauuauauagauaaucuuuaaaaaaauuaaauuuuacaaaugaguaauauuuuccuaaauaugucauaggaacuagcuuuaauauuauuauuggagaaauacuucuuuccugacuuuuuccccccucaguauugugacuuauuaagaaagguaaagucagguagaaguuuaauauaaaaauauauuugauuauuuguacagaugguaaauuaaacuguaaaauaaaccauuaacuuuuaaauaauggaauaaaagauggguacuuaauuauccaacacuuaaaaaugauuuuuuuaaaaaauugcaacuuguguauauucuguauauugacuuuuuaucucacagugaauucacaauaauacugaaucuagacguuaauagauuaguugcauauuauccaaaaaacauaaagcaugacauuucuauagaauuuaguuucuguaaguuacgcaauuguuacagguuuuuccugugaaggauaggcugcuaccucagguugaagaagcuaauguuggagugaauguggugguugccuuagaaugauuuugccggcagcagugaaaaauguuuuccuuauaguucuugugcagcaggccauggaguaaagcacauuuuuauaauaaaggugaugaauuuaaucgcaaacuggcagccuaauggaaauugcagaccuugauacugggagaaaauugccuauaaagcaacucuugagagaacaggcuuuaaauuuauccacccauuuugacauugaggagaacauuggaaucauaggguauuuugcuuggccugcuuaguucagaugaaugacacuugaguauucuauuuaaguguuagagaugguuuaaaguuaaguuuuauacauuaaagccuuuagcacaugcauuuuuguauuuuauaaaguauuuaaaauuuugcugguuuuuaacauuuuaguagaugauaugccuaaugaaauccauuugccacguuucuagucauaugccguguauuucauguuucugcuguauauaugaggaacugcaaucuuaaaggauauagaauauugugggcuuauaauuaacacuacugacagaauguuugucauauaaaugaucagucuuuacuauuuucuauuguauuuaagccauuuauauuauaauauuuaaacacagaaugguagaaaauuucuauuacaggaaaaucuggguuuuugucauuuuuuacucuaagugacuaauguuuguaauuucuuaggaauaaccaaacccuugauucaguacacacuauuuaaaguguuuaauccagaauuuaggugcauuguaguguguauuuugagaugccuguucugucccgcaguauacaugcuuguuaacagauagcuaauguccaaguucagagaauuauuuguggcuauuggaaacauuuacccauccaagcaagguaaauguuuaaaauguagaaaugcugauguaaaauauaaaaauaacauuucucauuauacuuauugaaacuacugggguuuaaagguaaagaaguguuaacuucuagaagguuauucgauuuugcuuccauacacaacccugauucuuuugacuguaguuuugggcagcaugguacauuacauaauaaggguauagcugugguagaucuuuguucucuuuagguauagaauuggagaaguuuaaguuuaaagcaaguaugagagcuuaauauuuugauggagaaagcaagaaaaacguuuuacaaauucucuauucagggaacaacuuacugagguggucaugagacugaagguaugaaaaggaagaaauggcaaggugcgguggcucacaccuguaaucccagcacuuugggaggccgaggugggcugaucacuugaggccaggaguucaagaccagccaggccaacauggugaaacuccaucucuacuaaaacuacaaaaauuagcugggcgugguggugugugccuguagcaggagaaucuuuugaaccugggaggccgagguugcagugagccaagaucacuccauugcuuucaagccugggcgacagagcgagacuccgucucaaaaaaaaaaaaaaaaaaaaaaaagggaagaagaaauagaaguauuccuuuucuugcuaaagcaagaaccaguaaauuguauauuuuucauugaaaguaguuccaucuaaauuaagagccugacuuuuuggagaaugauuacauucauaggagaagagcauguaauguuggagauacauuugaauguuuagccaucucucaauuuccauggagaggagaguucaaaauaaaucaacucuuuaauucccuuaucggugacauagauacuuggucauuuguuuuauuuggcugaaggaagcuguggcaaguugagaauucagagguaaagccuuugugagagagaugauguaguuuaauuauuuuaacucuaguucuccugauccaggaaagcuuuauuuuuacuuucagaugaaaauuaaaauuuguugcaauuuaacguguaacacgaagcuagaauaagguauauacauaagcuauauauguauauaauuuaaaugauacaagugauguauguauacauauaguacuuauguuaaaauuuuacuguuuuucuguaacaggcuauaaauuuaguguaucgauuaucaaaguauaauuagcugaauauaauuauuuguuuaugagaugauacuaaauucaguucccauagauacugguggugauuuacuuuuuaaaaagaguuuuucuuguuaugugcuuaaauccacacccgaaauguagccauaauuuaguucaagauuguuuaugccacagucuggaaaacaccugaaguaauugagauuuuugagugguugugaauggauuuuagaaucauguguugaacagugacaucacuaaauuagccauaguaauguuacuguuucacauugaggguuucaggugugaugcuuuucaguuuuuuguuuuuguuuagauaacuauuuuaggguuugaguuauaguuaugcaaauuuacauuacgguaaugcaaauauaccuuccaaacuugugucaauauguauuagacgcuaaaaugcccuccccucccaucucuguuucccucaaauuauucauuugugguuaaacuaauuuuaaacuccggaaaagugguuaagccaaaaaaggucagauccuggaagaaaaagcucugaccuuuuaaaaagaguguuggaaaaguauuugacggucauuuucauaagcuaaauguacugugagguuuguguuugaguagcuuuuaagguuuucuggauuaugugguugaauuuuaaggaggaacuuaguaaaaaugaguugggaaaauuaaccuguuacauucuaccuuccuuuugcuauguauaguagaucuacaugugagaagucauuugcaaacagcauuuguuaggugucuuuucuaaguauuuuuuaugccuacaaagucugggaaaagaccauuuucagauuucagauaauauuucagauaaauaaugaucagaucaguagauacugucuuucagaucuaucagaacacaguauuuccagaauauaauuuuacaucacagucaucauuuauaaugacauugaugaccaguacuauuauuauuuuaaagagaaagauauauauacacauacacauaaagucaugcauugcuuaaagacagugauagauucugauaaaugcaucauuaugcuauuuccuuuugcgaacaucauaggguguacuugcauaaaucuagaugguauagccuacuacacaccucagcuguaugguauagccuuuuuuguuccuaggcugcaaaccuguacagcaugcuacuguacugaauacuguaggcaguuauaacacaaugguauuuguguaaacguagaaacauucuaaacauagaaaagguacaguaaaaaugugguauaaaagauaaaaaaugguauaccuguauaaagcacuuaccauaaauggggcuugcaggacuggaaguugcucucggugagucagugagugaguggugagugaaugugugaaaguccuaggauacuacuguggauuuaauaaacauuguauucuuaggcugcccugaauuuauaaaagauauuuuucuuaaguaauaaauuaaccuuaacauacuauaacuuuauaaacuucuaaauuuuuuaaaccuuugacuacaauuacaguuuaaaauacaaauacauuauacagcuguacagaaauauuuucuuuauauccuuauucuauaagcucuuuucuguuuucgaacuuuucuauuuaauuuuuacuucugaguccuuuuuguugaagacaaacacacacauuaaccuaggccugcacaggguccagaucaucaguuucaucuucuuucaccuccacagcuuggcccacugccaggucuucaugggcaagggcuguauggcuuaccagugugucuccagcacagugucugauaccacagaaagauaggaacuacugcauuaauaauagcagauucuugagcauguauuacaugacagacaccuacaaauauuuguuguucaagcgaaagaauuuauucuaucaaacucagaauuuucgcucuagaauaauccuucgugguuuuuuuuuguuuuuuuuuuuuuucgggggggugggggacggagucucacucuguugcccaggcuggauugcaguggcacgaucucggcucaaugcacccuccgccuccugguuucaagugauucuccugccucagucucccgaguagcugggauuacaggugcccgccaccacacauggcuaauuuuuuuuuuuguauucuuaguagagaugggguuucaccguguuggccaggcuguucucaaacugcugaccucaggugauccacuuaucucggccucccaaaguguugagauuacaggcaugagccaccgcguccugaauccuuuuuuuuuuuuuuuuugaaacagagucucacucuguugcccaggcuggaguacaguggcuuggcucacugcaaccuccaucuccagggugugagcaauucucaugucucagccucccgaguagcagguaauacaagugugugccaccacgcccagcuaauuuguguauuuuuaguaaagauugaguuuugccauguugaccaggcugaucucgaacuccugaucucaagugaucugccugccuuggccucccaaagugcuggaauuacagacgugagcuacugugccuggccuagaauaaucuuagaaguccucauggaugaguaaauauggauggugaaaagcuuaaaugagaaugucuugucugauuuucauuccacuuuuaauuugaauauaccauuuccuuuccccccucauuguauaugucucuacuuuuuuguucuuuacuuuauucauaguucuaauuucuacucacugccccaucuuuuccuucuucucuaucuagcucuuaccaucugucaucacugcuuuucccacuaucaugaucacucacucuagcagcaaccaaauuuaacuuuggggauggagcaguagugcuggagaggccaaaugguaugaguaaaagaauacagcuuuuggagucagcuagauuuucaucuuuauguggucuuuggugaaaguacuuaauccccaaaucucucuuuccuaacuaugaaaugaaggugaaaauauuacuuaccuguaagggaaucuaccugauaauaauggaauaaaaugcugacuuccaccacagaguucuuggggaggcuuuuuauguggaaagacauuagacuucauuacucugaauucuggauuuguaucuccuagccauauagacugaaugacuguagaauccaacauaaugcuuuuaauauuggcauaacuuccuuaguuuaaguuauaugaugagauguagaaacucaauaaaagguaaaauuauucuuuguguuaugaaguauguuuagagguuucuuuuaagaggucuuauuuugcuacucugcuucaacuauaguuuuuguucauuuaguuuguuauagaacugggaccaugucuguauuugcacaugacuauauuccuagggccuuggccagugccugguacagaguagguguaaaauacauaguuguugaaugcauauacgaaaaaaaucauuauauuguaucauugguaagacaguuuuuuuuuuuuaaaacagguuauacuuuauucaggucaguucaauuuuguaaaguuuuuacuuuuaggaaauuaaaaagcuuuuauuuuauuauguucugaauauauuuuuacuaaauauacuuugaguacaggguuaauuaggacugugcaggcuaugaauauaggguuuaugauaaagcucaguaggaguggaugauugcaguccuuuugugcaauccuggcaggagcagccuuuuccuuauuggcucgguuuuuuucuuaaagccaagacuaagcacauauuuagaugccuguauauuuuauuuucucaucugauguaagauacacuggaagaauuuagcauugauguaaugaacauauguuauuagcaaaguguucuaaacuucucaaguccagaauaaagagaccaagccauuugcagaagagcacugugcauuuauauuacuuuaaagggaagaggaguaagcuagcuagaauugucaagcagaugccauauugaugcuugagugaaguuacaagaaauauuuuuggagcuuugcguguuuuugugcuaauaguccuaauauuuguucaaaagguguuuuuucuccaaggauguagauguuacaaauauagcaaaaggcaaaaacaaagcuaucugcccucucagcuaacauucuaaugucaacaggcaauaaucaauaaacaaguacaguaauguauuaggaaauaugaauuauagaaauaaaauugaaggguaaaggggaucuggaguguuccuauggauugaggcaaguugcuguuuaaaaauaggaagaucaagguuggacuccuugaaaaacuggagcagaaaucugaaggagguguuagugugagccauacugcucuuuggggaaaagcuuuccaaggcagggaaagaguuacugcaaaaccuugagggcagggcuagcaauuccuuguguggacuuguagccagggacggagguuagguugguuaaggacauuugaucagaagggcaaaaaaggugagggcaaggggagccuguguggaugcuguaggcuauuguuuaucuuuguaaggaccugggcuuuuauaccaacugagaugggaaaucauuagagcagugguucugggcauccuuuuagggaaucugugaaaucagacuaucuuugugauaauaagauguuauuugccauuuucaccaccauuuacauacgaauguacaguggaguuuuccagaggcugcgugcuaugugauauugcaacagauugaauucaagagaagagagaaucuagcugucuuuauuaaaacagacauuuaaaagauugcaaaaguauaaaacugaccuuuucaguaauuuguuuaguuggaaaauagguuauuuucuguaaaaugugcauuuuugguuaauauauaauaaguuuacuaguauuuuaaaaugaaaaaauaauuuaaacauuuuuaguuuuaauuucuagcgugguaaguuuuauuagacauaacuuucaugaacagggaucucuuugggcuccuccaauuaauuuuuagagaguggaguccugaaaccaaaaaguuugaacagaggagugacaucucacuuggauuucagcaggcuaacuccaaagaauaaagaauagacugaccaagguagugguggaagcagguagaccgguuagguuaagauuagguaggaaaugauugugguuagagcuguaauguuagggcuugugauggugaagugaaauuggggauauagucugaaaguugaguacacaguauuugcuaguggauggaauaugaagugugagaauggacuugacauugugucauugcccgagaucaggaggaacaaauuuuggggaaggcuuaggaguuuagucuugaauguaucagauagguugagaagggaguuggugauaggauuucauuguggaggguuggucuggaauguccauuaccaggguuuuuguuggauuguauuaguaauauauauuuuuuaaauauaguauuuagcuucuaaucaguuauacuuuuacaaucucaacacagagggcuguauucugcauugaaaaacugauuaaauuugcuuuccaaguauguuauuauaugauagaauguacacuugaagaggcaguaaaaaaguaauaaauguagauuugccaguagcaugacaugacuuagauuuucugaaucuuugugaaguaaaccaacugugguuuaauuaaaggagaucauauugcuuaccauauuaaaauaauguuuucaauaccaauuacuuugacauuugaaggcacuguguaauauguuggucuuguuacagaccaagauauuuuugcugaauuuuauuuuucgaauucaaugucagugcuuguuguaguuccuuuuggaauauuguguauaguagauuguuucuuaagccuuuaaaaaacucuucaccggguacaguggcucacgccuguaaucccagcacuuugggaggccaaggcggguggauuacgaggucaggaguucaaaaccagccuggccaagauggugaaaugcugucucugcuaaaaauacaaaaauuagucggugugguggcgggugccuguauucccagcuacuugggagacugaggcagauaauggcuugaauccgggaggcagagguugcagugagccaagauugcgccacuacauuccagccugggcgagacuccgucucaaaacaauaacaacaacaacaacaacaacuccucuuggcuuuuucauaauaugagagaauucucuugcaacaccugugaaugucuuuugacauguauuuucuuuccuaaaaaugucaugaagugacagacauguauuugcuuuguuuaugguauuaaggugauacugagguaaaccuaugcuacaugauuauaaaccuuagguucuuucuguauuguacuuaggugaaauuuugaauacaaucgaaaagguuaauuaaaaaucaaauaaauuauuaccuaggaaaaagcaauuuaccccuaccuccuacacagacguaacuccuucagaauuuuuggggcaucgguuucauuuucagucugauuuaccaaauuccuuuuaaagcccuaagggauuuggagcuucaagagggcgaaauacauagguacagaccuuuccccacuucuucaagagcaaguguagaggaaucuaauuacaugaggauuugguguuuuccgaggauguaauuuaaaguaaauucugguggccaguaguaguuuaagacauuuuagaauauauaguucuggcaggaguaggauagucuggccuggaguucucaaccagucauugaguauauacagcccuugccuguagggggucaguacagaaggagcacaaaauggaauucucuguaagaagacaaagagaugcauuuuagggcagauggaagccauaaaugugauguggucuaaugugcucauuucgcagaugaagaaaaugagacccagaagguucaguuugaaggcacacagcucagcuaaaucaugcuggcgaaacaggaguaaaauccagguuguguaaacucaaggccagugcuuuuugccuuaccacauguauuaggaagauaggcuuuuuauagaaaggucauuguuuuggauuguaaucuuucuccaccuucuuuaaggaaaguucaaaguguguguguuuucuuuuaaagcaguauauuaaagaaaaucuaaaacguauagauaaaauuuacaaagcuuuugcagggaaagucaucuguaguugagguuaacauuagaucuuuuaucuguggauauuuauuuuggagaagaguaacgaauauauuaagcacuuauauuuaacauauauuuuggaugauuaguaaugauugcuuauuugaagaaagcaaauauguauaauuaaaauuuuaacaacauuauuuaaacuguagaagauaccauuuugagugauuuuuuucccucaguuuucuuuaucuuuuuucacagcuuucauacuuugucacauuauuuccccccuucccucauuagaauaaauaaccccaaaguccaaagcaaacacuuuuuaauuauuauuauuauuauuuuugagacaggguccugcucugucacccaggcgagugcagcggagugaucauggaccacugcagccucuacuuccugggcucaagcgaucuuuccaccucagucuugaguagcugggacuacaggcacaccaccacaccuggcuaauuuuuguggagaugggauuugccauguugcccaggcucacuuuuuaaauuguaauucuuuauuuugaaauaaauuuagauuuacauaacaguggaaaaaaauaauguggauguuaacucauauaaucauaguauaguuaugggaagcaggaaaugaguauugauacagugcuaucacuaaucugcaaaucuuacucaaauuuuaccuguuuuccuccucacucuguugguuuuucugguccagguuuuccuacucuguugguuuuucugguccagguuuuccuacucuguugguuuuucugguccaggauuccacauuguauuuaguagugaugucuguuucguuuccuccaaucuguggccauuucacauucuuucaugaccuugacacuuuugaagaaugcuaguuauuuuauaaaaauguucuugaauuuggguuuguuugauguguucucaugauuauaaugaggaccauuuuuggcaaaacaaucacacacaagcgcuguugugcccaucucaguggaucaugcuguggaguauaugucuuuuuuuuuuuuuuuuuuaguuggagucuugcuccguugcccaggcuggagugcaggggcaccaucucggcucacuccaggcuccgccucccggguucaugccauucuccuaccucagccucuugaguagcugggacuacaggcgcccgccaccacgcccagcuaauuuuuuguauuuuuaguagagaagggauuucacuguguuagccaggauggucucgaucuccugaccuccucauccguccaccucggccucccaaagugcugggauuacaggcgugagccaucgagcccgaccguugugggguauaugucuuaauacugguaauauuaacuuugauuaguugguuaaggcgaugucugucagauuucuccacuguaguuucuccuuuuuuccuuaguaauuaauaaaugccuuacaggggagauacucugaaaccguacagcuauccuuucauauuuuugcuaacuaauuuagcauucauugaaugauuuuuguuugcauugauuuuuacuaauuaaaauucuuuaaggaagagcuguccccuuucccccuuguauuuauuuauucaguuauuuauaucaaucuuuucuuauggguuguaauucauuacuaucacuauauaaguaaaaacuuuuaagaaaaguuucugaaaaguuaauacauugagauaauucaaaauucagagacucguaagaguacauuuucuucuaucccuguuaucuuggguacccguuuccauugcuaagaguuuauuuuuauucuuucagaaauauuaaaggauugggaaaagaguuguuaauaauaauugcuggauucucagguauuucuuuuuaccuggauucugaugauaucaaacuaacuugcuguugcaucuucuucggauauucauuaaaauguuacuuaacuaguucgccauuagauuuaaauuuacauuucaguacagugacuauuauauauagauggggacuggcuuccccugaguauccuaagaaacgacaugaccagaagaccacauuuucuauuaaauaaauaauaguuaaauauuaacguguaaaaguaaacagguuuaaaaguaaacucuuuuuugguaaguugaaacaaaagucaguuuaaaugagaaaggcugccuauccaauuaaguaacugguuuuucaaaagugaaugaaggcccuccccaccaagucccccgcucuguucuguucuuuucagugaccuauuuuacuuucugugucuacuggcaguauccguuuauucauucaggaugucacuuuaggaaccuagaccuggaguucaucuacagaacuguguucuguuaaaauggagugaaagaaaagggcuaaaaagacuuucuuucacacgcuauuaaaacagugaacauacuggucuacacuuauuauaguacagccagcaauacaucaaaagguggcuuauuccauuuuauuuccauucucuaauuaccguuucuuaaaaugaauuuuaagaguuucuuaugccaggaaauccucuaugaaacucuuaaguaaagcugguuagacuagcugugacuugguccaguuucuuuuauuuuuuugauuuaccuuuucuuuauuuuuauugauagauauuuuacauauuuaugaggugcacgugauuuuuuuuuuuuuuuuuuuugcuacauacauagaauguguaaugauuaagucagaguauuugaggucuccaucaccuugaguauuuauuauuucuguauguuggggauaauucaaguucucucuucuagcuacuuugaaauauacaauguauuaguuaacuguagucacucuaaucugcuguugaacaguaaaauucauaccuuuaucuaauuauauguuuguaccuauuaacauacuucucuucaucucuucuccuacucauccauccuucccagccucugguaucuauaauucuacucugccuuuaugagcuaacuuuuguagcuucccuguaugugugauugaggacauaacgauauuuguuaauucuuuaaucacugagcauuaguuguuuuuucuuuuuauuuugaggggacaguaaaaaggguauuguaauauauccuccuucagauucuggugaagaccaguugagucauguaaaaaauaacuagaucgcuuuauuuuuagaguugggaggcaaugaauuauaacaucuuuauuaugcuacuguuuuuauauaggcagucccaugcuugcaguguuuugauguaagcuuuucugcuuucuacucuccuaauaggugauuauuguaagaaaaauuuauauaauaacaugaaagcgaaauaguccucguaaauucaucucccagagaugauuacuguuaauaguuguaucuuuuuugacuuuguugugucuaccaaaaaaauguauacuuaaauauaaauuugaucauacaguagagguucuuuucuauaaccccaggaacgugugugcaacuuacuguuagguacuucuguaauacagaacugcugcugagaacaaucaggaaaaucgaauuaacauuguuacaaaguuuuugcuguuuuguauuuuugcaugugaaauuuaucgccaguuguggacaauuguuaguuuugguaguacaaagaggaguuaugauuaauuuaauuuuguaguuuuuguuuuuggacuuaggauugugaaguacagaguacaauuuaacccuuggaauaagguuccaucuagggaauuacuaauagcuuggguuuuuuuuuuuuuuuucuugccaguuugaaagcaguuacuuugaaauuaaaucagauuuauuugguuguuagaguaagcaaacauauuucacuuaauagucuguacucuaggcuaggcgcaguggcucacgccuguaaucccagcacuuugugaggccaaggcggguggaucaccugaggucaggaguucgagaccagccuggccgacauggugaaaccccgugucuacuaaaaaaaaaaauaauaauaaauuagcugaccaugguggcgggcaccuguaaucccagcuacucggggaggccgaggcaggagaaucgcuugaacccaggaggcggagguugcagugagcuaagauugugccauugcacuccagccuuggugaaaagagugaaacuccaucucaaaaauaaauaaguaaauaaauaauacucuaguaacuugcuuuuuaaucuaguugcucucuguaccuugugaacuuggccucuuaaaaagagcacagugaaguuaaauuccaugggugguucucagcucaaaaauaacuuuaaaacuuucucuguauuuagucaagccuuaauuaaaguuuauuucuuuuuacagaagagauuguuguuaacccuaaauucauaagguuacacaccagccaccucuuuaugaagugacaguucuucaguuuuaaauagauuacuaauauuauuguuuuaagauuuaaugaguauuaucuaaauaaaaacgaguaauuuguuauuaagaccuaaaauaacuaaaucuuacuuugcuguuuguguuagugagcuacuuuaaugucuagcaagagguagggauugcagacaguguggaaauacuggagccuauuuaagcuucagaugaaagcagucauuuuaacuuaccucauaaaauguauuuuauguauaucaaauuauguauguguuuauauauacuugucguuuuacugacaacuaagauuuuccauaaguuaauggaaaauguuaaaaagcacaguuauggucaaaugacacagugaccuuuucauuccuuuauuagcuccugcucuaguacaaugauaaggcagauuuuguugauggauucaaauguacaaagaaacagcagauagauacccagugaaaaaauauauaugucuauaacaucagcauugcaaguugagcaauugaaucagcuaccacaacacuaaguauaagaugcauuuuaugugaguuuuucuucaguguuuuaaaacuguuuuguuuuuuuacaaauccugaaaguaauucuuuggugcauuuuggcuuugaauuuuacuuuucauuaauauuuuguugcuuaugauugaguuaguaaauaguuuuuguguuucauuuccuaauuuugauuuucuuaguuuaaauuugcugaaaaauuucuaaaccagaaaguaauauagagcuguauuugauucuuuggcuuuccaacauugcaguauugauuuuauacacagccuuagcuauguauuuauauauuuuaugaaaugacugcucaaugcuguaauuuagauuucucaccccauauuuuuuuauucucuuaacaguuuuuccuguucuuaauuccaguguucuaguuuuccagugauugaucuguuaguuaaauccaauaauucauauauauguaauuggauuuaacauauguguguauaacauauauguauaacauauauauacacacacauauauauguauauauguguauauauauauguauuucuuuuuugagauggagucucacccugucacccagacuguagugcaguggcaugaucucagcuuacugcagccucugucucccgaguuuaagcaauucuccugccucagccucccgaguagcugggaugacaggugccugccaccacaccuggccaauuuuuguauuuuuaguagagaugggguuuugccauguuggccaggcuggucuugaacuccuaacuucaagugaucugcccaccucggccucccaaauuguugggauuacaggcgugauccaccacaaccggcccaguaauucagauauuaaaaggauauguacaaaaguagcagagugcacguacaauaauuuggauacaguaaaagaguagugguaauggaaaagccaaagacaaacaugagcugaggcuguugaaacaugaaaccuaagaauuacuuuaaaaccuuuuagugaaauccauaguugggugaauuaaggggaaagaaaaaagaauaaaggucacauaaaacagaacugugcagugacaucggagcagaauuaacugacaguugagccuuaguuuggaaaagaaaaaaaaucaagauaauuaaagcagagaaaugugacgaggcaguaaguaguaacagguuuucaggccuaaacaaaaaauaguuuucagcguagugaaauucgaaaaaaaaaaaguaaauucaaaaaauuguaggaaaugggaggagccuaaaugcuguaaaggcaaauacuccccaaagcugaaaaauguauaugcuaaauuugauggcauaaccuguagauuccuaagcagauuauuuccuauuuaaacugguggcuccagaaggagguucuggucccauuguagcuugggauuucaucaaguaguagauaaagaugugccuguauuuugggaucugggccaaagaaaucugugcucuauaaaauuacgguuggauucuugacucggagacuauucauccuuaaagaauaaagaauaucagcugauagauuaauaucagucugcugaagggauauguguagcagaaaauaaccaggaaaaaaauugaaaucuucuguuggugucuaaacaaacaguuguggaauuauggaaugguagagacuugucuuaacaccauuagcaaaaugucagcagugugcuguguuugccaaggaaguaaagauauucuuaaacaucaucaccucuuaaacagugauuauggauggggcagaguuugggacuagaauuugauagcuucaguuggcuuauccauugaucauuauggaauguuguguacaguauaggguuuugcauauuaaaagggaccuagacagaucagagugcaucuaaacaagugggaggguauaaaaccaugucauugguuuagggaagaggacacuuagauauuuuagaauuuuuccaauguuuauggggcugcugaguuguggccaaugguagaaauuuuaggagagcagauuuugguuuauuaaaacaaauuuauaauauuuaagaucuuuagagaugucuaaaaauuucucuugauacuggggauauuuagauagaaaauacaugccugggguucauguugggagauuuuuuguacuaugcgugauuaagcaaacgguucugaacuucaguucucugaacaacugcugcggguuguugaagguagugcaguuggugguggggcauuugaguguuguaauguuugauacagcaaaauaguguguacagcauauuaguuaugaagcauuccuauguuucaugagaacaccugugaagcuauuacuuacaaaaggacuaaagcauuucccaaacccguacucguugcauguuuccauaguaguuuggcuauaauuguauccuccugcuaggauaacauucccagaagcucugauugccacgacuuacaaauggaaaguuuuaaagacaaaacuuuuaaaaacaggauuauggagaaaaagaauaaauggggcucuugcauaguaagauuggaaaccaguggauuuaguucauucauugaauaaguauaugaagcacagacacagagagguuguaagaaagagacuugucuaaaaucacaguuacuguuagaacuggaaucagaacuugcucugacucgaguguucugaauaacaccagaaugcugaugauuuucuacuuuuuuccccuguuuauaaagguaguacauaguuggccaaacucaacagugaguaagauuuuuaaguccuugaggacuggaacuaugucuuaguuaccuuuucauucccaucauuacuaucuuauacauuaauuuguguucuguuaugaaauugagugauauaucuuagagacugaaaaaaaucgugguagaaagacuucuuaucugucuuccuuauuagaauaaguuauuugagagcuggaaccaugacuuguuuaacuuuaaugcuccagaaaccuagcucuuucuugccuuuguuuacccccaccaaguauuuauugagggccagcuguguuccaggcacuguucaaggaccugcggacacacuggguaacagaaucucauggaauuuuguguuauuaaucaaggaaucacauagguauuuauaaaaauacaacuuaagugguaaauggcuuguaucaucuaaccagauagaugcuuauauaugaggacuguuuguuuuauacauuuucuuuuuauuuauuuuuuuagacaguuuuuugcucuuguugcccgggcuggagugcaauggcaccaucucggcucacugaaaucuccgccuccugaguacaagcgauucuccugccucagccuccugaguagcugggauuacaggcgucugccaccaugcccagcuaauuuuuguauuuuuaguagagacgggguuucacuauguuggcuaggcugcucuugaacuccugaccucaaguggucugccugccuuggccucccaaagugcugggauuacaggcaugagccacugcgcccggcacguuuauuuaauuuuuuaaucuagucauuuuaucugaauuuucugauaacuugcaauagauucuuuuguuuuuuuuuuuucuaaguuugauaaauuuguuuaucuggaaaaucaguauuuuuucuucccuagauuuauuauauuacuaugguuacuuauaauaguagauuuuucaauauugaacuauucuugcacucaggguauaaauucuacuauaucuuagugcauuuuucuuuuucuauuuauuucagauguuugcaucuauauuuuuaagcaaauuuuaucuauaguuuucuuucaugcugcuauucucaggcuuugauauuaguguggugcuaacugcaguaagaauagguaguuuccgaagaagauauuuaaauaauaauuauauggaaagugcuuuuuuaguccagagaccuggcuaaaggauguaugugugauuuuaauuagauuaaauuuuucuaaugucccuugguuaauuacuugcuguaauuauguaaaugauguaaaggaguuuaaauuguugcuugguuguugaaaacuugauuugagaauugcugucauaugcuaauuuaagauaaacaccaaguugauacuggacauuauuaggaaagauuuaauuaugaagcuagaaguauaaaaagaaccuuaggaaauaauaaaauucugcccuuaucauguagucaaauccaagguaaucucuagauuuuuguugauuuuauuugcuauucagagaaaagcauuucguaagcuuugacaaacaaauuguuauuuaagagauaaaauuuguaauaugaauauugguaucacugaagcagaaaauguauuacagugccuuuuuuaauugauuaagauuuuauaacugaguaagaguaccuuugauccugccuuuuugcuguguuggauuuuauuuaaccgaaacugauuuaaauaacuaguuagaaaaauuaaagagugccuucauauuugauaguuccuaaggaacuaucaauaaauugaacuuccccauguuuggaaagcauacaaaauacauuuaaaaaauacauuuuauuuuuaaauacuaauggaugcaagccuuucucccaaggaggacacagucuguaggauagagagacauuacaucugcaucuggcuaaccuuaauaaugacaacccuuauugggcaguauguuccaaaggacaggagccugucuucuggugcauacuagaagcuuaauaauuuuugaaaagauccauuuucuuuaugggacucggcucauuaaaauagaauucuccuacuuuuaaaaaaaaugucuauguauauccaagaacaguaauacaggucuuuaaaaacaggucauugauuuuagguauugcuacuuccuuuuuuauauuuaauauuucaaucauuaacccaguguagcuugaucuguuacccucuuucccuugaaacuucucugaucaccaguggcuuaguggucaaauccaagguaccaucuuuugcuguuuaucuuacauucuuuuguaguauucgauacuguuggucacccuguccuugaaucugucauuucuuagcuucuauaacaccucucuucucuaguucuccugccuaccuccauuucuucuugguuuggaucuucuuuuccuuaccccuuccuuuuucucaaguggauuccguccuucuuucucccauuacuugcucuaagacaucucuucugauagcuuuaaccauuaaauuuguauaugaaacucagacuucugcugaacuugcagucuguugucuuuugaacaucucuguuuggauauuccaaagauaucuaaaaauaauggaaguggucccguuuaaauauccuucggacaaauuaguucugaaguacaaaagaggcuuugguauuaguuuugucugacaggcauucuuauaguuguuuacugaagcuaugauuuggaaugacuggccucguuuagacuuggaaaaauuagaugaacuaacaaguccauauuauaccgguuaggaaggagcucgggcuuugaaguuaauuuaauaagauauguuauuugauucguauaaaaauugguuuguaguagaaauuaauuaaggcuauagucuuguuuaaacaugggcuuaauccagagaaugauagaauaggccaggagcuccuuauuugaguuuuaaugcuuuaucaaugaaacccuccccugcccucucuuuuuuccucuggacuagcaagaauauuuuuuuugucuaacacauuuaaaauuuuuacuuuuaacagaaauuagcagaguacggaaagacauguacaaugacacauuaaauggcaguacagagaaaaggagugcagaauugccugaugcugugggaccuauuguucaguuacaagagaaacuuuaugugccuguaaaagaauacccagauguaaguauauuuuguuguuuuauucaauuuuguucugcuucacauauguugggaagagauauauuuggugguaaauacuuaagcauuauuagccacuuuaaaaaaaugcagucaucaacugaagugugaauaauuuggcaugauaauuuaaaaaauuucucucuaaauauguuugcauuugauugcugcuaugucacuuuggaaaugcacaugguauagacucuuggguuucaaaacuggaugaggaauuguggaaagcacuauggccugacugacacagagcaccaagcacaacauugcucaucuuuaaucugaccuucaagaagccacagcuugggccacagcauucuuucuguaaaaugaagguguuggaccauaaguuuccuuucagcucuaaaauuuuuauugaaaccacugauuguaaucugauuuucccccaucuuaguccauuguugaacuauucucuauaagcaucuuguugugaauagccuccuuguccuauaucuguuaauuucuaaauaaauccagauucuuugcuuuuuguuacaaagcccuauaugauacgguccauucuauuucucuggccucaucuuaaaugauuuucccucuucuuuaccacacuguagucacauugacccucuuuuggcuuuuagaauaagucaagucuauucccagucuuagggaccccauguuaguugugcucugaucucuacuggcuggcugcuucuugucauuaagaauuuagcucaaaugucacuucagagaggcuuccccugaccuuuuuauuuaaaagccaucuaucuagcuacucacuguuucacguugucuuuuuuuuucuuugcaauagcacuuauaaucgggcauuuuucugguuuauuuucucucucucugucuccccugaagaauauaagguguacauaaaauaagaaccuugucuuuguuauucacugcuguaucccucauaauauuggcacauaauagguaacaauacuuguugaaugaaccaagaaaagaugauggcuuuuugcuaaguuucagaggacuuuuaugaaagcagaugaaaaaaggaguuauuauaauaucaaaaauaugaugugcucuaugauucuuuaguuauauggacagaauacuagucuguagaugagaaaugucuuaaguugaauuaauaggaaaaagcuuugauauuuuacaguuacauuacaauuugcaaaaauugaucugauacuuuuuuuuaaagguuauauacauuuacucugguuuuauagguauuuuugguugcaaauacacaaauagucuuggauaauguaggaaaagaggaguugguuggaagauuauugaguaacacagaggauuaaaggaauaguuggaaaacaaagugccauguuaggcuaggaaucagggcaucugagaacuugagcagcaggaguuuguggagcuucucgguugagagccuugcugacauaacuuggcauuggugccucccagacuuuaucuuuaaaauucagauucuuagaagagugaauguguuuugggccuuucugacuggggaagugagguuaucuaccauuaccuagacaggaccacugugagccuacccuagguauuaggauuauuccuagagaugggaaauugugauuugggcagcuguuccaauuggggucuacugcuguuagguuuuucacuauccuggaaaggauagcaacugucuguuuugcuuauuuaaacguuaagggauaauguuucugcagugggcauuaacauagaauauguaagaccacaagaccuugauagagaauauaauguuaaucugucugguuccaucucuuaaaaaaagaaauccuauucaaggaagggguauuuaugcauucuuuaaaagacauggguuucauacagucuucuaagucaggacuugagucuagagggcaccuguucacuauauuccuuuccuuccuccuccaguugugacuucuugccacggugaacuacuauuaccgacugguguguuggagcauggcauuugucuugaucggugauucucaaaacacaguccuuggaccauaguaucuacgcuuucugggaacuguaaauguucaagccccuuuccauacuuauugaaucagaaacucugggguaagggcgaggccuagcaauuugccuguuaagcccuguagauaauuccgaugcaugcugaaguaugagaaucacuccucuaauuuuuuuuuuuuuuuuuggagaggggacagggucagccaggcugacagguaggugaucauguaccuggucauuuugccaggcaucguuucaggaggccugaaacaguaaguggugaagugaugaauuaaacagugucacuggucuuguggaguggacauuucagugacaaagacaaacaguacacaaaugaaucuauagcuguaaucaguguuauggagaaacauaaagugggguagacagaugaauagugacuguguauggaaggagguauucauuuuuaaggguaaucagggaagaaaucuguuacaauaugaugggaauggagagacaggaacagaaugaugggaggaaggcaugaaaaccaucugggagaaaaacauucuaggcagagugaacagcaaguacagcugacucaggcaggaaugugcuugggaaguguuguaagaugugagguuagagaguuagcacaggggcagugucaugccguggucaaaaguaggaacucagauucagacuucuagcuaguuuugcugcuuguuuugugacuuugguacuacacuugaucuuaaccaaaaggccaggaagugaugauguuuugugacuuuaagcaaauuacuuuucauuccugguguucgcuuuucucauuucuguaauggagauauuaaaccucucacaagauuaugaagacuaaagaguuaauaugagugaagcaguuggaaaacaucuuuaugcuaugugucacaagcucuaugagggcaggaaucuuuuugucuuucagugcuguauuucuagugcuuagaauagugucugauaaaugguguauucacaauaaguauuuguugcacauauuuguaugaaacucauucuuucaaauauuguuaaacuuuucuuuuucuuuaaaccuguugucuuuugcauuugcacauagcaccuuacuuacagaagucaguguuaaguuagagauguguuuuggacuuggcagugcagaucucugaaacugauaugagaagaaagucucagacucaaggucugagaaaugaaguagugcuauagucuguagcccuuugcaacguuuuugaaguuuggccucaugaugugagaaugagaggcuaauaugaauaggccacugaaaauguauuaaaauuuucacagaauuaauauuuauuaauaaagcagacuucuauugcaucucuacuguguaccaagcacauccuagguaagaauauuuaauucuuuugaaaaaaacucuuugauauaguaaagacaauagguuucuuagucaggccuagguuuugaauucuggcuuauccucuuauuggcuguauuugucaacaguugccacaauaaugcuccaugauaaaacacucuaaaacuggguggcuuaaaaauaauaaucauuuauuucugugcucaugggucuguauguuggcugagggucuacugguuagggugaagccuagcuugauugaggcuaacuggguggguuuagaucuucuccauuuauguuccugcugggcccaggcuaaagcgggcaguggcugcuuagggcaugcucuuauggcaggccacuggaaugcaagauccaagccaaacugcauaagcagguauaaggcgucugcucuuguugcuuuccauuagcccagugauucucaccugguggcaguuuuaccuauggggacauuuggcaauacuagagauacuuuuggugucuaaacuugggagaggggguacuauuggcaucuaguggguggaguccagggauacuguuaaacauccuguaaugcacagggcagucagccuccgugcaccuccagccccccaacaaagaauuaccuggacccaaaugucaguagugcugagguugagaaacccugcguuagugauaccaagucacuucauuuacagagagaaggggacugaaauaaauauuugccgaaaaauaauugagaugaucacauuggcuuugagcauaugcuugcuuuuuagaaucuguuucuuugucuaugaaguuauaagguucacuucauaggauuguugggaggaguaaagguaacaaaugugugacaucugauagagcaggcacucugugguuuuugugauuacacauaagaaaaauaauccuguucuugaaggaguucagucuugugugaaggauaaacgauuaaauuauugaagacuuuaaguuucucaugcauucaugaaacuacagacaugaaagaacauugaaguuauauuuagaccaucaaauuguuuauuuggcuggucagguuuucuuguuugaauccauggagauguguuauaaaugauuaugaauagaguuaacugauuuauuuaaguaaaaaguguuauauuuugaaugagucaguaauaauuuugucauuaaauuugccuaguuaucaauuucaaguuguuagaaauuguucuauaggaucugccagaguaguagacuugauaaauauuggcaaggucuagcuguugaugauacuagucguccuguuaaauacaugaacagauuagauugguaaacugcuuccuuuggacaugaugauuaaauuguagugagacuucuuggaguuuuaugugaauauaauucugauuuucugauguuuuuaaaaugggauuuaauuuugacuaauagcuuugaaaggcaucucuugggucuaggccaucaugaauacccauauugucaaagguuuuguaagacagacaaaugucuuuucaaggauuguguuuucagccuguaggaucccagccugguugcuauaguuaguaguuuagauucauaauguuauucacaguacacuccacugucucucuuauaauaauacauguugaugauggaacacgaguuguaaguucucuuucuguuucauuuuccuggguuugcaaaucagcuuaggcucgucauagcuucugaguuaguuagcauaggguuguuguuugucagcagucuugagaaguuggugucaaauuggguguugagcuggcguuuguuuuagagggauuauggggagaggggccaauucaguaaguuaucuuuccuuaaagucuuuguuccuuugaccauugcggccuucuuauuguugaaggaucacgaacuucaggagucuugauguacacuacuuucacuuucauucuucugaauaacaaaugauauuaaaucaaaauuuaaugauauucaaagucuccuuuuucaauacccagguuaacacuugauuuuugccugaauaugaucauauuuugugagugaaaauaauaaugcuuuaaaauuacgaucuacacaucugucuuugauaguuuguacagaaaucuauuuaaagguaguuuuucucaaaagguuaguacauauuuguauucaguggaguugugaagugauucagauuacauauuaaaguuuuaauuuagcagugugauuugauaauauagggcauaucuuuauguuuuagguagggaaaacuuaauguauaaguucaacuagaucgguuuaguaaaagccaauuuaugacucuuuguuuuguuuugaaguuuccucuuuauuucacucuguaaggguauauuuagggccuguuguguaccaaauauuucauaggcuuuuuaugguuugggauauaccacauuucuuagaauguuaguaaauaauuacagaaaggguuacaggacagucugaaaacaauacauuuuguuuagcugauauuuuuccaacguuuaacauuucuuuaaauaauaaggccucucugaguuuuaaaaaugcaggcacuuucuuuuauaaauaauauauuuuaguauuugauaggaacuagugcuuagaagaacaaaaugaaagaugggguuguuagggaagaauuauucagauuagacagaaacguuugucuaugguuuaucuaaaaagaguuucauguuaggaucuacucuguuaaaauuacugcuucaaaggacuuauggauaauuugauaucuacucauagguguucaaucuccauaucucuuaagauucuugcugaaauagccaaaguauguaauauggaaaucgaggagaaaucugcuucucagugcuauccauauuccaggaacauugagcuguuucugauaaagauuaaaggaaagcucaaggugaugaucuacuuucagcccaauuugagagagcagugucuccgggaguaaaauggcuaauaacagaaucuuccucauccuaaccccucagaauugucacacaugaaaugggcuaugaagcagucaaagguuauacugcuugaacucuuccacucauuucaguuccuguuuauaaguaggugaccuaaauuuauuuuguaaguuaaugagacuauguuuucuuuugauuucaguuugggcggaaaaguaccuuaguuuuugagaucacgugccuuuacuuuagggauguugagguugaguuuuucagcuacuagcuuuugagauaaauucaguuaaucauuucauugggaaaaaauacauauauauuuaaguaauuuuuguuuuguuuuaucuuagagacaagguuucacuguguugcccaggcuggucuugaacuccugggcucaagcaaucuuccugccucagccucccaaagugcugggauuacaggcgggagccacugcgcccagccagaaaacauauuuuaugucuuaauaaacccaggauuuacaacaagguagcuuacaaauaaauuggggauuucuugaaaucuuguuuugucugccauagaacacugcuuuucccaaguccaaaaucagugucaucaauaagcagccugucuaucauaaacuugggcaucuacuuguuucauauugguauaauauuuucuuuauuauuugguagggaauugauugacuuugaaaacuucuauccuguauuguuugggguuacagaacaaugauuguuuugauuaguuucuuuguacuuuuaagauugcauauaaauaguauaaauuugccauguuaaggacagauuaaaacaaaacucuuaaaauuugaaaaguaguuagaacuugaacacuaaaaaggauaucugaauauaaaacagcaaaauuuugguaucauuucuucauccuggaaauguuuguguguggucugugcuagguaacaggacacaggaauaugaaaagauguaauugcucucaugguacugauauagccacaauccugguauggaauaaugagagcuugaacucaggcaauggcaguugaaaugaaaagcacaaauuaaauagggagaauuuuaagauuucuuuaucuuuuacaugugaaggcuaagaaugagggaagggccuugcugguauugccauucguugagaauaaagauguaugugaugauuauuaaaguggugacaaucaguaaaacauaugaaaauauugagaaaccaagaugugauuaucugaaaugauacaguaaugauauguuugggauauauguagguggggaagaaaugauaaaaacacaacuggacuaauucugaaaguaaacuuggauuugaauagaguuucuauaaacugaguacuaaacauuuugaaagauuaacaauaaugagaaaacuaaccaugaauuuuucuuguuaucaggguauauguuaaggucauuagaagagaggcauuauacuguauuaagugucugaacucuagaaucaaccuagguguucuaggauuugggcuacugauguaaccucacauguauuagauguaggugguagugguaagcacugugcagugguguuucgaggauuaagugaccuaaugcauguaaaauacccagcccagaaguuggcucauacuugaacacucaaaacauacugcagcauacucaacaccaaagaaauguugaauaacguaguccuugcacucgugauacuucgauuugacaccagcagcaaaggggaaaaauuaauaaccaguuauaaccaaaauuugaaaucugugguaugcgaauuaggauauccuaaauuacgguguaucauucuuugaguacugauauaacuggauaauaagcugaaaccauucaaaacaaauucacgugaggaagauagauuaucacucuagaugcuaaguaacaauuagaaaaaagauuauuuaaccaauuaauaaaaauacgaaggcaauaaaggucaacaaguguuuuaugacaagagcagaagacaguauuugugagaguaugagauccaaugcacaaggccuuuugaaagaucccaaacuacuuuccaagccuuuauuuugcugcuacccauguuuucuagccaccuaagcaauucacucuucuguaaaaauggcagguacuuuuaauuuuucuucccuguaacacuucuuuucuuauuucuuccuucccaccaaacaugcucagcucccccucaucccacaauauugagcuguagugcuccuuuugcuauuuguaugugcuuugacuccuacagacaguuguuuccccuuagaguacuuuguacccaccucuuaagcuguuaucacaugguaugcagugaucugccugauucuugcaggucauucucugaagucaggaacucgcucuuagucuuuuauuuuuuagaaaucuaugauaucucgcgcaauacauagcccauagaagaaacuauguagugaaauuacauagugauuuuucauucucgcaguaaaaauuuccugggauuuuuuuuuuuuaaugggugggaaacuaccuggaaauaguggaugccagagucuuaaacagaaggaaugaaauaauaaagaucagagcagaaauaaaugaaauagaggccaggaauacaacagaaaaguucaacaaaacagaguugguuuuugaaaagguaaacaaaauugacagaccuuuaguuggacuaaccaagagaaaaaaaagucaaaauacaugaaggagacauuacaacugauaccauagaaauaauaagaucauaaaagacuacucugaguaaauauaugccaaaaaauugaacaaacuagaagaaauggauaaauuccuaaaacauacaaccuaucaggaccacaucaugaaggaacagaaagucugaacagaccuauaaugagugaggagauugaaucacuaagucaaaaccucccaacaaauagaagcccaagagcagacagcuucacgggcaaauuccucugaacaucuaaagacgaauuaccaccaacccuucucaaacuuccaaaaaacugagcaggagagaacacuucccagauucauuuuaugaggccagcauuacccuuaaccaaagccagauaaggacauuguaagaaaauaaaguuacaggccaauauccuugaugaacaguugcaaaaauccucaacaaaauacuagcaaacugaauugaauagcacauuaaaaggagcguacaccaugaucaagugagauuuuuccucugaauguaaaaaugguucaacauaugcaaaucauuaacugagcuacaccaaauuaacagaaugaaaaauaaaaaccauaagaucaucuuaaaagaugcaaaaaaggcauuugacaaaauguaacauccuuucacaaugaaaauucucaacaaguaagguauagaacaguaugccacaacauaauaaaggcuaugugugacaggcccacagcugacaucauacuuaauggugaaaagcugaaagcuuuuccucugaggucaggaagaagacccuugcuacuuccauuaaauaugguaaguucuagccagaacaguuaggccaagaaaaagaaauaaaggcagccaggagugguggcucauggcucugauucccagcacuuugggaggcugaggugggcggaucacuugaggucaagaguuggagaccagccuggccaacaugaaacccugucucuacuaaaaaauacaaaaauucaccaggcauggugaugcaugccuguaaucccagcuugcucgggaggcugaggcaggagaaucacuugagcccaagagguggaggucgcagugagcugagauugcaccauugcacuccagccugggcaacagagcaagacugucucaaaaaaaaaaaaaaaaaaguaaaagacaccuaaaucauaaaggaagaaauaaaauuaucuuuauuugcaguggcauaaucuuguauguagaaaaacccaagacuucaucaagaaaucuguucacuuagucaaguucugggauacaaaaaucaacauacaaaaaucaguuuucugucuauacacuaacaacaaacuauucaaaaaagagauuaagaggucagguauggugguuaacaccuguaaucccagaacuuugggaggccgaagcgggcggaucaccugaggucaggaguuugagaccagccuggccaacauggugaaacccugucucuacaaaaaauacaaaaaaaacaacugggugugguggugcaggcuguaaucccagcuacuuggaaagcugaggcaggagaauugcuugagccugggagagacggaggcugcagugagccgagaucacaucacugcacuccagccugggugacaagagcgaaacuccaucucaaaaaaaaaaaaaagggcuaucucauuuacaauagcaucggaaagaauaauauaauuagaaauaauacccaggagguaaaagaugccugcucgcugaaaaguauaacacugaucaaauaaauuaaagaugcaaauaaauggaaaaauauuccauguucguagauuggaagauuauuguuaaaauuuccauacuucccaaagcaaucuauagauccaguacaauuccugucaaaauuccauuggcauuuuucacagaaauaggaaaaaacaauccuaaaauucacguggaaccacagaaagcaccuaaucgccaaaacagucuugagaacaaagcugaagacauugcaguuccugauuucaaauuauauuaaaacaauuugcuucuggcauaaaaacagacacauagaccaaugaaacagaacagaaucucagaaauaaaccuaugaauauagagucaacuaaucuuugacaaggguaccaugacuacacaauggagaaagaaucgucucuucaacaguuggugcugggaaaacuggauauugacauuccaaagaugaaaguggacccuuacuuacaccguacauaaaaauuuagucaaaauggauuaaagaccuaaaugaauucccugaaacuauaaaacauguaggaaaaaacacugaauuauaaagguauuugauacuggucuugguaaugauuuuucuagauauuacacccaaaaaacacaagcaacaaaagcaaaaauaaacaggacuacaucaagcugacaugcuucugcacagcaaagaaacaaucaacaaaaugaaaaggcaaccuacagaaugggaggaaauaucugcaaaccuuaugucugcuaaggguuuaauauccaaaagauaccagaauauuaacucagcccaaaacaacaaaacagcaaaaaaaaaaaaaaaaugacaucacccaauuuaaaaauaggcaaauaacuuuuagacauuuuuucaaaagagaauauacagauguccaaaaggcuuaugaaaaggugcuuaacaucacacacacacacacacacgugcguguacaugcgugggcacaguagcugugugggugauggauguguuaauuagcuugauugugguaaccauuucacaauguauaccuuguauuaaaucaucacaaguuaaaccuuguucauuauaucucaguaaagcuggagggagggauucagucacuaaauuguaaguuguaugcagcacaggaacucauauguuuagaacuuucucauauaauaagccugacuggcuguucucaggauaaaucccaaaggacaaagucaguaauaaaaaacaaaacaguuacuauuuccacuuucuauuucaacauggaaguaugcagcuuuaaauuuuuguuuuguuuuuacauagccuuguaagaaaccuuuucuuacacagcacuuguacguaacaugugccaugugugcuaugaacaaaaauguuuauaaaggccuaauaugugaaagguuuugccaaauguuuccuguaauguuaauuauauuuuauaaauuagcuauuucuccaggagauguauuuagccacuuauuaauuuauaagaauuaauaugaagguaacaaggcauaagaugcucguuuucccucaaaacacaagacauuuugguauauagucuccaacuuacaauggucugacuuaggauuguuuacaaugguuugaaaggauauguuuucaguaugcuucucaauuuaugauggggccaucuccagauaaaaccauugcaacugaaaauaucguaaauuuaaaacugcacuuucaacucagugguggguuuauugggacuuaacuccauuguaagucaaggaucaucuguauucauucuguauuuuuaauuaaaaacaguugugcuguuaauauauagacacaacucuucucucaucuuacauacuuguauaagauaggcccacuaguguugacuagauugggugugguccguuuuuugucuucugcuaagugaaagacuucagaaaauauacauauacgcuucugugaauguauuuguuucauacccacuguguugcuuaugugauauaaugaaagauuuguaaggcaucuaacuaaaaucacccuagaaauaacuagacacaauauuuaaaaacauuaucaaucuguugugcaaaaagcaauccaaaaaagugcauuuuuuaaaugaaaacuuggucucuccccuuguccccaaauuuuaggcacagauuacacuuuaucaguucuuagaaguguuucacuugaggugcuuuucgaaauccauuuuuuauuaucuauugugauaauguguugcaggaguuuaucuuuaauuagggaauuuuaaaaagguuaauggaaggguuuucuauaaugcuuuacauuuugucauugggaaaaaucuaucauuuccauuuaaaaugaagugugagcagcaaugaacagcauuagacauaauuguuguuaaaccucuucuuuguaaauuaacaugccacuuggcagaaauauaauuggugagccacagagaaggucuguauuuaaacaguaggguuaaugaauaucuuuuuuuccccuuuuucuuucccuucuuuuggccuuuaaaguugcacuuagcucaggcuguuugaaaugauuuucuuugaaaguguugugacauuguuuuaauugaaugaagcugcagaacuggcgugauaaaucaacacagaaugaauuuuaaugcaaggcaaacgauauuaaccuggaaauugguugcaguagacaaagcagcugcugugauuaguuuuuuuuuuuucuucauucucuacuuacaacauuuugagaaggaugaccucgacaauuucagcuguacuagaguccugauggcuugcaccuuaacauccuugagcuguuuguggcuucuuggggcaauagugauuguuucauuuuuuaagguuaguaaaauuuuuuaagguuaguaagauuaguaagguuaguaagauuuaaugugauuuuaacugcuuuacaaauauuuuuaauuuaguaaaucauaauugugaggauuaauuagcugugguagaagcccuuuucuauguaaucuugaugugguuccagccaaggaggguuaauacuugaaaagcaugggguaugccaaacaaggcucuauauguggucacagaguguagggcagcugguuucacaaaggguacgggucaaaaccaauuacauauuagugauuuguacuaaaguaucucuguucauaaugcauuuuuccagacauuuuugggccauaugugaaguauauaauguguaucuaguuagugacaauuugggaaaagaucuguauagaguacaacuauuauugaagaguagcuggcaagguuacuuaaagaaauagccaagguaacaaauauaguagaggcauuuucacagacuucuugagagcagaguuucguuauucucaauccuucacauuuacuucacuccuugccacauaauaagccuuaaguaaauguuuuguugaauuugaaaaugaaaggcuguucucuguuuuacugaaaaacagugggugagugauagcauguaaagauuauuaucucuguccagguuggaggaguggggaagugaaauuuaauguaaucugugacuuacauaaacugguuaagugaugauguuguagaaaaaaguaggaagagcuuauuggagaugaacauaaggccaggcauguugauagauuuucuguuauguuucuuuuuuauucagauccucauuucaacauuguuacaccauacuaccuuaugucaauucuagaccucuuuagauuaaaaagcaacugcucaaaaagugccaguagacuuguguuuguuaaggacugacaagauaaugcaggccagcugagcaauuccaggaaaauaggauacaauaggaaaaaaaauaacugaacacaucagagauugugaaucagcaagauugugaagaauuacuaguucauggucuucaggaggugagaugaucaaggauauaaccguguuuugggggaucucuuuuucugcugagcacguuugcagaaucuggagaggacagacgaaaggcugagcuuugggggauagcguuuggagucuauaauuugucuaugugaaccucccuugccaugcccagccuagucuucgcuuggggguagggacacugauggauacguacuuuaggaguaagaaugaacuaggagguugcagguccucacagagacaguaucucagcucaaaauugucuaucucaguaagugaaauugcauugauccuggguugcuaguaauaguaggugccuggcagaagcugauauguaucuuuccuggaggaagauauuauugucuuuggccuuauauuauuuuuauaagcuauuuaguuaaguguauugucugacacacacuagaaaauaagcacacaaggagacaagaugacauuaacaaaaaucugaagaaacagucugaaaaacaauacaaaauccacauacucuagauuuuagaauuucagacccagacuuuauaagaucuguaaguuuucaauguggaaggagacagaagaaaaggaagagaaauggaagcuauaaaagaaaaacuaagccagaaaauuauuuaccuacuauuaacagguggguuuaacagaagauuagaagcauuugaagagagaauuaguaaacuggaagauagcucagaagaaaauuuucagcauggagaugcagagggauggaaaaaaguagaagggaaugugaaaaguaaaaggaauauagugagaaaauuuaauauauguaguuguaguauuagaagaagaggagagguggaaugggacagaagcagaguuugagggaaguguguuucagaacuauaaaaccaaagaaagaaauaaagucacagauuugugaaauugugguuuucuuuauauuuaucauacuuacugauaaacaugauaaaggagaccacaccuuggcaagugauaauaaaacaacugaaaaguaaugaugagaaaaucuuaaagcagcuagaagagagaaaagaucaccuucaaaggagcagcgggaagacuuaguucacuuccauuaguaacaguggaaugaauccaggagaugguguauaaagaaucuuuaaggugcccuucaaaaauaagacauuuucagauaaggaaaaauggagagaguucauuacuagaagacguucacuaaaggaaaugcugaagguuguuuuucaggcagaagaaugaugauuauuugaaaaguugaagaugcauaaaggaauaaagagcaacaaaaaugguaaaauuguugauaaaccuaaaugcauauuuguacaaagugaaaauaauggccuguugaguuuaaaagauacagaauuugaaaaacaaaggcauauaaacuggauugaggauaaauauuacacuuucugagguccuuguauuuguaugggaaaaggguaaaaguacaaaugaacauuaauguuugauaagucaaggaagcauguuguaaauacuagggugaacaagcauauaacuuccaaacuaauagaagaagagaacgaagaaaauacguucauauuuucuucguccgcccacauccaggaaaaagaggcaagaaagaaaagaaaauaaguagaggacauagaaaacacuuaguaaaaagauuuaguaaaccauguaguauaaauuggcuguuccuguuaaaauucaaugaagaaacaacucauuuagaugauuuuuacaggaguccuguuuaaaauaaggauaacaaaaguuugaagguaauagauuggaucaagaaaagacacauaagaaaauaaauucuaucuauauuaguaucaguguaagcuuaauggcaaaaggcaucucuagagauaauaaagaaggccacuucauaaugacagaaagauauacacuugacccuuaaacaacauggggcugaggggcacugacucccuuugcgguaaaaaauccacguauaacuuuuaacuaccuccaaacguaacuacugauagccuacugucgacuggaagccuuaccgauaacauaaacaguugaucaacacauuuuguauguuacauguauuaacacuguauucuuacaauaaaauaagccauugagaagaaaauguuuuaaagaaaucauaaggaagaaaaaauacguuuauuauucauuaaguggaaguagaucauaaaggucuucauccugguggucuuuacauggaguaggcugaggaagaggaggaagauucagguuuggucuuacugucucaaggguggcagaggcagaaggaggugauggaggugggaggggugucauacuugguguaauauuuguggaaaaauguucuguaaguagacccacauaguucagaccuauuguuuaaggguugguuguaauugccuuuacacauauacagcaaaaauagaaguaaaaggcgaaacagguaaaauuuaaucacaccagacuuugcauucuuuuuaagcaccuauggaauauuuacaaaaauugaccauaugcuaugcugaaaagcaaguuugaacaaauauuaaggauggcuauuacauauaacauguuugcugauuacacuguaggaagcuaaaaaucaaaacuacaggaaauuauauguugaaaugagcauaauauauuuaaauauuuaguagaugucaaauuaccuugacuuugaaugaaaaugaaacugcucccuaucugaauuugugggauacaacuaaaaccagcuuagagguauauguaaagcuuuagauguauauguuagaaaagaaggaauacaauaagcaaaauauucauuucaaaaaauuggaaaaagaacagcagauuaaacgaaggaagggaaaaagaacagcagauuaaacgaaggaaguagaaggaaggaaauaaaugaagaguagaaaucaauuaaagacaaacacaaaaugaaguaauucaauauaucagcuagcuaucucuacauuauaauaaacuacuccaaaaucuuaaguaaaccacuuguugagcuccuuaguccuucuuccagucagcuguaaggucagucagguaguucuacuucugggaguugcgugguugcagauauugaugaugacugggucacugucuuucauuccccaacaaguuuuaguccaagcuuguuuacaugggggaaaggggcucuaagagaguagaaccacguaagacuaacacugaggcauaucauucucaccacuacguuguauuggccaaagcaagucacaaugcuagccuagauucaggaggugggaggagaugcagauucccuuugcagauggcauggacacaaugaggggcagagaauuauggucauuuuugaaaucagucuaccucagucaacaaaagcagguucuuuuaaaacacuuuugaagacagaucaagagaaaggaagauacagguaaccagucaagaauaaaaaaaugagacaucguuucagaucuuauugguauuaaaaauaaauuaggcaucuauuuuaaaucaacaaauuugaaaauuuagacaaaauggauacaacuuaaaaauugacauacgaaggaauagaaagucugaauccauaauuuaaaacuuucuguagugaaaucucuaggcucagguagcuucaccagugaauuuuauucauuauuuaaggaagaaauaacagccauauacaagccuaucuggagaguggaaaaaggaggaauacauuccaacauguuuugcuaccagaauaaccuugauaccaaaaccugagacguguauuaugagaaagaaaaauugugggccaguucuauuuaugaauggacauuucuuaaaaaaaaaaaucaccagaaugccaggaaacaauuugcucaaguugauuuugcauuaaauugguuuaacauuugaaguugaaauugaauuugaaauuaaauuugaaguugaaguugguuaacauuugcaguugaaauccacugcaauaacagaauuaaggagaaauguuguuuuaauagauagugaaaaaugauaaauuuagauauccacuuguaguugggaacucuuagcaaacuaagaaauagaagggaauuuuaaugugauaaaguguaucuucaaaaaguuuaagauuaaacuuuaugguggacuguugaaaccuuuauucuugaaauuuggaacaagucaaggaugacacacuuuuauuuggcuuugaacucaagguaugcugaccaguacuguaaggauagcaagaaaaagaaauaaaaauauaugauaggaaaggaaaauagagaacugucauuauuuccaggugaugugauuguuuagcauccaaaagaaucuacaaaagauuuaugagagucaguaaugaagaaaugcugguuguaagguugauagaaaaaaacccaauuauauguucauauaccagaaacagaaaaugaaaacuuaaaauuaugauauacgguagcagaaaaagcccuguaaauuuguaggaaugaaucuuaacaacaacaaaaguaaaaacaaguaaaggcacaaucaaaaaagcucuacauuuuugaggcuagacauggugucuccagccuguaauccuagcucuuugggaggcuuaggcacugggguggagugggggugaggauggcuugaguccaggaauuuugagaucagccugggcaacguagugagaccugaugucuacaaaaaaguuaaaaaaaaaaaaaaaaaaaagccaggcauggugaggcugaggugggaggauugcuugaggccaagaauucaaggcuacagugcucuaugauugugccacuugcacuuuagccuaaacaaaaauaaacuugacguuauugagagagaugagagauaacuuaaccaaauggagaaauuuuaccauguuuaugguuuuugaagagucuauauuauaaugugaucucagugaaaauucuugcaaguauuauuuuagaaauugauggacuuauucuaaaauauguggaaauggaaagggccaggaauagcuaagccacucuugaggaagagcaagagagaagaacuugguguaccauauaauuuaccauaauuaauacaguaugauguuaaaguaaagauaaauaaauggaauagacuagagagcuccaaaacagaccuaaguacugucagcuguuuguauccucagguuccacaucuguggauucaaccaaccuaggaucaaaacuuuuaggggaaauauuuaaaaugguugcauuuguacugaaauauacaaauuuuuucuugucauuauuuccuaagcaaugcagcauaacagugauuuacacaguauuuacauuguauuagguauuuuaaguaaucuaaagaugauauaaauuauauuggagguugugcauagguuaugugcaaauaugacaccguuuuauauaagggacuugagcaucugugaauuuugguguuuguguggggaccuguaaccaaucccccccaccccagauaccaagggacgauuguguagauaaauauuuaugacagugaugacacuggagcaauuggaaaagaguagucuuuucaauaacauuucuauucagugacauucguauauuuaauaacauuuggauauucaugugagagaagaaaagaaaauuauaacacagacaucaauuccugguacacuguagauguaaauucgaaagacuuaacaauaaagcuucuagaagauaacaccagaagguaucuuggugaccuuaggguggggagagacuucuuuuaaacaggacacagaaaacacuaaccaugaagauaagguugaaaauuugaacuguguuaaaauuaaaaacuuucagucaucauaagacaccauuaaagagggagaagacgagccacaggaugggaaaaauacuugucaguuguguaaccacaaaguagaaaucaauaaggaaaagguaacacaauagaaaaacacaggaaacuucaaauguccuucaaaaaaugcauauccaaauggccaacaaaugugaaaaaaaugcuuagcuucauuaguagucagaggaaugcuaauugaaacauuuaauacauacacuagaaugguuaaaauauaaaaacacugauaauaaauauuggagaggaaguggaucaaaauaaauuuuuauacuauacggaggauaaaaauauguacaaccauuuuagaaaauaauuuaacacuauguacuaaaguuuuuuuuuuuuuuuuuaaaucaucuucuuuguccuguagucuuuuuuuucucaagggucagucucuuguccugcuucuuuaucuuguccugucucucucaugauagagcccuucuugaaccuuuggugaacauuguuuaagugugaaacaaugaaaaucugaauuaggagcuuguguucaugaacagagcuguccgcugccaaccuuaauuuggggugacccccuaaagugcuagucuuugagauggaagucauauaauggaacacagaauucuuuucguggguuauuucaauuuuucuagagaaaaaacuagcccauuaccuacaagucagaagccuggccuuugcuguucugugggcagugauggucgcuuguucuguguauuaguuccaccuuuucauucuuguuuucugcaaaacucagugugugaguguccagucucucuggaguucuguagggcaaguuugcugcugaucacaucuccuucuagaaaugacauuccaagcuuaauuaagaguaagagccugagguuuuaagcaaaggauuuguauuagacuugguaggcuauugugacuguauggcaaacuuuuuacuggaccuuguguauguauugugcuauacacauacauaucuguacaugccaucaucacuauagcucugucagauaguauuauccccauucuguaauugaggcuuauuugaugugauuuucagauuccuuuuuuuguuuuguuuuguuuuguuuuuuuuuuuuugagacagagucucgcuuuauugcccaggcuguagugcagaggcaugauuucagcucacggcaaccuccaccuccuggguucaacugauucucaugccucggccacccagguagcuggaauuacaagcaugcaccaccaagccuggcuaaguuuuguauuuuuaguagagaugggguuucaccauguuggccaggcucgucuugaacgccuguccucaagugauccaccccgucuuggccucccaaaguguugggauuacaggugugagccacugcgccuggccaauauucagauuccugauuacuguuuucauauuugagcuuggauaccagcuagaaucugugugcucucagaguuuaagcacauaaccguaguauacuacuugaguuuauuuaaauuggagauguaggaagguuaaguugaugaguuucuaaauuggaaguacuuuguuaaaauggaucaugguggggguuuagguuggguaaagagguaaaauuacuauauacugaagcacugggcaaagauaagggacuuuaucugaauauaaagagcuauuagcagauuucagaaucuaggaucuugaagagcuaaauuaagugcuuauagaugagucugugagucucaacagagggugaaauaagauguaugaaaauccccucggagacuuucuucgaaugauacaggcguacuaccuaccaccuuucauuugagaaucacuuuucuaaggugugacaaugcaaaauaagagccaguggaguacagaugauaccagaaguacccagcuucuuaagcccugauggcaguggauuuucuagcacguuacuuuuauguaaugauauacuaaaaguuggauaaaugcaagaaaaaaguagaagaccauaugcauaagaaucaguaccuauuugauugaauaaguaaaugaaaaccaccuguggaauuuuguggaacugauagcaaacucuuauauuuuggccuuuaugcagauaacaugcaaaugaggaaaauuuacuuuucacgauuuagcccguuuuuccuauuggcuuuaaagaaauaacuuguauauaugaauauuaggaauuucuguugagggaugguaauuuuuuauuuuuuuauuguacaguuuuuaauuuauacaauuauugauaucacuggccuauuuagugauauucagaguuuagguuucuuauaaguuaaagguagaaaggaauauguacucuuaagacacauuuaguguagccaacccauaguuuucguaacauauuucugaacaguugcuuuggagaaaguauaauuuuucuuagguaaauaaaagaggacuuuccccaaaggauuuugguagaaagggcagugccuaacaauuucuucaacacugucaugacaaagagacaguuggacauuuuguggaagggacuuguauucuuggcuggcaucuaauauuuugucaaacucuuuaauacucucuguuuuagguuauuuguugauggacaguuguaucuguucuagcuguauacuguucccaguucauaguuuguguuaauacuugugaaaauauaaugcuaaacgaugagcuauuguaauuagaccugagacuuagcaagaaauucauaagggcucuagauuuuauuucaacuuaguauuaaaaagacauuuaacuucaguaaguaaauguagauauacuuuauauuuuaagagcuguaaguuccagcaagugaauaauguauagugauccuuuuuuuuuuuucucaguuuaauuuuguugggagaauccuuggaccuagaggacuuacagccaaacaacuugaagcagaaaccggauguaaaaucaugguccgaggcaaaggcucaaugagggauaaaaaaaagguaaguccuugaaaauggacuaagucuuuaugugaguaacuuacuauacuuuuacaucguaauaauaaaauuuccagauuuuuuugugcuuaaaacacuauauuccaggccgggcgcgguggcucacgccuguaaucccagcacuuugggaggccgaggcaggcggaucgucugaggucaggaguuugagaccacccuagccaacauggugaaacccugucuuuacuaaaaaaaauacaaaaauuagcugggcgugguggcgggcgccuguaaucccagcuacucaggaggcugaggcaggagaauugcuugaacccgggaggcagagauuucagauugugccacugcacuccagccugggcaacaggaguaaagcucugucucaaaaacgaacaaacaaacccacuauguuccaugucaggaacuuuuaaacuuuuuaaagguguugucaugauuuucccuuguuuuucuuuuuucuuuguuuguuauuuuugagacggagucucgcuaugucacccaggcuggagugcaguggugcaaucuuggcucacugcagccuccgcuuucugcauucaaguguuucuccugccucaggcuccugaguagcugggauuacaggcgcacgccgccaugcccagcuaauuuuuguauuuuuaguagagaugggguuucaccauguuggucagucuggucucgaacuccugaccucgugauccacccaccucagccucccaaaggucugggauuauaggcgugagccaccacgccuggcgguuuccccuuguuaauuaucauuuuuuacuuagcaaauuaaaauaucaguucaucauguuaccuuccuuugucauuuacuuuugggaagcugccaguuuggaaauuagucagacuguaauguguguaaaaguauauaaaaguuuugaaaaaucugaaauuuuucuuuugaugagauuuaaauaagaauggucaaauaacuuuggauguaugucagaucacugggagaguuagaagacagaaaucuauuagaaggaaggcuaucacuagccauaugagauacacuuuggguuucaucaacauuuuguguugauuuuacauuuuaaaguauauuguuucuguuucuguggguuuuuuucuccugccauuucuucuuuugcugguuuaauuaguaaagacccaacuaucuaaauauuauuguuaggaagauuuuauuuaccuaguuugucuuacccagcaauacugugaggcaggauaguuuugaauuucuauucuuguaaaaauuggcggauuuaaaaaaauagauuuugauggccaaagauuaaaaguguuuuaggaagguuuggucugucugucugucugucugucucuuucucucucucucucucucuuucuuccuuccuuccuuccuuucuuuccauugacuugaaggggcuaucuaggaauagugcgugguuagcuguguuagaccaguacgcugaaucgcuuuguggaacuuacggaaugaauaccaaacccacaggguaucugauaaacuuguuuucugagcccuccgccucaugucuuuuaagcccucacauaagcugacuggaucucauucauuuuugcuccucaucaaugauuuaguagccaagaaauuugggcaaaaaguucucauaauauugauuauuuaaaaaucuuauuauaauguauuccuugucaacuguguuuaaagauauguucaugggagucugugaguucuccuugagcaauuuuagauguauuaaauuuuuuuaugagaaucuuaaaaaaaugugcauauuuugaaucaguugagugauaaucuuuucaaaugaacguugccaugaaguuuugguucucauguuuggacuuaggauuauguggucauuaaguaauacuaguuuaauugccuauggacaaugaaugaagucuugacaacuggcagauauauaaaucuguaugaaaagauuaguauauauucaucaguuaggcuauucugucagccaguuaacaaaaccccuuuuucccugcuucugaguuucugugaauucugcaguaauggccccccacucaaccuugcuuacuguuucaagcccucacagacaaugagcauuagagcuuauaacugugugauuauacuguugcacucuuauaaguguuuauaauaaaaguaaagucagaauggaaugcuuggccauuugguaaagaacaugaaaagagauggaaacaaaaagaaguauugauguaaguaauaaagauagcucauugagauguauuucaggaguucaagaggaaaagccauuugcuuuaaacuuuucuacagaguuguccauguauauauagacauguguguauauauauauaugugugugcguauauauauaauguguauaucuauauguguguauauacugauugccuguuuuacuuuuaacacaaaaugcuacgaugggaauggugugugcuggucugaauccuucccuacacugguaaacucagugagagccuaccauggcuauucuauggaguauuaauuuccuugguguuuggugaguaccuggcacagagugcaggcacuugaaaaaaauaccugugaaaggagugacuaguucagguaauaaaugaaaggcuuagguguaccuucccucauguuccccgaaaagguugguuaaauaaagaaaauuguaaaugcuauguacuucuaaugcuuuggggaaguuaguacuauauuauucuaagcugcugguuuuuagcaaguaaguuaauaugccacuuuaguuuucauuuucuuggauuguuauuauuucagcauuauugaugggcucaacagcauugauuuagugcauaaauacccaguggaaugguacuaguuaagaucauggaaccagggcuugaaaacuauuaugaacuucuugucuguaccagcuauuuuguaaaugaagagaccaaagccuuggggagguugaguaauuugccaaaggucacacgccaaaauguggcagucaaauuugaaacuaggcugggcacaguggcucacaccuguaaucucagcacuuugggaggcugaggcaggaggaucccaggaguugaagaccaacaaggucaacauagugagacccccaucucuacaauaaaacuuaaaaaauaauuagccaggugugguggcgugcaccuguagucccagcugcuagguaggcugaggagggaggaugcuugagcccaggaguugaggcaacagugagcuaugauugugugccacugcacuccagcuugggugacagaacgagacucugucucgggggaaaaaagaaaaagaaacugaauucugaguucuauucugugguacauuauuuucuaauuauaaaccauuucuaagagugauaacuucagacauacuagaacaacuugaauauugaguauuagaaacuuugacuaccauuucacacaccacccaguacacuugugaccccagauguuguaaggguuucuccccacaaaccaaacaaaucuccagaaaacaccaucugaauguccucuaauucaguucaaaacugggaauaaugucacauaccacaggcugagggcucaguccccuaagacugucuccacuucagaugccaguuacaagccccaguggugaccugugcuuuugacugaccagcuguaaauguguuuuuuugcaagucccucgucggguucaauuaauuugcuagaguaguucacagaacucagggaagcacuuuacuuauuuauuauaaaggauauuacaaaggauaccgacgaacagcagauggaaaagaugcauagggcaagacaugugggaaggggcucagagcucccaucccuucuccagugugccacccuccaggugcauccauguguucagcuauuuggaaucucuccaaaccccguccuucuguuuuuuuguggagguuucauuauguaggcaugacugauguucaucauuggccauuggugaucgacucaacauucagccuuucucccuuccuuagagguuggggaaugaggcugaaagucucagcccucuguauacuugguuaggguuucucuggaaucagccuugaucuugagacuauccagggcccccacccauuugucacuucauuauacagaaagacacaaacagguuccagaccaccacaauaagggaacauugcgauaaagcuagucacacauuuuuuuaguuuccuagugcauauaaaaguuauguuuauaccauacuauagucuauuaaauuuguaacagcauuaugucuaaaaaauauacauaccuuaguuuaaaaauacuuuauugcugaaaaaugcuaaugaucaucugagccuucagagaguuuuaaucuuuugcugguggaaggccuugccuggauguugauggcauguugauggcugcugacugaucaggguggugguugccaaugguuggggugacugugacgauugcuuaaaauaagaacaacgaaguuugccucauggauuugcucuuccuuucacaaagaugucucuagcaugcagugcuuuuugauagcauuuuacccacagaacuuuugcuguugcuuuauaaacuaaguuuauguaauauuauaaauuuuuuuuugucauuucaacaguguucacuguaucuucacuacaaauacauuucaucucaagaaaucacuuucucugcucauccauaagaagcaacuccugaucaaguuugaucaugcaguugcagcaauucagucacaucuucaggcuacacuucuaauucuaguucucuugcucuuuccaccacaucugcaguuucuuccuccaucauacuccuaaaccccucagagucauccuugaggguuggaauuaacuuuuuccagacuccugcuaauguugauauuuugaccucucuccaugaaucaugaauguucuuaauggcauugagaauggugauuccuuuccaggagguuuucaauauacuuugcccagauuuaucagaggaaucacugucuguggcagcuauaggccuaugaaagacauuucuuaaauaauaaggcuugaaagucuaaauuacuccuugauccauggguuacagaaugaauguuguguuagcaggagugaaaacaacauucaucuccuuguacgucucuaccagagauuuuggguuaccagguggauugacaaugagcaguaauauuuggaaaggaaucucuuuuucugagcaauaugucucaacaguaggcuuaaaauauucaauaaaccuuucucugcugacauccaggcuuuguuguuccaauuguagagcacaggcaggguacauuagccuuuuuuuuuuuuuuucuuuuuaagacagagucucacucuaccgcccaggcugguguguaguggugcaaucucaggucacugcaaccuccgccuucuggguucgagcagucaugccucagccugcugaguagcugggguuagaggcaugcaccaccacacccagcuaauuuuuuguauuuuuaguagagaugcgguuuugccguguuggccaggcuagucucgaacuccuggccucaagugaucugcccaccuuggccuuccaaagugcuaggauuacaggugugagccacugcaccugucccauuuagcauaauuuuuaagggcccuaguauuuuuggaauggucaaucagcauuugcuucaacauaaagucaccaguugcauuagccccuaacaagagaaucagccugucuuuggaagguuugaagccaggcauugacuucucucuagcuaugaaaguuuuagauguaaucuucuuccauuagcaguccagacacacacaguacuugucacuuaaguucacugucuuauaugggcaugguuuggugugccccagaacaauuacaguaguaauuucaaagauuacuaucuacaggucacuauggcagacauaauaauaauaguaauguaaaaguuugaaauauugugagaauuaccaaaauguggcuuggagacacgaauugagcacaugguguuggaaaaauggugccacaagauuuguuugaugcaggguugccauaagccuucaauuuggaaaaaugcaguauaugugaaguacaauaaaaggagguaugccuguauuacuugggagauucagggguuuuaggagauuugugccaggaaacaaagaccaaauauauuuauuucaucauaaaucacaauaucauacuaucauuccuuugauuuuucaggaauucucccuagaggauuuaaucccauguacuuaauggaaaucuauauacuugagcagauuacaaaugcuagaggaguaauuuuagaugagaucgggugcauucaguaugguaugguguagacuagaggaugaauuuuaggaaaagaaaguaauuaugguguuucacuugagguugcagaggccguauccagggcugugaaagaaauguauucaugcuaggaggcaugguccaccuuuagaaacaggugggagucagcugguucuaauguagcaaaugagaacauguaagccauuaaaacagaacaguguuuugcacguaauuagguacuuggcaaauuguuguggagugacaaguaguacauugaaguucacccuuuggguauauauaugcauggucauuguaggggacaccauuugugguuuugucuuauccgucugcaauuugucagcucuucugaggucucccuucucauaaacaagaggagaauaaguagccaugcuuguggguuccuccuucucaccuccuuuuucuguccuuccuucucucccauuguguugaugggugaaauguaugcaguuuaucaaagccaugucagucagauguugcaucaucuggaaaugugcaaagacuuagcaauuccaguucaaguucuuugcucaaaaugaagggaugugcauucuucuucuagccauuccagggcugcuaauaacaguggcuagagcagggguguccaaucuuuuggcuucccuggaccacauuggaagaugacaaauugucaugggccacacauaaaauacacuaacaauagcugaugagcuaaaaacaaacaaacaaacaaaaaccucauguuuuaagaaaguuuaugaauuuguguggggccacauucaaagccuuccugggccgcaugcggccuauggaccggggguuggacaagcuugggcuagaugguaucagccacuuuuacuaucugugcugcaucauguucagaccaugggacaaccuuggaaaagaguuacacucuuccaacggaaauggaggcuuaaagaaguguaguaacccacccaguugcucauuucuaccugaagaguacacaauauagaaacuuccaucucucacuggauauucaaauucaguuguacaaaucauucuugucagaaugugggcuuugaaauaaauugguaauaguuuuuaacuuaauauuuguuucccaaauguauuuggccauagucuccccuuuuuugaagaugucccuauaacuccuugaagaacuacaguguuuuguggaacaugacuuacgaaauguuauuagagucauauuguauaauugcagacauagguggaauucuugaauuuuguuuugcaggacuuguuuagguagagcauuuaauaacuucuuuuacgugaugcuuuucauauacauuacaaauuguuaaguaucucuuauagcagagauuucuuagcucuauuuguuaugcuuaaaauauauuuuaauuggucaauauguuauauuuuuagaaaagugagaaaguccuagagggucucaagaaaauuaaaggcuccugacauuccauuaguuuagacacuacccuuguuuauaguuugguaugucuuguagauuguucuucaugcaguuaugcauauguacacguaugguauauuaaguggaucauauuauauuugcugcuuuauaaucaacauuuuuuuccugcaacucuguauccuguccuaugucaguucaccgaauaguagagcuuuaugccuaagacugugauaggugauaggaaaguacacuuaaaggacauuucaaggcagcauucauagugauaugcaaaaauaaauuuccuugaauuuuugggugggggaacuuacaagauuuuauucuuaugaaauauguuacugcugugucaacacuuugaaagagagaaauuaauucagucuugugauugauacaccagaguggcuuuggcaauugguggcaugacaucaaguacaaguaggguuccaaacagccuguuuuaucgaucuuguugaauacuuagcucucugacaagcucuagcauggauauaguuuuuuuuuuuuacguuuucauuaugcaaaauuuuaagcaauggaaagacaaguaguguagugaacucuaauuuacccaucacccagggucagcauugccucucuccuuucaagagggaacucucucauuccccauugccucacuucaccuuuugccucccagauuauuuuagaaucaaauucagacauauaauuucaacuguaaauauuuuauuagcuaucucuaaaauagaacucuaaugauaacguguuuguguuuuaauaucuagaaaauuauuuauccucaaauauguugucaguguuaauaguuucucuggugucucauuaauaugcuuuuaaaauaauuuguuuuaaugagcauacaaaugagggucaucuacauuguaauugauagaucucuuaagccacuucccaaaccuccauuucucuuucuuggcuucacugggugauuugucuugaauuccuguggauuuugcugguggcauuuucuuggugguguuuaacauuuaucucuguuccccauauuucuuguaaauugguaaugacaaagguuuaguuaaauucagcucucccaccuucucuuucucauuucuguucuuuuuugaaagaauauuucauaacuaguguuuugaugguaguacauaaagucucauuuccucucugugauuuuagcaaucauuguugauuguuuucuagguccuuuuuuucagugggaguugcagaauagcuauauucuguuucuucauucauauuagcuagauacaguuuuuaucagaaaggcggaauaaauguuuaauucuuuauuugcuaguuuuuaaauagugaauugguucccaagaauccuccagacugaaagaaugaguguuucccugccccccgccuuuggguaucacuacgaaugcauuuaaacaguuuuauauguuuccguucauugaagauauuauuuuuaacuggcgcucaaguuguuuggccauuggagggacuucuucacauugacuucuaaaucuuuucaacauaauccuaguagaugggaauaguaacuuugccgucuaguguagugugauaugacagucugcacucuugugagaauucuuccucagacuuggaaucagccaauuuuuuagggaagcuuuguuaacaaaaagugacaaaaaaaaagagagagagagagaaagaaauagugcagagauuauagucugggcucuagugauucucauuauuguaggcuuuucagagcugugaaauacacacgaauauuuucacaagcucauucucauuaaauuuaggacuauaauguuuuuauuuaaucuucuaucuguaucuuauuuucucacugaaaauucugguuccuagugacacaaaauaaugauucauuugcuuuauuucaaaaaaggaauacaaagcagucucagaauaacuauaaccacuacuaccagugauacaguuggugacaauuuuacacugagcucuuacuauuuugaggguauauccacuagauacaaguuaccaucucuuaaagcagcuggaauaauuuuuacuauguaacaguugugcuaguauauagauccaugguuagguucauuuguugcacuugauuuucuaguuguggaaauugcauaaaauauuuuccuguuuucuaccuuagaauauuuacaugguuccaaagcaaaauaugcaaagcagagaauuuuuauaaaguauggcuuucaucucaggcccauuuauuuaccuaguccucccuugcuguuuggguagauuuuuuauuuuuaguuuuugguuuauccuuccauuucuuuuuuuuuuuuuuuuuaaacauaaacaguuauguaacaguuuuguguguguaucuguguauaauuucucacucuucauagauuauuauacucucagcacuuuuuaauaccuuuauuauuuauuuucacuuaauaguauauuguggucauuuaaugggaguguauaaagaauagccuuuauucguuuuuuuuuuuuuugccguuacaaaaagguauagugcuguguugaaaaguguuucuugaaguugcuaguuuauguuugaauagaauuguagaagcaggaucgugugugguuuuauuaguuagugcuaaauuccuccgucuuagggugaugguuugcguuaccaucagcaguguaugagaguagcaguuuccccccagcuucacaaaacuuugcucuguugugcaggagauugagcaucuguuaaaggcacuuucaaagaaguuaugcuguguguguguguguguguguguguguguguguuguguguaaaagucauuacuguuaugaacacuguuaccaccuucaguuucccaacuauuguuuguagugcguuuuuuaauauucugacugaagcaguuuauaaauaaugguuagacuuacuugaaaugguaccauuacaacaugucuuaaggcacacuaauuguaauaacuucuggcugggcuuaagaaacuacuucuuaaauguuuuuaaguggaaauaugcuuugauuuuucuguaagcuuaacaagcuuuucucagcuaggguuccucaucugaaccacagaaaauaggaauuauuucauuuuauuaaagaugacucaucaagagaaccauuauaguuacacaggagagaaguuaaccacauauaauuuuuaugucuugggcugggcauugaaauuugauucucauguggaauucuuaguugagaaagguguacccugugagaaaugguuuuuuucucgcauuuuauauuacugccucuccaucaaaccauauauaucucccccucuuccuucagccucccuuauugguaccauuugacgagaugauuagggaguaggaacuguuacagguuguuuguuagaggguuaaucuuacaaauuguauucuuaucaacuuucaugaauccaauugaauaguagaauucgcuaugaaaacagaugaguugcuuuagaaaaguggcaaugaaauguauacucuuguauaaccugguuuagagggaaccuuauuaagucaucgagucuaaaccauauuugugauacuuaauuccaugauauuucaguaaguaguacuauaaaugacuguuagucaguuuucauuaccuucuaccauaguuaauuuaauacaaucugcggcagcaguuauguuuuugaaugccugugauuuuuuacccucaaggaacuuucaccccuggaagacugauauauugacagugaacugaugcagcggagaugauauauacauugugcaggaagucaagaaguaauguguucuuugaagguugaagguuuuuaaaggaagcuggagaagauugaaguaggaguuuaccaggcaaauaaguaaaaugguauucuagacaucagaaauagaaucaaccaggguauguugcuauguggaugcuuggugugucucaguggaagguauggggcacaguggaguguugguauuggagauaaggcugaggucugaggauaaaggaccaugaaccuuauauccaaauuuauuucauuuugaaagcagugcauugacacucuucucuuuuaaagaugagaaguuauaugauguauuaauuguuuuggaaagguaacuugacaguaguggaagagauggacagaagugggaagugacuaaaggcagaagacaaaugaucaagucucacacaacucugccuagaaaguucuuucuuguguuaggauaaaaucuuugaaacuucaguccucugaucuuaaucuacuuugaauucaaaacaaauauaaucucuuaaacuuuagagacuuugacauauuuaaugacagugcuugucuuaaagguguucugcccuagcuaaaaguuuauugccuaguagccuuaguucucuuuuuuguuaagaugucaugugauaugguguugaauucaacuucaaaagugguagauugguuuguuuuuaaagagaaaagaagacccgcuauccuuuucagugcuuuucaaacugucugugguaagagacccacuaaaaaaauucaauccauuauaucuuuuggugaaauacaauaaaauuaguuaccagagaaguggaguuuuaaaaagacauauauuuaaccccauuuaaaacugucuuuuaucaagagacauaaaauuauccugucagaaugcucaaagaguuucugaacaggcuugauuucuguacuuguaggcugcacuuccggccgcacugguuuaaaugccaacugugacgugguauguuuguuucaggauuguaaacuagcucccuggugucccuccuccucuacuuuuguucuucucacucccucauuuuuuuuuauuuuuuauuuuuuugcucuguguuuauaaaauaaaauucauuuuagauuauugacuagauuauuuuuaaguuugauuucugguuacauguucauuaaggacucaaauggcuuagcuuuguuuuaagauagaagaguacaaaacagugcaauaaagauuaaauguuuauuuccggguugauaauaucucaguacauuuauagaguggagucacugcuuuuugcccauuguuaagaaagauugggaagacuugaaauaaaaaauuuauuugaaaauacauuuauuaaaauuugugagacacccuuugagagguaaaaagauggacccaauaagaauagacuuuuguuuuuauuaguaaaguaauacuuuaaccuguaaaacuucaucucauuacucagccauagauauaacuccaggaugaguuaauugcccaugucuaaugaaaugagacgugagucucagugaaaagggagaguccauuuuaucacuagaugcucuuaaugagccuuuuaaaauuaagucuugauuggauugcagucaauuucguuaaggaauauuugagcaucuuguaguugugucuuauguaacauuuucuuuuuagaggauucagcucucuguugacagagugaguaguggaauguugcugauguguauuaaugcugcagcaauugaucuuuucaaaacccguuaaccuuaguuggaaauaauuuuucagucuaauauauuaacaacaaauuauuaggccguuucauaagccuagggagccauccuauucuauccuauuaguuuuaguuuucuguuuauuucuucaguuaugagagaccacuauuaaauuauuuuguuguucuuuagauuuuaaaacauguaauuguuaacucucgauuuuaaauaccuauaauuuuuaguuugguguuuuuaaaucacagguuguuauaggacauaguuuguggggcuguguuuaauguuuaacaacaauugugaaucucagauuguugaaauuauucuucauuuugugaauuguuacguuuaacuauuuuuaaaaacaguaauagaaauuauagcagauagugaagaauguuuuuaaaaaggucugcaaaaacuuaagauuuuuggugaauuaaaauaaguauaagguagucuaaauauagaggacuagucacuucaaauagaaaaaaauuuucuuaaaaaaucuaaugugaagaaaauuuggaguaauuuuaucuuuguaacuaauaagauuaauguuugaauaauaauuuguguuaucucaguagugagauuauugaauaauagacaagugaguaaacggaugccuauauggaugcuucaggguguguaauauuaucaaguguuacaacagcacauuguuuagaacguuuaagauuuaagacgaguaaguacuuuaaaaggagucaaaagaagugaaagcaaauacugaaccucaucuuuuauaacauaaaaaugaauuuuuucuuaauuaugaaagccuuucacguuuaguguagaaaaaauuuagauaauucugguauuuuaaaaaucuaaucuuccccauuuagcgccguuacuuauguguuaauacauauuuugagaucuauguauuugugaccugauauauuuuguuuaaguauauuacguacuaaaaagucaucuacaauacuuuuuuuuuuuuuuugagauggaguuuugcucuugucacucaggcuggagggcauugggcaaucuuggcccacugcaaccuucaccuccuggguucaagcgauucuccugccucagccuccugaauagcugggauuacaggcgcaugccaccacucccagcuaauuuuuuguauuucuaauagugacgggguuuuaauguuggucaggcuguucuugaacuccugaacucaggugauccaccgccucggccucccaaagugcuggaauuacaggcaugagccaccgugcccagccuacaauacuuuuuaaugguuauaaguagcauuuaauuguacauauguguacugagguauauuguuuguugaaguuuuaaaauaauuguuuuuacuauaaaaaugcugugaagaauaucuguacuuuaucauuaagauaaaugugacugggcuccauggcucaugcuuguaauuccagcacuauaggugggauuccaccacugaggugggaggaucauuugagcuuaggaguucgagaccaccuuggacccuucucuaacuuaaaaguacaacaaaaaaagauaaauguguagaauugguugguugaaaaugcauuucaaaauugccuuucaacuucacuguuugaaauuguaagcucccucagaaaaugaaaaugcuuauguaacgaaucuucuaaaaaaucacuuuuuuaaagggacaaaaauauagacaaaaauacaacaaacauacuucugguuaacaagguuaaagcuuaucuguuucacuuguuuauugccuaacauugcugccaucuguaaacccccacuuuguauuuucuuuucauccucauuuugaaaaaauaaaaaauuauacaugcagaauaauuacaaggcuaacaaagugaauuuguguauaccuucaaccuaaauuugcuguauaccuuggcccuccauacugcaggccccacauccuccaauucagccaaccacagaucaaaaaauauucgggaggaaaaauaauaaaaaauaauaauacaacaauagaaaauaauacaaauaaaaaauaugguacaaugauuuacguagucuuugcguuguauucaguauuuuaaguaaucuagugauuaaaguauauggaggaugagccugaguucugugcaaauacuguaccuuccuauaucagugacuugagcacugguagggaggcgguccugggaccaaucccacagggauacuaagggacaacuguaguaacguuuuguucauuuguguguacacacaguguugauuuuuuauuuggaaguucaccuacuugcugaaacuuauguguaacccucaaaucauuacuggcgacacuuucacggucauucagacacgcacacaguggcaauaaaaaucugagucacccaaaugcucuuuuuugauauugagauagaacaagaugacacaccaccaccuuuuuacuucaguucauacacuguuaaaaaaaguuauuuucauggucugcuuagugucacguuuuggguuuuuuuuuuguuuuuguuguuguuguuguuauuguuguuuuuguguuuuuugacuguuuauuaugauuuugcuguuuaaaaugucccucaagcauagugcugagguggugucuaggauuuaggauuccuaacagcaagaagacugugugugaugugccuuauggagaaaauacuuauguuagagaagcuuaguucaggcaugaguuaacugcuguuggcuguugaauguuaaagaaucauaaggugucuuuuuuuauuauuuauuuauuuauuuuuuuuuugagacagagucacacucugucguccaggcuggagugcaguggcgcgaucuuggcucacauuaaccucugccuccuggguucaggcgauucccuugccucagccucccagguaucugggauuauaggagcgugucaaaacaccuggcuaauuuuucuguuuuuaguagagacaagguuucaccaguuggccacgcuggucucgaacuccugaccucaagugaucugccugccucggccucccaaagugcugggauuacaggcaugagccaccgcgcuuggccuaaauaaggugucuuugaacagaaacacauauaaaacugaauuauguauugaugguugaugaaaaugugaccagagguuugugggaaccaacccuguauuuccuugaggagcaguauuggcuaauucaguguuccuggugacuuuaccacaaauaaugagaguugcgugugugugugagcaugcgcgugugugucuguauguauguacauauauaaaauaauuauuaccguuugcugaaucauuugagagcaacuugcagacauuaugauccuucaucccugucuuagagugcauuuccuauaaccaaggacauucuuuuacauaguuacuuuaucaaauucugaaaauuuaauauuauuacaauauuguuauuugauggacauucuaaauucaaauuuuccaauuuuucauuaguuguaaguucuuucugauucagaaucuaguccagaucacagauuacauuuauuugcccugucucuuacaguguaauuuggaacaguuccucagacuuuucauuaucuuuuauaauuugugugugucuuucuucaugacuagauucaggccaugcauuuuucacaagaauguuuuaaaaagugauguuguguccuucucagccaucacauuagcaguuagaugaugucaauuugccucauuuuugauguugauaacugaucauuugguuaaaguagugugaguuauguauugucaccguaaagguaacuuuuucuccuuuuaaaucauaucugaggagaaauacuuugaaacuuuguaaauauucuuuccuaacaaauuuaggauuguaaugucuuuuguccaauuuucguaucauucccuuuacauuuguuaguuaacauuuaauuguaaugaauauauugucugacauuucuaauagguuaagaucucuuucaguauuacauguauucuugcauaucccauucguuugcugauuuuagagucucucuccuugacuuuuacacugcuugauaucuuuacuugguuagauggugauaguagugguuguggugacaacaauaaguugauguuauuguuaagggcuucaacacacugagcuuugauuuaggcauuguuaucaguccaugugaauuaacccaucuaguccucugaaagcccuaugaggcaguuauuguucuaauuuuauagaugaggaaaugaagcauuaaggaggagguaaaguaccuucuguggcuggugaguugcuuggccccaagauaugaacccaggcuggcuugaguuuaacuacuacauugugccuuuccucuaaguagucuucugauuuccuuauuuccauucuuccgcccuuuucucuuuucagcaaccagagugaauuuaaagaauaaucuucuagcauauuuuaauguauucaguuagagucaggucuuuacuguggcuaaaggcccuacguggccuuguagcuugcuccucccuagaguuuucuacucuuugccuccucuuuguguauuccucgaacauacacaugcucucaucauagggcuuugguguugcuacucccucugccuggaauacucugcccuuauguauguguaaacuugauuuaucccuuuauuucagauccuguugaaucucacuuuucagagagacuuuccauaaccacuuggcccccauagaguaaaccuucuugcccuuuugcucucuuguauuuuucaucuuaccaucaacagcccugacauguucuacauauauauuacuaccacccucacuuaagggaauauguucauugagagcagaauugucucuuuuauucauuguucuguccucaguaauagaauuguacauaccugccauguaguugguacucaguaaauauguguugaaggaaggaguaguuugucuuuuaauuuugcuuauaauuauuuugcauaaagacauuauuaauugaauauuuuaaaguauauuuuauugugguuuuguggauucugucuuuaguguugugcuuuaaggccuuuaccuuguucaguaguuuauauagauauuugccauuuugugccaucauuaguuuuguucuagcauuuguucaguuaaaucuuaaauucuuuuggaaauucauucucuaggggaagauuggaaauuucgcucuuuaucaauuauuuugcuguuuaaaacaauuuuauugacuuaaaauuuuuaaaauugcuuuuaauaauuguauaguuuacuuuuuucuguauguuaaaaaugaaaaauucacauuugaaauucuuaauucaguagcaaauuuuuuuuaacuuauuaaagaauuuuuuggugcaguguuuuagucuuuggaggaauuugcuuuuacuguauaaguaagaauuuacucaggcaauuaguucuauuuuaucuagaugugcuauauuuauuaccuaaugaccuaggaaaaaauaagaguagauauuguuuguuaaaaaaaaaaaauccauguuuuuguuaaaacccuauuaccuuuguauuuugauagcaugcuuaauuuuucuucucaguauagcuuuuuggaagaguggcauuaaguuuugauuugccuaggauaguuuuagcuauauuuauugucuaguuguaauuacuaauagcaucuccauucacuuccaaaacauucugguugagaugaaaacuuacauagucaccuucacauuuggguguuguuuuaguguuugugacuucuacaaaacacuagugucauucuuaaaucuacuuuuguuacuagcuaucaugggauuuguuaaggagugauacugcggccuuaugaaguuuuugauauaaaauuaaaauacuacuuuaaaaauuucuguuacuguauugcuguuagaauaagaacuaaauuuuguaugauccuugaagaaaauaaguuauggaaaaauauguaaaucaguggauguuuuuguccuccaguagucuuauuugcuuauaggauuuaauucauguucuucauuaguuugcuccuaccgcagcugugguaaaaaaaaaaaaaaaaaauguauauguggaagguauccucaacuccuuucugcccucagucauuuaacaaauuugcacaauuguacagcacagauaaagaccauucucaguguuaaagaaaguuuuauuggacaauguugguuuaggcagagcaacuuuauacagaaaauuugaagaaauaaaaguuuggacaaauaauuccuguuuguaauuuuauguuuugagauaauuuuaaacuugcagaauuauaaaaacaguacaaagcucuccuacacaccuuucaccucacuuagccauguguagcauguuaccauaugugacucuuggugcauuggccaccauguuugugucccucaucccccuucacuuucaggccccucccuucuuccuuuuguucuuaugucugucucccucuuucccuccucuccccuuuuaaguuggaguaauuccccagacuuaguuuguuuuuuuccucacauuguuuugaagaauauuacacuaguuuuuagaaauaauuuuuuaugauuaaaaacugauucuagauauuugacagguuuguacgugugucugcuguuagaauauaaaacuagacucuaagcgugcucauuuuauuuuuccauugccuuugauaucauaugaauuuaguuauacagauggagcauccgaaaugcuugggaucaguaauguuucagauuuuggguuuuuuuggauuuuggaauauuugcauauauacaaugagauaucuuggggaugagaccgaauacuaaacacgaaauugauucaugugcacauagccugaagguaguuucauacaguauuuuaaauuuugugcacgaaacaaaguuuguguauauugaacuaucaaagggcaagggugucgacacagguaugcaguucuacacugcggcaucaugucagugcucaaaaugugucauuuugaagcguuuuguuuuuuuggauuaaggaugcucaaucugggcucaauuacacugguuucaacguguuuugcugaaaaacucuugcaguauuaaaaauaauucaggaauagugaugauugaacuuauuugacuucuauucguguuuaccuacauguaugacauaucuuggaccaauuuguaauauuuagauaggccacugauaaaccaaagcuaaucuagacacagcaagugaguuuuuuugacgauaaagagaugaagauagucauugacucaucacuuuugaggaauucuccuuugaugauaugauuaaauguaaaagaagaacauuuuaucaaguuggcaaggaagacuaggacacuuugugacauuaagugcuaggcuugauuaaauauaugcuaaaacgugaauuuguuuuguuagcaucacugacaguguacguuuaguuuaacauuuaauggaaauaauucaaccaaguccuuugucucccucauacaauguuuccaguaucuucuguguugucaauccuguccucaccuucuaaaaaaucaagcuaucuuuauuccuuucacauguucuacccacccgccacccccuagacuauucuuucuucuacuuuucaaaguuuguuaaauaguuuaguaaguauuuuuuauuuccuacucuggacuagacacaaaacugggagguucuugcucucauggagcauaauuuaggaagauagaagcuaaacaauuaaacgaacaaagguaauuucagauagggauaagugccaugaaaauuauaauaaugccaggcaauguaaguaugggcuggguggaaggcuuuuaacuaggagggccaaugaaggacucugaggaaguuacaucuaaacagagacucugaugggugguugacauggggaggucugcagacugaauguuucugggugaaguuagagcaaaagcucucaguugugaaugugaugggacuguccaaggaauagcaaagucagcaaggguggaaagugggaagagaagacguuuaugucccuguucauaugcuucucuauaggcuugguaaaauuuuauuggaaguaccaggaagucaguugaugguuuuaagcagagggaugauaugauauuuauuuuuagcaagaguugucuuuagcaauuagagacauguauguguguagggaguugggcaagaguugaaggaaggggauucauuaguuggcuguugcaguuguugaggcaagagaugguggcauggacugggaaucgucuucagauucauuuuauuuccaugcuguuagaauucuucaacauuugcuaaucuuggcugaauuuccaaagcacuuguucucuaaauauacaauguaauguuuauauuuauuguuugcuuuuguuuccuuacccaggcugucuucuucaggagggacuaauuuauauuuccaauuuccucaaugaaauguggacauaauuggugccuacuaaaaaaauuauguucuuccuacagaauuuuacaggaaauuucuuauuuucugacguagaggagcaucaaauaaugcauacacuuagaaauuuaaauaaacaacugaauaagacuuaaauuacagaauagagaaaaaaccaacaaauacuuuaugaauuaguuggagucgaaguuaaggaaaguugaauguaaaaccuaaaaguaaaauuaauugcuaagcuagaggcaauaugugagcauauuuugcaaagacuuugguggccauauuagguuuucaagccacgcccacacacauaacugacaauuuuugauacuuaugaaguacaaauucuccccuccaauguaugcgugauucuccauaguaacacccacauguagcuucugauagaaacccacaaaauaagaugaaaauaguuucucagucaaaugguuggaauauuuaguaauacuuggcaguauuuuuuauuuuguuaauaacaggugucauuuaauacaaugacuuuuaaauuauauauuaaaagaaauuuuuaaaaguuuuauggcaagcugugaaauacucagauggauaaugugaauuaaggcguguucuuuggccacucaaagugcuccccacccaacacuggcauggacugcucacuagguggccaaaagagauuucguuuauggauguguuuugaauguuuuaacauuaaaaaaaaaaaacccaaagcauuugaggcagagauuuuuuuagacaauaguuguuuaaugagcugcuuguacauacaagagaagagaaugggccugauugcucacaaucugauguuugaaaaguauuuuucuggaucuuaugcauuugcauaucuaauugcuauguaaucaaaacuaagugaacuguagcuacuugaaacucuaaaaugaaaggcaaucaucuuacggggaggagggagaaccccguuccaugcaagcuagccugaauauuagcauuauagucuucuuguguuuaauuauaggugucugacugagcaguaaauuuaugcuuguguaauaaagaaaugaaugugacccugaaacaccagcucagcuuuguuguaacugagcauuggcuuugagagaaguuagcauccauuguguauuuuggugauaagggauugugccagaauggcuguuaauuacguacuuuaugugauacagaaaguagugguucuacacuuucuuuccaccagugacagcacucaauuaaaacuuguauuaagcagcuauaaugccuuuauuuaucuguuuggaagacaugaggugaagaaaauuaacuuuauuuuuuccagcuguuuguuggcagcuuuguuuuugguaaauccuuugaggauaaaaaacuguuuguuauguguccuguaugcuuucauagacuaaauauuuuauuuuuugcugccucacaaaaagguuauuaagagauauuuuauauucuugccgggcauggugccucacaccuguaaucccagcacuuugggagguugagguggguggaucgcuugagcucaggaguucaagaccagacugggcaacacagcgaaaccccaucucuacaaaaaauacaaaaacuagccagacaugguggccugugccuguguucccaacuacuugggaggcugaggugggaggaucacuugagcuggggagguggagauagcaaugagcugagauugcaccacugcacuccaaccuggguuaaacagugagacccugucucaaaacaaaacaaaacaaacaaacaaacaaaaauauauauauauguauauucuuaauauugguuaaaugucauuuagaagccuuguagacuaguuaaagcuuuuuauauguuaacccauuugaaccuaauguugagucaguaagcacuucucgaugauuuaaacucugagagagcaaguucaaccuggaccaaaauuaagauaaagugaauguuuaucccccugccccccaccuaaaauuuuugugcuucauaaaggggcuccauuguagguugaaucuaagagaaaaauagugauuguauuuauggcaaacuugaaauuuauauuaucauuuugaacuuauuuuauacaugaacucacuaauuuccacaacuguuuauuuggugguauuccaugguauguauuugcugcauuuucuucauccacuuuacuguugauggucaccuuggugguuccaugucuuugcuguugucaguagugcugugaugaacaugcaaguugcaugugucuuuuugguagagugguuguuuucuuucggauguauacccaguaauaggauugcugggucaagugguaguucugaguucuuugagaaaucuccaaauucuuuuccacaguggcugaacuaauuuacauucccaccaacaguauauaaauguucucuuuuccucuuagccucaacagcaucuauguuuuuuugccuuuuucguaguagccauucugacuugugugagaugguaucuaauugugguuuuuauuugcauuucucugaugauaguaauguugagcaucuuuucauguuuguuggccccuuguauuuuuuuuuuuuuuuuuuuuuuugagaagacacuucucaaaagaaaugagaugaggcuggucucaaacucaugagcucaggcaauccaccugccucugccucccaaagugcuaggauuacaggcgugagccacugcgcccagcugcuaauuuuuguauauagugaaagaugugggucuaauuucauucuucugcauguggcuagccagcucucccagcaccauugauugaauauagggggucuuuuccccauugcuuuggcccacuuuuuaauggagucguuuuuuugcuuguugaauuguuuaaguuccuuauagauuccagauauuagacccuuguuggaugcguagccugugaauauuuucucccacucuguagguugucuguuuacuguccugauaguuucuuuugcugugcggaaacucuuuaguuuaauuaagucccacuugucaauuuuuguuuuuguugcauuugcuuuugaggguuuaguuauaaauucuuucccaaggcugauguccagaaugaugguuccuagguuuucuucuaggauucuuacaguuugaggucuuacauuuuaaucuuuaaucuguuuugagguuuuuuuuaaacuguuauuuuuuggagacagagucuugcucugucacucaggcuggagugcaguggcucgaucuuggcucacugcaacuuccgccuccuggguucaagcaagucuccuggcucagccuccugaguaccugggacuacaggcgcccaccaccacaccgggcuaauuuuuuuuuguauuuuaguagagaugggguuuuucaguguugcccaagcuggucucgaacucgugagcucaggcagucugccugccucugccucccaaagugcuaggauuacaggugugagcccccacccccagcgguuaauuuuuguauauugugaaauuugugggucuaauuuuauucuucuguguguggcuagccagcucucccagcaccauuuauugaaugggggaucuguuccccauugcuuauuucugucaaaauucagauggcuguagauguucugguucucuauucuguuccauuggucuuuaugucuguuuuuauaccaguaccauaauguuuugguuacuguagccuuguauuauaguuugaaguuggguaaugugauaccucuagguuuguuccuuuugcuuaggauugcuuuuccuauuugggcucuuuuuugguuacaugugaauuuuaaaauaguuuuuucuaauucugugauaagugauguugguaguuugauagaaauagcguucaaucuguagauuacuuugggcaguauugucauuuuaaugauacugauuuuuccaauccaugagcgugggauguuuuuucauuuguuugugucaucucugguuucuuuuagcaguguuuuguuuuguaguucuccuuacagagaucuuuuaacuucuuggcuggauguauuucuagguuuugagggugugaguuuggcugucguaaaugggaugcauuggcugucagcuugaauguuacaggaaugcaacugauuuuuguacauugguuuugauccugaaacuuuacugugaagucauuuaucaguuccaggagccuuuuggcagucuuuaguguucucuagguaucaaaucauauuguuagcaaagagagauaguuugacuucuuuugcuauuuggaugcuuuuucuuucuuucuuuuaccugguucaucugggugggacuugcuccucuucuuuuuaaaaauguuuauuagcucugaauccaagcauacuauuaaacccauuuuaaaaacacugcuuacacuucuuugccuucugaaaaccauguuuccuaauauuuugaggaaaaaauggguguccggcauuccagcagcuccagcucuagcuguagcuuaaagggccugagguacagcuugggcuguuacuucagaggacacaagccccaagccuugggagcuuccaugugguguugggcuugugggugcacagaacacaagaguugagcuuugagaaucuuugccuagauuucagagaaaguauggaaacgccuggauguccaggcagaagucugcugcaggggcggaccccucauggagaaccucugcuacggcagugcagaagggaaaugugagguuggaacccccacacagaguccccacugggucauggccuaauggagcuaugagaagagggccaccauccuccagaccccagaaaaguagauccacugacagcuugcacuaugugccuagaaaagcugcaggcacucauugucagcccaugaaagcagccgaggggacugaaccuugcagagccacggggacagugcugcccagugcugugggagcccaucccuugcaacaacguguccuggaugugaaacauggagucaaaggagauuuuggagcuuuaagaucuaaugacugccuacccggguuuuggacuugcauagggcuuguggccccuuuguuuuggccaauuucucccauuuggaaugggaacauuuacccaaugccuguacacccauucuaucuuggaaauaacuaacuuguuuuugauucuacaggcucaugggagaagggauuuuccuuuuuucagaugagacucagacuuugacuuuuggguuaaugcuggaaugaguuaagacuuuggggaaguaacuagugggaucuuauggaugguuaugaaaugugaaaaggacaugaaauuuuggaggggucaggggcggaauuacauggauuggcucugugucuccacccaaaucucuucuugaauuguaauucccauguguugagggagggaccuggugggaggugauuggaucauaggggugguuuuccccaugcuguucucgugauagugagugaguucucaugagaucuggugguuuaaaaaguguuuggcagauguguucccaccccgcccgccuccaucaccuugugaagaaggugcucuuuuccccuuccaccaugauuuuaagguuucugaggccucuccagccaugcagaacugugagucaauuaaacuacuuuuguuuauaaauuacccagucucaggugguaccuuuguagcagugugagagcuaauagagguaucagagagauuuucauuauucuugugagauuuucccaauugaauugacauuucaguuguuggucuguugaauaaugaaugcacuauaaaagugguuguuaaaauuaugauaagggaacaagaucagucaguaaaauccauguaugggaguuuuaugauuaagaauauuucuguauuuuguacaggacaucuguaaccacagaaaauugcauuguacaaaugaagaagaauacccuuuuacaucacaugauuugugauaucuggaaaaucucccaagcaccugguuucuggauuuuauuuagauuuuucaauguauuuucuaagucuuaggcaauauuuucagaaaaguuaguucuuuccuacuccuuugauccuauaacuuagccacaucauuacuuaagcacuuagucugcuauaguggauuacagaguucuuuaagaguuguaacucuuaucuuaaccacuauaaugugcauagugccuggcacauuguagacacuuaggaaugcuuaccaugacccuuaguauuguauauuugaguuaauugcuagaauuuuuaauaucuccuauugaauuuauuaauacuauuuucauacauaaguacaccccuuucaguguuguguuuuaagauuauauuacccacuucauuccucccaucccucacucucacccaccaauggcaacuuugauuaacauguuuguguauaguaauccuguggccacaagcacauagcuguaagcaaggacugaacuagaagaccaacuugauucugcgaugauuaaaggaaaaauggcuaggaaauugacuuugaacaugaguaaugggcauugaagccagucucacaagaguaaacgaugcuuugggugugcuguaucaccugugaauacagccuaaaaguuaugccugucaccaaggaaauguuucugguugcaggaggacuggagauaauacuguaacuagaacuagggccaagcugccaaauggccugaauacuggauuauugauauuucuauggaagaaugggcuuugaacugccaaaauaagaacuugaggguuucuguuuccgguaaugaaugaguaaauuucugucauacuuaauccccugcaauaagcaacucuaaaauaugcacgauaaaaaccagcuacuccaaggaacucuguaggaugaguguaagcagagucugaaauagaguugguccuugaaggaaggaaguuaguacacugaauacuaguuuuccuggcuuuuagccugaggcaaagcacauuagguggcacucauuccaacccagagaaaucucugcugauggagaaagauaaaaagaagggaaagaaaagagaacgggaauccccaaauuguagcugaccccaggauuauaugugcagaguagacauaagcaucucaucuaaagaugugaacuaagaccauaguuggcaccugagaaacaaagugugcagcccucaauugaaucaagauauugccuacuacaaaacaaaacgaaaacaaaaccagaaccagaaacaaaagaaaaaaauucgucaaaauaaucuagaaucaggauacaguuuaaaauuaagcucugaaaguaaaucauacucucaaaagaaaaucagcugauaccaaccauuacauuuuggaacuaagagacagauuuuuuguuuuuguuuuuuuaaauagcuguuaacuagucucauaaggacaaaauacagaaagacaguucuuacagagaaauagaagcaaaaaaaggaaccaauggaaaauuuaaaacugaaaaauagaauaucugaaauaaaaaauucacuagaugacauaacuguugaggaaagaguaugugaauuugaagaaagagcaauagaaauguuccauuguaaagaacaaagagaaaaaaaauugagagguaggaauggccugugaaguggucugacauauguauaauuggagucuuagaaaaagaggguaaauaagacugaaaaaaaauacuugaagaacuaauggcagaaaaaucucacaaauuugaugaaagacauaaauaugcaaauucaagaugcuuaagaaacagcaaguagaaugaacacaaggaagacuacacugaguuacaucagaggguaaaacugugaaaagccgaagauuauaaagaaccaaucaugaaagcagcaagaaaaaauuacacaccauauauaggggaacaaugauaugauuaauugcucacuucuuaucagaacaugguagagagccagaagagaguaaaauaucuuuuuuucuuuuucuuuucuuucuuucuuucuuucuuucuuucuuuuuuuuuuuuuuaugauggcguuucacucuuguugcccaggcuggagugcaguggugcaaucuuggcuuacugcaagcuccaccuccugagcucaagcaauuccccugccucagccucccaaguagcugggauuacagguaugugcuaccacacccagcuaauuuuuguauuuuaguagagaugggguuucaccauguugcccaggcuggucucaaacuccugaccucaggugauacacccacgucggccucccagagugcuaggauuacaggcaugagccaccgugcuugggcacuuuuaccuuuuuaaagauauuuuacuggccgggcacgguggcucacacuuguaaucccagcacuuugggaggcugaggugggugagucaccugaggucaggaguucgagaccagccuggccaacauggagaaaccccaacucuacuaaaaauugaaaaauuagcuggacgugguggcagguggcuguaauccuagcuucucaggaggcugagccacgagaaucacuugaauccgggaggcggaguugcagugagccaagauugugccacugcacuccagccugggugacagagugagacuccgucucagucagucagucaaucagucagucaaucaaucaaugguaaaaguaagaaauugccaacccugaauucuauaaccagugaaaauaucuuaaaaauaaaggugaaagaaagccauuuugaaaugaaagauaacagacagaacuaauugccagcagauaagcacaccagguaaugcuaaagggaauuuuacaggcuaaagagaaaugagagcagauggaaaguugauuacauagaaauuuuuacccugauacugguaaauaccuucauaaagaggaaaauaaccauuuuuuuugcuccuucccccuucuuaauuucuuuauauuacauaugaccauuuaauaaaggggggggggaauaguauuguccuguggaguuuuugauucuuguauguguacacguggacguaugugguuacagguuucuacauauuaugugaaacaguauaauauugauuguaaguaggccuugaaaaguuaaagauuuguauuguauccccuauagcaauaacugaaaaagcaaugccaaaagguauauguaaagagccuuuaaguauaacuuaaaaacugaaauggaauuauaaaauauauugaaauaauguauauauagauauauuguucaaaguccggaagggaagcuaaggaacaaaauacagaggcuacaaauagaaaaacaguaguaaaaaugguagauaaacaccuaaucauucaaaaauuccauuaaauagaaauggaagaaccacuucaauugaaugaaagagauugucagauugucaucauggauuaaaaauuaaaagcaaggcuggcugugguggcucaggccuguaauccuagcacuuuuggaggccaagaugggccaauugcccugagcucaggaguuugaaaccagucugggcaauauguugaaaccccaugucuacuaaaaauacaaaaaauuagcuggauguggugaugcgcauuuguaaugccagcuacucaggaggcugaggcaggagaaucgcuugaaccugggagguggagguugcagugagccaagaucgugccacugcacuccagccugggcagcagagcaagacucuaucucaaaauaauaauaauaauaauaauaauaauaauaauaauaauaauaaguaaacuaaaaagcaagccaagugcaguggcucaugcccauaaucccaacacuuugggaggccgaggcagguggaucacuugaggucaggaguuugagaccagccuggccaacuuagugaaacccugccucuacuuaaaaaauacaaaaauuauccaggcaugguggcgcaucccuauaaccccagcuacuugggaggcugaggcaggagaauugcuucaacucgggagguguggguugcagugagccaagauugugccacugcacuccagccugggugacagagccagacuuaucucaaaaaaauaaauguacaguuuacagagaaauacuagacacagguaaguugaaaauaaauagauugaaaagcauauuuuaagaaaacaguaaaagauugaagugacuauauuaauaucagguaaaauagauugcaacagaaaaauuuuguaucagguaauguggauucuucauaguaacaaaaguucaucaggaggacauaucaaucauaaguguauauuuauuuaaugcagaaugacuuaauacaugaaaacugacuaaaggcagaaauaguuccacaaucagauugagauuuuaauguaacucuuucagcaacuaauaaaaaaaaauuacucagaagauuugaaauuuauuauuagccauucuugaucauauugauguuuauuaaacguuauaucuuacagcuagagaauucucauucuuuucacaugcauaugguacauucaccaaaacagagcaugcugggcuuuguacaugcugggccauaagguacaaaggauuaagauuauauagaguaugaauuuugaccgcaguggaauuaaauuucaaguauuuggaaagugacacacuuuuuuguaaucaguuggucaagagaugucaaagggaaaucagaaaauauuuuggaccgagugauuguggaaaugcaagauaacaauuuaugagaugaagcuaaagcaguguuuggaggaaauuuauauauuuaauuauguuggaauaaaacuacaauuaucuaauuuccuaccuaauuaaacauuuaaagaaaacagcaagguaaacccaagguaauguaaaaaaaggaaauaauaauaaauucuugaaauagaauacggacaacuagagaaaaauaaugaaacuaaaaagaguucuuggaaaaguuaguuaagauaaagcucuaauuagacuaauccagaauaagagagaagacacuaauuaccaguauauuuaauaaaauaggagacaucacugucgaucauauggacauuaaaaggccuuuuaagagaauaucauaaacagcuuuaagccaguaaauuagacaacuuaguugaaaaaaauaaauucuuuggaaaacacaaauuauuacccaggagcaauagaaaauuuuaguaucccuauauugauuagagaagcugaauuugcaauuaaaaauuauuccaccaagacaaugugaagccuaaauggccacacuaauaaauuuuaucaaacuucaagaaagaaauauugugaaucuuauguaaagucuuccauuaagaaaaaaaaaugagaauacuucuuaacucauuuuauuauaacaaauugguaacuaccauuguuacugugauacuaaaauucaacaaagauaacagcaaaacaaagaaucaguauucuucauggauauagauguaaacauuuuaaacaaaauuugagcaaauuaaauuaacgauaaaaaaagaagauacugcauuaccaagagagguauauuuugagaaugcaaguuuaguuuuaacaucuugaaacuaaucagugcaguuaaucauaacaauagaauaaagguguaaaacuguauaauuauaucuaggagcaacagaaguauuugacaaaauucaauacacaaaaaugauaaagcuucccagcaaacuuagaaggaaacuuccucaguuugauaaauucgccuuaugaaaagacauaguaauauacucagcaguaaaauucucaguguguuccuccuaaggucacaaacaagccgaagauguuugauuuuacccugucuauuccaauuuguacuaaagguccuagcaagugcaauaaagcaguaaaacaaaauaaaaggcauacagaauggaaaagaagaagacuuucuuauuuuuuaauauagaaaguucuaaaguauauaaaaaggucauuccagcaagaagagaucaugauccuaagucucuguguaucaaguaacauagcuugaaaauauauaaagcaaaaacuaccagaacuaaaaguagaagcucagaaguccacagucauacuguucacacaacuccuaauaacugauaaagagacaaaaacucaguaagaauagagauggucugaacuacacaaguagcauacuucauuuaauuaucuaauuaucaaaaagaacauugcauccaacaaugacacuauuuacauuauuuuaaaguguacaugguacauauuguccaguugaccacgugcugguccauaaagcuucaggaaauuucagacaucugaaauuauucacaguauauucuuuaaucauaguggaaucgagcuggaaauuaaaaacuaagaguuggccauaaaggauguauguuuuaacuuaagcaucuggaaagaacaguagaguagauuaaaagcaaagaggaaaaauuaauaaauagaaaauguauugaaaauuauauaguaguccuuccuuauccacaguuuugcuuuucaugguuucaguuaccugugguacaguacaagaugcuucgagagaucacauucacacaacuuucauuacaguauauuguuauacucuauuuuauuguuguucaucucuuacugugcuucauuuauaaguuaaucuuuaucauaggcauguguuuauaggaaaaaacguaguguauauaguguuugguacuguccauggcuucaagcauccacugcaggucuuggaacauaucgcuuguagauaagaggaggacgacuauauugaugauuaacuaaaaugaaggaaguuucugugaaaauuuacaaaugagacaaacuuuguaaaacugauuaagaaaaaacaaguagaacuaaacuugauuguaauuauuuuauguaucaccaacuuggugauacauaaaauacacaaaacaaaaaagcagauuaauugacagagaacuugcaguucacagaguuuuuauuuguauaugaauaauaugaauaggcuuuuucuaaacuuauuucguccugucauuucauuguaucccaugguauacauuaaaagaaaaauguaagugaaauuaauuagugaaugccuaagacuuuuucgcagaguucaguaucaguuuuuagucauguuuuucacaacauacagcaaucuauacuaccaggaauguucgaugaugcagcauuuuuaaaagagugacuuacuauucuccucuagaauuucuucccaggccauuucaaguuuuugugcacauuguugucaagaaaugugaagcgccuaagauuuuuaucuuguaagauaagcuagcuugccaccacaguuucauggaugauggcagaagaccuaggacuucugaaucagaagccaugcuuuauuauuuacagcaaaaauaguagcagaguguuagcauacuugcacugaugcccugagcccuggugugcacaggguaaugcagaggccagacaacaccugcucuuggugggcuggauuucagaagaggagcccagggccaagguccccacaauucuugagcaagaagcagacaaggcaguccucuacccuugaccuccucaguugcauauguuacugcagaaacugcucagccagaggagauagauaacccuugcacucuggcacacucagugggaacauugagggcugcucagagcucacccaacagugguuagacaggaacaccuguggcuuacugcugccuagcuuauggcauuaaugagacacaucggguuucaaaaaaaccuuaaaauacuuuuuaagaaaugucuuagaauaggugacacacuguaaguaagugaaaucaagggccaaauuugaaauacuguauuuaaaaaaucauggaaaaugcaacaaacagcuuuagagcuauacauuugaaaacugauaauaauuuauuuaucuuaaagauauguauuuucaaaucuauauaguaaaaucuaguuagaaauccuaacuuuuuuucugguggaauuuaaugaauugauuacagaauucuuaagauaguaaaauugcccauugguaguugggacaguucuaaaagaaaaauggaggagugcuuucagagcauuuaauucuuaucaguuucauaauugucuguaugacugagggauaagcagguugaccaauggaauuagacuaagcuauuuuacucggauauguauguguguauuguggaaagaaagagguagauggagagaaauuuacaugagaagugggaagcgugaauuuaauaaaugauauuaggauaguugaauuugcauaugcaaaaauaaaucuuuugauggaucacaugcccaaaaaugaagagcaaaaaacucaaccacuagaagaaaacauaggagauacauuuaugacuucauuguaaagcaggauuacugacuagaaaacuuauaaaggaauaucaguagcuauaacuacauugaaauguauuuuaaaaauccuuuuuaugcaaaagacaccauaccccauuuaaaagacaagccacagagugggaguguauuugcaacaucuguaacaaaauguguauauuuagaauuuauuaaaaauucauucaaaaacaauuuuaaaagaucacaaauucaauuaaaaaugaacaaagugugugaacaggcaauucacagggcagaaaaccugaauuaaaaaugaacauuugaaaagaugcuuuaccuuauuaauacucaagcgaaugcaccuuuauauuuaaugagaauaauguaccauuugauguccucaauguuaucaaagcuaugucuaggauauggagaaauaugaacucccacacaagucaguguaaauagacacagacauauuggaaagcaauuuggcacugucaacuaauaguguguguuuuuuuuuaagaagguccuguuuguggaaauuucauuaugugucaguuucuuaagaaacucuugucacauguguuuuggaagaugggaaugaggauauucacugcaggauuguuuauaauaauaauaaauuggaaucaguauaaauggccauaaauggagagauggaaauauaaauugugguucuuuguguagcagaauauuuuggggcagucaaaaugaugaaauuugaucaaauacacuugauuuaacacauacuacaucuugauacuauaacguucaaaagaacaguuugaaauuauucuguauauuugauuagugauaaaaauauauugguguguuacaacaaaagggaaacuuacauauaaugauauggcgauaggucauucuauaugugaaguggaauuucaagugaucuuauuucuaguuuauuaaacuuucagaaagcacuuugaauauugaauauuugacuuuuucuggcauagguaauuagugacuguuuucuauuuaagauacaaaauaaguccagcaauugacauuugcuauguaaucaaagcuuuucacuuuuuauuuuuaucucaaaucggucaccucuuugugguauaagcugauuauuuaucucucaaaucugucaccucauugugauguaaucugauuauuuaucucucaaaucugucaccucauugugauauaaucugauuauuuuuaaagagaauaccuuuugaugggauaguaacuaaaugugguauucuaggauguuaagguaaauuaagauuaauauuuguuuuguggguccuucauuaaugucuuuccuuaggagugcaggcaauuuuuagaaaaucuaaaguacauauaugcacacaugacacucaacaacauacauacauuguaccccucagugucuaccuguugcuugcaacucaauuauggggccuuuuuugggaaaaauguagaguuucuaaagcuuauuuuauuuauuuauuuuuuugagacggagucuggcucugucgcccaggcuggagugcaguggcaugaucugggaucacugcaacuucugccucccaguuucaagcaguucuccugccucagccucccaaauagcugggacuauaggcgcacaccaccaugccccgcugaauuuuguauuuuuaguagagacaggguuucaccauguuggccaggauggucuugaucucuugaccucgugauccacccgccuuggccuccgaaagugcugggauuacaggcgugagccauugcgcccagccuaaaacuucauuuuaaauuaagcuugagggcuuuuauggucuuucaauauaccuuuaauaccuugaugacuuauuucaagaaagcuuuuuauuuuucuggucuuaacuauuuuccauauuuauuggauuaaucuguuuauuaaauaaaauauguuuucauacugaaaugaauacuacuugcguucuuacugguguagagguguaggcuagaguauuugacauucuggaauauauuuuaacuuacuuggcuuuaaaauacuccuuaucauacuauaacuguuuugaaacacauaucauaauguuagccucuuggguucaugccaugagcuauaauuaugguguuagugccauaaugggauguuauaaguuuuauuuuagaauuuuuaugaaggugaagcuuuaaagaaaagcuuaacaaguuucaaccagagaagcaguaggggacacacacacacacacacacucacucucucucucucucucucucuuucucucucucucucucucucuagcucucucuagcucucucugucucccuuauuaugaggaauuggcuuguauaaguucaugcugacuagucuagaguccacaaagcagauggguaaggaaggaagauccagagggcacuguuguaaacccaguugguguuuggaauaucugagcuuagaaaagaccaaagcccucuuuuaaagacuucuaauggaauaugucagguuaacccaggauaaucucccuguugauuaacuuaaauucaacugauuacuuuucuuaauuacaucugcagaauuucucacagcaguaucuagagugguuuuuuguuuuuuguuuugguuuugguuuuugacacagucucuagcucuuuuggcucaggcuggagugcaguggcuuaaucuugguucauugaaaccuccgucucccaggaucaagugauucuccugccucagccuccaaaguaacugggauuauaggcgagcaccaccacgucuggcuuagauuaguuuuuucuugaguagcugggagaagguauguguaugcuacuaaauggccacuguuuuccauuuauaguccaccucuugaaaaaauauacuuuauagaccaucccaacuggaaacauacaagaaaugaaauucuggaaacucuaguucagccuaguuaagcugacacacugcaaagguaucacaccggauaacuaacuuuuuucccuaaauagugucucucuuuauuuugucgauugauauuaaaggauauuuucauugaugagugagggauauaaauuuagguguuauuagaugauacacagcuauuucuagaagguuaagguaaaucugguaaccugguccuuuuuuggcuuguauuuagcuuauguuuaguaaauggguuuaccugccccugcccuacauauucuuugauuuccucccuggcaccaauuucauguguuuaguguacaaacuccuuuuaauauuuauugugaaggaaagugguaauucaggagguuuuugccaaaguaagauucuaguuuauuagaauuuguguaaucuagagagaugucugauucuuaucuuaaauggaaaaaagcuauagaagcuggcuagggaaaucuuguuuuucaggaaaaacucacauccacggaagguaguugaguucauuucuuuauuuccuuauucaacagacuucaaaaaaauuuuuccuuugugguaggcugugcgcuaaguguuugaauauccagucaaagauaagauacaaucaaugccugcccuuuuguagucaggauggacagauacaaauuuuaacuagaaggggccgagauaagcaaaauuggaaaucauguuuuacauagauacuguuuuuuguggguccauguucuuaguuuuuuccaguaauggguauaauugagaagagccacagacucauuucuaaaguagucauucaggcuucuugcauauaauuuucaacacucuuaaaaaccuuaugaacauuuuaaggaagagaguauuuuguaccuuuuugugaagaaggcuuuauuuuggcuguugauauuaaaaaauauuauauuucauugaugagcaagagauacaaauuuagguguuacuaacuguugucauuaaggucaaguuuuauacauguaaauaaauuguaguuuaugaacugcagacauagagguugagguuucauuuauucuguaguagauuguaguaacuacucuuucagcaugauuuacaaagaaaaucaaacuaacucaauuuauagauugcccuuuuccauagaaugucaauuuuguauuuuggcaagaauaccugugagguaagccuaggaggcacauaacaauucugccauuuccaacucuuccaaaauguaaauagguauuuagaguuacacaccuuguauggcuacaugaauuuauuuauagucuuuucuuuuuagaguagcauagcgacaaaaguagucacuggacuuucuguucagugugaagaucuguugguauguguucugcuuuauuaauaaauguagagagcugaacuagagaguugauauucauugaacaugauauauccucucccuuuccccaaucagauucauuucacugaauaaacaccugaguaugaagguuauuucaagaagugcugggcaggaauccuaaccuucaguagcacauaguacuaugaaaugaaaugauauguagacaugcagaguuccuuauaaacauaugucauuaauaagaacacaugaguaggacuguuggagaaauucaggacaaaagagcucuuaagacagcuugacaaaaggggaccucagagaucgugccagauuuccugugggccuuaaaaagagugggugugaugauauuuuuauguggcacaguggcgacagagaugaaauaaggagucagauuugaguucagguucugggccuucuauuuauggauugaaggacguaagacaaguuacuuuugcuguugaaauuuucacaugugaaaaauaaguuaauaucuaccauucaggcuuacuagauauuaaaaguauuauuuuuaguguucuuuaauacuauuuuagaauacaggcaguugauagauccugaggugucuauggucguuuucaaaaagauguuuucuccaauuauaaugauuacuauuaacauuuaaauugacccuugcucucauaauuaaccacaauaauuauuaaugauagcuuacuuuuuaagcauuauaguuauuuuauauaguuguuauauaaaguuuguuuaauaucucagaaaauguuuuucauugcauucacauuuuaguguugugaugaauggcauguuacaucuguuucuuaauuaaggggaagugggccaaagauauucugaaagaguagaguuacuuuuugucuuaggaaacauggcuuuaagcacuaguggacaaguaacguacccuuugaaaauacuuucuugucaccagugaaacauuuuagagcuguuaucaaagacugaagcaaacaauuuuugauucuauaguuauauggguugauaauagggagaggaauugaagaauuucaauuuagcaccaugucucugaaacuugaacauacuugaaaugauuuuuaaugaaggaauaaaaacauggauucucugaacuucuauuuuguauuucucugagagauuacuguuuucuuggcugauguaguugaauucuuagguguuugcaguaaaguauaagauaauaaaaugguuaacguuuaacaaacucaucauuauaacacuggauaauguauagaauauguaaaaaauggcauuuauuaaaaaaaucaugaguguaacagucuagguuuuagcuagcaagaaguucaggauuuuuuuuaaaauaguguuuggggaaauuauaaaugucgguugcauaauuguaauucaugaaggaagacauucauacagcuauuuuuuaccuguuuucaaaacuauagaaaaaaaaaggugguacgagauuguccuaagaauuauccuauuuuagcuugacuaccaccuauuagcuacaaggcuuugcaguggugcuguuagcuagguucauaugaccuauguccaaaucaugcuggcaacaucauugaagaaugauuuuuucaaugcuuucaaguuauuaacauauuugaauguacaugucagucuuacccaaaggaagugaaaauaauucaguaucuucaagaaaauggaaaaacugcauuauuuaauauacucugcugcauuaacuaucacuuuuuauaguuuugcuaaucaaauuaugaugaaggguuaugagaaauauaucacuuuuuauaguucucuuguuagccaaauuuuaaugaaagauuggaagaaaagucuaggauuauuauggguuuuggaugacagaggugauguaaguguaggagaaauguaugccuagaggaccuaaagucaccuaguuuuucuaaugacguaaaauuacccuugguuuuuuucugcugagaagaaugggugugugaaauacacguuaauacuuuggaauuuaagugaagaaagaacuccauuuaauacacuaagcauuuguaccaucuaguauuauauuuuuaaucugcaucagacauuaugucauccgaauaucagcccaugaguauagagguaugcucuucuuaguagcuauaccugcugccaccugacugugcacaaggagcaccaugcuuuggauccuucccuaugggaaucgcugggauguguuguagauaccugucuauauauuuuucaguugaaauuagaaggauaaucuuacagauauuuaaauguguuaaaccuuaaauguaacaaauauuuuagauuaacauauauagacuauuaacauuguguuugauucgcucuuauuacucuaaucuuaauucuagaacuuucaaagguugaaagucauuaccaagaaaaaaaucaugacaucacaaauaauuuggggcaggcaguuagauauauauuuuuugagacagaaacucacucugucgcccaggcuggagugcaguggcaugaucucggcucacugcaaccucugccuccuggguucaagcgauucuccugccucagccucccggguagcugggauuacaggcgcaugcuaccaugcccagcucauuuuuguacuuuuaguagacaggguuucaccauguuggccaggcuggucuugaacuccugaccucaagugauuugcccaccucagccucccaaagugcugggauuacaggugugagccaccaugccaggccuguauuuuuuaacccagagggaucauugauuaauugcuaauuuauuuuuuacucuggcuuugauuuugaggcuucuuaauugaggaagcgggaugugcuuaugcuugauuauguuaauauaaugacagaaaggacauccugcaguggaauuaaggggaaucccuguuagcugaaaagccauuuuuuaaggaagauacaggaaagaacagagauaggaguuacauaguaaaaguguuaaguauuaugaacuagucacugucuucaacauacuuucuuuaauucuugcaaccuuguaaccuuuacagaugagaaaauaagauuucaaaaaauaguuaacauuuugucauauaaccuugaucagucaacccucauaugugcuuuuauauaacacagugaacuuuggugucacucccucaauugcaaauaaauaguuacuagucuguaggcuccuugagagcuugcaugucuguucacuugccugucauaaaccuuguucacucacaggguguaguagaaacucaauuauuauuuauguauuuauuaaauaaauaaaugaauacgugagugaguugcucaagauuacaggggcacugaaauaagacuggcauuugagucuguguucuuucccccacucuguuuucuacccuugucugguuuuuagggguuauggaguguggggagaggccuuuuugugcguuuguuuuugaguaaccaguucuuuucauuuugucucuauucuccagugagcaaaugaaaauucaggguuuggagcaaacuuuuaacguucugauuaucagucagcaaauaugaguacuggauaaguguuuagcauugugguaagccccauggaauuauaaauuaugugccuguuuccuugccgagguucucaaaguucauuuaugccaacauagcucuuccauacacacauaaauacguauuccugaacaucgucauaaacuagggucauuauucuacacaguuguguuuuugucacugcuuuucagugaugugugcacgauuacaugaagacagcugugaauuaauauuuggggaguacgaacacugcagcuauccacggugccguuagguugaauaggacgucgcaaccuaccaacuacaaaugauggaaccuccuguuagucuuguaucuuaacauucccaggaugaaacaccuuuuauaacguaaugagcuaugugcuguuguucucuuacauuuuggaaauccuaauauauaacauuaggcugugaucuuuugcucgaugaggaaguaaggcagacuguauguggauccuucagcauaauucuuacuuugcuugugguuguagauuaugggacucugguucaguucuuuaguuuuguguuuuucauuuuaauuucacagaaggcagguaaaauacucucuuucaguguugccugacugaguuuuuaaaauaaaucuugaauuuuucagguauuuauuuucccuaacuaauguagaaaaauacacauguggaaugcacgagaaagcaccauauggcuuaggagcuuaguaaucauguaaucaguauauuuuauguuacuugcuauuuucaguuuauaaucuaggaauauuaagagacaauaauaaaugucuuuuaagugcuuacuauaugcaaaacauuuugguagauauuuuagggaagugguuucuuauauagaaggacaguuuagcauuuguuuaauaaaugcauaauuacagaaaccauggauuccauaguuccuuuuaaaugaguuuguaguauguuaauuaugauaguaugcauauauguugagaaacuaguauauuuguauuugacaugauuucauuuguagaauucagagcuacuuuguuuauacauaugugagacaaauacagaaauuaauauuuuaaaaacugaugaaaauaucauaaaagaugugcaaguucaaaucugggcagggcagaagagaaauagaaagcuacugguuguguaccaaacuuuucuuuuuagaugccuugugaauaauacaaaaaauuaaaaggagcagucuuugcuuucuagagcuuaccauuauguacacuggaauauuaaaguaugaucuuaaguaucauuuuagagccauaagauucgauggaagcaaaguggggcuuagggagaaugaauuuggauagaguaggguaguggaaaacaguuaaggaguagguaguauuugaacucauucuucaauuucauuaaguuuuuauaaauucccuuuacuauucguuguccauuuuguguacugcuugugacauacuaauagucacgguuuaucccacuuuccaggaaacuguaccggucguccuuuacguaucauuucuaauccaaaugcuucauggagggcaggguuaguguuuugaucagcugagcugucuuccagucugaaacccaaagauuacaguugugucuuuauuaagcuuuuucuuaaaaaauguauuuaaaaauaauuuuauuuucauguaaugguuaauauauuuuauuaacuaaguugguuaaaaaauaaauuaucuuaagcuacucuuuuuauucugaaaauacauuuccaauuuuauuuuucuaaauuauaaccgcuagucaugucauuuuauuuguuguucagucaucccuucccaguauuucuguuuaauuuucuuuuuuuuauuuuuugagauggaguuucguuucgcucuuguugcccaggcuggagugcaguggcgugaucuuggcucaccgcaaccuccaccuccgagguucaagcgauucuccugccucagccucccuaguagcuaggauuacagacaugugccaccaugcccggcuaauuuuguauuuuaguagagacgggguuucuccauguuggucaggcuggucuugaacucccgaccucaggugaucuaccugccccggccucccaaagugcuggaauuacaggcaugaaccaccacgcccggccuucuguuuauuuucuacgaucaucuauucuagauucuagccuguccauaccauauuuacauuaugguaauauuaauuucagagcucuuaaaugacggguacucguccaugugcuauccgaacacuaacauuuaaaacucauuguagcucugagauguaaguacuaucuuuaugucucuuuuguagaugaggaaacugaagcauagauaaauucaagcauuuugccuaacacuaaacagcuauuaagugguuaguaagugugguaucauaaauuccuuagaguaucagaaaaugaauauuaaacauucgcauuuuaaaaaucuuauuaacaauuguuuuguuuugaaucucugggauuuauaccuaaauaaaauucccucugaagaauggagcauuugcacagugaaccaugugcugccacucucaacaucaguacaugaaccuguuacugaccuuugcuugagacaggcuauaucuggauuuuucaaaacaucuuguuuccuuuuuuuuuuuuuuccuguucucucucucucucuccccucucuccucuuuucucucucuccucucucucucuucuuucuucuuucccucccuuccuuuccuuucuuucuugacggagucuuguucuugucacccaggcuggagugcaguggcacagucuugccucacugcagccucugccucccgaauucaagcaguucuccugccucagccuccugaguaccugggauuacaggcgccugccaccacaccuggcuaauuuuuguauuuuuaguagagaugggguuuugccgugucggccaggcuggucucaaacuucugaccucgugauccuccccccuccccgccucggccacccaaagugcugagauuacaggcgugagccaccacgcccggccaucuuguuucuuuuuauuguuuucaaugaaauaauuguaaucuugauuauguugacuuuuaaguauuguauuuagccuuucuucuuaauagguaguugucaggucgucaaaggcagacgagugucaucugaagucgguuuaacugaguacauugagucagguuucugcccauuaguuuaucucauuuuuaaaugagaaauaggugauuauaauaaugccuaccucuaagcuuauuaaaaggauuaaguuauuuuaugaauaucaaguacugaguguaaagcccuauauguuuuuuguuuguuuguuuuaguugauauugaccacacuaacuuuauuuuuguaucucaugcugugcucuaaggagcacuuauuagaaagucugugcugaaagauauggagaugagucugauuccauacuucuugaaacuuuuuaggaaucauacauaccagacugauuaugucaaaagaaaaaauaguagaaugggaguauucagggaacauccugucugguaggaccuggaagggguauauuugauugaaagaugauuauugaaacugggauuuugaugauuuaggaaggaaaauggguauaagguagaaaugucuuuuauuuauguauuuuccccugguauacuaucaguaaauauucaauugaguauuuuaaaacaucacauucuaaaacaauuauuucauuuuucugugccuugaauuguguaucuuagaugauggugagaauaacaccuaauguacaaaaucucacauaugaauuagugaaaggauucuuuuaaugcugugaggaaauauuuugugcuucagugggcaguaacgaauuuuaugugggugcuuguuagcaacaggagcucagcccaaaguuuccaguuuaaaaggauuucccaacaaucauuuauuucuaucaccacuauuuuuguuaaauauuugccagcuuuaaaguuguugggaaauaacaaaucacuugaugauuuuugucuuuuuaugggaaacuuuuuguacauauuuaauucacucuucucagccuuaacuauguuucaucaagaucauauucagcuuuucaacugaucuuguucagaauuguuucugcaugcuaaaagcagcucauaucuagagaaaucucacucauuuuggucaucguggggccagaauaguauuuuggcuaguauugggguuauauaaauuuaguuuagacauaaaguaauuaacaauuaaauuaguggaauuaauguaugaaaauuggaagacauaccuggcagucaauaaguacugugucuguaggagauagauguuacaguccuguuguuuuuaacuuggaaauuauuuggcaaaaaacaauaaaaguuauuugaauuuaggaacuuguuccuuugugccuaauuuaauaaguauuuguugaaugccugcugaaugacuuccuagaugaugauuucaacggacugaauauaaaauuauccuagucuucauacuuuauuagaaaauaauuugcuuugaaaguguaguuuuuguuggacucacauucaaguuuuuaaaaguuuuuugagggcugcuuuuauaacugagucagugaggaauuaaauugugugaaaucuacuuuaugcccaguuucucaaugaacauuucuuaaacuaaucuaagauuauaugcacaacuggagaugguaauaugucuaagcuuuaauauuugucuuaaaauguauauauucacaauacgccuguuauuggaaccuugguuuuugucagcauguaacacuuuugaauucuguuuggagggguuuuggcguaugaacuuucacauuaagagcacaguaggagcagaagucuugugcucauuugcuugacuacaaaugcauaauuaagagagucugucagcaggggugggacaaucaguauacucuaaugcuucauguuauagaaucccuuuguuguucaaacagauauuguaauuagagcauacuuuuaaacuucauagggcagcgauucauaaaguuuuucaaaaauccaaaacaaauacuuuguuucucaaauguugagauuauuuuuuuacuuuguaguuuuacaucacuguauacagugguuucaaaaaugaaauggaaguuguuuuauugaaaagugguaaaauuuaguuauaaacaaugguguuaauuaguccuagcuuaguaauaauguuggaaauacgcauuguauauuaagaucuaauuuuaguuuuaacaaccucaccuauucgaaacuuuaaagacuagaggaauuuuauguaagugaaauagcuacagauuuauccuuuuuguauauauguaucauuguaauuugauaggugagucucucauuuagggagaaagcauuuuucucccuaggugcaagagaucuguuauaccagauguuuuucucccaguucuugacauuauucuggaugugacuuacucagaaauucauuuauggagaaagaauacuugacaugaaguuaggagauaggacaaauauagaaagacaaaaccaaaucuacuaaauaaucucaucuaccccuuuaucugccuucaaaguccccgccagcucuaaauucugugaggacaagaugugcuuagaauucuacacaaaaauauuuaaagguaaaaagguaaaguaaaaaauucuagagauuccacuauucuguguuccguuucugguuuuucacuauuuuaugaugcuguuuuaggucaauuucucauguaggugauauguugugcuaggaauuaguuguugagggugcaugcuguaaaguugcucuggcuagguaugguagcuuggugguacaacacuuacugccugacuugacuaaaucauguuaaauguugguaagacugauagucccagguucauguaacuuaugaggauugaaugaggugauguauuuauauugcuuagcauuguccuuggcaagcaguguuugauaaaagcuuaguugccaucaucauuuucauuuuuaaguuugcuuaucaucaccuaagucuaauuuaucucaccauaguauacuugucaagaauacagaccaugauaaucauuaauaauugugacuaucugcucugccaucaagugugaaugaauuauaaaguugcuuagcaagcuacuauauuugaauuugcuguauaaauagagcuauuuuccauuuccauggaaccucuguuguuauugcacccuaccuuaaaagauggaagguuagugguuuugagcucugaacauauuuauacauauaguauuuauauguaauuugccugugcugucacuuugcuguuauauugagauagaacuuuagucuugcaguuuuaaaaaauacuuuugacccaucuugucuccuguucuucugauacaucaaaacaagguagcauugagguuuuagaguaaaagauaagcagacugauggguugugaaaaccagaccucauaagaguuauuguagaaaaucugggagaauugacuagaaguaagagaacaagaaauggaguaaaaauugucauguacaccugguaacuaaggagaaagaaagaagccgucccagaaaccaagauacaggagcaaaggugaauauaugagggauuaacuaaacaggcacaguaaucauuaguacagcagagcacugugggaaagcugcagcauauucaugcacaguuugauauuugauuugaaugaugcucuucaaucauaaaaguucaauuauucaauucaguaaauacuuguuuagagccagauauguguaaaaucaauguguacauacugucaagaguaugaaaaucagugagaugauucugauauucaacuuggagcaaacuuucuaauagcuagaaaaagacaaugcacagauaacuaaguuacuauauaauacagaaaaaaaagaaauaaaaguaaauauuaaagaaagggaaaggaggcauucuagacauaggcgauagauagcuuccauaaacuuaugggugucaaaauccauguuuggggaauggccaguaauacagcauggaguaaaucugagccuaucgugggaagugaaugaacacggcacuucagauuaguguggauagaugugaaugggugcaugugcagcagccagucucugucaaagcacaaguaagccaugacuguguuucagagauuuccuacaaagccucaaauucuaaaaauccacgcugauucagaaaauucauucaggaugaguaauagcugagacauuaauuguggacagauuugcagcagggagguaugaaccccaguuuggacauguggaguucagacugcuuuagagauugaaguauacauuucuaguuggcaguugaauuuggaggucuagaaaucagggggcaguacugugcuggaaaauguaaauuugggauuauauugaugcaaaacuguguucuucuauguugcugaagauuuaguagcacauauauuaugaaaugauauugcaaaugguaacuguaaaacagacauuauaguagucaugagcuauuuuuuuccacaucaguaucucagcuauuaaccccugaaagauuguuugaaacauaauuguaaaaagaaacgaaugccucguagaacacaguuucuaauaaauacagcauuuuuggugugcguccauaucaucaucccuccugucugcuuauuucaaccuuuucuuuguccugauguauuuaagugagaaaauggguuuugugaguggauucuuacuauggauauuuuaaguucagaaguaaccauccuauaauugcaucuauccuuaaugacuaaaagaggaccuuuugggguguguuuuauugauuucucuauaaaauuugccaaucccagauugccuuuauaaucugcuuaagaaacagaaugagaucacagggagaaauaguauuuguauuaaauaauuacuaagcugcaaacucacugaaggaauuuaacucuucuugagcuggaauggacuacaguagaaugaauauggcuucauggcuucugcguagcaugaccucaaagccuuuuuuugugugacauuugauaugcacauggaugaaagauuuucugaggccugauguggaaaacggguuggucggucucucucuucacacugcacccccuccaaaacacuaaaagaggugcuuuuaguguuuacuuucaauugcuacauuguuugauuuugaaguguccgcuucauuuauuccuuguggugaaaacucaguggguccuuuucaucuggaaccucagaucccucaguuuugcgaaaaauauauaacauugaugauuuuucucccucugcuuucuuuuucuuuauauugguaguuggacaucgucauuucaguuucugaaccucuuggacuaguccucuaauauuauacaguucugcaccauuuuuuuuuaucucugucuuuugcuacuuggagaguuccucaguuugucuuccaaccuucuaucaaauuuuucaucuuugcucucauguuuuuaguugcaggaguuucuauuuguauucaaaauuuuuaaauagagcauucuuguuucagcauuguagcgucuuuuauuaacucucugaagggucaguuguucaagucuccuguccccaagaugugggccuggguucccuugcucugcauuuggagcaggggagauggccggccagcccagcugucagaguggaaguuacccugucaacuguucuccuaaugcaguuugagcaaguguuuuacuuccuuucagaaucaguuucuggucuacugcugggaauuagggagugcuugauagcuagccauuuguggacaggggauaugggaauugaacugcuuuuuaaugagaguucaucuaguccugcaaucucagccccacccucaccccuguuuucacugcugcccauuuccucaguauuuuugggguggauugcaaggaaauaaguuucuuucuuaacuagagucagguaaauuuuaaguuaaccaucugcuuucuagauucuuaauuuuuaaaugguuuccuuucccauuuucuuacuucuuacgaguuuggacauuuuauuuauuuauuuauaauagacacagggucugacuguuccccaggcuggccuugaacuccugggcucaagcagucuuccugccucggcccccccaaagugcugggauuacaggcaugagccacugugcccggcugaguuuguacauuuuaaacucugcaguguuguagaagaauuuuuggugggaguguaaguacaccauuccauuaauuucuccaucuuugaaaauuuuugcuccuucaauuguuuuuaaaaguguaagcaaaaauguugauuuugaagcaaacaggguagauguagcuuucuccuauuuuuauauuuuuaacuaucauuuaaguuguugaauuaguaagaguacgcauuggccaaguguuuuacaccuuaaaaauguauucuugcaauaaagcaaaauggcaaauaauacugcaacuuuguuucuaucaugaaaauaauuauuccuuuuaaauucucuggcuuuucuccauguauagagguuucugcggcaagucaaauuuuaguuuuuauucuuaagcuuuucucaaaaauauuugauuauaaauguuccucaguuuucauuguauuaguaucuauaugcauuaguguuugacacacacacauagagcuuuuaaugucuuugucuauuuauaauaacaucuguaucacuucuagauugguuugagugaauugauugggggggagguggucucauguauugcauuuuucuugcugcuuugcaugcccguuaauuucuaauuguaugccagacuuuuaccuuguuggguggauauuuuuauauuccuauaaauaucuuugagcuuuguccugggacacaguuaaguuaguuggaaauaauuuaaggcauuuggucuuacuuuuaaaauguauuuaguuguacuggaacaaugcuuagauuagguuuaguuuuuuccuaccacugaggcaagaccuuucugugucccuuacccguggggaauccuucaagucuuucagucuuguucuuuucuagagccaggcacuuugaccuggaauccuuuugggugguuccuucccuggccucuggaauuuucucucaaguaugcaacgaucaggguucagcugaauauuugaguggcagcucucccaggacucucugagcuuuggcugccucgguuucccuggacucuugcuuagucuccucauggaguugucuggagacucucaagccagugagugggggcaguuauaggcucaccucaguuguucccaacucugugucauuuguccuuaguugucugauguccaguggcuugaaacuuguugauacguuuugccaguuuuuugguuguuucagcaggaaggugaaucugguuccuguuacuauaucuugccuggaaacagaagucccucauauauaugcguuuagucaaauaggugcacuuuuaggcccaccaaauaauaccagacuaguagcuuuuguaggucucucuccaaaaaaaaaaagauaaauaaaaaauacaaauuuuggugagaaaauacuguuagcauucuugaacauaacaauugaaaucuggauaacaaaacuaauuuuucuugccacaguuagagauauuaauacauauuuuauuucuugccauacagauaacccugagguuuccaguuucuugauucauugacuccuugguuucccacuuaguuugcaugguguacccuagucaaaaagaaauauuucagaguucuguuuauuaaauauuuacucuacaaacaacuuugaaacagacuauacauuuuauuuguaaauaaccacauuuuuacuaauagcauuuguauuuucuugggugcuguucaaauucucaaacuuuggaaucagauuuuuguacugccacccucuuuucuuguuccacauugauuuuuguauguucuugauuuuuauuacagcaaccgcuaacaaccuagcuuuguaaagauaugacaucaucaaaaagaauguaaugugaccuuauguugaaacagucagauauucugagcuggugguucacacagugucggacagaugguaccccuguaaaaugcugugcugacucagaguucacucuuuggaaauacauagauggcccagcauaggauugugucugauuuuuuuuuucccuguauccccuuacaauauguggaugcauuuucauccuaaagauguguugauuaaaaauaaagcagaagcauuuacuguuaaaauuuauuuuuagccuuauuggcuaagcucaaucaugugaauuguugcagaaagcaguuuuauuaugccugcuuuauuuucuuuuacuggaaucuaacaauuagguaaauaguaacuucuaaaauaaagguccaaaaacagcagauauuuauuguuugucugugguaccuugcugugugccaggugcauuuauauuuaccauuuauauacuacuuauauauucuuauuuuauuuaaaaacacuuucucuaaaacuuaaaacagcgauucugaaauuaugccaacucuacuuaaccucccuguagcuuaaccagguuuucaacauggggauauuucuuacuagaagacauuaaggaaaugaaauauagauauucucuaugaaacuaguauuuaugacuugauauaauuaaagaguagccuuacaguuaauuuuaagguauggucugaugggaauguagauaaaacuauuuucauaauuaccgcaugaaauacuuaaaacaagugguagucaucuuacacaauaacaucuauaugcaaaauaccuuuucuaaugcugaauacaaccaaugucauuaaaagcaguuguaaugaaguggaaagaucacugaauuagagaaugaaaacuuugauucaguuccuaaauugacagccuguuagcugugugacauugagaggugacccccuuaaccuugaugaccuucuguuuacuuauaaguaaaaugcagaaauaaugacauguuucucaaaguguuuuucaugguaauguaaggacaguaucagauguauguuguaugauacuacauacaugaugaugauguaugcuucuagugcauaggagcacgcuuggggcugaucuuuagcaucugguucugugccugguagauaguaagugcucaguaaauacuuguuggauuaauuaucauuugacccaguagucucacauucaaucaaacuuugaggacccagaaaaauaauucaaagacuugugccaucauagcaaaauaaugcaaacauagcugaaauaauugacaacagguuaguauuaugaaagaugugcucucucuuuaaagagaauaauuuuaaucauguacucuguaaauuuuuuaggaggagcaaaauagaggcaagcccaauugggagcaucuaaaugaagauuuacauguacuaaucacuguggaagaugcucagaacagagcagaaaucaaauugaagagagcaguugaagaagugaagaaauuauugguaccugcaguaaguaauaauuuccagaccuuagauuugggccucguccuuuuuugucaguuuauuuuaaauuaucguaauguuuauaaggaauagguuauugguuguuagaaauuuuauuuaagcauaaaauuaaaaacaccugacugauacuucuaacauaauaaaaacauaaaguucguauuuagggguccuuagauagacauuaaaagggguuuuggagggugacgucgcguaagaaauuauccagaugcuuuuguguuaucaguucuccuuccuucccgguuucucuuuccccaucucuucccccaucucuucccucugccccccuuccuuggguuggcuccuuauuguuucuuaacccuuuaauauuuuuagaaauaauaauuguacuacucccagaguauaauuuuuuuuuuuuuaacgggaaaugaaaaauaaauuacugguuuucugggccauuaauuuuuuuuucuuauauuaguaaaacuauauggaaauguggacccuaauuugcuauuggaaaaacuagggcugggugcgguggcucaugccuguaaucccagcacuuugggaggcugaggcgguuggaucaccugaggucaggaguuugagcccagccuggccaacauggugaaaccccaucucuacuaaaaauacaaaaaauaagucgggcgugauggcaggcaccuguaaucccagcuacuugggaggcugaggcaugagaaucgccugagccugggaggcagagguugcagugagcugagauugcgccacuauacuccagccugggugacagagugagacccugucucaaaaaagaaaagaaaaaacuaggaauacuguuaguauuguguccaacaaaaagcauuggcauuuacauaaaugaguuaugguuccugcugcuuuuuauuucccagauagccuauucuuuauuacccugauaguuuauucaacaaguaaacucacaaaucauaaacauuucccauuaacuugaugaaauuaauuccuuggaauaaaagaguuuuauguaaauucuguugguagauuuuauuuuuuuuaaugaucagguuaaauauaaacuaaaaucuauauuuguguacuauuaaaccauggaaucuuucucauuuuccuuaauugugugguauugaaaaacuguauagaaaaggagauuuucgaaaguauacugggcaauuagugucaugaucagaaaaaguuauuuaacaucgacuuuuacugcuuuaauaacauuuucuuuucuguagcuuacuuuauuguaagaauacgguauauaacauauaaaacauacaaaauauauguugaucaacugucaggcuuccagacgacagugggcuauucgucacauuuugggagaguugaaaguuacacaaggaucuuugaugcagucugugucccugacaaccgagcccucccuuguuguuugaggaucaacuggauauuguuagcgucuuuuaaauuuucuauuuacccagucaccuguaaucucuugucuugcuuaccauuuuuauuucuaguguuuagcauagagcccagcacauagcaauaacauaguaaauugaaaaauaaaugauugaaucuugucauaagguaaaaucaguuccuucaucuucacuauagaaaugcauaaaauaacugaauuuuccugaagcaucaaaugauuuggguuuuuacuuaaauaaaugugggagacagaauacaucauauuuuugagaacucacuuccugguuuuugaaucccagcuuugugacuuuuaacugucuucauuuucucaucuaugagauuggaacauggccaagcauggugacucaugccuauaaucccaacacuuugggaugcuguggugggaggaucauuugaggucaggaguucgagaccagccugggcaacauagcaagaccccuuuauacaaaaaauuuaaaaaguagcugggccugguggcacaugccuauagucccagcuacuugggaggcuaauguggaaggaucgcugaggccaagaaguugagcuauaugauagcaccacuguacgccagccugggugacagaauaagacccugucccuuaggggggaaaagaaaguuuggagcauuauaaaccccuauacuucuugugaagauuaaaugagaugauacauggagaauacuuagcauaauaccuagcacauacaugcucuguaaaaguuuguuguuucuauacaaaugcugaugauaaaaugaaugcauuaauucaaguuggaaaaaauguacagaaauaguuccuugccaacucacuguuacuguuuucagagaaguugcuuugacuucuaugaaaaugcaacauaaggcucauuaguuuaucauugccuaaauauuuucaaaggcagauauuuuaucuugaaauguaccuuuaauagugagguucauaauuuuguauuguugacaguuugaauagcagaugcccaguuacccuguagauuaacagaaauugccagucuuuugguuuggaauucucaguuacgcuuuucuuguucguucaguauucuguuggguaguuuagacuuuuuaacuuguuaccaugguccugaaaaacaccaaguucagucagguuacuuccugucucucucagauuugcuuaccuuccuucauccccauugccuuuaccuacuucaaaccaugcuuguaucagaaccccacaacugguauuccuucuucuggggccucucaaacccaucuuuacuuugcagucuauuguuaccuuucccugcuuaaagauuuuuuaguggugccuucuuacucugagaaaagaauacaaaacuccuuagcauggccuacaaauuucuucaugauuugccauagcuuaccuuucagguuucauuuuuuuacuuuuugcuauaccuaaagcacacagucauauguacacaucuuccucauccugccacagauugaguuguucuguauuuauuugaauuucuuaaagcuucagucuucucaccucugggccuuguaguucauucaacaaauguuaauugaaugccugcuguagguuagacacugugacagcuguggaggauacaccaauaauaaauaaaagcugaccagcaaagugccugccauccugaaguuuaccuucugauugggguuggauuacugacaaugaggaaaacaaauauaggcaauauucucuuuuaacaaagugcugcgaagaaaaauaaagcagaauaagggaauagagaacugggauuagggaacugcuauuuuauaugggcugguaagagaaggugacaucuaagaaaaaaccuuagcgaaaagugcgguggcccugaggcauguucagagaguauccagggguccagugaggagcuuaaugagccggcugaagagcaguaggaggugaggucgguggggaugggaggcacuggcagauccaaggccuguaggcaugggaaggagauuggguuuuaguccgagaugagaagcuauuuauuggaggaauuugaggaaaggagggacaaaguguaauuuguauuucaaaggaucauuccagcugcuggccugagaauagacuuugagggcaguggggaaagcagagauuccaauaaggaagucuuugcaguucaaguuagagauuaaagugauuuggaguaguguugaaggugcugagaaguaguaagaucauggauuuuuuugaagguaaaacugcuaggaauuuugacagacuuggugugauaugauaugugauaacuucaagcaauuggaguugucauuuauuuacacuuuuacaagagcagguuugggaggaaagucaaaaaauuggauuugaaaguauaaaaguugauagcaaauguugaaugggcauuugguuauaacaggaauuaggugagaaaguggaaccuagaauuauguagaauuaagaauugucauuagaucaaaagcuuuuugagccaugagacuggauguaucaucaagaaauuggauauaaguauagaagaaaaauugaggacuaaaccuggggugcuucaccauguaacaggaagagagggaggauccagcaagggagagcaaagcggggagccccuggauuuggaggagagcugugagccaguccuggaagucaugcuuagaccuuuuagguaggaagaggaaaucaucagccauuggauuuggcaaguaguggucauuggugaccuugccagucaauuuguuuuuuuuggaacagugggguuaaaagugucacuggcauggguucaagaaagaauggcacaagaggaaaaagaaccgggauuuuuucccucuucaagauuuuauuauguuuauaaauaauccuuccuguacuuuggccucucgguucuuuuauauugcuucaccugcagugaucgugucuuccacuccaccucagucauccagccucaugguaguuccuuagaccuuuccauuaccccuaaaggugccuuccuaaauaggcagcggcagaauguccaguagugaacauuucccuucucuucaguggaagagaugcugcaugaauuuggcagaguuaauuaacuugugcauauauacuugaaggguaagucucuugaaguagaauuacuagguuaaaggguaagugcauuuuaaauuuuauuauuuuauucauguuaaaauuucuaaguugccuuccagaaaauuuguaccaauuuacuguccugccaguauugcaggaaaaugccuauuucucaacacacacucaaacccuggauauuaucaaacuuugaucuuugcuuuuucuaauaggcuuuuuuuuaaaagcccuuuaauuucaaaaaugugaguaaaaucucuugguucuuauaacuauuuguuauuuaggucaguuuuuauauuaaggagcuuugugauacuuacguaacaugagauacuuuuguaauguaagaacuuuaauguucacaucuugaacuguuuuuuuuuuaaaugggaaauauuccauuuacauuaucauauaaagaaugaauaaguucuuuuuuuuuggaaagauagaguaaguucuuuuuuagaaagacaaagaguuuuguguauuuuaaucauuuugugcccauuuuguuagguguuguauagcaaaaaacaucuaguccaggcuugaggguccuagcaggguggggaguagggaggggcagacuuuuugcuuaauauaaacuuucauaaggaaauguaauaaguauuuuguguuuuuccaucugcagaaaagacuaauaaaucugauuaaagauuguacuuccuucucuuugugaugcaguucuaauuuuuaaaauaauuuugaagauuguaauauuucaucaguuugcauaacuuuacauguaacuaaauguuuaguaaaucaguucaaaucuuuucaauucguauuuggguuucaaaacaaucugguagacuucuuuguuuuuuaccaacaagcgugcaaacucagagaagcuugagcauuauaagggcaauuauacuuguuucuuuucagagaacaguucaguauuguaauuauacugcaaaaguaauaaggguuuugagauaaucacacaccauuuauuaguagaaucaaauaauauuuuaccuggagaacauguuuacucugaaaaugacaccaguuuaguuucagauguuucuuugauuuugaugaucaguuuacuuuauuccuuuuuguuuccuggugacaaaacaugaaauaacuaggcaggaguuguuucucaaguuauauguagguuuuuaucuagucuaaauugguugacuucaaauaucuacuuuuuuuuucuuccugauccaaucuaguucuagaguuuuaucaauuuuaucaaccguuuucuaaguaucagcuuuugguuuuguugauuuuucucaauuuuuuuucuguuuuauugauaucugcuuuuacaucuuuauucuacuaagguuuaguuuuacuuggggacauuuuaaagguagaucagugauuugagaccugucuuuuguacuucugagacuuuucuuuuaaggacauacauuccucucugaguaauguuuuagcuguauccaacaaauaauauuaugcugcguuuuuauuaucauucagugcaaaaguuuuuuccaauuuucuuuguaauuucuucuuugagccguguuuuauuuccaaauguuuccaaauauuugagacuuuucuguuuaucauacuguagauuucuaauuuguuaugcucaguauguauuugauaagaugguagucuuuuuuaaucuaauaacuuuuugcuagcccagcauauggucuguuuugaugaauguuucacauacacuuaaaagaaugugaauucugcaguaguugcguguauauucuguauuguuuauagaugaagauaguugaaagcacucagaucuucuccuaugucuacccuuuuuuuuuuuuuccuuuucucuaguuuugucuguuacugaaagagguguguaaaaaucuccauucauucauuguaaagauauacacaccaguguguucuugauggcacugaaagggcaaaagaauuugguguacacauguacaugcaugcauaucuauguauguaauccgucuauuauagcuuauacaaccuguaugaacaugguuuggcaucauuaaaaaguuuuacucuauuucauuucauaugauaguaacuuuuuccuucuuuuaauuuugaggucuuuauuuuuuucuccccaaauaccaguuauuucaugcagcaucuuuucuauaaagauaguaccaagcaguauggccuacuugccuuagagagacuuuguaaagguaguaauuauuuuaauuauguggacaugaaaggcgcauacauguuccuccuuccucuuuuugcauuuuauguguuuaacuauguaugggcugguuacuugcaacugcaugucauuugcaaguucaauuugugaucccaaaaggcaccauaccaggagagaguacuucuguuccuucccuacaaaauguacccuguuugcuagucaugauuuugucaauauagguuuuuauuuacaaggaauaguagcccccccaaaaaaugaaauuauauaacauuacuaaaaaauaauauauauaaaacugucucuccacacaggagcacacauuaugggaaugcuucucagguaucagauaccauccuuccuccuuccguuaauccucauucaucuaguuggaaaguaauacaugauauuucuuagucaagacuuuauauggauacauauucuaugaucuuuugugaucuucucagaagagaccuaaaacacacaagaauggugaaauuggaggaauauuaugcuggauuaugcugauauuaagauugagaaaguagagaugagggauccuguaucuuguuuucacuauaauuuucccacaguuuuaauaggaaguggggagguaaaagguuuccauuggggagauagaguacuaagcuugaaagggcuagacuguaauacagaaauuaagugauuucaggcaacugaaguucauugauguugucucauaaguuaaaacagacuuuggcacacaauaugccugcagaccuagacauuucauaaaguguugaaauaacaggucuuuuucuuuauggugaguaaaauuguguguuuguuuucucuguauguuuacuuuauagguauuugagaacuugaauacagaucaguuuuuaacauauagcugaucucuuuauauacauggaggucaguacuauaaaaguaaaugaucuaauacaugacgacaaauuuccaccugcggguuuugaaauuuaaaguugucaucaggauuauuaugacauuugaaaauauucaucaagacaaaaguaauuuuaauucauuuucaaaaaacuacauguuauagaaauuuaggauaauaggcaucuguuacaaaaugcacuuuuuaaaaguuugcauuuuguguuccccaaagguucuuuucugucugccauaugcauuugacucauaauuaacugaguauuaauuauaaccugaaaauguuaagaguuaaugaaugagaagguaacagacaucaugaccauagagaugugguaauuuuaucuuugauuuaguucuuuaaccaaauuguuaaugaguugaugguacugcauuuauuuaguccuugaucaaauauugaucauugaaauuugugguauuguuggccuccuuuucauuuuauugggagagaaggagagguauuaaaacauauauuaaaagacaucuagagguaauguacuggcuccuugauagagcuguaaugggaaagaacaucucucauguaaagaaagguguuguuacugauuucuaccuugcagagccauuuuaaucugaaugggaaaucugucuggggacccagagugugguaauuagcagucucuucagagugucagagcagaauuaccauuguaaugguuuagcugcaggauaaaaggauugaauuugggacugccugucugccaaccuaaaugaguugccaugggaauuuucaaaugugagaggcguuuacuuaaagcuuuuuggcggguuugaauaaacucauaaauuguagguuugaaagaaggcaguccuugcuuucucucauauaggcaaaacuguauagaaggcugauagcuucuuaaauucuuaaugagaaugaguugauccauguucccaugcaggccaucagcuuauucaggcuuguuuuuucacuaaguaugguacaaugaagcacauuugaggaaagacauuuuguuccaagucucuagaggaaaaaagugacaacucuagauauaaauuuccuaucuuaauuuaaauauauuuucagauaaugcuauuauacugauucuuuguuuugcuuuaacaaacguuaaccagauacugacuuuaauuuuacucagugcauguaauaaauacauauuuuuaucuuugucauaguuuuucucacaaaguaagaacauuuaaagcccuuuuggaaaauaaauaagauacuuagguuuauaaacuggauuauucagguugcacguaacuacaaccugcauauacauggguuccgcacccauggauucaaccaaugaggaaauuccacagaguuucaaagagagcaaaauuuaaauuugcauccuucaagcacuacauugaauccacaugaaugaagugauaugugggcguugcauuagguauuauaaauaaucuagagaugauuuaaaguagacuggagcaugugcguagguuauaugcaaauacuaugccauuuuauaucauggacuugagcauucauggguuuugguaucuguagauuuugguguucuggaaccaguuccccgcagauaaugagggacaacuguacuuucagagagagcuucagcucuccccugucucucaaaagaauuaaauuuugguguaaugacuuuuuagugagaaaauguuccugcaaaugucuaaggugaugaacaucacuuacacuuugcgugcccucacucauccucaagauaucaguaauaguaguucuuacauuggugguuuguaucugcccuucagaaaaacacccgaaguacaauuuaagccaaaaauuuugagacuguaaaauacuuuuaacaaaauaaacauggucuuuuuggaggucuuaacauugucaagccauuaggguacaguuucauuaagcaaauaauaauuugguuguuacuaacccuaguggccugaaaauguggaugcgucuuucaaaaauguuucaccagggaaauguggguauuuugaggagagaacaguuguucaauucaggugagaaagaguaaaauuuuuuaagguacaauacauuuuuuguuuauauauuaaucuuuacuggucaguauguaaucacacaucaguauaaucugauuaaaauccuauagcucuaagauaacuguugaaccauuaauaaaacuugagucauggacagauaauguccuaaaaucucauuuaaguguagaauacaaagacccauguaguccuuaccagagaucucuguaauuucugcagagcuccuuggaaucacagccaucaccuuugugugcuguguguaagguacucucauggguaugugcugcuuugggaaaaaugauggcggagaaaagcacugcagaaauuuaaaugugcugauuuucuuuccugugaagagggacaauucuaaguaaaauccaguucuauaucagggucauaauuuuuauauucuaucuccacauuuuagguguguggcuuauucugcauuaggacaacaggcacauuguccuaacuagaauuuucacaaauaauuaaaaguaccauuugauucgggugacauuccauacagacagauuaagaaguuugccaagguauagguuuuaagacuucccucaacaucauaccauaauuaucuaaaucauugagcagcuauauaaaucuuugcuuaccgucuguccagccguaauguugccuggcagugacuguggcuucuuaaacacaacagagggcuuuuccuuaaacuuggauguuuaguuugaucaggcuccuuggugauaaaaaaauaugucuuguuucugggaacugaacaagcuuucccaaacagagacucuguaugaauaacauccuccucuugauucuuguaaggauucguugaggaaccgcuucuuucaacacaagguuuuguucagguugacaaaagguuuagacaucuuguaauucuaaauuuuaggcguugcaaauguaaaaaaaagggacccugggcauagaauaauagggccuaggauauauuuauuaaauuaaauauuuauacccuaggaaauauuuuugcauuuguaaaggaaguccuuuuacuuuaacuuuguauuccuugcaccccucagaauuugcauauuuaguuuguaacacuuuauaauugcuuguaccuauuaauuuaaauauuaauguaaacuauuuuauaauugguauaaauauauaauuauauauuuuauauaauuauauaaaauauuaauauuuaugucccauaaacuucucauugguugggauaaugcauuuuaguguuugggguuuuuuaaaaauuucuuuauuaaauguaugauauucuacacagauacuguaaaauuaauuucaauacauauuuuuaaauauuuauuagaaaaauaggcgagugauuucucaguguauuuucuuuaguucaauuauuuucauacaucacuuuaauuuguuugcaugcccuucugaugguggguaaguagcaucauguuccuuauauauaggcaaaguauuuguaaucauucacuuuauaguagggugcauugaacuugaauuaguaaaaacauuaagaaaaucacaugucccuuacuauauuuaaugugccuguguuuuaacucauauuuaauuuuucuuuaccacauuucagauguuucaguguuuugauauuuuuaaguaaaauuauuaggaguaaccauugugacauuuuaauaguauauuaaaugauucagaaaucacaugucccuuacuauauuuacuuugcuuguauuuuaacucauauuuaauuuuucuuuacuacauuucaaauguuuuaguguuuugauauuuauaaguaaaauuaagauaguaaccauugugacauuuuaauaguauauuaaaagauucaaauaagcauuuuaguauuaagauuauuucagguaagcuuuugguagcucauuauagcuuuauuuuugguuguauuuuuaauaacuauuuuggaaaauuugaaagugacuauuaaauuauccugcuuauucaucacaaggcuccuuuaugggaauuaacucugaaaccauauugccaaauuauauaaauaaguagauguguuuuguuuuuuaauucucuuaacguuuaaaaccuuuguggagaaaaacuuaaucuuuaauguauaaauaaaauauaagaguauuuaucaaaguaucuuuaguuaugccuucaaacugacauggccucagcuuauuuuuaguaaccuucuuuguagaauauaauauuucugagaaaguuagcuaauuuaggaauuagcuuacuuugugacaguaauuuaugaauucuccugucaauuuaaauaaaaauacuuugauuuuuuaauuuagcauuuguggaauuauacuugggaauauuucuuucaagcguugaacgacugacaaaagaaauucaucucacaaacuucuauugaaaaacugcaguuuacaaggcuagaaaacaagacuucauuauauacagagacuuagauuucauaauguaaaugagaauagaacaaaauuacuguguucuuaauugcuuuuuugaucacuugaugucugcucuucagaacugucaugcucucacuagaauuaaaguauuucauuuccaauuuguucuuccuggacagucuguucuguaaccaugccuccaguuaccacugcagugcugauuguuuuucagcgugcuucuaaucuggaauuccaaaucaaccagccauucaacaccuccaugcgggugccacauaggcaucucauacauaacauuuugaaaacuaaaaucacauucuuccuugcccuccccguaucacaauucuucccuuguuuucucuguagaaugauacuuguugccuaggacucauccaccuuccuuccaccuuuuucucuccugcccuggcuccuucccaucuauaucaucaccaaguucugucugauucuaccuccaaauagcacauaucuuuucuccaucuccacagauggaguaggucuguuacccauggugcucccuccuauccauuuucuacuugaggccaaaacuaucuuuuuaauauauagaaaugucaucacacuccuuguuguagguuuucagugacuuucuaucaccccaugguaaaaauguauggcauucauagcuuaucuucaucuaacaugugccuacuuuuccaacuuuguuucaugucauuccuccuuuacacuuacacccacacauauuaaauaacucacaguuuucagaacacuguuuguuuacguaguguauuuuggcgaucuccagaaagaacuccgugauuuguauucuguacuaauauuauaguagaaugcauugucuaugauagugguguagaauuauuagaacugaauguuuguuuguuuguuuauccccuugccccugacugggcauuucagugacaugcaugaagucuguuucaucuuaguaucucucccucacugccuugcacauacauagaaagugaucaguguuuguugaauuaaugauugaauauuaguccuuuaacaaagcacuuguuguuugcuuuucauaguaaaaauggaaccuaaaaacacauucauguaaaaucuuccacaagucacuuaccccuuuuugccucauuuuuuaaaucaccucauuagguugcucuguucuaaaucaauuaauaucuauauaugugugauggucauacacauacguaagccuacccaaaacuauuaaauuuuacacuuuaaacagguaaauauugugguauauaaauuauggcaguaaaacuguuuuuuaaaagauuguaauagaacauggucaguuugguaaggaacugaaagaagguaugugugaccagagugcagagugagagagauugaggugagguacccagugaguagaccuagcauguuugaggauauugaucuuaucugaagaggacugggcacuacugaagaguuuuaagaagugagccagguuuauuuucauuuugucaauaucacucuggcuacgaggugagagaacaucuuaaugggccagaguggaugugugaaaggagacccggaaggugacaguugaguuagaacugggcaaaauaagcaguuauuuaagugguaauauagacuggauguggugaauggugauugacuagaagguaucguuuguaacuccagaauucugacuuguauaacuggauggauagugcuguauucacuguaauuauagaauaugguugcugacuggguaauuuauaaagaaaagagguuuaauugacucauaguuccacauggcuggggaggccuuaggcaacuuacaaucauggcggaaggcaucucuucacagggcggcaggaaagagaaugagugccgagcgaagaagauuugaccagagaaaugugggaggagaggccagagagguugaggggggggacaugagguuggugaugaugaaauuugagcagagccaaugucucauuuuccuuagcaguccuggaggggauaugcaggaaguauggacaggaaaggguaggaaaaggcuugugaacaucccagagaaaguguucuccugcacuccagugcugugaauaacuuaagacucaguaaaagaccaacagcuagaaaacuuacuuccugaaaacacugcgcugggcaugguggcucaugccuguaauccuagcacuuugggaggcugaggcgggcggaucucuugaggccaggaguuugauaccagccugggcaacauagugaauccccaucuuuacgaaaaauacaaaaaauuaguugggcauggugacgcacacauguaaucucagcuacuccgaaagcugaggcacaagaaucauuugaacccaggagguggagguugcagugagccgagaucgugccacugcacuccagccugggugacacagugagaacuuguuucaaaaaaacaaacaaaacaaaaacauacuacaugguguucuuuacuugucugugguuuuuaaaugaacauauauuaguaugcaauuguaguaauguuucacuuuguuauucucuaccucuuaaagaaaaaauuaccuucuuuuacaaucuaacacacuacuuuuuuaacagguguuuuaagcaucuguuuguauuuguugaacaaauauuucuuaacauuguauauaccaggaaccuaauuguauacuuuucagaguuaaacuaugcaaucuguucuucaguaaaugaagcuuugaccgugcagucaaauccauuaaaaguucuuccaugggaaauuaggagaguuucaaacucacagugucuuaguuugauuucuguuccuuauaacaauaccugaaacuggguaauuaauaaagaaaaggaauuuauuucuuuguuauggaggcugggaagucuaaggucaaaggguggcaucugugagagccuucuugcugguggggacucugcaguguccuggggcagcgcaggcacuacaugguaaggggguaagugagcuaguguguucgcccaggucugucuuccucaucuuaugaagccaccaguucucuuccuguaauaauccauuaauccacuaauccauugagggacugauggcagagcucucaugauccacguugaggauuaaguuucaacaugaguuuuggaggggacauuuaaaccauagcacauaguaacaaagcuacuuuuucuuacaggaauuucaguaaucagagauuuggggggaagcuauguggcuauuauuauaaaacugaguucuaacagggcaaauccagaguugaauuacuucuaacucugguaccacagcaguugccuuuuuuucaccacuaacaaacuuucuuaaauauacguacgaaauauuuaaagcaccagccaccccaacaaagagcugcuuauggcugggcgugguggcugacgccuguaaucccaacaguuugggaggcugaggcagguggaucaccuggucaggagaucgagaccauccuggcuaacacagugaaaccccaucucuacuaaaaauacaaaaaauuagccgggcaugguggugggcgccuguagucccagcuacucagagaggcugaggcaggagaauggcgugaacccaggaggcggagcuugcagugagccaagaucgugucacugcacuucugccugggcgacagagcaagacucugucucacaaaaaaaaaaaaaagcugcuucuguuggaggacaggggcaucgaucaaauuuuaaccaauaauggccagccaaugugaauguuaucuaauucauugauuccugauuccauuucuuaugaaaacuaguauguuagaaaaauaccagugcuugcauaucugugugcauaaggauauaggaaaacacaaaaucaguuucuccuacuauacucucacaacaccgagugcuucugugaucuauggucaucaaaauuuguagggauuccuccucaccaccagcagccagucaguucugacaccagauuccucagcagacaccagcuggguguccuccgauuuaauccuguucugacgcuguccaccuggagauagccuuaggucccacagguugagggcuccaguuccacaagaugucucccacuucaggcaccagucacaaguaguaggugguagcccauacuucuuccuuaccuuacuuuauucuagcuuagccuaacucugagguucaagauuuuagucaguaauuuguguugaagauaucauuagacaucugaugaaacaacaaagaaaaagaagaugggcagcaaccaaaauuaauuaccuccucugguguuaccaccaugacuacaucugaaaauaguuuggguauaagugaaaguagcagucaugacauaaaauuguuuuaaaugccagguaguuuucuaccgcuacucuucuuugagguugucaagguugugcuugauagcuuagaaaucucaugaauaucuccuggugaaaagcauuuacuuugaggagucagagucacuuugaaaaguacuucauuacugugaugaauacauuacacagcauuaccuuggaagucuuguaagagcaguuggagugaauuaacaauuuaaucacauaucuucauggguaaguuuaauacucacaguuaacucccuaaaauuguaugcaacauuuuuugcuuacacaguugacuuuugaccauaguagggauuaggggaaccacccccacgugcaguugaaaauccacguauaauuuugacuccccaaaaaugcagcuccuaauaaccugcuguugacaggaagcauuacugguaacaguugaucaacacauauuuuguauguuauguauauuauauacuguauucuuacaauaaaauaagcuacagaaaagaaaauguuauuaagaaaaucagaaggaagauaaaauauauuugcuauugaagcagaaguggaucaucauaaaguucguucguucuuuuuuuuuuuuuuuuuuuuuugacagagacuagcucuguugccuaggccggagugcagugacaagauuucagcucacugcaagcuccaccucccggguucaugccauucuccugccucagccucccaaguagcugggacuacaggugcccgccaccacgccuggcuaauuuuuuguauuuuuugacuagagacaggguuucaccguguuagccaggauggucucgaucuccugaccucaugaucuaccuaccucggccucccgaagugcugggauuacaggcgugagccaccgugcccagccucauaaaguucuuuauccuaaucaucuucauacugaguaagcggaggaggaggagggguuggucuugcuguuucagggcuggcaggggcagaaaaaugucuguauaaaaguggaccugcaugguucaagcccauccauauuguuggaagguucagcggcguacucauauauguuuucuagagaaggaaucuauaguuaccguaagauucuuaaagcuguugugauuauuucccuaggccuuuucauuuggucuuccaccgcagccugugcaaacucccaucauaaucccaguugcacaucauuuaucuugcuuuaccuuucuaucucagugcucauucugaauaugaaugaguuuaauauauuuucacuuucagaacuuuuugucaggcaaucauuacaacaucuuuuagguucugcccaccucuaagccuccucaccaccacucccgccacaguggguauacuuuucuuaguuuuugccucucugucccaccucucaaaacuaagagauuuuuagauagucauaauuuucagguucuuuuuuuuuuuuaauuuuuauuuauuuauuuauuuauuuauuuauuuauuuauuuauuuauuuauuuauuuuuugagauggaguuucacucuuguugccuaggcuggagugcaauggcacgaucucggcucacugcaaccugcaccuccuggguucaagcgauucuccugccucagccucccaaguagcuaggauuacaggcgugcaccaccauugccagcuaauuuuguauuuuuaguagacauaggguuucaccauguuggucaggcaagccucaaacuccugaccucaagugauccacccaccuggccucccaaagugcugagauuacaggcaugagccaccaugcccagcucagguuccuauuuuuuaucuucuuuuguagaacaaggcucuauuaaacucccaauugguauuuauaugucccaccuuccagcccaaccauaucaucuaauaauauccgucuaaaauaacaaucaacuuuggagguguuuuuuuuuuaaucuauaaauugauguggcucuacuaaugcuaguauguagccggaguugugaaucauauaaauccuucagaaguuuaucaugccuguuaagauuacuauuacuauuaauaaaaucacagauuguaucguauuuagcauuagaagaaguaaguacuuauuauugagacuuggcuuuuguuuuucugagauuguuacuuuucaguggaucuguuuauaccuuguugaagagaggcagaacauauuguccuaagguacaaaucuuuguuaguuuuauauaguuuuaauggaggaggagcaucauauuuguguguguuugaguguuuuaagcuuuucugguuaaauaaagugccugacacuuucccucuaccuugcuuuauguguggaaaguuguugauugguuacacagguauugagaacugaaaaaggagaaagacaggcuguaauacagauuuagagacugcaaaaaaagcaucuuuuaccccagggcuggaauaaaagagaagaaagccuguguaaugaugaaaccaagacccuggcuuggugucucucagcuacuucaagaaccucaggagcucagaggggagaacccuagcuggcugcuucuggugugcauggagggaaggggcugcacgaugagacugguucuagaggugcugggaaagaagcauggagccaggagacagcugccucuggcaagugcauagcugaaaggagcgcacaugggaaagagaacaucucuuucccucauccagcucuucagggucggcugcuuuacacccacacuaugccucaguucugagaaccucacagaaaaccggcuggcaaagaaguaguaguuguagagcccuacacuuaagcauuggaaagcauauggcaguucaguuuggaacuuaguaacugccacaucaucuuggagaaaaacucaagaaauaugaaagcauauuuuucuaccagcuguauaggauaaguuggaauaaguugaucaaccagaugaauauucagcuguguaccugacaucuccacuuagguguuuaagauaaguauuucagauguaaccuuucaagagagaacuucugauuccauauuccucaauuuuuaucucauuacauggagccaccgucuacuuuauugcuuaaaucaagaaccuaaacaacauuguucaauuucuccuuuucccuuacccucuguguccaacugaucaucaugccuugucagguuaacauaacucuuuucaucucuguuacaaccucuaccccaguccaguucauccucucuguugccuggacaauguuaaagcucaugaccuaucucaguaaucacgcuggcgcccccagcaguccauccacaaaauagcacagugaggcuuuaaagacaaauccuuuuuugucacuucccucucauaaaccccuuuguuuaagucaaucaaauuaucugucaucuucugucugccaaagcugucggagcagaucaaggugguaauuggcaucaaaauucuucauaaaauguggucacucaucauuuuuucuuuucucugauauuuguuauucuucaauuaaauuagucauguauuuuuuuguuuggaaaaccuuuucuacccauuauuucaaauuuauagaaaacuaauucauuuuuuaaaauauguugagcacauucauuuuugcaaggcuuuggggguuacaaggaacauggguuuauugguuauugguuaguuuauggauacaauucaugauaaauuucuuuaaaaaucaaaaaauagaaaaacugagauagcacauggcuauauaugauugaucaccccaaaaauaagcagcaugaauuuauaaaagcaagaccaguaugcgugagaguucuuagaaaagccugcacucaggagaaucgcuugaaccagggaguuggagguugcagugagccaagaucacgccacagcacugaagccuagcgacagagcgaaacuccagcucaaaaaaaaaaaaaaaaaaaaagccugcacucugagagaaaacgaugaucuguguuauugaggaacacauaggaugcuuccaauaggagccuaacuuggagaggaaaguaccaggucuacucggggauuguggacagaugauuuugacuaaugcaaaacauuugcaagcaagguugcucauguaaacuguucaaugcccugaaugcuggagaauuugggccuuugugauaggcagugguucgaauuauuuuuuuaguugacauaguuuuaaugauuuggaaauacacauuuguuucagcucucuggugauuacuuuguuguaguuuuuuuuuaaaaguauauagaucuaaaaauacuaaauaaacaugauuuucuuacuuucuaacauguggucugaugaauucaaaagauacuuccacuuaaaggcaucauaagacuggagaagguauaauguaaugguuaaacaugaggacuuugaaucagguauucuggguuggaagccagguuugcaaugugaacuuuuguggcuuuggauaagcugccuacccugccugagccucagggauaaugcacugccaauaccacacauuuguuaggaagcguaaaugauuggauaaugaagaucuagugucuaagucuagaaaaguugaacaauguauaaauuacauuaaacgugaccuguuuguauccuuuuaacauagcuguuaaacauaguugaugauggcugggcacaguggcucacgccuguagucccagcacuuugggaggccgaggcggguagaucaccugaggucaggaguucgagaccagccugaccaacauggugaaaccgcaucucuacuaaauacaaaaaauuagcugggcguagugacauaugccuguaaucccagcuacuugggaggcugaggcaggagaaucccaggaggcgaaguugcagugagcugagauugcaccauugcacuccagccugggcaacaaaagcaaaauuccaccucaaaaaaaaaaaaaaaaaaaaacaacaaacaacagaaaaggcauaguugaugacauaucuauaucuuaauaugcauaaauuaaaauauauauauuuauacauacccauaauuggucauccuuaauugcaagccuccagaaguucagaaaacuguguuuauaguugcuucaccccacuuagugugaguauuuuucuguuuguuacggacuggauuaugggcguaucccccagacucugcuggguguuauagaaucugugguguauuaucuuucuauaaaucugaaaaacucugaaauucucaaggcacuuccccgauaccacagguuuuagcuauuagcaggaguguguucuauuuuugagcuuuuacauuucaaaaguaaagacauucuuuguugugcuuuaauaaucuuuccauaauauuuuccauacaaauacaagggaaauauucaucugcccuaugacccagcaacucuacucauagguauuuauccaagauaaaugaaaacuuauauuugcaaggaagccuuauaugagaauuuucagaguggcucuguucacauauccaaaaaguggaaacaaucaaaugucuguagcagaagaauagauaaauaacauacuacucagccauuaaaacagaugaacuacagcgacaugcagcaauauggaugagucugacagcugucauacugagggaaagaaauugaacacaaaauauuauauaugccuucauuauccgaaaaucuagucuaggcaaguuaaaucagauggaugguuagggcuugagguacaaggagacuuucuggguuuguggaaauguccugugucuucaauggaguacuauuuagccauaaaaaagaauaagauccugucauuugcaacaacauggaugaaacuggaggucauuauguuaagugaaauaagucaggcacagaaagaaucuucacauguucucacuuuuuugugggagcuaaaaaaauuaagucaauugaacuuauggagauagaguguggagcgaugguuccagaggcugggaagagugguugggagggcacagugggaaugguugacggguacgauaauauaguuagaaugaguaagaucuaguguucaauagcacaacagggugacuacagucaacaauaauuuaucguacauuuaagaauaauuggauuguuuauaauacaaagaaaggauaaaugcuugaguugauggguacuccauuuacccugaugugauuaauaugcauuauaugccuguaucaaaauaucacauguacuuuauauauacauacaccuacugugugcccacaaaaacuuaaaaaaaaaaaaagaaauaucgugacuggauauugcacuuaagaucuugggaguccacugcaugugaauuuugcuuccauuuuuuaaaugauucuugaauauagggcaaauacuuaggaaaccagaagcuaugagauugcggauaaucacuugaguucaguauuacaaaauaugauuuuaaugacccauuuuacaaauguaaaaguuaguguucugucucuguagaguugcucauucccgaucaagguucugcaggauacuuugugaacuaucuggaguugacauguacaacuucaggaugcccuguuugaucaguuguaauuuuugagaaaaaaagaggucagaaaaacuggucugaagacuggcucauagaagcucuagagccucuagacuguagaagaaacuuaguuuucucaucugaacuuauauuugaaaaagaggugauauauaccuucaacaguguuuaggcagguacguacuaccaaaucucauugucaaaaccaggacaguaacauugaaauaaccacuucgaugugaaaguaauucuauaauuaacccuguugucucuucuuuuuuuuucuuuuucuuuuuuuuuuuuuuugagacagucucgcccuguugccuaggcuggagugcaacggcgcgaugucgacucacugcaaccuccgccuuccaaguucaagcgauucucuuuccucagccuccuaaguagcugggauuacaggcaccugccaccacgcccagcuaauuuuuguauuuuuaguagagacagaguuucaccauguuggccaggcuggucucgaacuccuaaucuucaugaucugcccaccucagccucccaaaguguugggauuacaggcgugagccaccacacccggccagugaacccuguugucucuuaagacacacaagaucaugcccugugaauacagaguggaggggaguggucaggacaugagggugaagcccauccuggacugagaccaccuagaaucaaauuccagcucugccaacuaaauccugugcauuucugggaggcauuaguguacccugccaaaauguggcugugaucugguguaacauaccaucaccuccagcaacaccauauggcagacuacaccaggaucuccuccuaugccacucuuauuuuuauucucuuagggugaucucuccuguuuucauuauccugcacccugcacauuacacaagugugcacacacagugguaaucacacacauuucuuccaucuuuuuucucugugguuuucucccuuguuugacacuccauugccaaauaaugaauagcuauuuugcuauccaaaaggagcaguucagugccaacauguuuucaagcaccugcccuucugcaggaaacucgucuuucgucuuuauuuccucuuuguuggaaguaaauuugcccucuuauuugcugacauuuucaaacuuguaccacuucuuucucgcuaugguagaugacuggagguaaaccuacugcucuucuuuuucuuuuuuuauguagaguauaauuuauaauacuuuugguauuccauuuuuauauauaaauuuaaauuugaaacuuuugauaaguuuuaauuuucaaaugacuaguuuuuagcaaauaaguugaaguuuuauuauaauggauuugauucuucuuuuccaauaguagcuuacuuauuucguuuuuaacaaauaauuucugugucuuucuaagaucauacuuacuuuuuguucaucuuuguacaaguugauaggagucaaauucuacaggcaugccaguauccacucccuguaaucuucugcaaaguagguuuuuaaaaaguuggcaguagcacaucaaaacauugucuuuauguuucacucauauuuuucuuuaauucuugugauuuacuaaaagcucacugaacaguucuguuuacuauauauuauaguauaccauucaccauuguaaugccaaaaacagaauuuugugugucauuacagcuauaauagaaaggagcacugagaagccuguguccuggucguccuucccguuuuaugaaucagagaggaacaagacuaugucagaaaauuguugcauuguguuacuuucauuguaaauaucacaaagucauguaaaguuacugggauucgaugauacauaaaaguggggggcaguuaguucuaucucuacacagacuuugauagauggacccucaucuacugcuugcuuugacuguggcuaaaguuuauguuggacugagacauuugggauuuggaaauaaaguuaaagacuucucauaccagucacuuauaaguucuaguaaguaacuuggggguggccgugggaacaugggguuaggcagugguaacaaagaaauaagcccuauucucauggagcuuacuuugggaguggugauacucaacagacuguaauuugaaguagaagcaauuaacuuugucgauagguucuuggagauacaacuuuaaacaaaaugaguauauugcagccucuuuuuucaucaauguuauaaugaaaccauguugaaagcaguggcauuauuugaggaccugcugucugucguuucacuuaaaguuaguuuuaaagaauguauugaccacauuaagugaggaucuacuguaaucuagggauggccccuggagaaggaagguagcauuuagguugaaguuuguggggauggggauagguaggauuuggaaagagagaggggcagagagugcgcaggggagcacuuaggauggaggaagugggaauaugcacagagaugaaugguggagagcaaucugguuugacuuaagauguuacuuacauacguguguaaaguaguagguuaaugggcuuaacuugagaggauauuuugggaccagauuauaggcaacuaaaguuuuuuauauuuuuagauaguaagaaaccaugaaaguguuuugagacagaauguugagaaacaugaugaaaauugugauuugggcaauuaaucuggccuuuguguagagauugauuggagaacagacaccauuagcaacauguuuuaguaguuugggugcuaugccaaaaacaacuggaacaguaaauggaaagagugggaccaauucaagguaaaugggguggccaaacauuuugaugauuagagacuauccugauuuagguuugaagcaugguuauuauuagugcccauuuuugcuuuuaaaaguuuucugcuuuggacaauaaaucauauggugacccuaaagauagauugcuguagcauugauagcacuugcuaauuagauugaaaggagacagggauggugguguaagagagcagaauauacgguuuuuuagaaguuauuauuucacugaguuuucauauuuugaagaauuaagcauaaaauuuccuuaccuaaauucuguaaucaaaucuuguauguuuaaaauuauuugugugcacaugugcacgcgcguguguguauguguguguuuaacgaacacauuugaguuuuggaauauucagcaaaaugauaguugcuggcugggugcaguggcucacacuuguaaacuuagcacuuugggaggcugaagcaggaggaucacuugaagccaggaguuugagaccagccugggcuacaaaacgagaccuugucucuacaaaaaauaaaaaaaauuagccaggcaugguggcgcgugccucuagucgcagcuacuucggaggcugagguaggaggauggcucgaaccuaggaauucaagguggcugugagcuaggaucaugccacagcacuccagccuggguaacagagcaagacccuguaucuaaaaacaauaaaauuaauuaaaguaauuuuaaaaugauagaugcugaagagaauauguuauguuuagucuuaucucacauuuucauucauuucuauuuaaaaguaaagcuuuuuaggggaacuuuaauaaaucgguguaacugacaaaaaauuuacaaauacaauaugcuguauaucaacaugccuuuacugagaaaacagagaaagcaggcuccauuauguuagcaccuuuugguucuugaucuuuuuuuccccuuauuaaaacaggugacuguagucacaugauacuuacuuuaaggcuuguguguagauauagcuauuauauuuguggacagucucaaaugcuuucaucucauguguuuuccauguauaggcagaaggagaagacagccugaagaagaugcagcugauggagcuugcgauucugaauggcaccuacagagaugccaacauuaaaucacguaagaaugagcucugaggcccaggguuacugcugucugcguuguuuugucuacagacuuuuuuccuuuuggcaacacaauaauaguucauacaaagugaacaguugaaauaacuguucugucacuugauauggggcugacaguccuauuuuuaaugcuuucaugaauugaggacacucuugauuuuauuuuaugucagcauguugaaguuuuagguugauaaacuuacauuauuuuaacaaaaucacaaucucuaaauucaaguguuuaagaaauuuucuguuugguuaacuacagauguagggcuugcagcuuaucuuguuaaauuuaugcaaaagacaacauauugaaagcuuauuuugaaaaagugaauuugaaguguaucugacugaaaugacccucuguugaguucuguccuuucacuuugcuugcauguuuucccucuaguauuuuucccuguugauuucauaugugaguucacagagaucagugggugauaacucuuuuuccguccuauuuuuguuuuuaugcguaucuaugcauguuuuuauaagccguaagaggauagcuuuuuuauguuuaaaaugaaauaaugugaaauuuauauuuugaaacaauuuaagauucauacaugucauuuauaugaacauaccauguuuaaauuacugauuauuuaaaacacauagaauuuuuaaguucuagccagauuuagaagauguaggcaaccucuaguggguuuagaaguaguuacuuuacaaauuguugacauuaauuuacucaugaaaaugugaguauaucauuaauaggaauuuagaaguagggcuuuuuaagauuuucugugacguugguuccuaaagaugcaggaaauguacauauauaccuagugguuacuugacuaaaugcaauaaaaauuauucuuucuuuacuuugaaacuaaagcuguacuuuagaaauauaccaaaacugaguuucuguggacuccgguuacaaauuauuuuuuaacaucuguuaaugcaaguguuucauugugcuucugcauguacuuuagucuuaugaaaucuuagauauaucaaauguaugaacuaaauauaaccuauuuaauggugucauucauuuuuuuacaauggcuuuuuaauuuuugcacauucuuaaucacauugggaaagggaaagcuguuugcauuugauuggugugcuuuugcauuuuugugugaucagcgcauguacuaaugauuuccuuuuauuuuucuucuuuccugcuuuuccuuucuuuuuccuacucccuucucauuuuuccguauuuuauacugcugucucuauacuucuuucuaaauuucuuugcuuacuguagcagcccuugccuuuucucuugcagcaacagcccaggcugcuccaaggaucauuacugggccugcgccgguucucccaccagcugcccugcguacuccuacgccagcuggcccuaccauaaugccuuugaucagacaaauacagaccgcugucaugccaaacggaacuccucacccaacugcugcaauaguuccuccagggcccgaagcugguuuaaucuauacacccuaugaguaccccuacacauuggcaccagcuacaucaauccuugaguauccuauugaaccuagugguguauuagguaaguucuucuccccaugggguuaacaacauucucuuuauaaauauuuuugcucccucagauuuugaaaugauuuuaucaguuuuagagaggcaagacaaguuugcauuagggaagaccgaaaacuaaauuuuguuuuauuucagccucucauaaggguuccccuuugaaauaauugcaccuuaaauuuauucagauccacuuugguaacugagguucaguuugguuggguaaaucuguuguguacauuucaacaaauacuuuuacauuugacauuacugaggucauucugaguuuuaggucccaccccauuggcccgucaccuccaucagcuccacuucucaaacuuuauuugagauuuauuuuaucucacagguuuguguaauuguuggaaaauuuuuaaacuucuaagugaaaguagucugagcgcuuuauaaaauucauauuauuguguguguuuuguaauauuugcgaucacuuaaaauaucagauaaauacagucaugcaucgcuuaacaacggggauacagucuaagaauugccuugucuggcaguuucaucauuugguguacaucauagaguguacuuacacagacauagaugauaucguuuacuacacaccuaggcugugugguauagccauuauaaucuuaugggaccacauaguauaagugguccguuguugaccaaaauguuguuaugcaggcaugacuguaguuguauucuuaagauuuuucaguucuuguguuuuggaguccuagucauauuaaacaugagagauacucuuaauuucaguaguacaguauggaauaguuaaauaaauagcaaaucacugaauucagaaucucacuuaaggcagaaauuaaaaucauaauauaaacgcuugguuuuacaugaacaaaaaguggugugcucgaaaaagacauuacugaugccuuuuuuuuauagaguggauugaaaugccagucaugccugauauuucagcccauugacuugcuggaugaaggacuagaauacagcagcuguuauaacacgaccagucaauguggaacaaacuguuucugugcaaccccuuuguuuuaccagacaaaauuugaauacuuuuuuuccugaauuguauaugaccuuggugcugcaugcaugcuguugacuuuuaggacuuugaucuuuuaagguuuuuuuuccccagcauuaauauugauuuauaaagauuugaaaaucuuuaaugaacuggagaacacuaagauuuaaacucgaaaauucguuguucaaguaaagaaagccaugaugcucuguauguuaucugugugugugcaugcacucaggugcccuuuguuucaugaacaaauacauuucauuguacauguuuucuguuuaaaucauuguauaaaguaauugcaggucagaauuauaccacagaacuguuuaugagaggcuugugucuguugcacauuucuugaagcauuuuuaaaauaacauguaaccuguaaccuuguuguuuaaguuuucuuuucuauuaauacucuguccuguggucccgugcaugcuccuuuucccagaacuccucucugcugcacccacagcaucuguucccgaggaguuaugacucuugacuuccugcagggcuggggcucuuagccaccagcugcuguuccagcacuuucagcgcaagaucucccugauuuugccacguggaauuguacuuguauaugauuaccuuaucuaaaaugaauaagaggugauggaccaguuuacugcuuagaaauagcaagaggcacugcaguaaaacuuguuucucauuguaaagcuucaugucuuuuguuuguuggaaaauuuuuacuuauagaaacuuaauuauuagacugguaaaauaaagaccaaaauaugcagauuucuaauuggcauucauaaggugaauaauaauaagugcccaaugaaaaaaucuauuaugguuaauuucauuucuugcuuugccaccuaagcaguaaaacaugauauugaccacuuggagaacucagaaaauuauuuuaaauuucuaaguuauaauaaauuugcacacagauaacaugcaugcuauuuaugucacaucucacauuaaauuauuuuaaaauaagcagugcccuucaaaacagaugcagacauguguguugguaguagugaggagauugguauuagcaucaagucuucauugaugacuaauuuuuaauucccuuccuuuuaucuuuagguauggcuuucccaacgaaaggcuaagaauucaagaacggucuuaacugaacccucaucagaucugaauuuaacaaaugcuuagucucagcagccuccgggggaaaaaagcuuagccuagcagucagugacuuacuugcacuuuuugcacauagauauaaaguaaaauuauguuauuaauuugguuuagucuguaauauuacacaguaaugguaauuuauaaaggaguguauaguaguauacugacugcuaaguguacuauacuguuugcuuuacuaaucaccuaauucauugcaguucauacuuauugacucagaguuuaaaaccacaaucuguaggcuuuaagaauugcuuuuaaaccuuuuuaagugauaaacucuugaaguggucuuaagguuagcaaauaauugucuguauuaaacauggcguuauuuaaguaguccugcugcaagaaaggcacuucagugaauaugugacuaguaaagcuuaaauauguuuggaucuaauagagcucaugaaauacuguaacuuggggauuguaaaugaauggauacaauagguuaaggcccaagauguuugaaaugaaugcaauauuaauagaugcauauauacaugacauauugugguuaauuuuaaaacuacugugccuuaacguguuucuuaaacuuuuguaguaaaugaacauuugaaauccauuuugauaaaccugcuguuaauguuuuuuccccccuugugaauguuuucuaacuuugucuugguaauugcaauuuaacuaggugcgguggcuacuaaaguucgaaggcacgauaugcguguccauccuuaccaaaggauugugaccgcagaccgagguuaguuuaguucugcaguucuugucuauaagaaaugcguuggguguccauaaaauuugcaacaccacaccugauggaaaaauguaauugcuuaccugcacacaguuuuuuuuccuuuucuaaauuuguuugugaucauugacagauuuaaggguuggguuuuuuguuuugguuugguuuuuucucccuucauauuuuaacuuauuaaaucuucuauuauuauguacuaugauuuauuccuacuaaaacauaaauuagucaauuuggggagcuauuaaauuuugauguugccucaguuauuuucauuaauaacuuuugcuaaaauuuaccuuuuaaaaguucugaaauuugggguugguauugcaaaaugaauugaacggauggugcuuuaaugagagaaguaaaggaauauaugccuccuguguacuuuuggagaaaacugaagauuuaguuuccauuuuucuuuauaauaaaauauuugagccacuguauaaacaugagggugcacaugucaaguacuuagcuaaaaucaacaaagugaggacugugaagauaacuuucauguaguuggauuuuuuuauauaaauuagagcgucaauucccuuuuauucuuacauucucuugccaaaauggauccuuugauuuuugucauuugcugcuaaaauauauuaucugaagguaaacugucucuugaaguucuguggugguaugagauccagcugugugaauauaauuuuugacuaaccugugacuggaaaauaagucuucauuuuucuccuuuacaacuuuuauaauuuguguccuguauaugcccuuggacccuuuuauaaauuauuuuugcuuauugaggaaugguauuuucgguuuauugacauugaauuguuuucuaaguuuuuccaucacaagauaggaauaucaagcaugguaguaaaaaaggauuuuuuacaaguuucuauuauggcacauuuguuuccuacaaauuaaauugaucaaagucucaaauauuaguggaggaaaaagugcuggauuuguacuucaauuguacaucuucuaugaauuuaugaaggaccuaccugcuuuaugugauuaccuugaguacugaugauaaauacuagacacagcuguuguccacaucagaaauaacaugccuuucccaaagacauuguuaauauuuguuuagcauaauccauaaagaacguugaagacuuuuaaacuaauguauucaucacuaacagugauuguucagugaacaaaauagaccccagcuccguggucgucuaugaggaugguauuccuuguaaguguucuguaugagcacgucucauagggauggggaaguuuuuuggaaagucacuugaguuuuaaagaaacuggacaauuccaugaauaauuugagguuuuauucauauugcuaaugucuacaauuguucuaaagaguauuuuaaaguaguuuuuuucccccagcuaaucuuucccuauguaugcccccuuuuaggagauuucucaccauuuugcuuuaacacaauaauuauuggccuacuuaauacuccagugccuugagauaguuggacauauuuuaggaagauuuuauuguauuuggaaaauuacgacacauuccaugcauggaucuuuuguaguuacguguuuugauuaguccugucacuguuuuuauuuaaaaugcagugucagcaaaccgaaaugcucauuucuuuuuuaguaacagaguacucguauacuuaucacuguaugcacucauugggucuaagggagaugucugaaguccuucacuuaaauuauuuuaugauacuacuguuuucucuauuuuugagguuaaaauuauuuuaaaaaaauauuuugaagagaaguuuauuaguauaagcauucauuuaaugcaaaaaaacucagcccuuggacauauaaccauguaauucuauaugaacguuuagaguacuacaugguugaccaauaucuaguucuuuacuaaaaguaaacucaccucuuuauauauauuucaaaacugaauuugaagccuauuagagaccaacugaccuuuuaguuguaaugaacuguauggucuugcauggugacacaccuguguaggaggccaagacuuggcagaggauguagucuagguguccugguauauauaaauggucacucacuucguuuauauauuccacacucagaaaagaagucagaguuuuuucugaguaauacaaaaaccaucacuuacauaauuuguauaagaaacuuuaaacaguuuuaaucaaaacuaugaguaacaucaaaaaugcuuuaagauucuauauuuuggaauaccugugaaguaguaugacuacaucauguuaaauauuuauuuucuucuaugauuuuggagcagcaauuuuuauuuuaaauaaaauuccacuuuuaagaaauucagggaagauuuggucacauugaagauacaguauuuuuguaguauuuauaaacuguucuaaaugauagacuauagaaaacauuuuugucauaugaagguaaaucaguccauuauuuuggaucauuuaaacugaacauuacaccuucugggcuuugauuuaugaaguggcacagaaucuaacuuugcacugaauaucuuuucauucacaucuccucugccuuagucacaauggcaacaguacagaaaauucuaucaaaccucagaauauaguagaaauaauuaagcuguugaaugagucuuaaaaauuauacuacuguuaaguggaccaaguuuggugaagcagaaugugacaaagguugauuaaggaaggaacaacucaaggacauugggaaugauaacuuuuccacuugagaacuacuuuauguuuuacuguaauuuuuaaaguuuuuuuguccuuuuuguuauuuugcaaaagaaaauaguauuuacagguggcuucuuuuaaaauauaaaaauauaaagcaggaauguauaugaaaugucagauuuuauuguauuugcagaguauuagcuuugaaauugaauaaagaaagcuguuuguaguuuuaaaaugccuuauugguaucaauuagaaauuucuucuauuuuuugauguacuuagagcuuuuugaguguagaauuuuaaauggcaggauuuuacaguguuuacaugcaagugcauuuuauaaguguucuauauguguaaaauaguauuuucaacuggaaaguguuggcuagugcaaaaggccuggccauuuucugguucccaugauguugccuacacugcuagacuacaguuuaguaucgcuuuguaucaugaggccaagaaauuccauguuguuuguaaauagaauaauugaaaaagcaauaaacauuuauugaacaaaagaaaccuuguuuggcccagaguuuauguugaaccaaaugguucauagaauuuugaauuucuuuagauucauuucuguuaaucaucaguuauuaauaaucacauccaucauuaauaguugcuuuaaugcuugcaucuuagagaauacuaaugcuuaauagcagucagauacugauaacugcacugacuguuuaaaaauucuguauaccaaaccuauucauuguuguuuuucaauuuccuucauugacugcuacuaacuauuaguuguuaguuguauuuuauuucuauuuuuucuuguuaaccaguuuuuuuuuuuuuuuugugggagugggcucuucuucauuuguucaaaucaugauacgaaauugucaugauuuuaauuguauucuguagauggugucaaucaguuugucagaauuaaacaugcuuuuuuuuuuauuaguugugauuaguuuuucauguugucauuaagccgucacuagcugaaacuaaucucuucucuaucuuuucuuuucuuuuuuuuguuuuguuuuuuuuuguuucuaaccacccagccgccaccggcaacuaaccuaugaccuucugaccucugaacucuucacccaaugaugaccugaccaugccugccugcugaucaguuaacugguaaucgccuuugcuugccugucgucagugcagcgagcugaggcacuuguccguucgucuuaccaucuaaccaaacaaaagacaaagaaauuguuguccuccaacucagcuuuuuuuuuuuuuuuuuccuguuugggugaaagugguucuagaaacugcacugaauaguaguaaagcaauaaggcccaauucaucccacagcacugaucaucuuuuaauaucccacccuaagcgaacgguaagaaggccucucuuaagaaggggagacagaugguccuuaacuacucaaugacagaggcaguuacugugagagacuucuaggaaucuuuuucuucucauagcgaagucaaagcucucucugaauguacugugugaugaugcaucaugcaugaaccuucggucagggauaucauuggugaagugauuucaaaaaguauucaaaauuugauaugcuguuuagucacuacagugcccucaaagggcagaaguugcagccuuuuuuauauugccugccaaaauuugaaguauuagaagaaagugugccaugagagaaaaacuuaaggaguuuugaaaaguaaugcaaauaacaaaacugcaacacuauuuuuaaaaagauaaauaucugaguuaaaauuacugaaucuuuauuuuacaccuaaaaaaauaugagaacaagguacaugcauuaugugucacauuacugggcaaacuguucaaguauuuuuuuuuaaaccucccuguauagaaaaaaaucauuaaggauguaaaagccaugcuugccuauuugcuguauacauguaaugaaauuguagauaaaguguagugcauugaaacaaaugaacaaaaaguagauacuuuuacuauacaagggugcuggugcagaaaaaaauauauauauuuuuggaaauguagcauuuuauacuuucaaguguuauaaaaaaaaagaaaaagaacaaagaaacccuuuauuucauuaaaugauuuuuucuggugguugucaagaaacaaaagaccaaaagagccuuuuugucuuucuuuuuuauuuuuuaaguauuggaauaagucuaaagaaaagaaagugccuuauuuuccuucauggucauucagucaagugucucauaaagaucagcuccucccucagaauacaaguuaaugcauguuacucagucgcccaguaugugaaagaagauaugagggagacaaaugaguugauaguuugaauuauaggauuuuugccacguuaccuugaugcaaauuugccaaaucugauacugugaaaagauuugauaacuuuucuaaugccugacuaguaaguuuuaaaacaucauucuuuaaaagaauaguuuaauacuuuugguuauuccaaucuucaauguuaacccaaaggauucugagauaaaaauuaugugucaucuaaacuucaguuuacagacaaaauuagagcuuuguuuuauuuggagaagggggaugcauucauuugauuuuguuuuuuguuuuuaauuaauugaauauaauaggauaccuagcaaauguuuucacaaaagugaaucuuugugauuuucauucuagaaaacaauguuuuaaaucacccaaauuuaaucacaugucuuuauaucauaccagauaacugguguaguguauccuuuuacuguuucaauaaccucugccucccccaccccuuaacuuuaaaagaaugugaaaaacuagcaucauagugcauauaaauacucaaccacauuucagcuuaagcuucuaauuucucaagaaguugaaacaguuaguuauguaguugaagcaauuugugugcaaagccuacaucuaaacacuugagugaauaaucauuaacugcucaguaccagacguggcaaaucucaagugacaguggacccccccccccgcccagcuuaucaacucguccccucuuccacaccuucccagcaucacagucagaggucagcaggaagcugagucauuaccuucuuggugaccucccccaccaucuugucucacuuggaaaccguugucaguuuauuuacuaugcaauagacauucauuguuuuguauccagcuagcuuugguuuaauaugccacugcuuugucuuucuguuacacauacaguuuugauuuauuuacaauauaugcugugccauuuugauuuuuauauuguuugguugguugaauaaauuugcgacacucaaacacuugaggugauaguuguuaaaaacaauaccaguauuugauccaguuucaucucaacuauguuauaccuggacauuuuagauguuuaucaaaggucuuuuauggggaagaaaguaaauguaugaaauaauaaaugugugacauuuauagggaauguuggcucugaacaaacuuuugaaaacuugguugacaaaauuuuggaucaacugaaaaaagcaugacuuuugaaaucucugaaugccuugguucucaguauuaucauucuuuauugaauuuauuucuuauuaaaauauguaguuuuuaagacuuuuuuucugacaguauuauguaauuuuuuagcguggguagaugggagugucgcuuguauguuaucguacagcugacauguauuuuugucuauucuuuauuaucuuaguuucaugcuauguauguaccauaaccaaccuauugccuaugagaaacauguaagauaauguauuuacagccauuguuacaaguuuauaauguauuuuucuaucuuguuuuauauguauguuauauaacauucaaaaagaauuuuuuucuugauugagaaaaggauacaaaaugcaaaauccacaauuuugauaacugaaaauugccaauuguuuugcaguacuuuauuauauugggugucuugucuuuuuugggcuuuuaguuagcuaaugaaugaauacauuagacacuuuuggguuuuaguugggauuuuacauagcuugcauuuuaauucuuugguucuuugcuguuucuauuaacccacagcauuauuuuaauaaauguuauaauaccaaccuacuaacucuggacuuugucuguuuauuaaccuuuauauguuuaauuaaaauaaacaaauaaagacaaaagaauguaaagucuugaguuacuggacuaacccugaagaacgugaccacagauaacauaguguga

SEQ ID NO: 18194 - RNA, 3427 nt, Homo sapiens
cggcagccgacuaggggcugggucuggccguuuagggccgggucuuggcccgucgcccacggugcggagggcuggugggcuuuccuuggccgucgggcccgccacggcgcgggucuuggcugcggggcggagguggggcgggagagccgaggauaagaguuugaggcuuuucgaggcgcgugccgcggcguccgccucugcgggacucugcgccgggcgcccucggccggcgcgcccggcucccgcuuugucgccgagggaagcacgcgcgacgccccucccgucgccgccguggcuucuuucgguguucgugauuugcugagaggcuggaaagcagcacggcggagaggagccuugcacucgccaggcgggaagccugcgcggacacgcgugcgcacccacggggcggcgggcgggcgugggggguccgggccacgcgggcgacgcgccucuagggaagcgaucuuguugcaccuucccguuauucugaaagcaaaucguagccagacccgagcgcagcggcuuagcaaauaauaaggggagcgucagucgugcucgaaaugcuuccuucgcgauggcgucaguguuccgugagggaaugaagccgcaguaggaaauaaagaggcugugcgcguagucugaaaagcagaagucaacauuuuuacagaugaagaaagaauacggaggcaagaggucuuucucugcaguuugguggauuuccaacauuuagacuuguuuggaagaauuuccucagcugcaccaaugaaguccuugaucuauagaagucggcagucccuaaaucuacgucugcauuuuguugcaaauccuuuauaacauuccauuaaaauaaugcagaguuauuuaauauccaguuggccaucgugagaguaauucgcggcugagauuuuguuaaucauucugucuucugacuuaacagugaacguaggugauuuuuuuuguaaaauguugcuucacaugaauugugagaaucaccucuaaguuugaauuguacugaaggcacuauaagaauuucaaaugaacgcugaguagccaguagccuucuggccuuuucguuuaacaagcacagaguucguuuuuaaaauuaaguuacuuugacagaggaaauguaauagccuugguagacaacauuaaaaauguaacugucagauguuuuaaagucuccaacagccguaucuguuuuagagccauagaauauuuacuuacugaauugccuguuuaaagaugaacuuucuaaaugcagggaauaguaacuugcaaaaaagcuauggucucuaaguaaugaaggcuguuucaguaccuagaaaaaucaaaaucaagguuuugaugcugcuaguguaaaagaugcaauccccuucuuaauggccugcuuauuuauuaagcuccuaggcacuaugcugaaugcccuacaugcauaucucguuuaaucaucaguacaacuugggcuuagguuagacuguuauccccauuuuacaaauaaggggaaacccaagaaagaugaaguuaaguaacuugcccaagaauauagcuagugaguccugugucugggauuauaauccaauuauauuuuauucuaaagcuuuuuuuuuuuuuuuugcuuuuuuuccuugcccuauccuuuaaaucagguugaauuuuaugacaauauuccaccauuuuugacccauagaaauggcagugucauaaggcucaaccacuuaaaccagauuaaagaacaaugauaggcaauuuucauuuccuauguauuaaaucacuuacgguuacagcauuugauaauagcuacuguguguuaauuuucuuuuuuuugaaacagaauuucgcucuugucacccaggcuggagugcaauggcgcgaucucggcucacugcaaccucugccuccccgguucaagugauucuccugccccagccucccgagcagcugggauuacaggcaugcgccaccacgccuagcuaauuuuguauuuuuaguagagacggggguuucuccauguuggucaggcuggucucgaacucccgaccucaggugauccgccccccucaaccucccaaagugcugggauuacaggcgugagccacgugccuggcagguuaccuuuucaaaucuauguagaucaccucauuuccugacagucccucaaugguuucuuaucucaaaaaaaaaaaaaaaaaaaaggaaagaaagaaaaaauccgaagagcuuaccaaguccugcaagacgacaggugugccccuggugcaucacugaccuuauguccuucuccucccacagcccacuuggcugcacccccguggaauccgucuggauccuuaaauauuccaagcaugcuuacccuccccaggacucugcccuugguguuugcucuccucggaaagcuuuuccccauacaucggcgaccccugccccuauuuaucuuuagaaggugucccuuaacacccuauguaaaauggcgccuuugugcacgcaaacacuuccucccuucuuccaucugcuuaccccagguucuuuucauaccauuuguuuccacguaacaaugggucaacucguuugccacuggcaucaacauuguaagcuccaugagaaaaaggaguuucuucuauuaggaauuuccaacaccuagaucagcauaugguacacguaggcacuuauuaaauauauguccaaaagaaguauuaaguacuuguuauggaccagaagcucugcaaaacccuuaucuucauuguuuauuuucauccuuacagccaauauuugagguaggcaggaagagccauauuucagagaugagagggcugaugcuuaggaggaguaaguagcugcagagggucgggugcgguguuugugccaguaaucccagcauuuugggaggccaagacagguggaucacuugagcccgggauuuugaaaccagucuaggcaacauagugagacccuaucucucuagaaaauacaaaaauuaacagagucuggugucacauaccuguagacccagcuacuugggagauugaggugggaggaucagggaggcagagguugcagugagcugugaucacaccauugcacuccagccugggcaacagagcaagaucccgucucaaaaaaaaaaauguagaaagacuaacuuuguaauaauuacauuauuacaaaaauguuaucuuaauacaguauugaaaauaaauuacaacauguagugaguauauauacagaaugagccuccaguugaagaucccuauaauagguuuuuucacugugaaaaauugucaucuaauauguugacacuaaaaaugguuccacauucuaacaucaguaauuaaccaggcguggaaacauauuuucuauucuguuaaauuugauuggcucuauuugcuuauugcuauucuuaacauuuaaaauagaaauuugcaguauucca

SEQ ID NO: 18195 - RNA, 8787 nt, Homo sapiens
accuccugaagcuguucacagccuucuucucccaggguguugccugcucaaggggagggaagagcagucagccggggugccagggccagccuagcagaccugugcagaggccucccccauccgacuaccauucagguccagcuucuccagcucagcuuugucugccauggccucagcaacagccagggcagcaucccucuugauuucacagaaugacaaguucagcuccugaaaauaagaggaaggguuggaggcaggcagaaacccgggccaggacaccagguucuacucuaagccucaguuuccccaagugaggauauggcaggcucuguccuccagguggggcaaagugggcaggaagaauaacaccaacaacaaaaauaaugcccugcagccaacgaugagucacguacuguguuuacuuaaaucacaagacagugauguacaccacucccugccucccgcuuuagaaaugaagaaaccauggcucagagggguguggaggcucacacagcaucacagggcccgaaguggaggagcugggauauggacacaggcccaccugccuucagaccagaccccugugcccccagccgccccaccacccacagaccccagagggaggacgucaggcguccaggcuggcaccuuuagcuugggcaggccgccgcggauggcaucugcaauggcaacugcacccuuggagcgcaccaggcaguccccaaaauuaaucaccuccaccugccgcaaggucuucaaggucugugagggggaagcaaggguccagagugagggugcagaccacaccccagcccucagcaagccccgggggccccacacggucacaucccaagccagccaccacacacuguccuccucugcaagucaccagcuuugccgucuucuacuuguuggccucugggccccuggccaaaccuccuccaccccuccccauguuacggccagaacucuuccugagaccaaccaagcaagguuccugcugagcauccgggucuuccacacguaagcugaucccucugccugaaacacccaucccccacccucuguccagagaaagaccacuugcccuauacaacuuagccaaaaugugaucucuuccaggaagccugcccuaagucugauuugaacuuccuucuggcguguuccccaacaccugcacacaucucugcuaacacacaggcagccggacuagccuucuguggggccacgggacccuggcagccaagaagccacugcguucagagcccagcacuguuaccacuggcagcuuccuucccuccuugagcuagggucucccugaaggcggggucuuuggcucaaccccauguggccugcacuugguacaaagccaagcacuaaauggggacucaaaaaacagcugcugggccaggcacaguggccugcaccuguaaucccagcuacucagaaggcugaggugggaggaucacuugaucccagaaguucaagaccagcuugggcaacaguaagauuccgucucaaaaagugauaauaaauaacaaaacaaacaacagcugcugaacaaaucaaccaggaaaacagauguggggagcagucugcuccugugcagccugagaacaaaccagcggcagccgcugggggcugcagaggcggcucaggagaagguggcaugaagaaucagagcugcccgaggagggcguggguuaccuugggaccugcaacccuguucaggacauguucaaagagcuggagccauggggcacacacccagggggcaggcaggggguagaggagucccugcuaaacggagccccagcuucccuggaaagacagcagccagccucuaucuggcggggcccaacuggcucugccacacucgccucaccucggccauggccacggcgcccuucucagugaagguguugucauucagguugaugacccgcagcaggggguugacagcgaaagccugggccagggcagugaugccagggugguugaucccauucuguggcauguggaccuccuccagggucccgaugaccugugaagaggaggcagagaguggagggggccccgagugccaggugacauccagcaggcaggagagcaauuccacacagcaggcacaggaaugggcugccgccagcacagggcaggggccugucugugggauuuuggggcauggcugcaucuaacucuuuccacaaccuccugagggaggccuacugccugggauaggauccccaccagagaaaagacuagggaucaaagaggcgaagugacuugcccagggucacagagcucuagauccagcaggucgauuucuuguucucagucugguguccucagcacaguggggacccuggcuguggugggcaggcacucaugccccuucucuggaugacauagcuccaugugaccuuucuuucuuaggggcccuccuagcccacccaccuacacaacauaaccccuucgacauggcguccuucucuagggaugaggaggguguucccuggcccaugcagcccuaucacagccuggccuuuugauacccauucucucugccuccuuauuuucuuuuucuuuuuucuuuuuuuuuccuuuuuugagacggagucucguuccgucgcccaggcuggagugugauggcaugaucuuggcucaucgcaaccucugccucccagguucaagugauucuccugccucagccuccugaguagcugagauuacaggcgugcgccaccacacccgacuaauuuuguauuuuuaguagagauggagguuucaccauguuggccaggcuggucuugaacuccugaccucaggcgauccagcuuccucggccucucaaagugcugggauuacagacgugagauaccacacccagccauucagcauuuucuugacaggcuaacucauaugaguucuagggcucuuguuuuggucaccuccucucccaggaaggcuuccuggauucccccagccacgauccagugugcguuccucugugcucccggagcaccuggucccuccucuaucacggugguccucauccugccuacauucaaagccuauauuccgucugcaucccaucggccccugagcuuuggaggagagggccaugucccagucuccacugugacccaggacugaggguuggccuggcuuaacugugccaaggaaucuucugcugucuucaggugcucagugcagcacagggcaauggggggagcgggugguccacaaauaaauacaggaaggccaaccugggcacacuccaggucaggccuucuuaguauuuucugugccaugaacccuucaggcagucuggugaagccccuggguccccuccucaaaaaauguuuuuuuaaaauuuuaagauaaauuacacagaauuacaaaggaaaucaacucaguuggaacaguuaucaaaacauuuaggaaaaaacuccaaacgcaugcuguagugauauacaaacuucuuguuaaugcaccaaauaacaagaucuagggguggguccacuauuacuguaauuuugauguagugagaaauauuucuauauaucagcaguaacuauaacuucauaugaaauaccugugauuuccacuggggauaaagucacaagauuuucuuuuuauuuuuuuaaaaauuuuaagcugggcgcaguggcuuaugccuauaaucccagcacuuuaggaggccaaggcgaguggauuaccugaggucaggaguuugagaccagccuggcuaacauggugaaaccccaucucuacuaaaauacaaaaauuaacugggugggcaugguggugcacaccuguagucccagcuaaucgggaggcugaggugggaggaucacuugagccugggaagcuucaacugcagugggcugagauugcaccguuguacuccagccugggcaacagagcgagacccugccucaauaaaauuuuuuuuuuuuuuggguucagggacuacaugugcuuguuuguuauguggguagucacaggccuuucuaaugcugugagguuuauugucuacauuuauaaucaaaggucacacuacauauuuuagcuacauuaguaauaaauaauaauguuauuuuuuccucauccauguucacagaccccugaauucuauccacauacugggggggauuaagaacccccauucuaagcccaccagaggacaccuaugaaggcucaacacaaccacagcgcacccccuccucccagugcacugaggacagcaggcugacggcagggagggauccaaggauggcagugaggcccccaccagcuccagaggaggcagcaggagcuccccugcagccaggggugcagggagacacaaggcagaucucugcgauguucacuuggcacugaagcaggcaaaggguaucuacagacagccucgaugggcagccaggacauuccggcccguaugagcaaugcuccuaggauacuguuugcugaagaaaacauuuaaauuaagagaagaggggccggacgugguggcucacgccuguaaucccagcacuuugggaggcccaggcgggcagaucacuugaggucaggaguucgagaccaccuggccaacaugguaaaaccccgucucuaauaaaaauacaaaaauuagccgggugugguggcgggugcccguaauuccagcuacucgggaggcugaggcagaacugcuugaaccugggaggcggagacugcagugagccaagaucacgcacugcacuccagcaugggugacagaaugagacucugccucaaaaaaaacaggaaagagaggagggagacagaccccaaaguuuucaguccuguuaggggcaaguguagccuucugcuggcacucacgaucggggacucagcaauguccugcggggauggggagaggagaguggaagaggaguggggauaaggucaccugagagcacgucauuuggcaccugagcccugcggcugccccugccuaucucccugucuuggaggucugguauguuccuucucugugccccacaccaguggcugggccaggcuacugucagcacucgcaccaucucacuucaccacuucugagccuggcagaugacacuccuuggucagaguggccugccuggccugaagccccauaggggcuggcucaccagugggagccagucacacaccuuuccggaaagucacacaccuuuccagaaaugcacgacaggaauucuggcucauuuucggauggguuaacaggcuuggagagggcacgugacgccccaggucucuugguugagugccagcccugggauuagcauccagaacugucagccuacuaugccgagugcaccucaaggcugcaggggcaggauggacagaaaccacucacccuaaaagcuucugccaaggcaguggcgccaucauucuccagacgguuucugccagccacaaagaccuucagggccagaggcuugccuugggcacuggauuuccggugacauucggucagagcugcagccaggaucuguggggaaaggcaaggggcccuggucaugggcaggagccccuucucccagcgggguggccacugcugcugaacugcucuucaacaucccacgccacccaucggugcaggucaggggacgcaggacugcuaacagcucaacagucacaccuuaaauauguccagcacuucaguuacacaagguuuuuaucucuaaugcugugucacaccagccugagagguuuagcuucacuuucgagacggggagaccaagcccuacucaggaaagggagagaccacauggaguggaugaacuuuuagccagguccaggggaaggacuuccuagucagcucacuucacugucuaaggcccucugcuaggugggaaaaucauggcucccauuuuccagcugaagaaacucaggguaagaggaacggaaacuuucuuauggucaauaaacaagugguggacucuggaccaaagcccaaaucuuccagcuucucuuccacguuccacaauguccaagggagccagcugccaaguccacgguccagacgaaccugucugacaccugccugugccuaaaagcuggccaggcacagcaggagcuugccugcuggugguaaaaaccuaacacccagcuugcccugucccugguguggugccaggaaguagcuucuacccugguuacaccauuaggaaaagcacugaaaaacggagacugaccgaugggaaucagagcccaugguaaaugcgacauaaaagaaucacgagcgagugcaccgagagaagugauauuugcagaacaccugauguuugcagagcaccugcuagggccugggcauccuuggcauauuuucuuguuucaaccucaacaccagccugggaggcaggcaggauuggccguacuuuacagaugaggaagcugaggcucugagagaugagugaauuggccaaggucacccgguaaguauuuagcaaagccgcacauggcggguggguuggccuaacuccuggcaugagacugcacacagccauccuugaggaacagaagagccagcaccugccugacuccacgguggugaugguggaucacgcacacacgaucacgcacacacucaggguagagacaucaaacuucugccaaagaccagccucugaggaagcuacucagcagcagcagccgacugcuaggucacccccauucucccagauucccuggaggccacguggugauggccuuagcuccugcaggaguccaacuuggguauggagaguucucaagcacagggccaugccucuugccccaccaacuccucugggcccuucuauucucauggugcauggcacagaaaccacacuaaacacacugcccagaagaaaaagauuccaaaggaccugcaggccuugguuagacacccagaccauggcgucugagcucccaagaggcauaggucagcaaggccgagacccagagaccuaaucaaaucaguggucagggaggcacagagaaccaucaaucaaacuccaggguaggccugucugcccaggaggcccucugguccuggguccaaaacucauuccccaacucaccccauuacaaguauaggacaggccagacaacuccuggccaguaggaaagcucccugagccucaguuuccaggcacugcugggcaggagaagggaaguaauggaaggaaaaccgaagcauuuugcuagaauagagucucuggcucucccagcguaugccacucacucuagguugggccacgccugcuuucugugcugacgcaaacguuuuuauauguuucuguuuguuuguuuguuuguuuguuuuuuugagacggaguuuugcucuuguugcccaggcuggagugcaguggcgccaucucggcucacugcaaccuccaccucccggguucgagcaauucuccugccucagccucccgaauagcugggacuacaggcaccugccaccacacccagcuaauuuuuguauuuuuaguagagaugggguuucaccauguuggccaggcuggucucgaacgccugaccucaggugaucugcccgacucggccucccaaagugcugggauuacaggcaugagccacugcaccaccgugcccggcccauuuuuacaucuuaacacagggauagcuuauugcccaaguggacuugggggagggcuggcuaaggcaggcacagagccugccccugcucacccucacgucaggccgagggacacaggcacccucugcaggggaggccacuccagcuccucagccuggggcuccaugggccucacagcacuagcuaugugauccacuccaccccaucucucuaagccuaugcugagucauguggaaaaacugggauggcaucagccaccuuucagugugggugggaaaaguuaagguauugcauauucaaauaagauauccccaacugcuguuacuucuguguccccagcccuuuucucccuuugguuagaaaguguguguagggguugcagccuggcacucaguguccuccaacccugggucuaaaggcacugggauggaguuggaagagaauaauacggcaggccgcccuugaugcagguucugggaagcaaagaagcuccacucuacacugaccagcccaacgugaagcucuacacugaccuugccugaggacaccucccugggcaaggcccugucuaggaauaaaggugagcugugacggugcccccccugagcauaugcuccucuuuucagacucccucugccuaugugccaggcucuaccagcugcucugcggguacagugaguauagggaugccccaagcccugaguuuugcagagccagcaggcuggagcagguaugcaguggcacucccucugcguugccaagccaacccaagaacuggggaugguugcuuggcaaccccacccucauggacgccucuacccuccggccacaggcuguugccuuugaggccuuucucuuuugaaaacaacggcugaccaucccagauggugguggccaagggccagggcacauaugucagacggauguggauggaccaggggacucugcggggagggggcugccacacccaccuugccgccgccaaugcccaugccacaguuguugagcuugaguuccugcagggugaagcaggcugagcucuugagcagggccucgaagccuugcacaccgucgggcccgaaugcguugucgcuuaaguccagcuccaccagcugagccccagcugugaugaguccuuccccuagugagaucugggc

SEQ ID NO: 18196 - RNA, 713 nt, Homo sapiens
caauauacaaguuauuaucguuuagaggugacuuuuuuuucaguauccuugaggauauuauuggugaaaaaacauugccaaaaucuauaguuacugacagaaaaaggaugauacaaauuuauggugcccagauuugaccucugacuaaauaauuuugaguauuuuucuuuuagguagccauaugguaccuuugcaaagacaggucaaauacauaucuucaggcuucuuagcaggaaaagagaaacaaacauuccaccuacccaauuuauaguuuucuaucaauacaaacagauuggcugcugcucagaagaaacucagcuacuccagauguagaaaucucaaaaaggaaacuuuguagguauagugggaaggguguuagccaaccuucaugagcacaauuuugaucuuuuugugugucucuuuuguagagcccugaaaugcuagcugaugaauaucuccaaaggauaauugagaugguacaguuccaugaagggccaaguaugcagggcuaaacccgggguaauauuuagaacagcuagaggaguggauagauuccaugauccaaggcaauacuccaaaaauacucuuucucacaacuggauuuuuuuuucaagauguuuggguaagaaagagcacaggauuauaaucuagguaaggaauuagaaggcaaagugucuguauagcagauuacgugccgauucagaggacaagaa

SEQ ID NO: 18197 - RNA, 1136 nt, Homo sapiens
ccugaccggcuuccuccacauacgccccucuccuacacaaguccggcccucggcgcuccugccgaagcagcaggcgccucggacucugcgcggcucccgccggccacucaccuaugaugguccgcgccgccgagacgaugaccacaggaucugagccugcauucaucuugcuucuccugccgccgucugcccugcgcugccugcaagcuaggcaaagcuccuccucgcagcccacaggccugccgcgggcgggaccugagguagccccgccccucgcccuccaccuccccgcgcaccaccuccccgcgcaucccacugugcgcaggcgcaaggccggagcaggggcgggcggaggcgcgcggggcgcggggcgcggggcgcggggcggaagugaggccggggcgcggggcgcggggcggaagugaggccggggucugggcuugcgggcagaaccgcggaccucggacgcauuuacagagcgccugaaaccccaguguuucuggacaccccaauguuggaguuccccgacuugacgucuugggcuuuuuuuuaaaaaaucuuaggguuucucgaaacaguaaagacuggggggugacaaagacuuaucucucguucagcucaggacuggaaucccacgggcgagaaucucgagugcgagcccggcccgcggcgggucucagcacagcucugauggguccuuuugcucucggcggcuucgggagguccuaugcguuucuccuggcgccagucauucgcucgcgugaggggcuugcuaggagcgucucggugcgagcccccugccuucuaagaucaacucuggcugugaacgggugaggacgccgggagcgucuuagcgucacaaaaguuccuuugguugacguuuggacagugaaaggagcauguaacaaguggggucaguuuuguuuaaaacccuuucugacuucccagccucuuacugggcaaaguucauaauuuuucugagcuuucuaggguuuccaggcaagcuuaugaggggccaccguuacagcaacuuguugggaacaccuggauaguggaacaagaaagcuuugucacaaagucaugaaggggaaaacuguugacggaccuggagaaucuuccugaagaacuuuaaaguu

SEQ ID NO: 18198 - RNA, 1136 nt, Homo sapiens
aacuuuaaaguucuucaggaagauucuccagguccgucaacaguuuuccccuucaugacuuugugacaaagcuuucuuguuccacuauccagguguucccaacaaguugcuguaacgguggccccucauaagcuugccuggaaacccuagaaagcucagaaaaauuaugaacuuugcccaguaagaggcugggaagucagaaaggguuuuaaacaaaacugaccccacuuguuacaugcuccuuucacuguccaaacgucaaccaaaggaacuuuugugacgcuaagacgcucccggcguccucacccguucacagccagaguugaucuuagaaggcagggggcucgcaccgagacgcuccuagcaagccccucacgcgagcgaaugacuggcgccaggagaaacgcauaggaccucccgaagccgccgagagcaaaaggacccaucagagcugugcugagacccgccgcgggccgggcucgcacucgagauucucgcccgugggauuccaguccugagcugaacgagagauaagucuuugucaccccccagucuuuacuguuucgagaaacccuaagauuuuuuaaaaaaaagcccaagacgucaagucggggaacuccaacauugggguguccagaaacacugggguuucaggcgcucuguaaaugcguccgagguccgcgguucugcccgcaagcccagaccccggccucacuuccgccccgcgccccgcgccccggccucacuuccgccccgcgccccgcgccccgcgccccgcgcgccuccgcccgccccugcuccggccuugcgccugcgcacagugggaugcgcggggagguggugcgcggggagguggagggcgaggggcggggcuaccucaggucccgcccgcggcaggccugugggcugcgaggaggagcuuugccuagcuugcaggcagcgcagggcagacggcggcaggagaagcaagaugaaugcaggcucagauccuguggucaucgucucggcggcgcggaccaucauaggugaguggccggcgggagccgcgcagaguccgaggcgccugcugcuucggcaggagcgccgagggccggacuuguguaggagaggggcguauguggaggaagccggucagg

SEQ ID NO: 18199 - RNA, 147312 nt, Homo sapiens
uggcaucucucagggccaaauggggcgcaucaaagcuuccccucgacguuuauuaacucugcaguccguucucuacgucugcgaagaauuggcagauaacgaugugucugagagaagaggcguuuucuaaggagacacacaaagggagugggacccuccaaccucacucugugagaggaacaccgcacagcagugugggggcucgaacaccccaagagcggcagagcgcgguucagaaaacaugacccuugaaaugcacacaaagccuaacaacguguccuccgcggaagaaaacagcuugaaaaggucggcuuugaagugacccagcggaaaggaaucacccuggaagaaacacgcagcagccccggggcaaugcgcgggcaggaggagcagcgagcgcggggagcgcagggcccuucggagagggcgcuccaccggcccugcgcuccguaccugugccgccacgcccaccgguccccugcugagccuagcaccgcccauuuagacccagcaccacccguccggaccgaaccuagcaccgcccguccggacccagcagcgcccauuuggauacugcaccgcccguccagacccagaaccgcccguccggacccaguaccacccaucggacccagcgccgcccauuuagacccagcaccgccaguccgaaccgaaccuagcaccgcccaugggacccaucgcccguucggacccagcaccgcccguccagauccagcacugcacccccauuuggauccagcaccgcccguccagacccggacccgccaguccggaccgaacccagcaccgcccaucggauccggcgccgcccauuuagaccuagcaccacccauccgaaccgaaccuagcaccgcccaucggacccaccgcccgucuggacccagcaccgcccgucuggaaccagcaccgcccguccacagauccaucaccacccauuuggacccagcaccgcccguccccgcccguccggaccgaacgcagcaccgcccaucggacccagcagcgcccauuuagaccuagcaccgcccguccgaaccgaacauagcaccgcccaucggacccaucaccgcccguccagauccagcaccgcccauuuggauccagcaccgcccguccggacucugcaccgcgcguccggacccaacacagcaccacccaucggacccagcacugcccauuuagauccagcagcgcgcguccgaaccgaaccuagcaccgcuggucgggaaggaacccgguaccgccgguugggacccaccaccgccaguccagacggaacccuagcaccgcgcggggcccgcccuccgacaccucccucccuggcggccgcggcagcagcaccuaguggagcggcccggaggugcggcggcgccgcgcggggcggcggcgcgcacggcgggcggcggcgcgcacggcggcgggcggggcgcgggcgggugcgggcggcgggcggcgggcgccgggcgcacaccggccggcggggcugaggcggcgcggcgcggcgcggacugagccccaggcggaggccaagucggaggacgcggcgcggccgcggaggcggaggcagccgcggaggcggaggcggccggcgggggguggcgaggggcgccgggcccccgcggaccugucguccucggcccguccuccggccccggccccgcgcggcugaggaggcgcggccaggaccaugucggcgggcggccgugacgaggagcggcggaagcuggccgacaucauccaccacuggaacgccaaccggcuggaccuguucgagaucagccagccgaccgaggugagcaccgccgggcgcggggccugcgcgacccccgcccgcugcgccgcgccccgccccucccccccgccgccgcccgccagccgcggacccgcccuccuuucccccuccccccuccgccccuucucuccccucccccucccccaggcccaccgcgggccccggcgucccccgcagcccccgucccccugccgcgguguaucccggggucgcgcgggccgagcgggggcuggcggggcgcggcagucaccuguuccccucuccggccgcucaccugguggcucaccugggccgccgcccccacccccgcgagcgcggcgcggccccggccucauccccggcggcgcggggggcgcggcggcgcgcggggccggcgcccuccaccugcagcccgguuguggcucgcggcgccccuucgccguggccgggauggagccugugacgcgcgcugugcuucggguucauaaacuugcaggcugccagcugggaggggaaagucaguaucacaaaguucgggaggugcgggcugccugauggcacaggcccggagucggacgccuccgaggaaaggcgcgccuucuccaccuucggggccgcgaggaagggcccucugcggcggccucugcccggagggaggcgccggccccaggcuggcucccugagaggaggaggaaaucacgcucgcuccuggccugguaacaauggggguuguuuauagcaaagcugcugaaagcguuccgagcagcuuuuaaaaaaauguuugaguccaaguccacuaggaagggcuccguggagaggggagggaggugaagggucggggagcaacccuguaaaucgcuccgcaagggucgguuccgcgcucuguucauucgguggcugcacagacuuuaccagcauaaaaaaauuucacucaauauuugugcccguuuaggaaaucauuuuaauagcgucuauuuuugauuuguuguaauagguaauuuauaguuaauacuugcuauaaaauacuagcuccuaggcaacaaaacauguuuggcagauuugaacauucuuacgaaauguaauccuuuuaucauuaaauuccacuuuauguuuuugagagaauuugacuauugcuucucugauuucuugaguuuuugccagucaugggaaggacucuauuucuucuguuuucaucuguaccugugacugcacuugacguggguagcuagccauuugucuuaauacugaguugaauacugacacacgccauuaggcucagguugucaauuugagcauagauguuauguuaaguuacuccugauucauucaucuucuguaaugauuuuaugaguuagguucuaguaagggaguuaguacuauguacuuaaguguucguucauagacuaguguaucuuuagaaaggugacaugauaauuuaguuucaggauuauguuuucuuuuagaauaaugaauucauuuuucuuuuuaucacaagguaaaaaaaguugaccauaaaacauuuucuugguguguagcuuuuuuuuuuuguuugaauggauuuuuuuuuuuuuugagagauuucucaagucugguggaaaggaaucuuuuuucgguuuaauaaagagaauucagcuuuuugggauuuugaauugaguuagcauuaaaaaaaucucaaaucagaaacauuauaguucauugauuuaauuaaauucuauuuuaagcacucaauugaaacuuuuuauuucuuagugauaugacuaguuuuuaaaauuggccugucauuuggaaagcuguuuuuucaguuauacuguaggugaaaguuugcuuuguacauacacugaagcaaaacaagaauugaaggacuuggaaaaaaagaugauauauuucauuuccuaauuuuucucccuacuuauaucugaacauuuccauuuuuagaaauuauucuucagaauuguauuagaagccuuucauaaugaaaugaaugguuuuuaagaauguccauauauugguuuuuuagcuuuuuuacuauauaguggcuggcucacauuucuauuuuguuuucucgagaacuuuccuguacuauuaaauuuauucugguccuaguuaagcuuugcauuuaacauauuguaucuuuuauuaugauguagguaaacuuaauaugaguaauucucucagccaguauuucaaggccaacaguuucaauuugcuuugucuaagcucgugugaauuuuuuuuuuuaaccaucuaaugauuauuuuuacucuauuuggccaucacaaguccaauuuuuuaguuuucugcaagaacagaagcauuguacugguccuuaucagauguucaguagauguugaacaaauucacugcaggaguugauuuguagaaauaagauuuaagccuuguauuuauuuacuuggguaaucuuuuuauguguaugagaguauaguuguggguuuucuuuuguuguuuuuuuuuuggguacagugauaaguaucuguuuucaaauuuuauaacuucauuaaucaucuaugauuggugguuucaggcagcuuugauaaccacugauaauuuugugguuucuguguuuaggaagaugauaaacuugguucuuuggauuacauucuuuuuuuaagaaaacuagaguauguuuuaacaucauccuggcuaaguuugcuuuuuccuuuguauucacauuuguggguaaaggaagggcuuacaaagaauaagcaggcuaucacuggaguauuuuucaggcucuuugucacuuggauccuagauucauuuggaauuuguaaaaugagaguugaucugaaccugauguuguuauuuuauaaccaggagauugaugcuaagcugacuuaaugucuugauuacuaugaaaagcuguagcucacagaaacuccuuaaaguauguauagucccuccuuugcuuauuuuuaauguuacagcuuguuuucuuuuagggauuccuggauaauuauggcagcagaguccuuuuaaucuuuccugucaccuccuuagaagagggcuucucugguuauccaaaggucucccuguugguuuuaacuuaccagacuugucauugucauugguaugucugucucccucuuauuacacgaaggcaagaguguagaauuuucuuggauaauuguucuguaucuugcaugguaggagcucaauaaauauuguguggaaagaauguugaauauggccuucauuguauauaccuuuauucaugacaaaauauggcauauaugcuuucuaaaaauguagugaagaguguuuauuaggccagugaguauuuauguuuucaugucuuauucuuaguuuugcaagaagcuuacacuuaaaugcagaaauuaugcuagguaauugacuauuuagcuucacgagauacuucuuaaagucauuuauuuuuuauuggauuuauugccuccuucuugcccugaugguaaaaauaacccagaauuuauguggacaccuacauaugcuuuauuacaggugaauacauuacauuuuaauacucugauuaaucgagaaguaauguggugauucauguuuucuggagauguguguaagaaauaacuuugucagcagagguggaguaggaagucuucaggugaagugguaauaauugcauaacuuauagcuacaucuauauuccagacuaauauuagcuugugacuaugcuuuaucauacaacugaacuauauuugaaacuuuuuuuuuuuuuuuuuuuuuuuuuugagucagagucucacucucuugcccaggcuggagugcaguggcacgaucucagcucauuacaaccucuaccuuccagguucaagugauucuugugccucagcuaccugaguagcugggauuacaagcaugugccacaacaucuggcuagcuuuuguauuuuuaguagagacgggguuuugccauguuggccaggcuggucuugaacuccuggccucaggugaucugccuggccucccaaaguccugggauuacaggcaugagccacugugccuggcugucaauaguuguauuuuuaaauauugguacugcugaagaucuguuucuggugacugauguuuuaaugagauggaugauugccaaugauguauuuuuaguauuuauaggcaucccuauuuuuuauuuuugauaaguugaaucucauuggugguuauaaccuuuuaaaaaucuuuuauuuccuuuaauaacugguuacguuuuauguuugauucgguguguucuuguaagucugagggacagcucuuaucuaacaguguugagucaucuuaaguugaaacuacaucuaggcuaguuucaauuugcugucuuccugccagugaaaaauaauuuuauuuuacauaauuugcagaccugauggaaaauaaguguuauaacuguagacuuuuauaacacuaucaaacugugauugugguuaaauuaauaguggcagacuagcagaagugggucuuucauauucuugaaaaacagggaucauaaaugauuaggauaugauaccaaauuggugagaagcuuaagaaacguuuaugauugucauuaaggauuugauugagcaauuguaguguauaaagcauuauuucuagguguugguuaaucugguagcauagacuaauuuguuuauaaacaguuuuaccagacuugaauuuugguguaaugucagacaguguguacuaauaaguaggauagcauuuauuuugauauaaacauguuucuuuauuauaaauaaaauguauaugcagguagcaguuauugaacauaugagacugaacucauuugaaaauuauuuucagguuagauugagucuugauuucugcuguuguucaaauguuugcuauuucuguuaguuuucuggcugauaguauauaggauauacccauucaccuuguagauacuuaagacagagaucaaauguaucugucugaccuacauuuacacuuguaaguuggauacugagcagugugccaaaucccacagacccuuuaaccaguucugggcaugucggaguuggcuaacgcugaugugcugauagggccugaaaaaucuaccggugggcuuccaguucgugucucucuaugugggaguucauagcaggagugugcguguucuaagaauuguaccgucuuuguuaaugaguagaagauuuuucugaacauuucucguuguguguaacugggcuaaagcaggcugagagguggcaagggagaucuuugccuagcugaagucaucugguugagauuuuauucuagcaaccauaagaacauaaaauucacuaaucauuuugacauaugugauugaccaaaaccauauuagaauuuaauuuagaaagugaaugugcuuaauaaagugagaauaagcauauagagaggugguucaaauacaagcaggaagguauuuucccaguguauuuccaaaaaggauaauuugaaguuuuauacuuacaaauuuaugcauguaugucaugagugaaacucuuuugaggaacugaaauggaauaguuuacuauggcuggaaaagagccaaaauuuuugugcuuuugcucacaagaaauuuaauguuaaaauuguauggcuuacagaaaauaagcaaugucaaccuugguugcacauguuuacacuuugcuguguuuuuaggcugaauauacacaacuugcuuuaccuuguaagcgucacuccuuuguaguuagaguggcuauguggaacccugugaguacaagugggcacuauuaauaauuauaccaggacaacagccauaaacuggaguugucuccuuuaacucuagguaugaacagguuggacuugcuggcacuguuuuuucaguuucugcaguuucaaacuuccugaaguuuauuagugccugacugaccuaggcugacaggacaagaccauuuucacagaauauucagacuuuuuuguggguguuuuaaaaaccaucuuccucuucgguaggguggaagcaggcugaaaaguacauauugcaguugaggcuagcucuagucuagcucugccacugacuauaguaacaacagcaggauagguuguuuccaaauuaggaagucgugccuugccuccuaaaacuccaccugaaagugccuuugauuuucagaauagaagaaagguugacccaacauuaugauccgugaaaaaaaugcucauuuguuuguuguuugggggguguuuuauuggcugaguggugcagugggcuguucuauucagaauccuagcaaguucucuugcuugaguucauacauguucuauuaaaggaaaaucaggcgguuucugcucuuugcagacuuaaaacuuuugguucuuccaagaauuugcuuucucuuuauucuuguuugcucauagugguacuuuccauuguggucuacuuauuauucuaguuccugauuuuuuuauaggagaaccaacaaaaauucugucaauuuuuucacuguuaaccagcuuuugguacugagcuuugagguugccaguuucccuccuccucuuugacuucgguucuguauguuaaguagagaaaaugaaaugggaguaacaauauggucacucucagacacuauccacuguuuuaaaaacauuguauuuuuaaguuuuauaaucucuuauaaacaugcuuaguauaaaauucauagauugaggacauaucuuucaaauauguuauuuuaaauauuguuauuauuauccaaauaaacuucugagugcugcagacuccuagaugcucauacaguauaccaugauuuuacauagguugcaaagaacauuuguuuuucaauaauaugauuuuacacgagcuuuuuaaugaguuauuagguuacauuacauuacacuuuuuacauuaauuucauugggaaaaacuuggaauuuuuuuuuaaauuuuuuauuucuguagguuuuuggggaacaagagguauaugguuacuugaguaaguucuuuaguggugauuugugagauuuuagugcauccaucacccuagcaguguacacugaacccaguuaguagucuuuuaucucucauccucuucccacccuuuuccccgaguccccgaaguccauugugucauucuuaggccuuuguauccucauaagugcucgcacuuaggagcgagaacauauguuugguuuuccauucuugaguuacuucacuuagaauauagucuccagucccauccagguugcugugaaugccauuaauuggaaugauuuuuguuguuguuguuguuucgguuuuuuuuuuuuuuuuuuuuuucgaaagguauaaaacgugauagauggaacacuggacuacaucuugaauaacaagucacggugcaucacaccaugaaaacaccccuccugccacccauggaacgauucuuuuuaagaggcauugggaauaaaaccaguugugucaaggauucuaguuugaacuuacuuuauuuucauuucugcuguccuccuuuggaagauucuuuuaaauacuuuucauacucuauacaguggcuuaucccuguaaucccagcaguuugggaggccaaggcaggaguauugcuugagcccaaaaguuugugaccagucugggcaacacagugaggucccgucucuaccaaaauuuaaaaaaaaauuaacaagcaggguggcacauaccuguguucccagcuucuugggaggcugaggcaggacgauugcuugagcccaggaggucaaggcugcagugaccuaugaaggagccacugcacugcacugcagccugggugacagagugagaccccaucucaaaaaagaaaaacauuugucugccuugcacuuugaaugguucuuuuacucacgugugauuuucuucccucuuguugauuauuaggaaaauauugauucacugaguuaugcagaucuacuaaauguugauaaauuuccuuaaacaauaacaaaauguuaaccuuuguuaauaucaccacugaucucaucagaaaaauuguaaguauagggaagcucucaaacucucaguaguggauacaaguuuuuaaaaaauuuucauuucagagcucaaauuuuauuauugacaucacugucauaggcagcacuugaagagauaagcuugcguuauucauuuuugacaaaaugucugucaaauaucuaagccuaaauaagcauaguuguucuuucaaguaaaaaaaugguguuccaugaaagaagugacuaauucaauucacaacuuaaacaauugcucauauacuuuuuuuuugagacagcugucaagcugugguaugcagaagggcuuuauguaugccucccauuuuggcacauaauugaacaaagaaacguacucaauuuucaaggaaaucagucauuuuuuucuguuguaccaaagacauucuuaagugaaacuggcuuuuuaaaaaaguuugcaugguaguaaaaaauacguuuuguauauagugcauuuugaugcuacugccuugauuuggugcuaaggugccaucagcuauacucaucauugcuuugaccauucaugcaaauuccaacaaaaugagaaaggcuaauacugucaaaauauuacuaagaaaauaguuuugaucucacagaugaccugaaagggucucagagaaccuuggggguucauggacugcaguuuaugagcugcugcccuagaauguuuagugaugaguuuuagggcugauuuaaaaaauauguguguucuaagguagauauuaugugguuuuccaaguaaggcuauaauauaaacguauaauauuuaaaauguaaacauagggcucauuauuauggaaguauacauuucaacauuuauuuuacgcauuauauauuuucuguauuuauaaaugccuccuuuuaauuuuuaguuaucagugcuaagaugcacacauuuacauuuuugugacuugagaauacuggccacaagcuauuagagugaugaccaucaaguuuuauuacuugaauucacucgggaugugaccuaagccacaccuacuuaugggacauuuucaaguucuacuuauagaucuuguaguucagggagcaguggcgucucauguauucagcacaauguggaguuaugcuguuguuuaauguggcuuaggccuucuggcacuugucugccccuucagucuccgucucccaaauauaaacucuugaguuagccaaccaucggcuguguaaagacgucuuuuucuccuacuauguuuaguuguauuuucccuuggcuuauuuccugagaaacagacacacaaacacagacaguauuuuauguucuaagaccaaucacgcacauauggauuuuuaauacuucaaaauaauauguggauauauuaaaaaaauacguguaguaaaaacaaaaugucagaguacugcauuuauauuuaagauuagcaucacuuaagauuaguuuuauuucuacguaguggcaccuuguuuugcacaaaauauauuguguuguuaauuuauggaugagugcaaaugcauuuugaguuuuuaagucaccaauuuaauuguuauagauagcauuacuaaacuauuaugaugguacacaauuuuuaaccguuuagugcaucaugcuuauuagcaaacauuguuuuaauuuaucagaacaauauaauacagauaaaaaauuguaguuggugaauauaugaauuuguaaugauucuuuuguaaagcagcuaagcuuucguugauucagaacucugccaggaguaccauggacaguguuuuuacugaauuuaauguuuaugaccucgaauauuuaaaaauguguuuuuaauuuaagauuggcaaaggugacuucagugaguucauaguacaauuaaagugguuuuugugacaaacuugcugauuuuaauuuauaaaaaauauauuuuauuaccuucaugacauuguuaguuuugagaauaugaaggacagugaaauuaagacuaguaaaucaggaaaaacauuaaaaaauauuuaugauauggcuuauuuuuaaaguauauucuugcaaauaugauuagacaugaaggagcuaguauguuugcuucacuauaguaagauacauuuaaaaaauauuugcuucuuuccauuauucaaauaugcuuauuuuagagcauuuggaaaauacaaacagaaaugaagguaacaaauuaccuaguguucugccaucugaagaaaugaguugcuuuucaggcuuuuuuuuuuuuuuuaacauuuuauuuuauuuuggaaaaaaguuugcguguauguuuagcuguaucugcuuauuaguuguuuacaucuuuaguacugaaucguguuucuuaaccagccaugcaucugucaggaaucuaguuuuuaaagucaccuaaguuauucugauaguaauuguaauacaucacauguagugaacacaugugauauauaccugacauuaguguaaaugcuuuguguauguuaucuuuuuacguucuccugugagguauguccuuuugcuguucccauuucuggaugaagaacccaaggcacagggagauuaaauaacuugcuucaggguaugcaaaacuaguaagccacagagcagugauuggaacccagauccucugacucuggaaccuucucuuaagcacuauguuuguaaaauccaaaaauuuaaggucacugcaaugaaaccaguguuuggaaguuuuauaggaaaauaauauccaaguagaaaauuuggaauguaauuuucaggaagaaccacaggcauaauguaauaaaacaucucuucuguuuuauuuggaucauauacuuaugugcauauauauuuauuucauacauaaauacaugauguauugauuuucaucuagacuuuuuaaagcccuauuauaauuuuaucauugugauaguagauucuguguuuuguagccaaggugacacaugccauauuuuauuuuguaacuauauacaaaccuuguaucuuauauagcauccagaaauuggaauaugaaugaggaguucagugaagaagucuucauagcuucacugauuacuuucuuaggccuauaggaaagaaaggaggucaagaccuacccaagguucagaugccuuuuugacagcauuggcugugacgcugcgcuuguggagaucguugugccugcucaugccaucucgccaucucgcuuagucccuguccucuuacugggcuuccucuuggugcugccuugccugacucugcucuggauguugcccuagcccuucccuggucugugcuuacaauuaaacaauaaacaaaauguguuuauucugugacucuuggagacucugguucuccuuacugccaucacucaguuaauuuugugucauaaaguuuuauuuacacauuaacuagcaauuuuuccccagauaacauuugaauuuuaacaaucuucgagagguuaucuuuauuaccaacaguuccucaacaucuacugaacaaauacuugcauuuccaaaugaaaagggugaaucucagacacaguggccuguuguaccuucuuacauccuacagcccaucuucucuggugaugagccuuuguuuuuccuucuuguaagaaacagugaagcuuggcgaguaacccuggaggagguuucuagguaggaaguuaggaauauuuuucuuucaugaaucaugggugcucugaauauuugauuuuaagaaccacauauuagccuaccugauauugugaugagaauaaacuaagacuacucacucugcuaguguuguaagaugcuuagaugcagguaacuucaauugcucacccauuauauuuuccuuauuucuaucgguuuaauguagcguuugccuuuagauucuuguggccaauauucuugcauaaaauauaauuuaacuucaaaaacuuuuuuuuuuaaccaaguggcacccaaccaugaagugcuaccuguuuauaauuuguguagcugcugaacaguagcuucugauaaaucaguaauguuaacauuuuauuaguguaauggcaucuuagacauuuuauuuuaguauguaauuacaaaugcauguuuuugagaaacacuucagauuuuacauuaaauguaauggaaauuauuguuuucaugaacugaugccuaugaacagcaaacguuucggaaauaguuaugugccuguuucaugggccgagaagcaugggaaauuguuucuguuguuuacuuuuuuuuuuuccaguaauggcuuagcccuauuaaaauuauggacauuuaaacauuuuucuucaauuguagggauuuauaugaggauaauguacuuauucauucagacugguauuuauugagagccuguuaggagucagacuuugucagagaugaaggaaugaaguaaucugugaucucaagggaggaagugaacaauuaccuaaugagcuugcugugccuuaagaagagggagcgguaacuggcacugagaucuggggcuugacguugacuccuagcccucccacucaguacauguguuccuuucugucuccauuuccacguucacucauugaguggucauccacuauauguaaguuuugcugagcaugugacacuuaauugacacauggucuuuuucucaaaaagcucccauuucaguaugggagauaaauuggggaaaaauggcaguaguaugguaaauacucuauuuggguggugggaaucaggcacaugguuacagacuggagucucuagaugagaaggaauauucuauggggaagaggggaccggcauuccugcagcagagauguguccucuuuguacccauuguguguacacacuguacuagcacaguggugccgcgcugagcaagaggagcacugcagcugcggcagaaucucauugugguggaagacaggcacagcaagcaagcagaguguguucagggcugugaagaggggagacccgguagguagcucaugggcgguggaccuuuccaggauuugucaagucagggaagcuuaacugaguucauuuuaggaagugauguuuauucugaauccugaaaaauuuguaggaaauagcugggcaaagggguaaggcuugagaccuuauuuaaaaacauucaauuugguugaaucugugcgcagacaugugugaauaugcaggcccauuuuguggcuugcagauuguacuguuccucguuauucacuguccuccuuguaagaggauuauauggccuuugcccuuuugacaucaaguuugaccaugugacuuucuuuggccagugacagauacgguuucugagcagaagcuugaaguccauuucaugguucugucauugccuuuuucugucauccgugaaucagugugucccaugcuggggcucauucuugaaccauaguaccagaaugaagaugacuagaucagagcuccagcuacucacagaaugauauguuauugugagaaagaaauacagcuuuguuguuguaagcugcuaagaucuuggggccauguguuuucauagcaucauguugugacugagaagaguacuauaugugugucuguguguacaugcaaguguacauacuaguugguuuggggcugaggagccaguugccaguuaugaaaccaaagguguaaaucauggucaguucuuaugggccuuguaagccaaguuaagaacauucaagaugaaagaacaugaggagguugacaguucagauggaccucccuggcagccgagucuguggagugaagggagggaaguuaaaaacauucgagaugaaagaaugugaggaaguuugcaguucagauggaccuccguggcaucugagucuguggagugaagggagggcacgcuuggaggcggggccuucaggccuuccugcgcuugugucugugagauaaaggccugaacuaagguaacagggaaggagaaaaugaaacugaaggagguaaacuggaauuuggagacugacgaggagagaaaggaaagcauuccagggaaaccccaguuuuuugcuuggcuacuuuggguaggugauggugucauuaaccagaaucaaaaaugucagugguagauuagauuugaguggggaaauaaaaaguucucuuugagauacaccaaauuugagguacuuguggauuucccagaggcauccuacauaggcacuuaggaagagagccaggggauucagggugauuguguagguagcagguagccaaggcguagaggagacuacaaggaaaaaguugugugaagagagacaagaaccuaggacagaaagccugagaacaaaauaucuugugggcuggggaaggggaacuggcuaaguguacuggaagggaaugggcauagaaguccaauacaggaaaaaaaaaauacuguacaacgaugucagaucaggagaggaaaguuuagaaagugucaccuacuaaacuucguccuccaugaucuugcuuuaaaguuuguuaaauugcauuuaauuuaauuucuacucucuggucuugcuucauaguuuuuucgguauccucuuaaaugccccccuuccuagcauucuguaaaguuuccuauucuuugaucaucugugauguccauaauauaucaguuagaguguuucaauuuauguugcuaauuuuuuuuuucuacuacuggaaacauuuuuaugauuguuaucuauuuuauuacuucaagagcgcucuggauucucaccgaugccuuucuucuuuugagaucccauuccucugggacuuugcagcugcccuuucauuccuucugucuuacuucccuuccucucuguccuuucuucuuaccucccauucacucaucuuugggcuuuucucuucuguuaaaaggcacucagguuuuguuuuuuaauuaaaaaaaaaacuuugcuaaaguuuuguaacucuucauguuuugucucaucauucauuaaacaaacauuucuacuccaacuuacugcaggaauuaucccuuucccccaucuacuccugacucauuuaacccuugccuuucuugcuucuauccccaaaacacugcuagaacugccuuucuugauagccuugauuuccugauuaccaaaaccaguugcccacugugggaccauaaaaggcuuuauuuaccacccuuuuuuuuucuugguaaugauacuagccucuuucuggagcuauucuuuccuuaucucccuuaguugacuccauuuugcucaugucucaggacaguguguauuguaaugcuggauucuugauguucuucuacucauucucucaauuaaaaaaugccccauaauuaacuauggggccacaauccugaggucaaggaggcacauugauaaugacucuagcugacauaauauacuuagcauuuauugacuucaaacuguguaugcuuauuuagauauuuaaaaauuuggcuggcauuccugggucacaguauauacucugcaagauggguugauggagagccugauuucgugguagcugcuauuuacugggcugucuuccuuccucuccuccacuaggauguauuauuucacauacuugguuucaucucacuauguugacauauugcuuucaucacagaaucuggacugcauauuucuaggugaaguaaucuaggugaugauuuaccuauacuaaaauccaguauugauuuucaauuuuagauuggcagucaauugagaauauugcucaggaaaugcuggcuuuugcuguuuuucaaguccucugccuuggugguugucuuuagcaucuccaguaaaguuuuauaaaaacacaugagcuuuuagucauuugcuacuaucuguaaauaaaggucuacaaaaaaaaacuaaaacuauguuugauuuugguggccagucuuggaagagaggaauugaggaaauacaguaguuaaugaguaguggcauaggauaggggaggaaaauaaauugaauccuggaguuucaguaggaaucaagugcacuuggguagcugacaaaguugggauuugacuuauugcuccaguauucucucuuagauuagccuaugugcaaauauuaccuccacaucguaaacuugauuggucucuuugcuucuaguccauucuauacucaaauguuacauuaauguccccaauauuucaucaccuggaggacuccagacugcuaaaaugccccuuuagcaauuccugaccucuucucccuacaauaugagaagaaaaaguugcuguagggaaaucuacuaaaagucaaggaugugacaguauuccucacugaauuaagcacuaaguauaagagagcuauuuuauugcuaagauugaugaaugggcauuaguacauuguuaaugcacuuaaaaggguauugcacuaaacuugagcucuuugaggacagagaccaggcuguguggucuuccagaggaggacacaaugugcacaguggauaauugaagaaugcaugcauuaagaaauuaaugaaaguugaucgguaaggacauaacugucauacacaaacucagcacaguaaauuugaagacuuuuauuuaaagcuuugaaagucuggccccuugcugggcuuguguagauuucuuuagaaauaggauaacuuacagcaaaaauuuauuaaauauaaguagcucauugcagauauucaugauuugguaguacauuguaagaaauaauagauuuauucugagaauaugcugcugcuuuucaccugguacuauaaucugcucauauaauuagaaccuuuuguguuaacauuucaauaucugacuaaaggagaaacaccuugggauaguuaggcuguugaagacuaauguaagcuuuuucaggugggcaguaacugaccuguuuuacucaaagggaaacuuaaguuuuauagcaagagauauggagagcuuguauuuauuaagauuuauguggauaaaauuuaguucguguuuuuugaauugagucuguaggguaaauuugaaggucucccuuucuccucugaauucuagcuauccagacauagccacuguaaggaauuuuuacagugugucuuucccaguuuugcucuuguagacucaaaaaugaaguguguguguguguguguguguguguguguguguguguguguuuugagaugagaucuugcuguguugcucaggcuggucucuuaaauccugggcucaagcaauccuccugccucccaaauagcugggauuacaggaaugcaccauuguagcacagcuguauuugaauuuuguuuuacaaaaauuggaucguaggauauacacuuuucugcaacaugcuuuauuaaagaaauucucccauauuucuauaaaacaaaaguauguauaaauauaauuaucuuuuuaguagcuguauaauccauguaguaaucauuuucuuaacuauuaaugaacacuuugacuguuuccacaguacacuguuucaguaaugcugcuaugaacauuuuuauacacauaucuuucuauacuuggguauuuccauaaaauagauuccuaugagugcaauuugagucaaaggcuguacuuguugaaaauauugauagacuaccaaguuauuauucaaaagguagggggcccuccaguuuaugcugccacuguugugacuaugacccuuuaccuaacacugcauauuaugaauuaaacuuuucagucugacagguaaaaaguaaugugucauugguuuuaaaauuuguaauuccuuauucauuguugagaaugagcauccuuuucuuuucuuuuuuuuuuuuuuuuuuuuugguuuuugagacagggucucacucugucacucaggcuggagugcaguggcgcgaucauagcucacuguagccucgaccucccaggcucaaaugauucucacgucucagccuccugaguagcuggggcuacaggcaugugccaccaugcccagcuaauuuuuaagaaauuuguauaaagauguggucucacuauguugcccacacuggucuugaacucuugggcucaaauggucugccugccuuggccucccaaaaugcugagauuacagacacgagccacugcacuuagcagggcaucuuucaugaauguuucuugccaucuuuauuuucuuucuaugugaagugccuguuuuucugucaagaaauuuguuuuauucucgucaauuuuuauggaaaauccuuuuuaaauaaacauuuugauguuuuacuguguuuauaaauaguuuuuccuacucagucauuuuggucuucugauuuuaugguauuuuugcuauuaaaugaauauuucuuuucuuuucuuuuucuuuucuuuucuugcuuuuuuuagacagaguuuuacucuuguuucccagguuggagugcaauggcgcgaucuuggcucacuggcaccuccaccucccagguucaagcgauucuccugccucagucucccuaguagcugggauuacaggcagaugguauuuuuaguagagacaggguuucgccauguuggucagacugcuuuccaacuccugaccucaggugauccgucugccucggcuucccaaagugcugggauuacaggcgugagccaccacgccuggccuaaaugaauauuucuuaauacuuuguuuucuuauuuuuaggggacuugaaauuuaacuaaaaagacugagugagcacuuauuuuuuaaaacccaaaauaucuuaguguauuagucuguuuuuacacugguauaaagaacuacccaagacuggguaauuuauaaaggaaagaaguuuaguugaaucaguuccacauggcuggggagaccucaggaaacuuaacaaucaugacggaagacaaaggagaagcaagcaccuucuucacaagguggcaggagagaagugagugcaagcaggggaaaugccagaugcuuauaaaaccaucagaucuccacucagucacaagaacagcaugggggaaacugccuccaugauccaaucacuucccucccuugacauaaggggauuaugauucgagaugagauuugggugggggcacacagccaaaccauaucacuugaguuacagcggauagcuuggaccccauuccuuuuacaucuaguagguagcaguuuaucagagcuugggcggucuuuuuuuuccuuaaaugagguucaaauuuauuaaacucucugugacuggacugcgugguaucgaaagaagccuuggauguagguuuguuaaugagaucuuuaaauguugacuaguuuagauguuuuaaguuccuaauuuuucauaugacuacaaaaauacuaaaauaauuuuacuucagugacuuugagaagauucucaaaaugaacuauagggguguuuuuuucuguuuuggggauaaaugaacauaaacaaaacuccccgaaaaccagugcgugaacuuuuaaaaguucaaaaauaagccaugagcuuuguagaaauuagccuuacugauaguuguaaauaguuaagguugucugauuacuuaaaacuucucauuaacuuuuuauuuguugugauguauauuuaugaaauggcuuuuuuuuucaguuuauuuccacaaacaucacaguaaagaaaauaauugaagauugaaaaaaguauaauauuuaaaaaaaaaaccaaguuguuuuuuuuuuuuuuuucaauguaucuuagagaaucuucuaugagauuugggggaggaguauaggaugucuaggaaauggcauuuucaggggaguuaaucuauuagaaaagucauaauuaaaacucugaguuaguagaaaucaaauauuguuuaauauaauucgucaacugaaucugcguuaagacauucaauaauuguauuauuguuuugccaguuuaguuauuugauugaugcaaaccugucaucuguacaauaaaaaaauagugagguaugucuauacucugucaguuuguuuaauuuuaaagcugaaaguuaaauuuuagaacgcuuuucauuugcuuuuuuaccguaagugggagcagcuuuuaacuucacgaaaaccacucuccucaaagucauuaaagacuuucaugcugacacauccagucguuuaucuucugaugcagcagcaguugaucacaucuuccaucaaauucuuccuucacuuggucuucaggacuggccuguugcccagaccucagggucugaucccaauacacacucuuuucuccacuuauucccuaggugaaauauuucauuuuugugguuuuaagugcuaauauauuccaaauuuacaucucuaaguuuggcccuuguucugaacuucagccccauauagccagucccucauaucucuauuuaggugcacucuaggcaucucaaagugagccuguccaaaacuaaacucugauuucccaccacugcacucucaucggcaccgcacucucaucugcuucuucuucagcccucuccuaagucuuagugaacagcagcucacuuuaccaauugcuaauguccacagccuggcauucuucuggauuccuuucuuccucucagaccaugaucauaucuaaucuuagcagcagauucugucagcucuacuuucaaaauauuuuuauaauuuaaccacuuuucaccaucuuugcuucuuacuacugaauuaauccaggcuaacuucauaucucccaccuggguuguuccaguaaccucuuacuuagucuuaauuuauuucccuugucugccuuugcccccuuacagucuguuuccuacacagacauacacuucuaaaccuuaaguuaaauaauguaauguuucuauucagacuccccaauuuuuuuuuaaucacucaguguaccuugaccuacaaaccuuauuccuaauaccguuuuuucacuuucucauucugcuauagccacaaggggccugcuugcuauuugucaguuaugccaaccaggauucugccugggaucuuaguacuuguucccugggcuuagaauguucuuucccuacaauuaggcuuugcucaaguauccuagaagucuuuguugauuuacccuaugugaaacuguggggguagcacuuuggugaaacaggagcuccucccuaaauggcaagcuuuuugaauaccuuggcuugaguuuauucguaacuaucauggucacauuucuuugacaacauguuccaugccuagcagugauucaggcauuacaaccagucucuuauuucauuugauucccacaucagcaaaggauauauuacuauuauuuacauuucuuuuaguuaaauaguguccagaaaguuuaaggaauuaagaguuacagacauagcgaaaggguuuucuuucucccuuucugccucccccaagaaaacuacugacgugaaacuucauaugaguagauauaguuuauuuaacagcuuugcauuauucuguuguccguauucuaucucugucccuauccagagauuaauaaauuguauauacuuuuccacaguuacaaauguggauuuaaugaacagucuuguccauguuuucuucuguacugauguaaaauuuuuaggaugaauaccuagaaguggaauauuuagauucagauuuuuuagguccugcaaaauugaucuuggaaaugguucuaccaauuuauauuccaaacuucagucuucacccuccucaauauauucagauuuguugauaugcucuaaaguauuugaaauaauaauuucaauuuguuacccugauuuccgucggugagcauguuuucauauguucaucuagccuuuacuucccuuuaauuggauuucucuuuuuuacagacucagcuguguauuaaacagaauguucauuuuguauuauuguauaguacaaugauuacugauuguuuagucugccauacugcuggaacuggguguuuuccacccuuauuuuuauacagcaggaugagacgcagugccgcauagugguugaaagugacuuguuucaaaauugccagaguaugaauucuggcccacugguauuagcucugugaacaugguccacuuacuugaucuuccuuaggccccguuucuucaucuguaagacaggaacaguaauaauaccuaccuuaugggguuguugugaaaauuggaguagauaacgcauaaaaaguacuuauuagcacaauguuuagcauaaggcaggcauuuauacuguuguuauuuguagugcauugucaucauuaguauuuguggguuuuuucuuucccuugauuuuauauguuuaucuuuguaucauguaauguaacuuguggggggggagagauuuccagcaacauguuuagguuuaguauuguauguucuagguugacucugcauucuuguuuguugccguuucuuauuuuguguucaauuauagcuagaaaugauaguaccuucuucaaaaguauccuuauaugagauuuuuuugaacaguguaauguuauaaaaacccaaucagugauuuugagguuuuuguuucauggaacuuuacacaucuuaccauauucuuaucauauucuguaucccugucuuugaguucaugccuauuguguauuccauuacuuaccuaaagaauuuguuucagaauguacuuuuuagaaaucuauauguguauguguuagccuaggauauuuauuuaacaguauagaagauucucaaaaacaggaguuaagaguauuauucuagugaacagaguguuuccauaaaauuaaaugagaaucuacuucacugauugguucuuuucaccaugauucuguuuugcaaagagaauuaauuaagaaaacuuaauugaacagugagcugguuucauuagugucacuuuuccugucgagguucuagguuccuuuuguaaguuacuacugauaagaauccuccuaaacagcuugaccuccuuucagaaguccgugugcugauuuacacagcuuaccuuuuuguuuuucucaugccugguacuaagugacauuccaaucugcuguagucauuugguaaugcaaagagugaaacuggaaggguaggcaggagguaccgguuggcaccaaauaugcaguucaagaucacucaugauaccagggagagaaugucaaauacuugaaccagaacaacacauuguuuuaguuuguaaaauuccaguuauaaggcaguaauagucauguuacucuaccucaaaauuauuuucuuucucauuuguucuuuucaccucugucccaaccccccucucgcucauggauguguuuugugugaaaugugaaaggucuuaagauaguggaggcuugaaaaaacugccuguguuuuaaaaugugcuuguguuuguuuccuaaugcaguacuuugaagauauuuuagguuuagguaaguugcuuuaaguuuuuuuuucuuaauuggaguagguugagugcugugaauucaauuuuuaguguacuauaaaaagauagauggaagcacuuugauuauaggaaguuucuuugaaucauuugcuauaguuugaguguuuacuuuaaugugaaacucacuguaaauccaaguaaaugcugaucuaccaauguucauguauauaauuuguaugguacauuaucuucaucguucaaauuuagaaccuucuuauuauuucacauacuuaaagaagaaucuuaguugcagauucaagaugaagauuauaaaacauuuucuuggguuuucuuucaguauuauaauuuugaggcugaauuuaagaacaugguuauuuucuguagacaccaaaacauuuuauaauuuuguguauagguugauuuggguagaucaguuauaucacuggaaaugauuucaacucucagaaauuguauuucaacaauauaauuuuuuauugugugugugugugugugugacaaagucuugcucuguugcccauagcuggagccgaucucggcucauugcaaccucugccuccugcaagcgauucuucugccuccugcauucaggcgauucuccugccuccugcauucaagcgauucuccugccucaaccuccugcugggguuacaggcacccaccaccaugcccagcuaauuucaacaauagaauuugaaauauguauagugccauucuauuuuuucuacaaaguuugaugguuuucauuuuucacgucauauauacagaucuuuaauauauacucuguuauuuuuugcuuuuguauuuaguuuugcuagagauagguuuuuuauacacauacacauaaacacaaacacacaccuuucuuuuuuuaacuuuuagggucaggggacaucugcaggguaugcagguuuguuaccuagguaaauguauaucauaggaguuuguuguacugauuauuuuaucaaccagguauuaagccuaguauccauuagauauuuuuuucugaucuuauuucuucuuccacccuccacccuccagugggucccaauguguuguucgccucuaugcacacccaccuuuucaacuaguucuuguguaaguguaggcaguugagaauuuguagacaggaaguaauauuuaucaagugccucauauguggcagguuccuuuauauagugugaaucaguuaguaaccaccaaacccugugaaauaguagccccuccacuuuauagacagggaacuugagagaacucaaguguuuggcacagauucauguggguauuaagugaaaguaaaauuaagugggauuuuacccaaugucuggcuguuuccaaggcucugccucacuugcuuuuuguaugacacaccuguugcuuguugaguguaagcaagcuauguuuggcuucugauguuaaauaauucauuauccauuuucagaaccaaaguucuugaguuuuuguagcgcauuuuuaaaaaaaacagguuuacuuuauuuugcacuuaauaguugguaauuauaacugaauuauuuucauauuacacauuuuuuagcgugaaaauuuucaaacacaaaugaaacucauucccuagacuucacaauuuucaguuugucguucuuaauuuuguuguuuuuaggugcacuguuuuuuaaagcagauccuaaaacccgucauguuauuucuucccuacuucagugugcaucuaacaaaaauucaaccaucaugcaauaaucucauuaacaaaauuagccagaauucuuuguuauuaucuguuauucgguccauacugagauucccuauaucucucaagaaugugguuuugcaguuaauuuauuugaauuggaauccaaacaagggccacacauuauauuuacuucuccuacaucucuuuuaaucuagagcguuuauuucaugccauacacuuugaaaauauugggcuacuuuuucuguagaacaucucuguucuagacuuaccuguaucuuuuacagggugguagugguuugacauguuucucuagcuuuaaaggcuugaauggauucagguccaauuguuggacaaggcuuuauaagcagugcuguguauuucauauugaaucccauuagaaggucaaguggugacagccccuguacugucaaguuccuuaucacuguuucauucggagaucuuugucuaaaucaguuaauggcuacaaaauggcguuuuucuaauuccauuauuucucuuuacauuuauuggcuggaauucuuuaaaagauauguagacauaaauucugagcuccuguauugcuuauuuuccagaguaaggaguugguugcucuaguuaccuucagugcuaacauugauuuuguuuuguugguguucucauuuuucuuugguauaaugagcugguggauuuuuauguauuccauguuucaguaacuugaggucauuucugcugguauucagauugucccaaauuuguccagcugcaguuuuugguuggcuagaggguucuuuugauaugaguuagucuuugagaacuuccuuguuuuccagcauaacaagaugucccaaacucaucuuguacauuuucugaccuagaccuggauuaagccauuucuccaaguagcugugguuucuuuuagugguauuuaagagacuacagucuaagugcuagagauguucauuuuuacagauuguuguuugcuucugggccuuuucagugggaaaaacuaggagguauuuauauuuuguggggagaaaaaucuguauauuucuacugauguuuccaauucagaauggccuuguauggcuuuuacuuaauuuauuuaauuuuauaucucuuuucucuuacauugaaaaccuugucacuguauaaacacaacuaccuguuggcuuuauuguaucauauaguuauuauuacaacauauugccaguauuauuacuaacaacaggauaucugaaugggcauuuaaaaaauucugcaaaauuauuugcagauacugacuugucaguagacuagucugcuggcaauuuaaagucaaaagcuguuguccaaaaucacucagaaaaaaaucuuuuuucuguaugcuaauaugaccaacuugauagagaguuaagacucauucauuucaguuuguuuuauguuuccagcgauugucuuuuuuuguuaaauaguuacaugguuccagagcugaaacugugugauaaaguacauuuagaaaagcuuugcuuccaucuugauuauguuuugguuuguucaugcauggaaggcaucucuuugaagauguaaccaaauacagguuguguguuuguguccugucuuuucauauaauagaugcuuaugacacaugcuguugugcguugugcuuuuuucacuuaacuguguaucuuaugcaucaugccauaucacaguauaaagaguuuugcccuaacucuuaauggcaccguuuuauuccacucagugaauauacgagaauuuuuucaaccaguucccuacugcuggaucauuuucaaacauuugcuuuuauaaacauugccacagugaauagccuuucgcauuucauauguauuuuuuuuaguguaucuuugguauagauccacaagagaauugcuguuucaaaauguacaugaguaucuaauuuuaccaaauguugccaaauucugcaccuuggguauauacuuuuuuuuccccuucagccccacaaaaagacugguuucaaaccuucagauuuuugccaauuuggguguugaaaaauggcauuuuacuauuaguauugucuauuuuaaaguuguuuuauugugggugagguuguucaucuuuuuguguauuuaagggccgauucacuacuuuguaugcugccugaagguuuuuuugggugcccauuuuucuauuggguuauugguucguucuucacaaauuuuagaaacucuuuaucuguuaaagaaauuauauuucuuucugugaaacaaguuggaaauuuuuuucccccaguguguuacuugucuugguacuuuaccuauugugugcuuuuugaauuuuuugugauaucaaaguuuuacauugucaaacuuauuaacauuucuuuaauugacuuuggauuucaagucaugguuaggaagcuuuucuuauuucuaaguuuucauggaguuuauccauuuuuucuuguacuuguguuguuucuuuuuuguaucccuugaccauuugaaauuuaucuuaauguacagugugauguauagauccaguuuucucuuugccgucugucugucccaacacauuuaugaagaacuucgucuuuuccacacugauuugagacccaccuaaaagucuagacuuuuucuuucauuuaugucaaggugguguuuuaaauagagauuuuuauaguuuuuuuaaacaucuaguaggcugacccuucauauuuauaauucuucuuuuccuggauugcucuggauuucuugcuuauuuuccucauaggaaauaaaaucuuuuaaauuagcuuguuuaguuccaggaaaaaaagaaaaaccaacaaaaccauuguauuuuuaguuacuguuuucuuaaauuuauaaauuaaguguguaacuugauuuuuuucagaagaaaauaagcaaaagguuuuguuaauauuacaagagaaauucuguuuugaaaaacaaacuguucaaugaugauauucaguguaauuugacuucaaauuugucuucauguccuugauaacuauaauuuuuuguugaaauugaguuuaguugacacaguuuucaagguauucuaguuuacuuaaguauuugaagugacauggaauucauaaauuaaucuuuuuuaaaacuauuaaaaugaauacaguugugauaaauuguuuuucgugugcuugacaauacugaucuaguuaauuggacgguugaacuacuuguugaaaugagccaaguugucuccugccuccaggaguaccuuggcaaaugucuucuuucuuaaaauauuuuuaaaaauuauauaucagaagauaaguuuaaucuuacaaaacgaaguaguaagccuggccacauuacuuagugaaaaaaguaggugaguucagaauccacucugcauuacugaccaaaaguuaagucuuugugaauugaacuuauucuugcaguuuggucagguccagucaccuuucuuauuuaauuuaaaaugaggauuccccccuuagcuagcauucauugacuuugagaguacuagaacagccugguuuauucuagacaguaggaagauagcuuauagcuuuaacaacugugguugauuuuucucggagcuggaauaacaucaggaauuuuagacuccaguggucacuuagcuacaccaaauagugaccugaauguuuagacaagggccuguauuauuuaaaccucaggauuguaguggauaauacaacacuuuuaggguaaaauucugcuuuaagcaaauuguguucacuugugaugcaucauuacuuuucugagaaaugauaagucauaguacaguagucccaccuauccacugguucacuuucugagguuacaguuagccaggaucaacuguggucagaacauacgaaauggaaaauccaaaaauaaacaacuaauauguuucgaauugcaugacaguuuaaauagugaugaaaccucuggcuguccagcuauguuccacccgggaugugaaucaucccuuugucugucaucuccaugcuguauaugccuguuagucacauauagcugccucauuuaucagauagacugcugcgcugccacagaacuuguguucaaguagcgcuuauuuuacuuaagggccacaaaaugcaagaggggugaugcugacauauuguuauaacuguucuaguuuauuauuguuaaucucuuacugugcuuaauuuauaaacuuuauuauagcuuuguauguauaggagaaaaaaaccuguaguauauauagagcuuugugcuaguugccauagcagacguccagugggguggggggucuuggaacauguucccuacagauaagggggaacuacuauacacauuaugguuggaaggcuuugaacuagaaaagugaaguauaauucuuuaugugcacauacucuuagguacuauuaaauugguaguuaagucuuggccuacucuaauuuacuauaguauuuggcuagaaauuggguaauucacucuuuuauagaaagaacuauaggucacuggauagccauguauuugaagaaaguaacauacugaugaaauauguaguuccuacugcacugugcuaggugcuuuugugcauacugucucauuuaauucuccaccguaacauggagaaguugguacuguuaucuccauuuuuauacaagagguaucugaggcugaauaccagacaaggcuaaaacagaaacuuucaauuugugaaaaaggaguguuuuagugucauauauauaugacaaauauauuuauuaagccuguuuuauguuugagggaaauugggugcauaaaaaggacuauuuuugagcuuuuguacauauuuauaaaauuguauaguuuuguugucacauaugauggcauauauuuauauaucuuaauggauaauuuuugaagcaucacuuuguaagaaagauguuuacuacacaguaaaaaguuuaaaagcaauguuaaccucguuauuuauacucacacuguaaaaaacugaacuguucauggaaauguuugcuaugauuacgguaagauggaagaggaaaguaucuugaggcuuaaaagcuguguaauuccauucguaggaaccaguauggcuuacuaaauacaguguugucauuuccugugaaagagagagcgagagauaggauggggguggggauaguugauauuagagagugagagagaggguuaccagguuuguaguucagggaagugccuuagucauaauguaucuggacuauaucaaggacuucaauaauguuuuucaccacguuauuguguuuaagggcuggaucuaaaauaauuagaugaaguagaaaccaguugauuaguuguacucaaagacuguuuaacagauuuuugccaagcaggagaaauguuacuugguaaacuaacaugaaaaugacuugggaauuuuaauuuuacuggcuagauaguucccugucacuagauuuuuuucaggggguucuuaaguugaagucuaugaguaucauucauggggccuuugaacuuggaugagagggggauuacauuuguauuuccaauaaauacauccuuauuaaugauaauguagcauuuucuucacucaugaguuuauuauacugauuacuucaaaauccgagcuguaugaaccugaaccaacuguagaucuuauguaauauguuaauaaagaagcacuuauauuacuacauucuagguuuuacagauauuuuaguuauguuuuaauguaguccuuugagaaccaacucauagccuucacuagauguccaaacagugcauggcaaaaucaguuauaccccuagacuagauaguuggcuuuaggguucuguguuauguacauguguacgaauauaguauuuaaagauuaugauugaguuauaaacauaaucuuuaaucacagaugugauaauugcuuuuuugucaugaggguuuaaaauguuuuuaauugauuaucuuucaaauuuccaguguaugucuguguggguaguuauuuaaaaagaguuaaacauuuuuaagaguacuguggggaaaacuuucacuuuuugauccccuuuccauaaugcugacuaagaguuuggguagauuucuaauuccagugaaguccagcagcagagcacugauuucacuugcuuugaaaguuggcaggguuauggcuuacaaauguguagcugcugugagcagaugauuguuaaguagauaauguuggcaguuauaacuggggcaauuuaaaaaguauguuggcuuguugguuuucacagcaggcuguguuuucuggcagagaauuuuguuuuauuuauaacauuuagguguuuggguacuggauggauuuuuguuagaguucauaaaaagggagaucugugcaaucgugugcuuucucucuguuuuguuaguuuucuuaaguccagaaauauuuuguucuuugcuuggaagaugaccuuuucccacuuucagugaacuuggucuuucucagauuuggugaauaagcauuaagauguacuucuaguacagugguugguucacauuacacaguugugcauugcuguguguuaagcuuaugccuuuauuuucagacaaaaauuuaacgaagucauuugauuuuaaagaccacauguacacaugaagguguaaauucuuuuucuagaauuggauuguguuugcuaaguugcucucaguugcuuguuugccaguuuacauugccggcaacagaauaauagugcccuguguguaaguccauacuuuacugugcucauuuuauaaaugaggaaaccaagguuaaagacaaagcaaauugauugaauuuuuagagaaaauuauuuuguggucgggaaggucagaaaauucuaagguaauggaauuagugcuaauagaaaacuggguuucuaggagcuuuauaggaaugaggagugggaggaaagggcuaggaagacgguuucuugggaaugaauacaguggaaagaauguuagccuggugaagaaauuuuauggccguucuuguuuuuuuuuuuuuuuuuuucuuuuucaaaugcuuccagguauauuauuugucuuguaaaaauuuuagguaaugaaauacauuucauuucaaauaguguucuugaaguauuaggauuuaaaaauaguguucauagaaaagauuucaaaagcccauauucaaauauuucuucuguccucuaccuaaagcuguuaacaccuuaauguuaaguaggucaaauggcuauugccgccagguuguuuuguguacuagcaacugguguguguugaaggcacagcuguauuuuuuuuaaccuuugcacauauuuuguagacaccagcauaagaaauaaauugguugugugcauguguaacaaaguggacaguccgucaguuuccuccauggggaguaggaauuggugaucuguuugaaguuagcguuguuuugcuacuggcuaggacauggguuucgucuaagugcuaaccauagaagaaaaguaaauugugcaugguugaccuauuuaaguuuuagaaagaaugauucugauuagcuuuaucaaaaggagguuuaggguuguccuggugaauuucugcuggcuuggagaauacagccaguugauuguuaguuuuauuaaugaaauacugauauuuaaaagaaaaucuccaccuuuaauucuuuauuucuuauauugacucuaauaauuucacaauguagcuugguuuuguuauuguuguuuuuuuuuuuuuaguuuuggaucauuguauucuuuugauaagcaugaaaagaauuuuguuuuggaguugaccuaaagcaguuuuucuguuucaguaaucauuggugauaauauuucucagggaaaaguguguaucaagguaaauguuuaccaaacaaaguuguuuuccuggcaggagaaauaaccauuaaggaaagguuuccuucccuuugaauuaaauuauugagacauacugagaugagcauuguacgcugacuguacugaugaagugaucauaggcaguuauuaucuuaccuauucuaaauagaaacuucuuucugaaaacgugcugcuuccaaguaagcucuucauuuagguauuaaguaccuacagcaaugcuuuuuuuuuuuuuuuuuuuuuuuuuuuuagaaaccuuugucuuuguaagauuauaacuagguuggcugcaacauauuagacuauuaauucugcccuugagacuuuauggcuguuuauuauaaauuuaaguuuugcuuuccagcauucuuaucaauugagaacagacaaccacagcuggcagaauuaggucuuguuauugggcaucuugacucauauuuguuuuuauuguuauaugcagagcauuguauuggauccugagggaggaccuagaauagggaauaaaagagguuuccuugucccagaaaagcuauauucuagugggagagacuguaaagaagaaaacuucucauuguugagcacuuaccugugugugagguagcaugaguugcuuuauauauuuuguuuaauccucaaaacaagcuuguuuucauuuuauaaaguggagauuugaguucacauagacuuuaaauaacucacucaaggauguggcugucauguugaaaugugaaccuguucauguccuguugcagccccccagauguuucugcugcacuguaggacagacagaugucuagacgugguggaugagguugauuaggcacuguguggggcgugagcugccucggagucccucgugagcaggaagaauacuuguauuugaaugccaggccugucuagguaggugauggucucaagucaccaacaauuucuuucucucauuuaaccauucauucauuuguuucuucuggaacuuuucuuguaccuguuguaagaucagagaaaaauaauuagugucaaacucccagcagagcauggugauguaggcaggucuggggccaguuaaugcuggcuguaccucagcccugcugcugggcaagcuagguguugguggucaguguacuucuuuggaccuccccuccucuccccaacccucugcaccccuccucuccccucccuucauacccaguuuucagguuuaggaacuugauuuuauccauuugacuaguuuugauaagauucuguggaauuauucacaacagccaaacaugauuggcaaaauaauugagcagaauguuaaucuguuuauuaagggaauauucugggaacagguauuaauacauucuugugugaugucaaacuaaauuaauauuuauuaacauguagugcaaaugaaauauacuaaaacauaguuuucauaggcuuuauuuaggcuugguagaaccuggaacauuguuuccaggaauacucuuacuuuucuauacacaggaaugcuacugccugaugaggacaccaguaucuccuuacucccuuggguuucuuuuuuuucucucuuugaucucuuaacauuuuauguaagguaaguagcugggccacauugguaauaaagauuuuauguuugcaguuuccuuuuuuacagugaagggcaguaauuuauauguaaggaauuuucaugaaggugacuuuaaguggauucuccucuuuucccuguuugucuuuaucagcucauucuggauucuuuccuuuguguugcugauguuaaugggcauucccucucacccuugccagccacagaugaugcuucuguuuuucuuuugguucuuuaauaucugguaauuuggaauuauuuguuggcaauucucagggaaacuggugcuuuuguauuucuugucauccuuugguacaucuggccuguuuuauucugaucacaacuaauguaaaacuauuuuguuagcaaaaugauugaguacuauggagauuaauugcuuuuuugcuuuaacuucuuguauaagggugagccuuuggagaagccuggggguaguuuugccaaugaauauuuuagagacuauuagguuuaguauaaagaugguuucagggugguagugugaaaguauuggaauccuggaauaaaaauacagcucccaugauaaaaucuuaaauuuauacagcuaaauuuguauagaaauuuuuguuuucuaaagugccauuuuaggaguccguggaaggggguagcggcagaugcuugaaugauuccaagagguacagccagcagauguggggagaacgaaggugaaggaaagcuggggagacagugcguaggacguggucagcacaguaccuggcacauaggcggugagcguggccugucauuaauauuaccuaagacucacagguuuauaguguaggagcauguuucgcaugcauuuuuaguuauaaagguuugguuuuuuuuuuuuuagaugaagucuugcucugucgcccaggcuggagugcaguggcgcgaucuuggcugacugcaaccuccaccuccuggguucaagcaguucuccugccucagccuccugaguagcugagauuacaggugccugccaccacgcccagcuaauuuuuguauuuuuguagagacaggguuccaccaucuuggucaggcuggucucgaacuccugaucucaggugauccgcccaccucggccucccgaagugcugggauuacaggcaugggccaccgugcccggcaguuauaaagguuuuaggguugccagacuaacauagagauggacauguuuaaaaggaugucagguuugcuuuguuuguuacuugacccagaccagacuaagagguuguugauagaauuucugagagacagcaggacuccuacucauguagcucccauuuugccaacucuuuaagcuuucucaggucucgcacccaaaacuauggcccuccuuuacuccagaaucuauggguaaguguuguuucugaacauacaugcucauuuauuuuguauuuucucuugguauaguggguaacaagacacccugagcaagcacuauaaaguuucagggcuagaaaugugccuuacugucucacuuuuuuguuuugauuuucauaaguuuguaugguuguuaacccuguucuaauacagguuaagugucucuaacuugaaaaccugaaauaugacaugcuccaaaaucugaaauguuuugagcgccaacaugacacucaaaggagaaaugcauauugcagcauuucagauuucagauucucagaucagacaugcugaaguguaucaugcaaauauuccaaaaucugcaaauacucaaaauucaaaauaguucugguuccaagcauuuugaauaaaguauucucaaccuguaucccauuucuccuauuuuucuucaaauaaguacuucuuaguucauacuuauuagucaaaaagaggcuaguggauuggggaaaauuaaagaaaggcuucauucagugugaugggcuuugaggaccaaaugguuugacuuuugagaacaugaaagccauugcaaaauguaaagccaaggaaugauguguugugacuuaguuugaacaggacuuugguuggauucuggguguauuuugauggaucagauguggaaccaaggaugacuuuaguugaacaacugaaucuuuaaucuugcuugagacaguaaaagugaccuaggaguuagaaauauucucuggaauuuuuguugggaguugugcuuuuucugugugcaaggaaauaaugggaaaggacaucccacaguugugagugucagcccacauugcaguagaugauaccuguggaggggauaccuuuggcuggaauaccaaugugcuuuuucucuagagguaagauuuugagacaaaucuaaaaugcguucauugauuaugggcaaguaguucauuuagaaaauuaguuacaacuauuagguuggugcaaaaguacuugugcuuuuugccauugaaaauaauggcaaaacccacaauuuugcaccaacauaauauauucuucaaaaauuaagaguuuucauuuauucacauuaaugguugggaccaacauuucccucuugcuuuuuaaaaggaacuuguucauuuaggcuuuugacccuuggagcuggaaagggaccucacgggcaguacaggcacggacuuuggagucugguggaucugggucuuaacucuggaucugccacauaccagcucgagcaccgaacucaacucuaugaguuuggacaacuagaucuugaaauaggguuaaauaauaguaucuguugagcugcauucuuauaaauauugagugucauggugugccuaccacuugccaaggaccaauagauguuagcuguugauaacaucaucuauuugacagccauuauuucauacgugacacaggugaggcaaagagaaauuguuaguaacuuguucaaagucagaaaugaaacuugaagacuaaaaacccaucucucuacauuagucucagauguuuaugaugaagcauuuuuuaaaaaagugaacagacuuccucauuuauuauuacaaaaagugaauccuuuucagaauguuguuuuccaaaaauguaccauuuuguuuucuuuuaggauuuggaguuccauggagugaugagauuuuauuuucaagauaaagcugcuggaaacuuugcaacaaaauguauucgggucucuaguacugccaccacucaagauguaaucgaaacgcucgcggagaaauuucgaccugauaugcgaaugcuguccucucccaaguauucacucuaugaagugcaugucagcggaggucaguguauacaggaaggguuugcuagaggcaugaccugaccugugaagagacagcuuguccagggucauuguggucaugucagguuuacugcucgucuccaucuuucuucucuuuugguggguaggagaguagcuggcaggcugagaaaacuguuuuaugucugggaaguguucuuauaaaucccuggcacauauaucuguuggaaguuagaaugaauauauuaauuuugcauaugcuuauuucuccaaagauaaguaacguuacauuuauccaacauaucugggugucacauacauuguguaguaugcuaccugcuuuuugagaauguuuuauguggcucuuauguagagauuauaauaauuguaacacaguuaaauauuauauagguaugagucaucaaucuugcuguaauauuuuugccuucugaaacaauacauuuucauuauucuuugggaauaauuuaggguauguaucuuaaggaaaccuccuuauguauuuaguaauuucugcuuguauuaacauuagaaauuucugaaaauaucuuauauagcaauaucaaaugacaacuaaaauuagacugauuaagaaauguggaaauuuagguaagugccauggcuuaugccuguaauccugacacuuugggaggcugaggugggaagauugcuugaggcaacauagugagacccgucuccacaaaaaaauaaaaaaaaaaaguuagcuaggcaugauggcacaugccuguagucccagcuacuugggaggcugaggcaggaggaucacuugagcucaggaguuugaggcuucagugagcuaggaucgugccacugcacuccacccugggugacacagugagacuuugucucuaaaaaaauuaauaaaaugaaauguagaaauuuuuaaauuuuuucauugguguuuuggaaauguugaguaaccuguuuuaauaaaauacagauuacaguuggugcagcaaauaaaggauuuauguauagcacaaaccuaauuugaauaccucuuuuaaguuccauccacagaucuuuuuugaaccuuuuuuuuuuuuuuacucaaaaaauacugcuuucuuuguacauaugaaaauagacuaaaguguuuguaauaugugggauuuucaggugugacuaaauccuuuuucccucaguaguauguaagucaggccauuuuuuguuguuguuguuuguuuacuuuuuuucuuaagguuaucaucuucaucauuaaugccaaaacuaaauuuaacaauagaggguguucucaauuuugggugauuuuucugaagcugaguuuuuccuuuaccuuagaauuuuuguaaauagguuacaaagaagaauaaaaucucucucacuuccaccuuuuuuuucuuuuuagucugugcuguucaguuaguugaauacugucgagugugaagucugaauaauauguaagauuggaguuugaggucuaaaaauuggaugaauuugauuuuuuaaagaaaagggugaaaacaaaaagaugguuaaagaagaaggaaauagugucuuccccacucccucagguacccuuccacaccuuugggcuuaaagugcugguuuuuuuucaccagugccucagguaugaggaaagcccuagcaugcagguucucagucuuuucuggguuacagaaaccuuagcgucucagucauuuuuuaauaauggcaccgcuaggccagaggaaauaccuaauaguccguuucauuaaguaguuagauucagacagguuuaguaaguguuuaacagugaacaguuagguagauguuugaaaaauaguacacauaaaaugauggaaaacugaagcuuucauuuuauucuuaaucacagcugcugucugcugggacaguugugccucuugggccuuuccgagcuccucagacccugggagcccugacuucuuguccauguugauuuucagagaguacugcuuguuuauuacagcguuacggaaaacccagcuuuguauguaugugaugccgacagaagagacgcugugcaguuugcugugguccagcagccacccgaaccaguucuuuuggugucuggcacaugcaccuuguuucucuugaauauuuaaaugcuccucagugcccuggggucaccucagcacguuugcauaccgcagcccuagugagcuaaagccccagccccaaaccuucagccaccagggaagcucugcaucuauucuuuuuauauaguccaagucuuugugugaauucaguaggaaacauaaaaaaggaucaugcuacuuuaaaaacgugaaugaaaccacuaaggcagaagagaucuuaaaugcguaaagauuacaguaggacccaguucccucuuuaccuucagugccuacucacacuugcuuuagaauaucucagcccucuucuugcuuuacuuuuaugauguauacauaauuguuaaugguaguucucuaaaaguugcacucugaaggauuuucaucuaguaaaaauuuugcaacaagaacgauuugguaauuuugguuuauggaaggaauucagacuuacuguucuaucccuaauuuuuacugugguuuuaacuucuuauauuuucaguugauaaaauaauuauccaaaauuuuuuauuucuguauuuugauaacuagcauuucuauuguuucuauuacggacuaauucuuuuuuuucuuuucuuuuuuuuuuuuuuugagacagagucucauucugucgcccaggcuggagugcagcggcaugaucuuggcucacggcaaccuccgccucccggguucacgcgauucuccugccucagccuccugaguagcugggauuacaggcgcccgccaccacaccuggccaauuuuuuguguauuuuuaguagagacaggguuucacuguguuggccagacuggucuugaacgccugaccuugugauccaccugccucggccucccaaagugcugggauuacaggcgugagccaccgcgcccgguuacaugauaauucucuagcuagucucauggccuccuauuuuuaccagccuccuuguagcauauccuguauauaauuaccuggauaaucuuugucaacacuauuaguaguacugucaauaucaucauuguugucaucauuauggugucauuuuuuauggggaggguggugguaaacuauugcucauuuaaaauuuaaauuuuuggcauagcauugaaagugcuuuuucaaauuaauaguucucuuccccugcgugaggcuguaguaagacccuugugccgucaccaugcuguuacugccucucuuucugacaguuuucuggaacaaccugugcuuauccuuuccuucaagggcugaccuggucauauagucucugggcaucuuuucguugaauaaccuaaccaaagugaucguuuguacugccucaucuaguguuuuuauuguaauauauuauuacuaauacagcaaaguacuguuuuccagagauaguaucuguaaaaggccccuuagaaaaacacauuuaaaacugggaucaaagcugaaugugguagcauguaccuauagucacagcuacucaagaggcugagguuggagggcuacuuaaaaucaggaguuucagaucagccugggcaacauagugagacccucaucuggaaucaaauuuuauaguaaaugcugacagcauuuggagaccuuuguuagaaaaacaaaguguaucucauauuuaucauuuauugcuucaaauauggacuaauugaaaaaacaaagacuuaaucuuggguugucuuucuugacuuucugugugacuguuggggugugauuaugaagagcacuuugaguuuaggacuugaaccaguauuucucagaacgucuuccaguccuuggaaaaucacaucuuucucuugcaaggagucuauguuaucaucauccuuaucaguugucucuuuaguuauuaauuggucugucugauccucauuuaucauuggccgaguuugugcuugauggaguuuuuacuaucaucagcauugugcaaucuuuuuuuuuuuuuuuuuugagacagggucucacuuugucacccagaguggagugcaguggugccgucacaguucacuguggccucaaccucuuggacucaagugauucuccccccucagcccuccaagcagcugggacugcaagcacacaccaccacacccggcuaauuucuucuucuucuuuuuuuuuuuucuguggaaaucggaucuugccauguugcccaggcuggucucaaacucuugagcucgaucgaucuauccaccuuggccucccaaagugcugguauuauaggugugaguccagccagcaucgugcagucuuguccuuuucugcaaaguauagcaguuugcaguuugugugacagggcacugucauaugcauucugacugugaggugaugugacugauggggugcugggcagugggcagagcuggacagggagugauguuuggauagggagucagugauuuuauuuuauggugaauuuuacuuuccuuacucaacucugaaagugcugggucuuguguuacugauauucagguuacagagcauuccuguaacagauguuucugaaagaggcauuucuaaaaaaaaacuaaaauucugccaaauuguacacuaaaagguagggacuuuaagauaaagaaagauuuggguaggucacucaauaccuguuuaaauuuguagcacuggcucaaagaacaguugaagguuugagcagagugaauggauuucuccgagcgacaaggagaauuccuggggaauguagccugaguuguguguggggcuugcagcgucaaaucuguugccagcuccugcuuccuuaguguucuccagccuaggaugggugucuuggccaguaggagcagguccauccuucagugccgccuuuuuuccacagcuuccagcgaccguaggccucugugagguggucaggcugugugaggcucucacggagacccuccguggaguaccauguuccugauaagugugccugggaggcuugcuaaugaaagaaguaauauaccaaacauaauacuuuacauaagaaaagugaugguaacuuuaugguggaagggagagguaaguguugaagugggcaaauuuuggagacaaggaucagaugcacagagacaggaagaauagugcagucaucacuuccaagacuggugagggcugcugccaucgcuuugugugggguauaacauuaaugugaugagaacaaucucauagaaucaguggaacuucugugugguauuaacauuauguccuuauuuuccaguugcauaugagauaauuugauuuacagaaauaagcuuuuagcaaaaaccauguauacuuuuuuucuuauugcauguauauuucucuuauuuucccaguuagaucuaaaugagggaauugccucuguucagugucuggcacuggauaugugguaauaaacauacaguagcaacaaaauguugaauuaauuaaaacaaaugauuuuacauuuugaacaauacauuucagucugcaaguaggugcuuugucuauaaaauuaaauguauaucagaaugcuuguauuagcuaguucuaugaaauaaccauagcuuauucuuuuuuucauuucauguuuugaagaagaaagaagauuggauauagaugagaaaccucuaguuguacaacugaauuggaacaaagaugaucgggaaggcagauuuguucuuaagaaugagaaugacgccauuccuccuaagguaggaacccucaguauuuuaugacggucuugguccagggccaggucugacugauaaacaggagacugauguuuuguuacaggaguuccuucucuuuuuugcuucucuuuauaaacccuuuuacccuccucccagaaaauaauuuaaaagaagccuuuuucucucuacuuuauccuuuaucucaacuaguaauuccagauauuguuucucaccuuuucaaagaauauuuauguaaacucguuacugugagauuuaaugaucaggugaucagcugcaguuauuuuuuuuuuccaaaauauaaaaucagaauaguucuaauaaggaucaaaagggaaaauaacgcuuuuauaucuauuugugaacuuuuagaugcaacuuuggucauuuaaaacguuuucauuaugugcaggguuaggaauuaguaaacuuucuugaaugauggaauagagugauucuacaacuuccuaggugguaggauaucuggaauucugugcugcuauguuuauuuugugcuaaaucaaguggcaucuuacacaagaauucauuauggacaagugauagcaaaugcaaagguuaagaauauuuuuaugaaaaaucuuccauuucauucccccccgccccgccccccaacagauugggaaaaggcugucguuaaucacuuuuagcagcagaaauuuuuuauuuugugugaugucacuguuccauguugaagagucauggagauguacaaaauguauugaccuuauuuguuacugugcuuagugaugugucauauuugcagcaaauacaaaaaaaguuaagaaugcauguccauuguuuugcuauacauguuuuauuucauuucugcuccacaauuucagcagaugcucuuucauucuguauauuuugcuauggaccacagacccucauugacauguauuggaacuccuaagaccagugcagugcuccaaguaucuaugaaucaaauggcaguguucacaugcuuuucucccauaacuuauaaagcagaagguaguuuucuuucccaucacaauagccauucuuuuccuuauuuuucauaguuauuuucuuauuaaguuaucuguaaaaauaaugcaucucugucaucugcuagcaggccauuguucgagguuaaaauacaaauuaagaagaagcaagcaaauaaaucagaucuggaaacgaaguuagagauuuuugcacaaacauaauacuuacaacaguuucauaaaagccaauuuauuauggcuacucuuaacaauuccuuuaaaguuaaaaacuacuauaggcgauuugucuauuauucacucuuuguuuuuauaauuuuguuagguuucuuuuauucaaguuacuuuauguaaauuacuuggaguuuuauuuacugaaaaucagauuucaucauuucucccccaguuuucuaacuggcuuugauuuuuguuucuuagcuugcuugcuugcuaguuuuuaaaugagguaaaauauagauucggugagaugcacagaucuugagugugcaguucaauugauuuugauaaauacacccauguaacugccagcugaaucaagauaaagaccauucucauuacuccagaccuuccuguguuucaguagcuuuguucacauguucggcagcaugugagaugaaguuaccuaagccguaggcaauuuuaugugauucugcauaguagucaauauggugauaauguuacuuucaucagaaggcucaaaguaauggaccugaaaagcaggaaaaagaagggguuauccagaacuucaagagaacucucucaaagaaagaaaagaaggaaaaaaagaagagagaaaaagaggcauugcgacaggcaucugauaaagaugauagaccuuuccaaggggaggauguguaagucaguuuuggaaauguuccccuuucuuugugcuccaaaucagauguuuuuguugcaccaaaauuguuaaauuuucagauaaauuauggaaaggaugaguaucagucaggaaauguguuugggucuacucccagcucuucuguguggagggaggauagagggucuuaccuaagcaggguucauugcuggcagugccugucuugcugugcuugggaagaaucucugcacccacagucuugcuagucuuaaauaagcaaacucuaguuaacauuauuauuuuucuuuuucaucuucagcuggguuuuuuccucauuucugugguuuuggccaugaggcagcaguugucucauauguaccucagauacacuuaaugccuagucagaggcugacaaggugaaaagcagguuuucccuuuuaagcuucagaucaccaucuaguucccuccacuuccaccucccauuucuuauuuugucacaccaguuccauuguagaugguuaccuauuuuaaguguuugaggaucugacacagagcugagggaauaaguuaaaucauugcauuuuuacuauaacaaaaagagucacugggagaaacuagacuuuccccuuaauguggaguuucuaguuccuguuuucacccucagcaguuuuugguuuuuuaguuagugcauuugguuaucauaugccuguucuuaggcagcuugcuguugccuuggucuugacuacaugguauucuauacauuacuuuuccguaaucaaauaauguauacucuuuuuagaaagucagaauauauagauuugccaaaaagggugaagaacguaaagaacucaccugucaucacaugaacccagagagaaucauaaucuaguuuguuuuuucucuauaaauguuucuauuucauauacuugucuggagaggcuuuaaacagaaauguaaccacaguuucuucaacuggauuuucacuugauauuuuuuccacuaagauguuuauauuucacaaaaacauuuuuaaacgauuauacaguauuauauaguucuuccauaauuuauguaacuaguccauuuuugguguacuuauagauuguucauagugguucuuuguuuuguuuuuaaauaaauguuccagugaauauccuuguucuacgacuuagggaacuuaucugauuauuuucuuagggugcauucuagaagaaugguugggugacaggguucagauacucucauguguucugaacccaucggcagacagccccguacugucauggagcccagaagacuucucuuuuccuuacaccugcaacucuuaggugucacagaacaguauauuaucucuacaguauauaauaccuuccauaaauugaauuuguuauuaauaaggcaacaucuuuccacauauuuauuaaccauuuguauucuuuuguuggaguggccuguccaaggcuuuuucccauuuuaaaauugauucuaaguguccuguauguauugaggauauuaaccauuugucagugaauaagguauacuuuaaaguggaauuugagccuauuuuguguugcaucaaaaggggguuuagauaugaaucuacuagacagugaugccuauguaaucacuugagucuaguauuacauaauaagacucuauuaaaugcaguuaugcaagagaaaaaaauguacaaagauacguugcucauacaugaacaaaaaucaaagaaaaggagaguuuaaaacaggcuagguucaugccuguagccucagcuagucaggaggcuaaggugggaggauugcuugauccugggaaauagagguugcagugagcaaugacugugccacuggacuacauagcgagacccugucucaaaauaaaccaaaacaaaccaaaagcuucuacuuuaugacucgcucuauuuaucaucuuguuuauggggugauaaauuauuuaacuuaaaaugaguuguucaacuugauuaaaagcuugacuauuuuuaauuaaauuauuuuuuaugaugaaaaauugugucuuuaaaguauguuuaccaaaauuuaguuaaguaugucaguuaccuaguauuguuuucagcucaucauucuguacauuugacuucuucacagaaacuguuggagcaauuaauucuuuuugaaaauuuaacuucaagaaaguuaaugcuuuuaaaucuuuuagguguuaaaaaaaaucauuccauucaauuaauuugggcuuuucaaaauuugcuauaauuuuuuuuuuuuuuuuuuuuuugagaugaaguuuugcucuuguugcccaggcuggaaugcaguggcacaaucuuggcucacugcaaccuccgccuccugaguucaagugauucuccugccucagccucccaaguaacugggauuacaggcauuugccaccacgcucggcuaauuuuguauuuuuaguagagacgggguuucuccauguuggucaggccggucuccaacucccgaccucagauuauccacccacaucagccucccaaaguguugggauuauaggcaugagccaucaugcccagccuaaauuuacuguaauguuaagacagauuuuugcaaaauuaaguauucaguccuauauuucuuucuugugguuggaaggucaugguaaaauauuggucuguuuuaggguaacacugguggaaguuacugaaauguauaaucaauauauuuuucuuuuagcauuauucaugaauaaacucacuauuaauguaaacuuuuaaugauagaugucugcuuaguucaguauauuaguuuguguugagagaaacuauauucuuuaucauauaguaauuagcaugugguaaauaguacguaacagaccucuuagguacagauguagccaaauagcaccugccauuuugauuuuugugcgguugcaaugugucuauuucuaauaagaaaacaguguuuaaaauauuuuugguauuuuuuuuucuuacagugaaaauucucgacuggcugcugagguuuacaaagacaugccggaaaccagcuuuacucgaaccauuucuaauccugaggugguuaugaaacgacggaggcagcaaaaauuggaaaagagaaugcaggaauuucggagcucagaugggcggccugauucagguacaacuugguauuuuuucucuguucuaccuguuacaaagagcauuguuuaauuacacuguacgugcgugagacuugcuuuaacuaaagcaaugggugguguaaccuuuucauaacaaauguguaccauauacuucugguacaaaaucagccuacccuauguacaagaguccuguucacauagggauauguuuaguuucauacuuuuacccaauacagcucuuaaaaaaaaaaaacuagaaaauuucaaguauauacaaaaaaagagaaagauacaauaaacucccguguacguaucacugagguuucuucuguucuccaaaauacauugccuccauucucaaacuauuauugggaagcaaaucccuaacuucucauucuuucaacuauaaauauuuugguauauuuuccugaaggauaaagauuccuuaaaaacaaaacaaaauauaaccauaguaucauuaucauauauaaaauaauugauaauaauuccuuaauacuaucaaauaacuagucauuguuuaaauuuuccugauugccucagaugauucuucuguuugagaugggaucuaaaugagauguaacacauugaaugcauggucacuugcuucugcauccaucgcagacacugcucaggacucuauuucuccugagcauauuucagccuaguguccagacagccaccgucuggggggaacguuggcccacccuaguguuagugcuuauuuugacccuuagcacccuauaacugagucguaauuaacauauuucacaggacuuguagugccagugauucaaaaaagaucucagagaguacgggacuucuugguuccauaaauauucuaauagauuacauuugagacccaagugauucuuuguuuauauauauuuugucuuguucugucaagaauuugaaauaauuucuaaaucuaugcaccaaaaaagacaaaacaaggagucugaaagaaaauacaaagaagaacaguaguaaaaauuuuuuaaaagacaagaggaaugcuaagaaauggcuacaugugcuaaccacguaccagaccugaaggcacuuuguaugcuguaagaaggaguuugacauuauuacugaaaugaauuucugaauguauucuaugguucccuuaaagaauacucagguaugggcuagagguagugagucaugguaaacauagcuagcuuagaguaucaauuuuuauaucuaacuuuaaaaaauauuuguuagaaugaaauaugcuuuaaugugguuagaauguaacauuuacauuuuuuuuuuuuacgauaaaauaggaaguuuuuguaugucaguuagcuuauguccccagauucccccauguauuuugcacugccauuggggguauuuugauggaaaaauuugauaugcuuuguuaauaagcuguugaagaguuuuaagcuagggguuuagaaggcuuucauuguagccuaagcuuuauaucuggagagaugacuguggaagcagaguggaagauggauuugagggaauucugauuaggagcaggcaugcccauuaaaaguauugcuuuggccauauaaggaauaaggggccucugagcucugucauugacagugggacuguaaagagagaagggucugaagaaauauuuaagagguagaauuaucaggaacuggcaauagacuggauuuuacugaggaggggaggcauuuaggauggccccucugcuuuuuauuggaaagauguugauggacuguagaaugaaagaauguuuggggguggaagguagguuuuguuuauguuugucacauaaagugcugguaggauaugggauauauuuuaggcuacuguuccaguggcacauggcgauuaggguuugggagugaucaguguuaggagacaguguauagaugauucagaaacuuaagggaaagccauugauuguuaagaggagucaucaaagcaaacaggaaaagcugcaaagaauuaggaggagaaauagcagaacaucaaaguacagcuugucuguuaaaggggugauuggggguagaaggagcauuuuucuauauguagacucugaggaaacucuuaacuaaauauugauaacaaaaaauggcccuuuaugguuaauacuaaggaagccaaaaguauuaaugaaguccaagguuuuuauuuguuaguuuuaacaaauaacuuccucugaaaaaauauauccuuacagccuacugcagcuaucagcuuagcuaucagguuaauucuuuagugugggcuggagacaagggcaccugugaacaccacuucucugagagugacagcugugucuguuauuuuuuucucuuuuaccccaaggauuaguuucucaaguucugaugacagaaccugcauguccuccuuaauuuguuuuuguuaaacucaccucacagcugaucaggcaucacaauucauaacaagcuuugccccugaacuuuguguuuuugacacucaguuauauuugcuucaugauggcuucaaaauguaauugaccccaaaaugcccuauauaucucaguuaauucauuugugguacaaauacucuacuaccauuuauuguuaugguuuuuuuuuuucacugauaaauuaacagaauuguaagagaaguuuuaguugauucuuccucuuggguuuuuuagcgcgcagucuugugaguagcggggcacugugaagugcagaagaacauggaccuggggucagggugcaguuggaaccacuguguacaaaccaagagccacaguuucuucaucuucaaaacggggcacuaaccaaaaucauauagauguuacugcagucuacccaauuguuugcucauccuauuguacaucuuuuuuuuugugaauuacuugaggucuguauuuggauguggaguguaauuaaauaaggagugugccuucuggugucauggaaaacacaguuuaaauggacuccacuccuguugcuaaugucccuaucuucauccaaaagccaggaucuucuuuggaaagcacaagugacauuuuguccaccuccuuagacauaugcacgcagacacagucauacaugugcacucuugcaugcacgcacgcacacacacccacucucucucucucucucucugucucucucucucucucauacacauagaacuuaaacccuuccaguggcuuucacuuuaacuagaauaauucaaacucaugaugugaucauggucugggaaguccuguaugaucuggucucaguugguuccugaccucaucugccccuuuuccccucgcucuguccguacuggccagugaacccaaccagacuugcccagcccugggccuuagcaguugcugguccccugcugagacaaagcccuuccuuuagauuuucacauggccacuucugucugguuguucaggucugaguucaaauguuuauucuucagagaguucuuggccagucacccaagcuuaggaugcucucggucauguucuuucucacaaccuuauauuuuucacaaugugugucacuauuuuaaagguauuuauuuguuuucuuguuagucuucuuccucugcauccuacuucccaaccacaggauguaagcuguugaggcaggaauaucaucugaccugcuuauugcuguuccucugcauuggaacaggagagccccugggcagugugagugugcacaugguaaagaugugcugcaaccugugauuccccuggucuggcuuagcagguccauauucuaauacuacuguggacuaguugguuucuuaaaagaccaacaugauuuuauugugagcuaagcuaucaaaaugcaauucaugccagacuuguugaaaaagagaguaugagaaauauucaguaacugaaauaacugcauuagaauuaaaaaguaauagaaucauggaaauuaagaauuugcuucaagaaacccacagauuuucuaaucuagcucucuuaaauuacaggugagaaaauugagaguuaaagaagccagagugcauaccuagggucacagugucauaaugggacuguggaaccuaucuuaauuucuucccucaguauccuuccaucuggacuucagauuucagguuauauuaaucuuggaccauagguagaaagcagguuaugacaccaaaagugacaauauuaugacauauacauguagauuuccauuaaaaagaaacaaaagaaaaugucaggauauccaaauugcucugcuguaguugguuuucuuuuuuucuccuaaauaaguucacagcuauaaaggacauuguaguuuguagugccuggaaguaaaaauagaacucugcucuguuggcaaaucucuuuugaaaaaucuuuggccuugagcacuugagaucuccugguuccuacuucacuuuuuaaaaauggauuuauuuaguggguuaauauuuaacuuuaucuggguuuuuaguuuuuuucagauugaugaucaggaaguaggaaaaugggagaaauagguauauaauaauauauagguaaggaaaucgcaaagcaauugaauaaagagcagcaccauagagaaauucuggaguuccuuccuuuucuuuccucacuauagauacggaaaucaauucauuguuuuuaaaaacuccuuuagcuugaagagagaagaugaaaauggucuuugucaugcuggauuguucaugguuucuaagugucacuagaucaacuaguuacugcuauuauauguuaucuaacaggaaaugaaacaauaguuauuaggcagauugucuuuacacucauuuuagcuagaaugcagguaccuuuuucucaagugacuguaaauguuagcuaucucuguuacuggcauaaaguaaguuguacucaaagaugucaaaauguuuuuucagguggaacauugagaauuuaugcagauaguuuaaaaccaaauauucccuacaagacaauccugcugucuacuacagauccugcagacuuugcuguggcugaagcuuuagagaaguauggucuggaaaaagaaaacccuaaggauuacugcaucgcccggguaaggaacuuuaucaaaucaguaguucuuucuacuucacauuuaaaugguagauuuucuuuaaaucaaauuaaaccuagauuuucagccuaccauaucauuuagaaucugauaauuuacaaaucaugugcuaaauauauauuuuuaaaaagcagucucccuuccauuacaaaagcaauacauauuucuauuauaaaauaagaaaaauauuaaaaggcaaauuaaagaaaaugaaaauuaccccaaaaucaauugaccacauauacuugugguucuuauucuggucucuuuucuguuccauugauacauaugucuaucuuuuuaccaauaccaagcugccuuaauuacuguagauuuauaagucuaaaauuauguaaaguaugugccaauuuuguucaugauuuuaaaaaauugcuuuguuuauucuagguuguuuauguuucuuuauaaauuuuaggaucaguuugucagugucuacccaaaaccuucugagauugugauuggguuugcauugccucuguagaucaacuuugagagacuucucauccuaauaauauuuagucuuccaauuugugagcagaguguaucucuuuauuuacuuagugcuuuaaauucucucagcaguguuucauaguauucaguguagaggucuugugccucucuuguuagcuacagguagaauuaaauaaaaggguguguuguuugaguuuuauaacuuuuauguuuuugcugagaagcuaagaaguuacauugaguuggaaaaacuagugauuugaagcuuaugaauacagcucaacuuuagcugacaguagaugggaaaucauguuuuucucacauuaaaaugacaauaaaggaauaaaaauuuguuuaaaugcacaagaacaaagagaaugagagaugagaugacaagagauuagucuguggaauuuugcagauguaaaugagaggucucugacuugccagaccagagaaaucuugcugggaggacaucaagacaaagcaggcaaguguaucccagccccaggaagacucaggaauuagaggcuuuggaacuuucuaaggcaguguugaaaguugggcugaaaagaagaaauugggcugaaaguuucuguaagaaguggcagacuccaccggauucacuucccuacccuaacugcugaaggcuagaguaaaacugaugggagguggguggguauugaauggaguccguggauuuggagguaacaggaguagcacaaggugacaagggucuucacugaaaacaggaggaugaagugaaagacuguacccagaauacugauggcuagaagauuuauggaucccucucagaaggcacuuguugaaagaaagaucuguauaaaaauggaccuuugaaaauucuggucuaauaacaucacucugagacuuagcaacaguaacccuugcccacauauauagccuuuacauucagcuuucaugggacuugcugucaaauguugauagccaagguucaacagacauuugaaaaaaguaccuuuaaaacggggacagauaacagaaacauuaagaaaacuggagcuaaaagggagaaacuggagagaacagauggaaguuugacaacacuaagacuuacagagauaaagaaaauagugcauccaugaaauaagacuagaaugcuggaaaaagaaacagacggagaaagaacucuuagaaauaaaaaauauauaaaguaaauaagcgauagaggggggaaaauguuaauaagauagguagaaaauaaggaaaucuaccuaaauacagaucaaacagaaaaagaaguaaaacagacaagauauuuagauuauuaguguagaauauuuaacauauacuaaagggggaucaaaaggaagccaggcaugguggcucacuccuguaaucccagcacuuugaggucagggguuugagacaaggcuggucaacauugcgaaaccuugucucuacuaaaacuacaaaaaaaaaaaaaaaaugagcugggcaugguggcgcacaccuguaaucccagcuacuugggagguugaggcaggacaauuacuugaacccgggagguugcagugagccuugaucucgccauugcauuccagccugggcgauggagcgagacucugucucaaaaacaaacaaacaaaaaagaaaaccaaaggaaauggagagacggaaguuaucaaggaaauacugcuagaaucucucaggacugaagaaguuuaguuucuagguugaaaaggcccacugaauaaugguauaauugcuuugacaaagacccaaaccaaagcuuauuauuuugaaacugcagaaaacuaguauugaaaagaaugauucaaaagaaaaagauucaaguugcauauaaagguuuggggaguaaggcuggugcuagucuucucaacaguaacuaugguaucuggcaugccguguacuuucaaaugcagagugaaaugauuccccauccagacugucagccagguguuacguggauggaauaaagacauuucaaaacauacaaggcaaaaauuuaccucccaugugcccuaucucaaaaaagugcuggaggacauuguccagcagaaugauggaguaggccaagaaagagagagagggagaauucaagaauagaaucuaucaagagaagggaauuccaaggaugauggggaaggaaaguccagaagauuccucugcaguagugcugaacggcacacacuugagauuggagauaauguccaagacugaagguaaauagcaauaaggacacauuguuuagaaauauggugguaaauacuaguugugacaucuaaaauaaacaaauagccaguaaauuccugaggcuauuucuaugagcauuuauuuuugcaguauucugugcauagcaauaaaaaagcagacaacaagcccagcacuaaggaaugcuucuaccacucagugacguguugcucugcaacgucaguuaaaucucuacuaguugaccuggagguauauacaggcacaccucagagauguugcagguucgaugccagagaccgucacgguaaaucuggcaucgcaguauagugaaucacaggaguguuuugguuucccaauacguauaaaaguuaugcuuuuaguaaagugugcaguagcauuguguuuaagaaaaaauggaccuaccuuaauauaaaaaugcuuuauuacuuaaaaaaugcuaacagucaucugagccuucagcaaguuauaaucuuuuugcuggugcaggggcuugcguggauguugauagccacugacugaccaggguggugguugcugaaggugaguuagguuggcuguggcaacucccuaaaauacaacaaaugaaguuugcugcauugauugacucuuccuuucacaaaacauuucucuguagcauaugauacuguuagauaacauuuuauguacaguaaaaugucuuucggaauugaagucaguccucccaaccccugccacugcuuuaucaacuaaguuuauauaauauuugaaauccuuuguuuucauuucaacaguguucacagcaucuucaccaggaguugauuccauaagaaacuacuuucuuugcuuauucacaagaggcaacuccuuguuuguucagcuuuuaucaugagauugcagcauuucagucacaucuucagaccccauuuauaaucuuaguucucuuccuguuuucaccucaucuucauguacuuccuucacuaaagucuugaacagcuccaaaucauccauaggguuugaaucaguuucuuccaaacuccuuucacuauugauauuuuuccuuaucccgugaaucaugaauauucuaauggcaucuagaauggugaauacuuuccagguuuucaccccagauuuaucagagaaucacuaucuauggcagcuauagccucauuaaauguguuucuuaaauaauaagacuugaaagucaaaaucacuccuuguuccaugggcugcagaguggguguugcuuuaguaagcaugaaaacaauguuaaucuuguaccucuccaccagagccugggugacuaggugccuugucagugagcaguaauauuuucaaaggguucuuauuuuuuuuucuucuuuccucugagcaguaggucccaacagugggcucaaaauaguaagccaugcuguaaauagauguguugacaucuaggauuuguuguucauuuauagagcacaggcagaguugauuuguauaauucuuaaaagcuccagaauuuucagaaagguaagugagcauuggccucaacuuaaagucaccagcuucauucgccccuaacaaaagaaucagccuguucuuugaagcuucgaagccaggcuuugccuucuccucucuagcuagagaguccuagauggcugcuuuuuccaauagaaggcuguuucaucuucauugaaaaucuguuauuuaguguagugaccaucaguggucuuagcuagaucuucuggagaacuugcugcagcuucuccauuagcugcuucaccuugcaguuuuauggagauggcuucauuucuuaaaccucacaaaucaaccucugcuagcuucagacuuuucuucugcauccuucucaccucucucagccuucauagaauugaagagaguuagggccuugcucuagaguagaauuggcuguaauauuguggcugauuuggucaucuauccagaccauucagacuuucuccauaugagcaauaaggcuguuucucuuucucaccauucauauguucauuggaguagcacuuuuaauuuccuuuaagaaguuuuccuuugcauucauaacuugacuggcaccaagaagccuagcuuucugccugucugggcuuucgacaugccuuucucacuauguuuaaucaauuuuuagcuuuugauugaaagugagugaugugcagcucuuccuuucacuuagaggucauuuuaggguauuaauuggccuaauuucaauguuaugucucauagaauagggagggccaaggagagguagagagauggggaguggaacauucagaacacacacacuuaucaguuaagcuugccaucuuauaugggugcaguucauggcaccccaaaacauuaguaacaucagagaucacagaucaccaugacagauuuaauaauaauaaugaaaaaguuugaaguauugugagaauuaacacaauguacacacagacacaaagugagcaaugcuguuggaaaaauggcaucaguaggcgugcucaacgcaggcuugccgcaaaccuucaacuuacauuuguuuuuucuuaaaagagcaauauccgugaggcacaauaaagcaacaagguaugccuguacauuuacgaauacccugucuuuguaaaagcagucaucauaaacaaaaccagauaacacaaugcuguguauauguuuacaugagcaaagagaaaguuaaaugccuagaaaagauacuagcuuacaaacuaagugagggaaagagggaggaaaagacuuuuaacauguguuauaugauuaagaucugaaucucauuauaaaauaaaugcauaaagauaauuauugaaaguauggucacaaaaauauaguaaucucacaguaguuuuuuuuuucccuugugcuuuuucuguauuugaauuuuuuuacagugaacauguguuauucagaaucagaaagaaauacagcaaagcucauuucauugggaugggagaagagagauaagcauggguauuugguaauuuggugcaccuuuuuauuucuuuggccuuuaguaggaaguagugagaaauaguaucaauaaaauugaaggaaaaaagucuucucagaagugaaauuuuaaaauuuauacuuuaaaugagaauucauagauaaacagugucaugaacuagaguucugccauacucuguggggcauugauuggguaaggguguaagguuguucagucaagguaauuguacauucucucugaaggaaaaauaccugagcuggaggguguugugguguguugcccugacaguuacuugaagugcaagagagcucuguuacaauccugggccuuauaagauaaucccuuaccauucacaagaacuauauagcaaguaugauuguauauauaagagagauaauuuaccuauagaauaauuaaguccauggauaugauggguuuuuuaagugguccguauacuuagaauugauuaguaacugcuguacaaaguuuucuaagucagaauacuauuaguaaaacagcaguguacauagggucuguacuacugaacagacgccugaugcuuucugagcugugucccucagcuguuguggugugaacacugagggcaggaacuugaagcccugucucuacuaaaaauacaaaaauuaauugggcaugguggugggcaccuguaaucccagcuacucgggaggcugaggugggagaaucacuugaacccaggaggcggagguugcagugagcugagaucgcaccacugcacuccagccugggugacagagcgagacuguaucaaaaaaaaaaaaaaaaaaaaagaaugccugguguugcaucugauaccugguguugcuccaguauuugccaagggaauguugauguugauaaguguauauaagucuauuuaauaauaaacuguucuauaaaauugcaucugauaaacuuuuuaacaucuuuuucuuuucaguaauuuuuggcugauuuuuacugaugaaaaugagaaagugaaagagcaccuuaaucgggguuuuaaaguuauaaaagccuaucuugggauuuuauugacagucccuuaugaagucauuugauaauuuccauugaguguuucuucuaguuuugguuuucuguucuguuauuuccuaaccaguuuucuuuugcaagauuaggcaauacaaaucaggagguaauuauuguuuuaccuugaaauucuuuaucuucucagcuugccuuuuuuuuuuuuuuucuuuuuuuccuuuuggagaugaagucucgcucugucacccaggcuggagugcaauggcacgaucucggcucacugcaacuuccgccucuuggguucaagccauucuccugccucagccucccgaauaacugggacuacaggcgcacgcugccauguccggcuaauuuuuuguauuuuuuaguagagacaagguuucacuauguugcccaggcuggugucgaacuccugagcucaggcaguccaccugccuuggccucccaaagugcuaggauuacaggcaugagccacugugccuggcccagguugccauuuuauaaauuguagcuguuuucuuauucuuuauucauuauuuuaucuauuuaauuauuuaauaaauuuucuccuuguuagauauuauccugggauaagaagaagcugcccuuagagcuuauaauaaagggagacagaaagacuaagaaauagaaaacagggagcuuuucuauuagaaugaaaaucauugaaugcuuucuagagaaguuguacuuaagcugaaggaugaguggauguuauuagacaugaaaguuggggcaggagggaucauggaagcauauuauaugucgccgagugugaggauucugguuccaugugacuuggcucuaaauguuugauaaagauugagacuaaagagaugagugaaggucagauccugaaguaguauguguucuaagccaagauacugaauguaauaugaaacacuaugaagaaagauugguuaauuuaugauaagguguguuacagucuauuugucuuuuuaagguaauugaagcaguguagagagaaauuacaggguucuguagaagagucuaacccauuugguaugugagcaugaggauacauuuggguggugaggucuauuaagauaacaucauuacauuaauuacagguuggaaguaauguucacaugccagugacuuggccuucuuuucuuauucucucuaauccuguuuugguucauguuagcaguguguuagagugaagauggagcacuagcccaaagucuagaagaauauuggacaaccaucaucucccacucuccuccauauuacaguguuuugggggcuuucuuagauuauuaaaaaaauuguuuggcucuaguaaaaauguaauaaaaaaguaauacagcauuaugaauuaggaguucaaugaauacaguauauugaaacaggugguuaaaagcauuuguugaaugaaugacuugcccuguaauauauuuaaauggucugauuaaaauuuaaucauaaagagauuauuucaagaaaacgaaaacuauucuggcuuguuguauggugguuauccuaagauaucucauauuguaugagcccacuuuauaaaaacaauuguuugaaugugaaaagguggguuaaggacuagagagauugaaauuugcaauagugaagaaauuacacagaaguuaaccauuacguacugccguacugccuuuccauauaaaaaguuguaaaaaaaaaaaauauuuagucuaccucuuuuuagggaccaggugauuaaaagcagccaaaucagcuggcuuagcuuuuuauuauagacuguuaccuuucacuuuuauugaugauuauuuugaugaugagugagaauuguuucuagugcuuaauucuacggugacauuuuauucauucaaaagcaauaaauguguucuuuuaaguacuuguuaacuuaguuacuuuggcacauucauaguuaauuauuuuuguuuuuuuagguuaugcuuccuccuggagcccagcauucugaugaaaagggugcuaaagaaauuauucuugaugaugaugaguguccuuuacaaaucuucagggaauggccaagugacaaagguaguaaccuuauuaaaggauuacuuacaccagauuccuaugugauauaccagguguucaccuuaucacaugauguaggagauguguacguuaauguuuuuggauggccuuguuguuguuguuguugagacagucucacucuuguugcccaggcuggagugcaguggcgcaaucuuggcucacugcaagcuccaccucccgguuucaagcgauucuccugccucagccucccgaauagcugggauuacaggcuccgcccccaugcccggcuaauuuuguauuuuuaguagagaugggguuucuccauguggauggcuuuuugcuguagagcuuucugccuccuucauuaacuugcuugaugauuccugaguguugccguugucccuaagaccacacucagcuuaucugagucucauguguuagacacugaacaaauggugauacugcagguaaaucacacaucucauuaagaaaccacaauauuagcacuacagcaagaagcgaaagaucauugguaucuaccaguaguagaaaacacauuucaugcugacuagauuaacugugugauguuuggacaaauuuguuaugauagagaaaaugacuucuguaacccuauagauuguccagugauuuagucauuucaaauaaugaauucacacuuugcacuacugaaacaauuuucccuuauuauuucaaagcagucuuaaguuuaaagcuguguuuuuaagaaaauacgguuuucuuucaaauucacaucauaaguuaacuguuaacuccauagagggccuugcauuaauaacgacauaaaaauguauugccauuuaaucgugucaauauggaauguagauugguaguuuuaaaacaccaaaaaaaucuuucucagcaagcaaauuucuauccuccuuaaaacacuuguuuaguauuuuuuaaaaacaguguaaaguuaaaauuuuauuaaaggcaaauugccuaaauucuuuaaguugaauuuaauaaaaaucaggucaacuaaaaauauacacauauauuuuguuaguaauagaauuguuguuuuauuucaauaggcuuuugcgggaacaggcgguauuugguuacaugaauaaauuuuuucguggugauuucugagauuuuaguguacuuaucacccuaaaaguacauuuuuauauguguauuugugugugaaugugguuuuuauauguaugaauguauuuacugaucauagaguuguuuacuaauguaagcauuuauucuuaaccugguguuuuuuuuucaagcuuaugaugucuuucgguagcuguuaauuuagaguagucuuuggaaauugcuugcuagagcuuuucaaacacaccaagaggcuaauauuuccucuguugagugaaaguaugaauuggguaagcuguacacagugauuccuuggcagauguuccuaaauuacaugcaucuuuuugagaaaguuuugcacaguugacugccagucagcgggccauccugaccaaccugagucugccugaugauuucccaugcugcuguucuagggauuuuagucuuucaguugaagaggaggccaccagaccacaucccaaagaaaaccaagaaacacuuggaaggcaagacacccaagggaaaggagagagcugacgggucuggcuauggcuccacccuuccuccggagaagcugcccuauuuaguagaguuaagcccaggugagaaaacuggucacaccagcacacauuauuaaugugcauuuuuagcuucaaaucuuuguacuuucuaaugcaucuucaaguagucuucuguuggcugacuuaacauuuuuagccauuuauuuuuuuaaaaguaacucucauaacauuuauuucucuuaaauuauuaaaacuuaagguuguaaaauauguauauguuuacauaaaaaugguucacauggacaaagaugaguauucagaaaccaaauuuaguguauggacaauuuuaaauuauuuuaaucccuaaaauuuuuuuuuccaagauaacuuuaguaaaauaguuacucuaccaacaaugacaaauugguauuuaccuagggcagauuucauaaagggguggguguguguguguguguguguguguguguguguguguguguguggcuguuguuucugaugcauggacagugucuaaaaagaauaucuuuaaauuuuauaucuaagaaacccaucuuaguaagaggaaggcuauuugauuuuaaaguaacagacuacauuuauuuucacaugaguccucuaaguguuuuuuuuguagaacucuuaauacacuaaagcugucguuucagguuagccauugaguagagaaauacgugggcauucuuaaggaaauguuuuacacacacauuccuagguagaguguauauuugcacauauguaugcugugcauggcuguacaugacauuuaucauucaguuaacauuacuucauuucuuauuucauuauuaaaugcuauuaugugaccugcauuauacaauacugugaagaucagaguggugcacccccaucccaagcugcaucaaaagaaagcccgaguaguaaucacagagcaaauuagcagaaaauugaaccaguuauguguaugauauauggcuccaugaaugugaauuacauuuuuucuucuuugauuuuugagaguuuauuuuuauuugcaagguuuguuuaguuucuuacagcuagguuauugcaauuaacuaaugauuacauacgauauuuguuguccagcagucucaugguaccguagguuauauaaauacaggaagugaugguaucauuuugaugccacaguuaguggcaguguggcuuuagguaguagcuuuuauaccuaauuaugcuucaggacuuuaaaaaaaucaauugauuagcuauuugugaggaauauauugguguugcuaaccucaguucucuggguggaaaguuuacuugaagcuuuauuaucucacuguaguuuggaaacacaucccaguauuguugugugucuauaaugugugugagagcauugauguuugguugucugagguaaugaauggcaacuaugaagcagccauuaguuuuugaacuuaaaauuuuuuaggcucuuuuuuggguauugggucugcccuuuaaaauuuuauauuaaauucuagaaacuaaugauuguuuucuccaaauccaaauuuuugaggaucuaagaguguugaguucugagagaaauuaauaaauagcagcugacagaauaauuuucagaugaguaauggacaguuuauuuugguagauagcagagacaggaugaggauucauucauucacgcaugcauuugauaaauauugauugaauacuugugugucauaccguguucugggccuuggagguagagcaccaaaacagauuaaaccccuucaccuuggggauuucucuucuagugagaauuguuauuucgacugcuucuuucauacuuauagucucucagguaaucaaauacauagaauuuuuuuuuguagguguggaguagaucacaguucuguacuacuuuucaccaaauauuggcaacagcauuuguuacaugguuauuaauacacugcaucccucauggcacucugcugccuucagucagcauucacugacccuucuacuuuaggcaaaacaauggauacaaaaggauuaaguuccuucccgccuucagguaauucacacagugggagggaaucacagugccaugugacaagugacucugccucuagucccgacuucuccugagcccugugccugugggauagcuuaacuuguuccacaaaugucugaaguucaggucuggugccacuauuuuaagggugaccuaaggguugguggcaggccugaaugcaaggccagggucuucccugcaccaaagccauguucuuucacuaagucaugaugucguuuuagguuuucauuauuaugcauugcucacagucagcaugcugaaugaaauugaucuauuuuccauuuaugagaaaauaauauucauacauaaugauuuguuaugaauggauaaguacuguauuuccccugggcacauugucagccaagcauuauauacucaaugcugagguucugcugggugugguuaggaguuuuuuugagauguggucaugagcucagcauugucuuuuggagaaauggggagaaauacauuauuucguucuuugcuuuggauuugaauguguucuuuaaacagaagaaaucagcccaguggggugguagcccucuguaugauuaacucacuguugcuguccugcugcuuggugacucaccuguuguccugugguuucccuuaacagucugcauugguuucuaaaacacugacuggggcacuaguauagucuuguccucacaaaagcugaugggugaaguguaccuuuucuuccuuugaaacgugucucacugaaguucacccucugcgucucuucuccuccuucccuauuccgcguguucugcauggucucucuccugcugaugcugccuucaccuggguccuggcaugugucuuaaccccagggagaaggaaucacuuugccuacuacaacuaucacacuuacgaagguaaugcuaugcuuacuacuacuuuuauaacuaaagcacuaauagaaccucaugggcagaauaguguugaaugaccaaauaucuuauguaucaguuuuuuaguugauauaaauaaccuauuuuaagaaauuuaauguacugucauuuuauuuguaccuaguaaguuuccauaucuagaacucauuucauuuacuggaagcuuguuuugugucuuuauuuucccagguucacccugggaaggaacugaaggcaaaagcagcaguggcuguggagggaugcuggggaguaaagacagagugcuguuucaaagcacucguugggcggugcucagccagucugccucccuucaucuguagaauaggaaaacuuucugguagcagugccguuacugucuguugugggguuacuuagauuugucucugcucuucaaggugcuccagauuuauugucauuaucuacggggaagaaagagacucaggcacuuugggcagaaauugacuauuuguagaauacuuguugaggaaggggagaaaauuugggauuuuuguuuuuggcaacgguuuuauauguuacucccugugagauaacuguccuucuaauuuggagagggaauggacuacugcacucucccuuuccuccccagcucaaaccaaacaucccuuuauccacugaauccuguggccaccauuuagguucuucaaaaucuguaacagcuuuaacuaugguuuccuauuauuacugugaaguaauaagagagccugggaaggauguuuaucucucuaucuguugacaaauuucuauuaccauggugaggugaggagaagggagagacugagaaagcagcuucugucucucccuuucucuguuuugaaaucuguugauguagaaaggugugugauagcucuuuauugucucauaagagaccuuucagaagcauucagaauucggaagaauaugaaugugaauuuuucuuucaucucuaaacacauuuuucauguucuguuuuuaacuuugcguugaaauguucuuguuucacacaugauuacuuauuuacugcuuuugcuuucuuuauaauuuauuugugucauuucucugugacuauauugcauucaguuuucuuuauuuuuauauaaguauucacugcugacacaucaagucuuuauugauugcuaacuauggaccguauguggagugaucagugccaggguaaaaauuuuuuuuuuuuuguaaaccuagccaccagggagcucagagaugagggagauaaguagauggaaaucaucauacgauacgguuagugguacaauuaauguaacagauggggugcucugggaguagauaagggggacacauuucuuaacuagggggguucauuagaacugccuuuggugguuaaaacacacaaaauaguaaacauuacuggaggauuuggacucagcaggucuagaagggagcuaccuauguccaggaaaagccccagaugauuuugaugucuuguucagaucaggacuuuagagcaguuagaguugaaaauaaauguuucaacacgaugugaagcagcacagaugaugaacaauuucuuaauggguguuaggcauuagugucucucagguacuucagucucaucuuaccuuuacucgaugucacagauuucugaaguauuucagaaauagaaaauuuugucauuagaauguaacuuuguguacccuaaaauuaacaucaguucuaacaggacuugcauuuuuauggugucuuuugucugugagaguuuagcgguaccacugcugagagauuuuagcagucucaaacucugugcacgcucauacuccaaacuguuuaacgugugaaacucucaaagcuuacguuccuaauugcagugacuagagauuuuaacagguaauggaaucagcggguuugaaaguuauaaggcacucauaaagcagaucuuggcgacucuuacugguuuggccuuuuccuaagcuuugguggguggugugcuugccacacuagacugacugccauggcuauggugcaggugcuaagcucugcaguuacaucaucauucauggguucuggaaggcacauuuucucauaugucaacucugaaaucagaauaccucauuuuuaguuaagguaaugaagugacauuguccucaucugggauacaguaggugaagagugagaaaacaugucuagguguauugggacuagagggcuucggcagagcagcuuccuccuccuccucaccccuucccugucauggaaacacaugcucauauaaauuaaacauuccaacaguucauaaagguauaaaaugacaaaaaaaaaaaagccaaaaaacccagucuuccuuuuacuccaguucuacuccagggagcuaaccacuuuuaacaguaauucuugaucaguaauggacagcagaauuacuuggggugauuuuucagaggacacaugcuuaggccucauccccaaggauuuucauccaggucuggggagcgcuaugagaacugcacauuuaaaaaccuccgucagugauuuagcugugcccucaaccuguauuguguugugugccauaagggcagcaagaauacugcaggaaagaucugguccgaagggaaggccugugugucuuugaugagcuucauauugcuacuacaguugcuccucagaaucauuaacaaacguccagggcagugcgguagagaagccuuuuucaauguaauaagaaugugguggaauuaaugcuaguguuagcacuuuguguuaaucagaaacugauacguuuauuucuuauuuugaauuuucuguauccaguuuguuaaauuguguuacauaaguuuggagaauuuuuugaaaagaaauccugagaaaugagaacuguagugccugagauaaccuuuuguuuguuggaaauaacaugacaguaauauuagacuuugcaaauagagcugucuuccuucucuucucacagaugguucugacucuagagauaagccaaagcuuuaccgccuucaguuaaguguuacugaaguugggacagaaaaguuggaugacaacucuauccagguacguagucugagcuuccugcugcaacucugacauuccaggaggcauaacguauuguacagagccugccacaugguaaugaaagaaggaauuauaauuaccgacuuguauuuaaauauaaauaauuuaucuacucugggucacuuuucucugcuuuaguguggaaacagcagaaugugaguuuauguucaaguuccaccucuagaaauuugggcuggugaugacauugcucugaaacugcuuccuuuucucuaaaagauggugaugauacuuuuauaggucuauuucaggauuacaggauauaaccuaugcagaagugcuuaucacuggaggucugaccacauagcauuaggcauucgguaaauucuaauuaaauuuagcuuaauaugguucucaaguacuuaaaacagagcuuaacacauuauuugaauaaaugaagucagaauuugucacuucuuugaaguugaauucaggcgaaucacccuugcucuguacuuaguucucaauuuguaagaugauggguucagauuguuaauaucauuuucaauucuaccauuucuucuuucuuagcacaacacuaaaaauaauaauaggaaucuuuaaugcuaaugaucuguuuagauuuguccauuaaccaucuaacaaauauugguuaagaugacuguaugccuuuuuuuuuuuuuuuuuuuuuuuuugagacagucuuacucugucagcaggcuggagugcuguggcacgaucucggcucucuguaaccuccaacucccugguucaagcaauucuccugccucagccuccugaguagcugggguuacaggcacgcgccaccacgccugcuaauuuuuguauuuuucguagagacggaguuucaccauguuggccaggauagucucgaucuccugaccucaugauccgcccaucucggccucccaaagugcugggauuacaggcgugagccaccgcgccuggccaacuguaugcuuuuuaaugcaaaguuacaguaugccuuaagucacuggguacuaaaaauaaaaggucugauugguuugacuuuuuuuugacaguuuaauuauuuuuauacgauugagggaaauccacuuuaaaaggcacuaaaaauccagagcuuauuagguuauauuugucauaaaagggguacucacgguuuuaacauucuguguuuaaaugcugugaacuucaugaugggaguuucuuugguuuccuucgguuuccaguuguuuggcccaggaauucagccccaucacugugaccuuaccaacauggauggaguggucacugugacgcccagaaguauggacgcagaaaccuacguggaaggccagcgcaucucagaaaccaccaugcugcagaguggcaugaaagugcaguuuggggcgucccauguauuuaaguuuguggaccccagucaggaucaugcucuugcaaaaagaucuguggauggaggccugaugguuaagggcccaagacauaaaccuggguaaauagauuaacccuaagauuuaaaauguuuugauuauacuuaaaguaguucagauuauucauagauaucuuggcuuuuuauuuuuguuucaauuuuuaaaaaaauaucaaagugaaguuugugauuuugguuccuauuguuaacuuggguugguuuuagaggaaagaagaaaggucuugacuuugucuuaaaauuggaauuucucacugguuuuaaauuguuuauauuuaaacuuuguuuuuuagccaguauacuaaaacaguaccuuuucuuuugugaaaaaaacaugguguucuuuguaauuauucaguguaacuaagauuauaaaauuuuuugaaguauucuuuucugugacugauaaugaaacacauuaagaucucuuaaggaauucagaauauuuuagcuccaccuagugcuuuucugaagacuugcauugugggcuuaguaagggaaaacagaaagccuuucuuaaugacuaucuaguaaaauuuuuuuguagguagggaauaugacuucuccuuugguuuuacuuuuuaaaacauccuguuaagccacuucauugucuauuuuucaugcugcuuaaaacaacugaaaacuccccuagauuguaggcuuucuuccugaagcacagacaugaacccgcguggucuucccugcuuggccuuucccauuguuuuguucuacggcaugccuuugauuagccacccagaccuuacacauugggccacauaugacuauuuagaauuaaugucuuucuccaagaugaauacuugguggguuaucacauauauuuauuuguaaaguucacagcuguuuaagauccauccccagcugcucaccucaccuugcaccccaagugucagcaaaugaccauaccuguggcauccaaggaaaccagcaugugcuuuuccucccugcuucccaagaaaauccauuucuuucuaacacuuucaucuuuaaacuaguguauuuaaacaccauccuuccauucuucacagcuuuuaacuguuucuuucugaaggugauguuuuucauugaucagccgugucccuauuuccugucccuugucauuagcuuuacaugggcucuucccuucaguagcgagucaugauuucaugcuuagauguucauuucaaucaucagcuuuucuucagcccuguuucuucccuucagcaucaaaaaucuugaucugguauauccugacucccuguuuauuuuuuaggcucacugagguuuguccaaagagauuauguauugucugaaacaguuucuuccgcuguguguuacauguggucucucaauaguaccuguaguuauugcccuuauauacaaaugcccuuuauucuugaguuguaauauauuucuugugacauguguuacuccuaguguuacuguccaucucuguucucuguauaaacacaauucuaguagcagccugugucccacaccuagucugcccuucgguuuugcuuguaauguuuuuauaugugugagacaaucuccuacuguauuuuugccauguggauccugcuuuggaagccugcagaugucucuuccuaccauauuucuggccagcagcagagaucauugaagaacauggcuuagguuucaaugaggagaaugugcugugaaauuuuguuacuauuguuagguauuuuucuggcaaaucugguaaaagcugcuuggcggcugaacauaccauccauaaauuagaaaggacucuuguuuuuuuaggaacauuaauuuugcucuagugucaaacgauugugacagauucuggcuagauaacucacauacccuccaaugcagauuucauagugugucuucaaauccuacugaugguuauaaacgaguggcaaaguuugauauugauaguuugggaauuuuagggccucccggugauacacugacucauuaacugauuuguuaaucuaguuuacaauuaucaaguacccagggcaugagcuacuauucucugaaugcugggaggagcgacccaugauuguuacagucaaaggccauaguuugauaauuucaaagucauauuauaaagucacuuugguuggucuuguccacauauccagccugcaguaaaaaugagccauguuaaaacuugaaagagguagcuuuggugggaaaaguuaaagaauuuugcaugguggaaauuuguuguucuaggaugauaauuguaaguggaaucaagaaggcuuugauucuacucacauacuacccacaagaggaaguuagggguggacacugcugugugcagcuuugguagguggcagagaagcuggccugcugucauuguuacuccuguugucagagccgauagcuggacugaaucucccacucaaacugaugggagccagcagggcauuuccauguuuuugugaauaucuuggugauagauuaugaguauuuaauuucagaauauugguaauauauugcagaaaguugugugcagaaaauugacaauuauuuggccuuuaguaaaaacuuuuacucuuucaaaaguuacuauuuuaaagcaugguauuauuuugcauuacaaaaugguuuuauuuucuuaguggugagauagaggagaaauuuguaccugcucuucuaaucugaaaaguuguuuucaacuuuuacauuacuuccuuguuucuuucuauugguugaguguaaauaaaaguuucccauuaccaugcugcuuugaaauuagaccauauauuaauauuuuucaaguauuauaacgggacauuucauucuuuuuaaauuauguuuugcagaaauccaggaaauuuaaauacuaauucauccuuguugguuuccagguguuuuuagggcuuuuuuuuguggagguggggagggcacucuccaaugagcugggaccagugaguugcauucacccuucauuugugcugaagaauguagucggucccagcuuguuagacucuucaaucuucauaaugagauuuugcuuaugaguuagguuuucaaagugacauauuuagaaauuuugauauuuugagauauuugaagaaucaguuuaaacuaggauaauuuuugauuugcaugcuaacauuaucaaaaaugucccacuuuuuaauuuguagccuaaguagugauacucaugugcuuuacaaaaauaaucagauugacuuucaaauaggagagaagcucaccgcuguuccucaugugucacuuucccuguguccauaaauagggccgccggcacuucaaccuuguacaccucauuuauaugccauuugcugccuggauagacuuacauaaugaaauaaccugguuuuuuauguuccguuucuuguauaguuaaaaaaaaaaauaugaucgggccgggcgugguggcucaugccuguaauccccagcacuuugggaggcugaggugggcggaucaccugaggucaggaguucgagaccagccuggccaacauggugaaaccccaucucuacaaaaaauacaauaauuagccgggcaugguggcccuugucuguaauaccaguuauuugggaggcugaggcaggaguaucacuugaacugaggaggcagagguugcagugagccgaaauugugcuacuguacuccagccugggcaacagagugagacuucaucucaaaaaaaaaaaaaaaaaaaagauacugggaauauugaguauauaccaguaaagaaaguucauaaggugguuuuuuaauucuguaaguucgugugcugaaaacagagcaauuucuuaaaaaucuuugacauuugguauuuuaguucuuccuuguguauuaagaagagacuaugccugucauuggaauguuauuaagucaguguguuucuuguuuuaucccaucagaauuguucaggagacaacuuuugauuugggaggagauauucauagugggacagcauuaccgacaagcaagguagguaauuauggauuaccugauagaagugugcuugcuauaggacaccauggaugaauacaguaguggugggggauguguuccccuuauuugugggggauguguuccaagaccaccagucaaugucugaaaucauaaauaguacagagcccuauggauacuauguuguuuuccuguauauauguaccugugauaaaguuuaauuuauaaaauaagcacacuaagacauuaacaacaauaacugaagauaaaauggaacaauauauauuauaacaauauacucaaauaagagguauguuaauuuggucucugucuccucucucaaaauaucuuauuguauuguacucaccuguuuucggacugcagcuuaccacagguagcugaacuguagaaagagaaacugcagauaagggggacuccaguaaacugguaauaggugcacuuauaaaacaucuuuguaaaaacagacuucccaguggccccaaauguggguuguccuaaucugcuguguuguuuguuagugauacauaaaagaaaguuaccagaucuuucuuuucucuaaggccagguugaagcagagccuucauguuugcuaggcuuucuccuguguaguuagccuugcucagucagaguacccuuaauacacuccuuuuauuaacccuucaguuuagguacuaaaucccauucaucaguuaacuucucagacacuuugcuuccauaaugaucccuuaucucuggaauaaucaguucauuuccuuucucauuuucauucucuauuacuggauaacaaaccacuccaaaacuuuguggcuaaacagcaaccauuuuauuuguuuaccauugugcaaucugguuugagcucaccugggcaguuuguuugcuggucuugcugguggugacuggugugaccaccuucaccuagaagaucaguugguagccaguggcuggagugcagggcccacugacccucucucugugcugucucacauucucuccaugggaccuuuagccccauuggggcagccagaagucguaguguugugggaccucacaagaaccacggagcuuccaggccuucuugaauguuaggcccagaacugacacaaccccguuuccuccaccuuucauugguugaagcaaauacaggcccaguccagauucaggaggaaggcacuacucaaggugugauuuauugaaugccauggugccacaaacuccuaugauccuggaguguucucaucagcaucaaaacacguuacagugucuucucuuuuagaaaacucuuuauaccccuccaguuuugaccccauuuuucuacuccuguuugcuacacagcuucuuggggaaaaaaaaaucaucuaugcuugcucccuccacuuccaaacucuauguucuuuccucugcuccuguucauucuugccccucccuccacagggacugucugucagggggacugaugaccucccaggucccaaaucuggcacgcauuuuguccugucuuacuuguugcaggaguuuuuagccaggccacaaccacguacuugaugcacuuucuucuguuggcuucuaggguauauuacccuccuauaaaccaccuaguagugguuucuccuugguuugauuuguugguaccucuuccucuuaugcuucacuccuaaaguuuggagggccaggguuucagauguagggcaccaaucuguuuucuuccugcaucuuuccuaggugagcuuacccuguugccugaguuuaaauaccaucuaauguuaauuauccacuaauguguaccuuugguucugaccucuccagacgcauaucucucucucuuuuuuuuuuuucuuccugagacagagucugcucucucucccaguuuggagugcaguggcaugaucucggcucacugcaaccacugccucccagguucaagucauucuccugccucugccuccugcguagcggagauuacaggcaccugccaccaugcuuggcuaauuuuuguauuuuuuaguagagaucguguuucgccauguugcccaggcuggucuugaacuccugagcucaggcagucugccugccucggcuucccaaaaugcuaggauuacagguguaagccacugcacccagccccgauucauaucucuaaagguuuacuugacauauccacuugcauauccuguacauauuucaaauuaaaucuagcuaaaagaagacuagauuuucuuucuuaacaaacuuucccugauccuuccccaccuuagaagacaauacuaccaucugcagcguugcuccaauagaaaccucuuccccguucccaguuggucccuuccuucucucagccucugcaugcagggguucguuccucugccucucuggcuuaggcugcagccaucacauggcaggaggaccacacggccccaagagcagccucuuccauucuacccagcucaucauucuccucacauuuaaaaaauguaaauuagauucuaguuacuguucugcuuucgaagccccugguggcuucccaacccauauaucagucuucacccugacuugcucagccccuaugcccugagccugcuuccucucagcgugucucuguugcucacucaggccacacgaggcuuccauccugugcccgugccugccucuuuccucccauuggaaggccuuucuugugcuaguguuugugcuuuugucuuugcuuuucacacucuggccccuucuugucucagaccucagcuuaaagccacauuccugaagagguugucccugagcauccugucacugucacagcaccugauguaaguuauuuauguggucuuuauuaccauccaauaccugcuguguuuguugaccagcuguagaaugugaacucugcaaguggggcuccuguuucauacgucauugcuguauuucuauugcacuuuucuuaaaaaaugccugcuguguagaagacucuugggaaccaucucaugaauaauugaaugagccgaagaaaacugucuuuauaaaaauuuucguuucuuaaaaaaauguguaguccacaaagaagacuugguaaauagaggaaaaaaguaaaaaugaaaauccgucauccacaauuuauaguugaccuuugauaguaauguugugagggguccuuuucuggacucugguaugggucuauauguucauguaugcauuuuaacacaauuggauauauuugucuccacacacaccuuucuugcuuucuucagcuguuacucugugagcauuuuuuaguacuuuaaagucacuuaaaaacaaaugaaaaccauucuguaguauguaagcauauaaacauacucuaauuucuuuauccauugcccuauuacuagucauuuauaacaauuuuuuaauaguguguaaauaguauugccauccauugaccagcaauuguguuucuauaaaucugucuuaugggccggaugugguggcucacgccuauaaucccaacacuuugggaggccgagguggguggaucaugaagucaggagaucgagaccauccuggcuaacauggugaaacccugucucugcuaaaaaugcaaaaaauuagccgggcgugguggcgggcgccuguagcccccuacucaggaggcuaaggcaggagaauggcgugaaccugggaggcggagcuugcagugagcugagaucgcgccacugcacuccagccugggugacagagcgagacuccgucccaagaaaaaaaaccaaaaaacucuuauggaaggauucauuggguguguauauaaauauauuuacaagcauaauugucuugucacucuguacugaugaacauuuuaaaugauguaauaaagcauugguuuaaugaaguaugaugaauagacaacaaaauguuauacagccauuacaagucuguaauauaaaaauaagugauauuguaagauguuuguaacaucugaaaaaguguuuuuuuaucaagaagauuguaaaucccauuuauggaaaauaugaaaagcuggaaagacguacaguacaguaauaaucgcuaggugauaagagaaacaugauuuuuuauuuacuacuugugcccaguuucuguaguaagcagauguaauaagaaauuuuacaugaaauuuuuucuacagugaauuucauuguauaaaauuuuuucuuuucuggugauuuucuuaauguagguaacucauccuuuugucugccuacaaauuccauacaaaugguuagaauuguauacuuuuuagaaguauuuaaauauaccugauuggguuaccauauaauauguguuuuccccgguguugauuaagggcaagaaagaagccaguuucuguacugaauucauuagguauugagcuauaaggaguaggauuucuaaaucuguucugagaaauaauaaacuuuaaaaagacccugccucuucauguuguacauauuuucuuaugucuuauccugauuuuaaaauaacuuguuggaaucgaauuacuauuaauguacuuucagaaaaaucaucauguguguguuaccagcuuugccugccuguguuuuaaaggcaacuccuagcucuuugagaaugaaaguggcugugcgucuuccuaugcuuuaauaccagugugcuuugggcacuccccguggacauaguguccccagcauugcuuuguuauuuccuggucuguguucuugccugcccugcuuggcagcccuguaucagaucucugcuugcaacgcugagugucaagcuugguuggucugugugagguucuaaacccguugugcuuucucuccauguagagcaccacuaggcuggacagcgacagagugucgucugccucuagcacagccgagcggggaauggugaagccgaugaucagaguagaacagcagccagauuaucgcaggcaagaaagcagguaggaaacacaucauuuuucaauggugaaaguacugaaaguauuccuaaaaaaggguugggauaaagauuguugaauuuauaaagguucagcugacauguuuacaauguuagcaauaauauuuuaagggcauuuccuuucuguguuauugaauugaaagaaaugcuuuaccaauaauuauaucccucacuuauaugccacaguguuaucagauugaaauaagaguacauugaauuaaaauguugccauuuaaaauuugcuacuuuguaaaaacauagagaaagggaguuuuuauaggauuuuaauauuugaugauuuuuguauuuagaaaaaucuggucauuucacccauuucuagaagaaaucuucaucuguuuaaaaauauguaagaucaaaaaugauuuugaaacagauuuuaagaauuauaaaugccauauuaugucuugugcucuaaugugaugugucucccuguggagauagauggaggaugaauuuuuuuuuuuuucugacauuguucuugccgauuucucugggcagagaacugucuuguuauuuccuugucuuaugauuuuuaacgugucaccuuaaucagaauccuauuuccuugugaccucuagaauuauuuaaauguugcagaguaauaucuuugcauuaaacaugguggauaaauaacagauacugacuaguggaaccagcagcaugauuuggugcugaacaccucuaccccagagcucugcgggaacucagacagaaauacagaaagacugcaugacuucuauggcauucucauuaucagcagugaaacuggcagcauucccccuuuggggcuuuucagauagauuuuugaagaggccauuguguuuccuucaaagauccagucagugaggcaguuagaugaggcaggcgacuugcccagggucaccuaucaguucaguugcaggugacgaagacacaguucuucaguuucccaacuuccagcagagggcacuggauauugcaggauuuuaauaucauucaucaccaguuauacauguguagacucauaagggaaucccagguuuuaacuuuauuuuuauuguggauuuuugguucuaaugcaagauuuuuauuggcuaugugaaucuuauuacaugugauaauaaauaguuuacuuuccguguuuguacuuguuuuuguugguggauuauggaguaggauguucagaaugguaaauugguauuguaaggaauaccucuauguauuucuaaggugugacugagaaguaugaaucauaguucuuagcucauaaauauuugaguaaaugaauucgcacgagggaguggauugauuaggauaaugcuuuuaauauaugcaaaauuagugauuaauauagugucaaaauaguaauaugguuaauuguaugucaggaauuauuuuuuaccauaaacacauaauuuaauuuuacaagguaagauuaguuugcagaguuauuaaaggcuuuauuuuaauuauaaacuauguuguuuuguugcuauuacuacaaugaugagaacagaugagccuuucugcuccauucuuuguuuuucacaugggcaguguuauaauaagcacuacuuaauuuaacugaugcagucaugaaaaauuuaaacguguuuaaaaugcuaauauuagugaaggaaaaaacccuuuugaauggaggggacgacuuuuaauugucacuaaauuuuuuuuucuuuuaucaaugacaauguaaacacuuuuuuaccagauuuguuaaaauauaauugguaaaguuuacucagguucacuuuaugagauauauaacugccuagcuacaauuuuaguugucuguaaauaugggaauguaagggagauguguuaaaauaauugaucauuuaaauuacauuguuuauagaggcauuuuucuuuuccuuaauuguugaguuaaaucauuagaucauaaacuaaauaaucaacucugaaacauauaauuugauaaaaagaagauuuggguuguauuuauuauuaguaaaauauuugguuauauuuuuauuauuuuguauaaauauauucauuucucuuuauucauuuuuuggugcauggagaaggugaggauggagggaagagaaugguuugcuguugaaaaaaaaauuaguuagccagucuguaaacuauuauaaaucuguaaucaucauaaguuauuccuuuuuauuuuugaaggaaaguuuuuuauuaucuauauuaacuuauuuaaugaguggaccagcaauuccaaauacuuaauucuggccguacaguaccaguugucuaagauuaacagacacauugcugcugaaaugacuguuguugaagucacuaaugaguauuucucauuccaauaucaagauaacuguguugacuuuccauuucaccaaauaagauuuauuugaguaaguauuagucucaguuuaagucaauauuuaacucaguagagauguucaucacaguuuaagucauuaauauccccacaauuucauuuuucauuaaguuugcggaaggcaaaacacauguucccuggcucuuacugucaauuuaaauuuucuuauuuuuucagagacauuuuugagaauucuuccugguuaucucuguuaaaguugaacuaaaaugauaaagacauugaaauguuaaggaagcuaaucacuugacuauguguuucgcugguuuuugguaaauauuguauauaaaauacaguggguagcgaacuuagaguaauaaguaaauggcuugaaguucuaaucacauggcuaagugaaagaauaagcugagcauuauucauugagaaaagcauaaauccacaaagauaaggaaaucuaaacuggauuuguaauuuauuaucuuacacauuuaaagagucugugccuagcaauggcuuucaaaaugcuuuugaacugugguuauaacacaagauuauaucuuacauugugcucuggugaacacacauacaaauguguauucaacugaaagaguaguuucacaaaacagccuucugcccugccaaugggugaugacacacuguuugaagaauauuuuuauagagauagaaaugaaccuaacuuuugaauuaauuugaucugaauaccuggaaauagauaaacaucagcacaaugcuaguuuuuauaaauguuccaaauuauaguuucuuuguauuuauaauuuuugacaguuccuuauuuguguagugucaggcuaaaugguggaagggaccuggaauuuaugugaccguaagaagaaaugugagugaguagaacaucucuuuauaaggcaugcgucacuguaagcauuggaaaaugaugauaguaauggcugaaggagacuugccguggucagcuugucuaacccugugucagcagagaaagacaaaguccaggucuuaggaagcuuuucccuuucaguauaagaacuccguuucaagcuuggcaugguuaguuuuucuuugugucacuuaguacuuuguuuucaguguuaccugagccauagcuguagcagaugcaagacagaccgaucccuguacuagacaugaaguguucauuaauaauccagaaucacgucagaucugcugucauggcggcggcauauacuucaaggaacuaaccuucuuagaggagucgugauaagaucacucccaaugcauuauuugauuaggcuacaucugaaaacaagggauauuuuauuauuuuacguuggaaagauuaguauauagauuuaaaaaguaguugcagaaaucuacacagguugucaguaauauuguuagccaugugaccuuauuuuaagugaugucagcuuucuucuuuuagaacacaggaugcuucugggccugagcugauacuaccugcaagcauugaauucagggaaaguugugaguaauuucagauuucauugucaaugaauuauuucuugauccauuuuacuccaucugauuuucacauucguuuuuauucuuuuuuccuuuuuucuuuguuuuugaaaucuuuccacagcugaagauucauuuuugucugccauuauaaauuauacuaauagcucuacaguccacuuuaaguuguccccuacauauguauuauauauggcaugccgguauguauuguccaaccaguacagaccugacaucagcccuacagagcgcacacauaaagucauugcagucgucaacaagauggugagcaugauggagggugucauccagguacguuccagccggccagccaugcuccuccagugauugugguuguaauugcuaagccagugaauucagcuucuuuaaggcuucucauuugguuacaagauuuuuuucuaaaauaaaaguuauguaaauauuguaggaaaauguauaacuuuaaagaguugaaaggaaaugcaagcuuuuuucuauuuuguuuucccuguaaaacuucagcauaagugaaguuaacuuguaguaauaguugugagaaagugcugagacuguugugggcuuuuguagaauuuuuucuguaaauaauuuguugagaugaaguucauauaauauuaaccauuuugaagugaacaauucagucgcauuuggugcauucacaguguugugcagccaccaccccugucgguuccaaaacgucuccaucaccucagagcgauaccccucaaguaguuccugggguuuuucucuucccccguucccugguaacgccuucuuagacuuuuuaaaaaugguucucaaaagucacuugcuccuguguaaugagccuagacguugguaguaauugggcuuuuugauagcacauguguagguguaauggacauuguaacauacuucucacuuaaaaugaaauucugucauaaaccuguuuucaaaauuucagaagauaaagguauuuuguugguagaaugguuugacuccuuuacguacuuucugucccgaucuacaguugauaaaauuuucauagcaguuuuucaucuacagaugauuugaagauuuaaucuuuaaaguucuuaaaaguaaauguacagauuuuuucaguuuuucugaaucacuugucaauguuguuauuuaacuuaauaaaacucuaguuauauaauguuaauaacauagauagauugguugcuuuucuccuggcaggaucauuugagggaaacuaagaucuuuuaguuccuucagaauuguuuucaaaggccagaauuuuucaagaaauguuucuuuuauauuugagugauuagcaugaguuugauaggguuaugcuucuuuuacccaaguuaggaaauagguaaaaaagaaagucauuuuauuuggauaccguuuuguuacuuucaugucauuauuuuauaaacaaacauggauuuccuuuucaguugucauucaaagccauugucugucuucuaucauguuuggacuuacuaagccuguuucgaguugugagacaccuaucauaaaacuacccuugauagccuuuuccuuauugaugugaacuagucagugaaaucaccauuaucaaacaagucuuuuaaacuucagauuuaggguuaguauccaguggggggaaucuuaaaguaguggaaaagaacugugguagugaauaauuuaaauucuauuuucaaaaaacaaagaauuugcucccuuuaguauagguguaaguuauuuauacacuuuuaaauucucaucuucucagcuuuuauuuugauuguuucuuggucuuuccugucucuuccauuccuauuaauuaaucuagagggauggacuuucaccuuauuagguaccuuuuaaguaaguaguaagcacaccauaucacugaaagauguucguucacaaguccuuccauuguaaaucuuuuaaagagaucaguguguucauguguguuuaugguaacaucauauuuauugauaaacucuaaaaauacaguuaguuauugugccagugguaagaacauaaaacuaauccuuuaggucguauacuucuaaaggugcuucagaaccauaaaugaaaauguuauuuugggaauaacauaacuaaaugucguaccuucaugucguaccuucauauuaguguuuugauuuuuuuaaacuaucaugauuguuuacaaguuucuuucucucguucugcuugauuuccccucgucuguuuuucuccaggaaguagaccagguugaccagguaggacaucugcugggagcugauccuagcuguguugcuuagccaaguuucucaugcugcucccaugucaaauaaguaauacaacagcuggacugaacagcucauaacacucauucagcaacugagacaugcaguacuaaaacccuuuuugacugugcaaccuuuaucggcauuucauaauuucugcuuaaugcacuucaguguggauaugaaaugacaaaaguucuguuucuucucuuuauuauuuauccuugguuccuauucuuuggaucucaucugagguugccuggccugcacauguggucgggagaggaugugauagaucaguacuugauacugaguugcaugguguccaagccagugacuacaaguaucaggguggcuguggguaaccauggauacauguauguauacugcacagacuaccagauaaugcacggucuacaauuugguguuauauuauuugauaucuccauuucuccgcugauuccaucuauaaauuguagcuaacugaauccauaugucuaugugcaugaauccuaagaaauaguugcagugguuauuuacuucccauugcuauguaugcacccaaauuauuuugcaaauaucugguaucugugguaaauaccuuggugaaaugggaagguacuggucuaucuucagcagcuuuucaagagcauuccuuuauauuuuuauuacuuuuguuuauucucuguugcuuauggaaguguguucugucuacagaaacagaagaauauugcaggggcacuugccuucuggauggcaaaugcaucugaacuucucaacuucauuaagcaagaccgagaccuuagucggaucacacuggaugcucaagauguuuuagcacauuugguucaaauggcauuuaaguaaggaacacauuuuugaaggcggcacuacucuaaauaauuaagucauuuguuuucuuauucaguuuuccaaacuaauuuuaagauuuauauuuaccuugauugaaggugaauauaaagaagcauacauuuuugcaaaauguauuaacuaccuauaguuauauccuuaauauaguuauacugaauucagugagcuauguuucaagauuccacauuuuuuuuuuaauggaaaauauuuuuuaagaguccagauuguuucccaugugauaacaugucugacaauagcugucugucaugcuaagauuacuuaaauugucuauguauuuucagauacuugguucacugucuucaaucagaacuuaauaauuacaugccagccuuucuagaugacccugaagagaacagucugcaacgaccaaaaauagguuaggauguuuucugacugucucccucuaucccgcuuccuucacguuuagcaucauuuuaaugcuuagcguagguaaguggagguguuuuuaaaauaaaugggauguccuuuuggguuuggcaaucuuuaauaaauuuuaacgauuauuuguuuuguuuacagauaguucucauuuuggugugucaugcuggccauacucuuuaaaaagucucuuaaggccaaacuaaugauguuaaguguaauuaguuaauaacuauauguaguuuaagaucaugucacuguuuccucuuggaaugaaguugauauuuuuaaaguaauuaaacggcacuuacuaccauagguaccauuaucuaaaucugcugcacauucaaaggcuucuuccuggaugacauuuugcuccucuuguccucucacccugucugggcagaugaugugcugcacacgcucacaggagccauguccuugcuacgacgcugcagagucaaugccgcccugaccauccagcucuucucucagcucuuccacuucaucaauauguggcuguucaauagauuggugaccgacccagauucggggcugugcucccauuacuggggugcgauuauccgucagcaguugggccauauugaagccugggcugagaagcaggggcuggaacuggcugcggacugucaucugagcaggaucgugcaggugauugcuggugccacuccccagcucaugugcuuuaugauaaaggcaucugaucuuuaugaugagcaagagcuucaaugcagcaaaaccucaauacccucuuuuugggguuuuucguauguacaaauaaugaaguagugcuaugugaguacuugggcugcgguuacaaaguacagauuauuuuuucacuguauuaauuguaugccauaauuguuacuguuaaguacuuaagccugaauaaaucuaauaaaaugauugcuuauagauaaauaaaaauucagaguuagaaaugguggugacaccaagcaacugcagauuguuuacaugguuuguuuucugauaauuuaauguacacaaacuuuguuucaugcacaaaguuauuucaaauauuguaugaaauuaccuucagucuguguguauaagguguauaugaaacaaauuucauauuuagacuugggucccauccccagagauaucucauauaugucaaucuuccaaaauuggaaaaacuccaaaaucugaaacacuucuggucccaagcauuucaguuaaggaauacugaaccugugucaaaaacugaguggcuuaacaguugcuccacagcccuggaggccagaaguugaaaucaagaugucagcaggguugauuccuucugggggcucugaggaaaggaucuguuucaggccuucccccuagcuucuggugguuugcacgcaguuggcauucuuuggccuguagaugcaucaucccagucccugccuuugucuucguacggcauucuccuuguuugccugucuguguccgaaagacugcuuucuauaaggacagccgacauuggaccagcugaucuuguuuuaacuugaugauucccuggaaagaugcugucucgaaaaaagauaacacucuugaggacugaggguuagcccugcaaauuuuuaggggacacaguuuaacucauaagugguaaccaguggacuguaaauauccuuaaaggguucuuuauauugagaucaguaagauggauuucagaacacuuuacagugaaagaugaguaccaguuuuaaaauggaugauaauuaacccucaagaauacaaagccaaauaauaucccaguggcuuaaccagcucugaggaaauuuuuuagauaugaaaaacuaggaggugauguuuugcaauuaacgaaaugagucaucuacagcuuaaaaaccuaggacuuuuuuuuuuaguauuacguauaauuuuuuucuccauuuuuaaaccuuuuuuuaaaagagauuuaguauagaggcuagacagcugguuaugaaaagucaggacgaugaaacuauucauacaccaguaauuggucaucugaauggucaaguaaauguuuagcuuuggaagagaguuuuuaaaaugcuuuacgaacauaaaucuaauuauacaugcacgucauaaaauuaagagggcaucuaaaaagaugcccuuuacaagauaaugcuuuuaguucuauuuaauguauauaguuacuguaaauggaagucuguuuccugaaaucauucugcauuucaaaguuaaauuagcaaguuauauuuuuauaaauauuacauaaaggauaauauuuuugaaauaacuuuacaagugugauauuuuauguccuuuauucuuuuacauaggcaacgacuuugcuuaccauggauaaguaugcaccugaugacauuccaaauauaaacagcaccugcuuuaaguuaaauucauuacaacuucaagccuuauuacagaacuaucacugugcaccugaugagccuuuuaucccaacggugaguggauguugccacauuaccacacagugcgggacauguuugcauggggacauuuggaugaaaaaacaaaaggaaauccuauuuaauacguuaacuuauuuauucucaucuuacaagaucauuuucguguugcuguccaagaguucaaugaaaaaacagaaacuauacuccuaaguagaaagggauuuuauucaggaaauuagguucuugggaagucaucagaaggacuagaggagaggagguuaggaggcugcccaggacuguuggguuccaguguacguagccacaacugaguguagaggguggguaccucugucacagaucacccucuuacagccuagcugaaaugagaggcuugucccuucucauccagaauggagccaggaguuuugguaugccugccucucaguaggagaaacagagggugagaaauaguaucuaccacuguuagcuauuuauaaagagaaauacuguagacuuaaauaugagucaugagaauuauguauguggauggauggauugaccagcauugaguuuaugcuaacaagacaugcacaaaacagccagaaacuggaaaucaccaaaucaaaagcacagcauauacauaaaucgugucauagucauuuaaagaaauaugugagaaagaaugaauuacaguuacaacaacugggaugaacauuaugacauaaugugaaaaaaggcagcccugugcaaagugcauagaauaugcuucuaucuguguacacuuuaggaacagucaaaaucacacucuggugauagaagccugaaaaccaugucauucuuuuugaaggagaaggaggggacagugauagggaaugggguggcuacucagguggcgauguucucuuuucuugaacagaagugaaccuggugguugagcugguguguucaucuuuuugaucuguacaguuaggauuuaugaacuuuccuauauguggguaauacaucaauaaaacgugucuaaauaaaaaucacccauaaaccaauaauuuagaaauaaccucuauauauugauauauuuccaaacuggcaaaaauacuggguagauauuugauuccggucuuuuauauuuuacauugugugggcuuuucccuauaucauuaaacauucuauacaaauauaguuauuaacagcugaaaauuaaagaauugugugaggaaaaaaaugauuagaaaagaaacuucuugugauugaacaauuucuuuuuauuuaaagcuacacguuacuuaaaauuaguaauuaaaaucuugguucaucuauaaaaugugugcggcccagaguugcuggcuuuagaaaacugaugauggggguacuccugggaccugugcucccuccguaacccugcgucugucugugugugugugugugucugugagauaagcugugcugcagugagcagacagccuuugaauaguuguuggucacaugcaccaggcagugagcaucucuuuuuaauuuugcguuuguuuuccaaacaggaucuuauagaaaauguagugacuguggcugaaaacacugccgaugagcuggcccgcagugauggaagggaagugcaguuggaggaggauccugaucugcagcugccguuucuuuugccagaagaugguuauucuugugauguugucagaaacauuccaaaugguuuacaagaauuuuuagacccucugugccagagagguaaauuagucuaaaugccugagucugagcuacgccccagguugaagcgagcauuuuauucauuguccaucucauaggguaguccacuugugugggagugcacccucgugcugucuggagaaguccguguuccacugacuuggagaaauauuucauggugauguaaggucagaagugucgagacacagagcccuugggcauguuuugugacccuguagugagcaucugcucugcgcacuugaugucaugguuacauuuucugccugggcugauaacaaggaaccguuuauuguucucccuucuugguauuuuaugagcguaguagguugauucauuccuuuagcacuaaauuguaaacuuuguugauaccagcauagcaguuaagagcaacacaagcuuuggaagcagacugccugcauucuaaacccaccucugucaccuacaggcugugcugccauuggcaggugacuuuggcaccucaguuucuuuucagugaaaugggcauguugauaguacccagcuaagagauucuugggaggacugaaugguuuccuguggagcaugcagaacucuagcacagagcgagugggugugagugcugcugcugcuguggccagcacugccaagcuggcuugcgccugugugcuggcaagacccaaacuccagcauguugugugcuuuucugugugaagggcuuauagcccugaaagguucgaauacaacugauuuccuggauuuuauuaugucacuuuuacuacauuuucuugugaucuguacugaucaaaaacaccacaguuauuucugauguaugagguuuuguauuagaccaaauuuuaaucccagucugccacuuuuucauaaaguagaaaacagcucagaugaguagaaaguuagacucaaaguguagggguuuguuuaaacacauaaaaguaauaacgauagagguuuuaugcccguagguauauaaaucuggugagugugauuuuuaauuucagugaauguuucacuccccacaauaaauacguuuuuauaccuuucaagauaucuucaaaguuucugauaguuaaaaaaaucauuuuacaaaggcugcuucuuuaaugaaauguguuugcaaaacaguuaccucugagccuuuccaaaaggugcucaaggcucagugccauccucagagacgcagagagaggccaaggugagaugaggcuggggugaggucuuuuaggaaagugugugugaaggaagagggguaggagcaggaguaggcagggagagccuucagucuugguagaggugcaccugugacgagguuggggaaggaggagggcuggguuucagugcaggucugagaaauggagugggccugaacuagccccagagcauuaguuccgugcucugccauucccuggaaaaagccucaugccacacacugguggacccagaggcagcagcacagcuuccaagcggcaggcacucggccaccacgggacugcugagaaguauccuucccagugugcugcaucucagcaagucagaaagcacagccagcuuuccuucccacaggcuucuuccccacacacggguuacuuagagcguuaguccucggacagucuccucacuccacuuuuucauuguauucuauuguucauauugccaugguaucuuaaaaccaugguuugcggauggcgcucuccugccaggaacucuuccucugucaugugugggauuaauuuaaacuguugagcaugacaucaucuuccagccuuacuucuucaccuugaaauacgcacacuauagaugucauucauauugaacuguauauuauuaauaucugugcuguuaccguugucgguacucuacuccugcuccugcuguugaacuuacacacuuacuuauuuucuuaauucuaaucaggcguccuuuuauguggaaaaccucagugucuuccuacuuaacaugucuuccccacacuuaacaugucuuccccaggagugauucuuaguuacuugcuucuauuuuugcacuggucacauuguguuucaaacgcgugccgcugucuguccuccacgcuuagugaggguggucccugagauccugggcuugaccagcugcacuuucucugauccucagcaccucacaugggccugcuguauguucagugcucaguaacuguuguuuuuauaauuaauaccuugcaaauaagcauguaaggugacuacuagcauuuugcaaaugcguauaguuuauagguuagaagcaacugccaguuuugucacaugugccauagggcggauccucaccaaguuggaaauagugagcucuugacuugaugauggaguauucuuugugacuuccccauaagcucucuuaaaugauuaauguuaggacauacgugauauuuccguggccgaggcaucaccacauuacuucauguguguuagaugaucauuguacacguagcuuaguacacagaugccuuuagaagacuuacaaagaaucgaguguuuucuuucaugacaucaguguuuuuaaugcuucacacucaauucuuuacaagcugauuaaagaauuacuuugugccgucaauauauauuccuuuguuuccuucauacaauacaguucugugagaaaagacuguacgaccagccuggacucauuccuugucugagaugcauuccguaagcuaauaaagccaaaccucuauuuguaauaugguccagagcuuguuauggaaaugcggcccuugaaaaaaauaaaauaauuuauaauuguucagauuucaaaaucaugauaaauuagugauucccugaaacaugagaaagagaagcaaguuguagguuauauuuucaugaaucugaauugaaauagugauuuaaaaaauaaaaaaaaaaacuaaguaaaauuacuuuguauacuuauuuuaacugaauauguuuuugacgucuccuuuuuugccuaccauaaauaaccuaauuguccacaaauaacggucagaauuuucuccuuguugaaccacuggaaugggugagacugucagcuacugccagggaaaacuccucaccaguccaagccauuagaccacuugagacuguggugaaaagcugcgcagagucugucacacaggacgcucuugaugaauguuaggugcugauagugggaagaagauggcaguagagaaaauguaccgaggauuguucagggcccgugugauagauaggaguuggucaaaaacauugcugagaaacaaaauaggauuugacuaaaugaggaaugaccuaguuugaauugaaaggcuuacuuuuacaaagcaugucauuugucccugaugaaaauaucagagauauucuugaaaacauuauaaaaugauucugaacuuuauuuguaagaaauuuaaauuaguaugaccuuaaaaguaaauuuggacagaguaaugaggaggacuccuagaauuguuauacaaguuacccaguaauuugaauguaaguaguugaaccgagagucugacgugcuggcagacaccccaugcucguauuguuuucuggcuccuucccucuuuucuuucccuuugcuaaguagguauucugaauguuauuaaggaucucuuaguguaguggaguaaacgguucugcaaggaaguaaugacaaggcuauuugguaauuucuuauaggaguaagaaaaaaguucuuuuggaacacagaggagugggaggccaauuuuacuuuacugcuuggugcugaaaugcucuuggaccaaaacaaauggauaauuuuaaaugucugguaauucaguuugcagaggggauuaaagguguagaguaagaagaaucaauaccguguguuggauauuaagcaauugguaauuaaucuugcuuccuuuaucuugacaagaugugcuuuuucacuuacaauuugcuuguuuccuccuuaggauuuugcagguuaauuccucacacacguucaccagguacuuggacaauauauuuugaaggugcagauuaugaaagucaccuucugcgugagaacacagagcuggcaaguauuuugaggguaccaugaagugaaauggauccuuaggacuugaagaugugaugcagauuuguuucuuucuuacacugaagauuggugugauggcagaguuuuaaaaucgcuguuaaauacugauauucagaaauuuucaagccauaauucauauauauguauuuuuuccucccaagccaugucuauuacaguuuugucuguaagcaguggugcuuuuuaaaauaaagaacacuuauacccaugguuguaccagucuuaauacauauuuuaaaacauauuaauaugauaaccuuaaaauauuuucuuaaaauucuuuggcagaaauauuucauucuuuuauagucaguucugccuugucuuaaauauauaucaagccauuuaguaauauuuuauaucuuuuugaaagagugguaaaucccaaaauuucccaguuucauacauguuaagaacaauucuacuuugccucauauagacaguuuuaaacacaaacaggaauuuuuguauauucaaaguaauuaauuuggcuuccuggcauaccuuagguuugagcaucauaucauggccaucuccagaaauugaauuaauugaugaucguucuuuuguaccaaauagaugaucacauugaacuacugacaaagugaacauacccuaauacuuuuuuuuuuuuuuuuuuuuuugagacagagucucgcucagucgcccaggcugaaaugcaguggcgcgauuuggcuuauugcaaccucugccuccuggguucaagcgauucuccugccucagccucccaguagcugggauuacaggugcccgccaccacacuuggcuaauuuuuuugaauuuuuaguagagacggggauucaccauguuggccagccuggucucgaacuccugaccucaaaugauucgcccaccucagccucccaaagugcugggauuacaggcaugagccaccucgcccggccccuaauacuuuuuauugacuuuacuaacugcugucuguuaagucccaaauaacagcagcaacuucuguuuacccaauuuuguggaaaaacaaguaccuucuagguagauucacucauuccucgucuuuuuaguuuauucuaagauuccucaggagauuucagguuuugauuuaaaaaaaaaaauaauaauucuaaugucaacuaauuuuauuuuccuuaaaauagucucuuacaagcuuuaguuauuauccuucuaaauuaaaaagccauauguauaauuaccaccucuuggcaagguaccuuccugcuuauauauuuaauuacuuaaguuccuccuuaguguguaugcacuguuaauuuucuucuugaauuuuguuuacucuuuggcguauaggagugacauguauagaauacguaacuucaaugaguaauuuugcuuucucauucuuugagucugucaggagcugucuugccuuacggucugucaguuuuaggcuccuuacccagccaggcgggcuucacucaauagcagcgugcucuggguguugcugcaugaguccugcagcggcccuggugcugugauuuaaaauaaaaugacugcuggguuuucgcaagagacaaagacguuaggucaucuuuguuauaaccauuuuuugcaguccuccccguggauaguguaaaauaaguuuacauuucuucuuugaaaacacaaaaagacugguaauuuauuuugaaagguaauaaagugaaaauugaauuuuuuccuuacgaucaggcuuucuaccugauaguaaugggaguuuaauuuuguuucauaaacuaaguucuucaaaucaauuuaaauagcauuugugacuaaauucaucuuuaagacuugagucaagaauaucgauuuaguuuaccagauuaauaccugaagaguaucuauauuaauugaaauuuuuuuuacuguuuaucuucucauccuuuuucuuuccccauuugcuccagugaacaugauugacuagaucaugaguugucuaaccauacagaagcacuuccauuucagucauaaaauaaaccuuuguuuucauccuuuaggcucagccucugaggaaagaaccugaaauaaucacugugacccuaaaaaagcagaauggaaugggccuuagcauuguugcagcaaagguaggccaauuagucacgugcgaguuguucucuccagucuuucggcauugaaucagugguugucagaguggaucgugugggaguacuuuaccaccuguguauaacgugccuguucaguucuguuucugcguaggagaggaaugguguuacaugaaugaagccagugugcucacugggcccaauuaguugagggaugaucuccuacucugagaauguagcuagagugauacuuugagauugagcagauggugcucagaaggaaacaauuuaaaggcauagucaaaacuugauucgcacagugaggagagaaagcauugcuacaguagaaaacugcaucgugggaguggggcacagggcugucaccucaucauagugggccacuggacuccuuucucagacuccagugcacauaaaaaccgcuaaggacuuugcuacacaaggagauuucugguucucauuuccaggugccuuccaguaagucugguguggagcuuaggaaauggcauucuuaaccuaggccuuauauaguucugauagguguugacugcuggaccacccuccuggaauucuugggguuugaaucccuucaccugcuaguuuuggcaggauauuuaaagcuacacagaucuuuucuuugaguuaaagaaaugaguauugugacuugguguuacucacucaugagccucuuccaauauggaaucucaauuauguuugcuuagaaugaauuuuagcuuugaaucauauuuagauauuuuccaugaaacaaauauguguuuagcuaauauucaguaacuaauguuucagucaacuuugcugauauuuugcuuaaaaauaacacuuuggccacuacaauuuguauuuuuguuucuaucucuagggaauauaugaaaagcuugaaacuguuacauagcaauaugauagaagugccuucugaauuacacaguuaaugugccuugagaaauauuuuaauugcuaauagucaaaaauuuuaguuuauuuuucuuuauaccagaauuauauuauccugaauauugauuuggaaauaaauggacugucauuugaaaccuugccauucccauugcuagagaccugugauuuuuaaaagcuuucaccgaagcuuuuucuuccucagcugcucuaauuugugaaggguccguuugaaaugaggguauaggggcaggccaugaggucagcuuugcagcgaacaagugcagaaguaugagaaaaaauguugagguccuggcuuugaaccgaaggcuagauggugagcuacuaaguggucuaacaaguacacaggcuuugccuggcugggcauauuugcaucuacugucccaucaugcugugagaccuuuauuuuuauguuuuaaaagaggcugggucuugcugugucacccaggcuggagugcaguggcacaaucacagcuuugaacuccugggccaagugauccuccggccucagccucccaaguagcuaggacuacaggagcauaccaccaugccuggcuaauuuuaaaaacuuuuuuagagacagggucucgcuaugcugcccaggcugaucucgaucaaacuccuggccucaaccaguccucccacuucggccucccaaagugcuaacaaagcuuuuguguccuacuuugcaaggacuugcuggcagcucacucugcucaucucuguccccuaaaucaggguacuuuuagaacuggaauuaaaucaugaguuugguaucuuuuuuccugucagacugauucuguagcaucuucuuuguagcuauccccacucccagacacaguccccagcauauaguaggcaaaaaauacuuguugaaaaauagcaaauaagaacaauuuuuuuuuaccgaguggauauuugauuugcuguuacacagguuuaauccuggaaguuaguuuauuuaaaauaacacauuaccagcuauauuagcacaacucucacugaauuagcuaugaggaaaauuuguuauccauaaucuuagucauaacaacacaaaugccuacgaaacaauaugugauuaagaucuaguacaaguaccauaaaacuuuaccuuuguguauuuuggagaaauuaagaagaugaaugggcguuguagcgguuguggagggcaucuugggagagguggaguuucagcuaauccuuggaacagacauaauugggauaaaggaauaagggagauauauugugggugggagugagagcacaagcagagauagaagaaacgagucuugugugggccacuuuuggauaaggugagaccugugcgauuacuaaggagagcagaauaaggaaggcagugcuuaauuaguuuuaaaacucuugauugacagguuaaggagucugugccuuaucuuguaggcaccacaaagaaaugcaggauuuagaacaaaagaggaacaugaugaaacugacauuuuaggaggcuucaucugggucuggugugcaggauggauuagaagaaccugggacgaaaggugggcaucuguucaggaguucgucagaggaaccugaacccuuuuagcguauggguugaaggugaugcguggggcauaguaagcugccucucagagaccaagacgugugggguucaccugugcaggcagaggguaguccagggcccuucaguccaccucaccauccagaauuucugcuuacuccugguaaggguccugcucacaggccauguuuccaggcuguugcaauuuaagggaccagaacucaaacauuuggagauguaaaaggggaacugucagccauagagcuauguuuucucuuugcuuaccgacugagucaaugcccauuuucaggaaaaaaucagaaucacaaauuacccuacuguacucaaaucugugggcagaauguaaccuccauauuuucuguuauguucauccuguaaccuuauuuuaaaugcucuucuuaccugggguuuuaagaguguggagguggaaguagggggcuuccaagaucaguguccaccucuuccaguuaaaagaaguaucuugcaguacaaaacuauuuguuuccuauagauucaagucuaauuuacuucugcauucagucuuucagaguuuuugguauucucuuucgcaugauuuccggauguauaaaggaaccagcauuaccuuacagcagggcagaaggagcggagcucuggguucacuuggcacuuucucacccucugcuggguggccucuggccucugguuguuugucucugaauuuugaccucuguccuugccagggugacagggggcaauuaggacaacaagccagcuugaaagucacaccugagccucuguucaguuuuacuguggcaaugcaggcaagaggcugagggacaaggugccagccccagugucaggugacagucagaugaugcccagaugaggagaauccucucacuucaaggaggagcuccagaaggaagauucugccaguuaugaaccugggagggaagaggggaaggagugcaaaaggugucaggaaaagugccucagcucagacgcucaggcacgggugcagagcccuaggagugcccgacugugccugaguccagggagcccaugcugcuugaaugggcuccacccggccucugcccauuugugcauccaugcugcugcccacaccugucuuugcuucuuguuuuuagauccuugcacuuggucaccucuuccacacccagccucugcuaaucccuaauccccucuucuguggggugugaaguccccugagcugcuguauguccucuuugcauuugcucuuacacaaggaagccucagaagaaacacagccuucucucuguaucuucaauggaaaguaauuuugucauaaaaauaacugacucuggaaucuuugcuauuacgaaaauauuugucauguguggugaaaagguacaguagguaucaguguaguacaauuacuggcuuccgugagucuaaugugauuuaggagucugcagggguuagcuucaggguauauuguaauuucaagacuagguucuuuguacuuuuacuaguauuagaauaaacuuaguaugaaaguggugucuaauaguuaaaauaauauuucagaaagacuauuacugccuaucgugugaaaaguagaguguaaauuuucacuuuuaaacuuuaaaucuccagcauuaaaaaaaaaaaaauuaacaaaagauauuuacaaagauuuguaaagaagaccaggaaauaacaauguuaauaguacuucuaacuggguuguaggcuauauuaauagaauuggggcuuaauggggcauaguaacagcguagaagguuagguacauacagucaaaaagauggaccuuucaccagcugaagcuagauuggggaugugucugaugugcaugucuacacugcaccugcaaauuugugacuccugaauuaaacaugcuucccucccccuccucaggucacucacacagcaagucuucccugguaagaggaaggugaagguaguuguccccuuagagcaggacacuccaaaagacagccugaagagguuuugagcacccgcucuauuuggcauccuugucucacucucccaugcauggcuuugcugccuccgugaggagucagacgggaagagguagagaguggcuggaaaggcccugcucuucccuuugcuggggacauagaccugugugucccuuuucuaaaguggggagugauccucccuaacuuguagaugauguucacuuuguucuuguuuuuggucuuuucaaauaccuuccacagugaauaauguguauaaauugaaaacuggaagaaagaaaagggaguucagauuuaguucuaaaaugguuaacuuggccaggcgccauggcucaugccuauaaucccagcagauggguuuaggccgaggcaggaggaucacuugagcccaggaguucgagaccaguccaggcaacaaggugagaccccauuucuacaaaaaaaucaaaaaguauacugagugugaugaugugcgccuguggucccaguuacacuggcggcugaggcaggaggaugguuugagcucaggaggcugaggcuguggugaacuguuuuuucaucauugcaccccagcccagguaacagggcaagacccugucucauaauaacaauaauaaaaugguuaaucaucagcuuauaaaauagauuuagggagacuaagcguggauuugacgcucaugaaaguuuuuuuuaccuagugauaaaaguuuucuucuccuggugagaugucuaugaucuuagucacuucaucagcacaugccccuugaccacuugaaagaugagacagaauaauaugagugaugaauuauaugguugauggucauuauccauggcuguuugcagaaugucuaaacugcgcuccagaguggaagucagugcugaacuugaaggaugagucaguguuagccaggucaaggauggcagcgggcccugugcacaggcucagcccaguuugggcugucaggggaagccaugugggguguguggagaggcagauaggaccggaucauagaguacagugucagcaagcuuuuucuguaagggcccagacuguggagauuuucugcuuugcaggccauguggaaucuguugcccugaguaguucugcuaucauggcagccacagggcaguuuguggcauagcguggcuguguuccaauaaaacuucauaaagaaaggccuugugauggugggucuggacagagcugaggauuuuauuauaggugaaauaaggacccuugagguuuaaaugaggcaugauaugauuagagugcaguuuuuaaaguuuauuuuuacaacucuggaacauggauuagagacgcucagaaguacaaccagagacuaguaaguaaguuguacuaguuuuccagaugagaggucguggaggcuuacaauagggucguggcaguggagaugacgagaugguuugcucugugugcagaggacaaaggcguucuggaacagacaccccgugaaggcgggcaucuucucuuguccacuauugaaagguugacaguuucugguuaugguagguacugauacauauuuguugaauggcaguuuuuggauuggcuuaugaguugcaguaguggaugaaagagggaaguaugaugaaucucaagaagaugaaucuugauucugucuugagcagcuggacauauggaggugugauuuacaaaggcagggaaacugaagggggcaggcaugguggcaucaggaguucagcuuugaacaugucacacuggagaugugggaugccuguucaggugagugaauagauuaucuaguagauaguuggauagugaagcucagaagguuagagcuagagauaaaauuuggaugucagcauauagaugcucugaaggaaauaaagaaaauggccuguuaauuggacaguguaacauuuucagaaaugaagcaucuguuaaugccuuuucuugaaaugagagaaaugaaucuagcaguucccuggcauacuggauuacuaaauacaguccauuuuuuuuccaguuuacuuguaauuucugguacuuggaaagucaucuaauacauacacacugccgagauaacacuguauaguugauagguaugugggucugcuuacaucauuauaauagaguggagguauuuuugagauuucagggguguauucugagugcaggguagggcaguauacagggggauuucaccguuagcccugcccugcgucuuacugagcguguugguguggcagcaucacauaggauucuguuuaugccugggcuuuucagucacgcugcugcugugcauauucugcuccugccacuggcagccuuggagcacggagcccauggcacccccucucaaagccucaguuuccuugccuuuaauauaguaguaauaguuauaguuaccucagcucuucagagagagaagcugugucaggcauguugagccugguauuggauaaucaccugcuguuuguauucuuguuagucucaugagugugugguauauguuuuuucugcagaggaaccuauagacuugugucguuaaauuuuaccccuagucauuugugugcuuuucuuguuuucuauaagcugcgugguuuuugucuuuggcccguucuuuuuuccuuuucuaaauugguguaugggguagcugcuguaacccugaaccauguuuugauguuaaguucccugacucgccuuccacacggugguuaaguuuuaugaaauccagaugauuuggaagcaguguggguaugcaguuuacuuuuuaaaacauugcuuuuggggacggucagcaggcuacuucuuggucaucugugggacaacaugaugcuuccuguuuaauuuggauuuuaaaauuacaaacaauucccuccuuuuuauuuuucuaagucuuuuuaaaguuuaaaaguacaaagcgaauagcagucagcguggacugguuacguaagagccugaauauugcauugguucuaggucguguugauaaaugccauacagggucauagcauccagcgcagaauguggugaucccggucuugaaaaaccagcugucuugguugcuguugaaaacugagagaaguagacgguugauuuucaguucaugaaguuguuguggucccggaaaugaaaaugugguucucuguuguuggaagaacacagucaguggugaguuucuucagggggcaguugccgguguucucgugcucacuguggucuugaaggaaugcuuuuucuuucaguguaacuuguuuaaaccugucaauaauuaacuugcucaugaagcaacaaccguuuaauguagcuuguaauuacacacucuuuuuuuguuuuugcuacuuuugugcugcaaauucuuaagcuucauaaaaacauaagccuucuguaugcuucuuauuuaagaaaacagccaugauauuucauccugcuggguauaauauggugaagguugcuuuaaauaugauaacugccgcuauguaacuugcugaagacauggacaagaauaucuaugauguaaccuguauuuggccccauuaggugguuuuaacuacagccuuucucuaagaccuguuuuuucuaaaagugaacauaaaaaugacacuuuuaaaaguacuuaggauauuuuacuauuuuauuuaaaaauaaaugguuaauuaaugccuuaaguauguucaaguuuaugcuuuuagacaauguacugauuuaaaguuuuaaaaucuuaaaaucuuagcuuaaaacauaagauuccuaugcccuaaaaaugagaugguaaagacuguuuauuaacaugccuucucacuguuuagagagucaguuucucgcauaaacuguaauuuaguccuuugaagacuuugagaccuucucuuguguucuuuaauggucuaauuaugaccaugugggaaacaccuagucaaacaaaugaagucaggaaauuccggguuccuuuuuagucaguuccaaagaccuauugugcuuacauuucuuccacggagaugccagaaacaucuuuccacuaaguuguaugaagugacacugccccucauggcuucuuaugaauuuggaaacaauauauuuguguaucaaaagcaaaauaguaaauuauauaaaagaauacuauuuuuaccugguuuauaauuuuggccuaagugcugauuucuuggauuggcugaaauacugaauucaaguacaacauuaaaauaacauaauaggaacauaaaauguugauccucuaaagagccaucauagaaaaugauaauuuguagaguuuaccuggauguagaauauuggcugugggguagcccagagguucacacugccccaggcuugccccaucucucucaguggaaucuuaagugauccagacccauccccugcacaggccaggacucuggggagcuuugucaggagugucaggcucaccuccaguggucucuugugccugaaaaucugcugagucgcacaccgcuuugcgaggcuaaggagaguugugcacucuacccuggugaaauucacacaccugcaaaugucgcgugcggucuuuggggguuuaugggcuuccugcaucccaucugugggaccaccuucguucccuucauuuuauggagagggaagagauagauguggucuguuggguuuguauuuuauacaaagcauaaacgaaacccagagcuggaacuacagccuugcucauagauaucaagcucaguuaccuugcucacagcaccaaaccugcuggggguaacuuaccauggacuuccaagguugcugaauguagaauucauauacaaagugaauuuuagaacugauuauuucacaauuaagguaauuccuacccaagaagagagaucuuuagaauguuuuuaaaacccaagccuggauuuacuuaucugacuagaaguaaagcaguugaaaaacccagaggagagcagcgagcgggcagagugucaacagaaguaugccugaugacugaaauacuucugggcucugaggucauuucagccacuuauuguucuaaaaucaccagccagagaacccaggcuagguuuucuuaccugagaacaauaggguuggauucaugaugauuuggccagcauaucuuucuuccuccugcucuuuuuuuuuuggauuguguuuuaaugaugucuuuaugcuguuuaucacguuguacucccacacgcacucaggguuugcuacuggaauguuugaagccuaggcuccgccugaccgagccucccugugcguguggggagacuaccuacacuucuauaagcccucuucugaaaaggugcaguaaaagaauuagagaagacauuuggggagcagucuuuuccuuguugccauuucucaucggauguacaaagcaacuuauaggugcgugcuucuuucucaguucuagggaaaguugaauguauggcagcugaguuauuucuguuuuuuauuauaauuuuugauaacuuuuuguucauuuauugccauucucucuuguagcucguucuacaggugaauuucagauacagcuuugguucauccuuuuuuguccuccuuucuucucucuccucucccucguuagucccauccccacucugaaacccccuucuuccuuuuuaauggaaagaaaggcaguuucaagaggcauuuuaagauuaaaauguuaagaucaaacaggcagugaucuuuguguuuccuuuuugcguguuuuuuaaaggauacaagaucuaaaucuucugccagugugugcuacacguuggguacccucugauacgcugaaauugcauugaagggcacaaaggcuggacauagcagugugggcgcuguacugcagauguucucaggggccuccagacggggaaaagugcauuuaaaaauuuaccucugguauuuaagugugguuaauuaaauuccaaaauuguacuuaaugaaauuuguaauuccugaugucuuuggaaucuguaacugcuuuucagaagaccucugccucaacuuuucuuuaaagaaacugguuuguuaaaugaggaaugaguaauccugaauaauuaguuuugcagagaauaaauggacuaaaaugcaauaauaucuuuucaaauaccauauuuagguaccuuuaagcaaguaauccuuaaaacuauuuagccuuucuggaguuaucuauaauauuguguucucaauuuuaauggcucuuuugcuuuucuuuuuuuuuucuuuugguuggaaaucaggauguguaauguuagcauguaaauuauaguaugguaaaaucuuguuuuugccauauuaucugcauaauuguaaauguguugcuaguaccuaucauuacucauaacaaacauacuaugaaaaucuacauuauuggugcagcacuauccgauagaaauauaauaugagcuacauggggaauuuucaguuuucugcuagcuguguuuuuuuaaaaagugaaguuaauuuuaauaccauauuuuauauuaucuaauacaucagaaauguuauuucaacaugcagucaauauaaaaaucaucaaugagauaguucacauucuuuuuuccauacuaagucucugcauuuccauauuucaguuuggaugagccacacuuucagugcucugucaccaccuguggccugccuacugccauacugaacagcacaguguuuaaugccguuucacuaguauucuuggaacuguuucuacauuucugugauuguuuuugguugguagcuaacacuugaauguucuacaugcugacacacagcagcaaagaacauagagcuucuaggccuggcuguucuuucuuaguuggaaaagaaauagaauuaccauaaaaugaauuuuaauugugugcgcauguaaauauaaagacacuaauuauuuuaauaaauuuugaguucagccuuaauagacuacauagauuguccauuauuguuuagaaauaagaccuaaauuaagugguuuaauauuucugaaauuaauaaauuguuucauacaguuuuuuuuuuaaccguaggcaguacaauucucauuuauucaaaugaagggggguagguagugagagcuccauaauguuaaggaauuguuauggcucgacagacgacaguuugcugaggcaucugaccagcagcagaggcagggaugcagcagaguuucuuuacucugcucuucccccagucagggugcacauuccaguccugcacugccauagccagacugagaaaccuuggacaaguggacaccuuguaguuggacagagacuguggugguucggguugaagguaauugcccauauugaugugauacaaauagacauuuccuagaguucuuucaucucuggguaaucaucucuaauuuuguuuugcuaagauaauuaccaguagaacuguaauuucuccauucagcaguuguaguuagaauuuuuaugaucaguuuaugacugugagcugcaccugaaguauaaguaggauccaaauaaccagaggugauaggagggaagggcaugugaacagggccagugggucugcaggaaaggaguguguacagaaggugcagggucaguggacagggaauguguccacggaaauguccaugaagcagagcaguccgugaaguggaggcccgaaugccgaccaaaauguggauaccuguuacauuaucuagauccguauucuuuacuugcacauuguuuugucuucugugucuaagaguauuuucaaaauauauuucgugaugcauugucuugacuuuugaucaaauuccauuuuuaugaucaaccuugaauagaccuuuuagauuuuaauggguguuuugaauugaggucucuaauaaucaugaaugcuuuuuaaaauuuuuuuguagagacaggaucucgccauguugccuaggcugguugugaacucuuggccucaagcaguccucccgccacagccucccaaaguguugggaugacucccaccaugccuggcccuaucaugaaugcuuauuuccuuaaaugaaaaccuccuuuugugacaaacagauuuuauaaauucaguuuacuuggaauuaaaagaagugguuauuacuuagaauucagauaaauucugaauauauaagaaaauagaaugugucuuauuugugccuuuccugacaaucauggauuugaguucccuuccuaaaagggcacauugggugccagagccugaagugcuuuuguaucuaucuuucuaaacuaguaauuuuacaguuuuauugcuaacccauauauaaugggcauaucgguugcuucuuaacuuacuauuuauucaguaaaauuacagaccuccucaucguagguuuuuaaaauaggaaauuggccaaauuccuuaucgaucaauguugguaaacuauaagucaaccuaauugagaagcucuucuggaagggauagagcuccuuauauucaagaagcuucuaauggaguuggaggaaggagccauuugcagagguagcuguaaugcaggacacagugacucacugcucaaagagaacaaagagaauccaaugugaugagaacauaagugaaugaugauaccuucccugacacugggaaggugagugggcuggcaggugagccucggaggugaauggagaggauuugggcauauaucuugcaucagaaagacacuugguguagagagaacaucaaccaagucaugaacaugagucagauagaaugggaagaggugaggggcgauuuggguggagaaugacgagagagguucauggagcugugaauaacuuaugcaggaagcugcugugaauuuuuacagcagcuggcaguuacaagagucuggucagcauagugugagcugagcugugcuucaggaaaugugauuggauuuagagagaccagaagaucagucaugaggagagcuuccucauuuugccagaauuugucugaaauuuauaauguaaacuucaaccuauuuaaagauagggagugcagucaaaauaucaguaguacaugaucaguuuugcuucaggauuuaaauuuaggcauuaaauuuucuauugcauauaguaugauaaauuaccuaccuuaaaaugguagaggauuucggguucuuuaaaugccaugugcuguucauguggaguccacauguucagcuugcacguuggcugucugcuuguauaggguggcuaggaaggaaaagagccuagugguugcccucagguaugugauuacugcucugaaugaaggaguugaaacauggaguaacaggugccacaaaacugaaguuuauugugaaacuggaacaaagacaucuuccaaaaaugaaaauugggaguggcagaagagcugacuggcaggcagcaccaacugugugugcaggggcuuggguuuuagggagaaaugaaacaguccuguuuucauuucugauaucauucuauuuuaugauuuuaaaaagggaguuuuguuauuacaguuugucuaaguaacugucauuuuuuuggucuguauuaauugugaucauguaaaacauaccagaaauggaggaaggaggcuugauuuauuguucuaaaauauauauuugguauuuccuuguuuauaauagugucacuaaaaaugcuguauuacuaauauuauugcuaaacauuuuucuugucagagaugauaauaauugguuaucuuaguaaagggaugauuuuuauucuuuacaaggucaguauuacauuaaccggaagauaaugccaugugaaaaugucgugaggugcccauucucacugacaguuggcauucugauguucaguaaucauugcuuuucuguagucagguggaaagcagaggaaaaaauaaguagugcuuguagaacuuuuuaaaaacugaccuaggguaccagcuggaagggaauaggcaugcagcauuuucaggaaaagaagaagaaggacuaucagcgcuccaacuaaaauuauuaguggaugaccacagauaaacucugcugaagaauagaagaagcucccaaacggcaaagguguuugucugguuuguucauugauguguacguggagcuuaggacaauacaggcgcucgauggauauuuguuccgugaaugaaauugucguuuaaacagccaaguuguagaauuaaaguuauucaugaaucacauaaaauuauuaaaugugugaaaaaauucaguuaauuagauuauguaugagggauuaccugauuuaacaaauaggggcggugaggagggugcugugucuuagaaguauuuuuccguagugugucuuaggucccuagauucaaggaaacccaacauugucacagauagagugaggcaaaaagcauauguauuauucuuuucuaagugauaugcuaaaauucagaaaguugcuguuuauugagugccugcuguauauuuuaucuuuuauuuuugaaauuuuaaauuuauaaaaagcucagucuuugccaacuaucccagucaugcuuuuuauggcaaaaggaucuguucaaggaccacagguuguauuuggcuguugugguguguggacuauggugaaugauuucuagagggagguagcaagugggccaugaggcaucugggacugggcuggagacuugcauugaggugagaguggaaaccauccacaggaaagauggguggacagacacagagagauguaggggugaggguggaaaccauccacaggagagauguguggacagacacagagggauguaggggugaggguggaagccauccacaggagacauguggacagacacagagggauguaggugugaggguggaaaccauccacaggagagauguguggacagacacagagggauguaggggugaggguggaagccauccacaggagacguguggacagacacagagggauguaggggugaggguggaaaccauccacaggagagauguguggacagacacagagggauguaggggugaggguggaagccauccacaggagagauguguggacagacacagagggauguaggggugaggguggaaaccauccacaggagagauguguggacagacacagagggauguaggggugaggguggaagccauccacaggagacauguggacagacacagagggauguaggugugaggguggaaaccauccacaggagagauguguggacagacacagagggauguaggggugaggguggaagccauccacaggagacguguggacagacacagagggauguaggggugaggguggaaaccauccacaggagagauguguggacagacacagagggauguaggggugaggguggaagccauccacaggagacauauggacagacacagagagauguaggggugaggguggaaaccauccacaggagagauguguggacagacacagagggauguaggggugaggguggaaaccauccacaggagagauguguggacagacacagagggauguagggaugaggguggaaaccauccacaggagagguguguggacagacacagagggauguagggaugaggguggaaaccauccacaggagagauguggacagacacagagggauguaggggugaggguggaaaccauccacaggagagauguguggacagacacagagggauguagggaugaggguggaaaccauccacaggagagguguguggacagacacagagggauguagggaugaggguggaaaccauccacaggagagauguggacagacacagagggauguaggggugaggguggaaaccauccacaggagagauguguggacagacacagagggauguaggggugaggguggaaaccauccacaggagagguguguggacagacacagagggauguagggaugaggguggaaaccauccacaggagagguguguggacagacacagagggauguagggaugaggguggaaaccauccacaggagagguguguggacagacacagagggauguaggggugaggguggaaaccauccacaggagagguguguggacagacacagagggauguaggggugaggguggaaaccauccacaggagagguguguggacagacacagagggauguaggggugaggguggaaaccauccacaggagagauguguggacagacacagagggauguaggggugaggguggaaaccauccacaggagagauguguggauagacacagagggauguaggggugaggguggaaaccauccacaggagagauguguggacagacacagagggaugacgaggugaacagauggaaaauucagaucaaaagcugcaaaggagaauacuugauuuugcuuucuguagaacuuuuauaaacuuaguugccagauaauguaacccaugaaauuugaaguauauacugcucuccaaaauggaguugcuuuguuaaauuaagaaauacuauacuguuuuuaaaaugagauauguaauggaugguuuuaugcuuacaaaauuugaccugcuacaggcguuuuguuuugguuugguuugguuugguuugguuuguuuuuucccugaggggauaaagggagucaggaucaacagugcuggccagucaggcugucuucuguaaacuuaacuuguuaacuaaaggggacaaaugcgagugguuuccaagugaaaauuacauagcuccaggguguuacagaaaaucuguuuuaacuaagucauguguugaaucguaucuucguaccuuucugugcuguauuuuuacucuuaccguacagugccucgcagugauugaaauggauuuguauuugucuucaaucguugugaccuaaggaauuaugcucaguuguauaaccuuguccauaauaucuaaguaagauuucaugcguaggacugcuuucuuugauaguugcaauaaauuacccaaaauuuugauuguuauagaguuagguuuaguauagucgugguauccaaguagaauauuggugauucugaaaacaauuauauauagaacuuaagucuauguaacagaauuuuauucuuucauaauauaucaauucuaugugaauugggucuuguugcuuugauauuuauuuacaguuacaguacaugaguuauaauacugauuauuuucuguaugauuuucucuuacuaaguuccucuguuugccacaagaaguuuuuuuaucauuuaaaaucuuaaacuauacguaugaaaagaacaaggguauaagggaggauauagguaaauggugaaauguaaaaauacuguacuagguugcuuuuuguauuaaaaugauugauaguauauaucaugcagguaguuuuuaguuugcuuacacuuguggcuguucagaacuauucuuaaauuaacuucaggauuccaagucucuauuuuacucucaucauuaacugaugcaugaauaacugauuuuucauacuuguaauuuucauguaaaaaugagaaccaggacuuuguugcaguuaucuguguacauguugggugguuuuauuuuuguuuuacuuuccugcauagugcauuucuuacaauauaucuucaaugcaguguuuucgccuuguuuuugcaauagggugcuggucaagauaaacuaggaaucuaugugaagucgguugugaaaggaggugcugcagauguggucaguaucauuuugaaagaaguacauuuucagugugucauauauucagcaaaugaugugagagauucugcugauacuucuaguuauguagcacuauagugcuuguuggaagaacaaauagaguaucuacucaucauuaccuuuucuuccucccgcucucuuugcucucuaccccuaauccaugcacacaccuguggauuugccuaggauggacgucuagcugcaggugaucagcuccucaguguggauggacgaagucugguuggacucucucaggaaagguaucauugauuuauuugcuugaagcauaguauuagcauuuuuaggugauuuuugcauuaaauguugaaauuggaagauaaaaacuaugcuaaaacgugcucauauuacucuuuaccuuuuauaguguacgugacauuucacuuguuaucaaauuauaaauauauauuuuaaucuaguacaguuucuuugaaacuugaaagaaacauacucaacacuucuuuaaauuucugaauauuaucuuacuauucuuaaaaugauaacaggagauguguuugccuauuuucauagucaguuuucaaaggagaaaauggguagugaguaagcugucuggaagucagaaccauuacucaaaauaauagaugaagcuguguaacaugauuuuccauugcuauaaucacagcgauucaugacagagcaggcacugcguuuuagucuuucuuacauguguaaucuucuucuccuagggcggcagaacucaugacaagaacaagcucuguggugacacuggaaguagcaaagcagggugccaucuaccacggucuggccacccuucucaaucagccaucccccaugaugcagagaaguaaggaccaguagggaaacaacaguguuuuacagucauggccucuuugaauggucacaaaacccccauggaggagguacugguguuacuaucgccccaguuuuaaagagaaagaaauugaggaugagagcgcuucagcauagugccugggauucccaugugaaccuucugaccuuggagcccacacugugagucaccaggaccccucccugucaccaggagccauuuaacuucacccccacagggcugguugacugcuggugagcuuccauaggcccggcacauaguaggugcucaguagagaaugaaugugacguguuaaggaugaacugggaaaaaaacuaaagaaugaaugaauggauuuucaguuuugauaggcagacucaggauuuaaaguguuuaaagaauaaauucaguucuucacugaagaaauaggcaucuauuuguauaugaguaguuaccuuaguccugcauuugcugagauaaggcaugaugaucucauucuguauacagucaugcucaccuggcaagggggauccauucugaaaaauucguccuuaguuuaucucaucauuguauauacgucacaguguacuacacaaaccuagaugguguagccuauugcuccuaggcuguagaccugcacagcgugucacuguacugaauacugcaggcaacuguaauucagugggaacauaucuucacauagaaaaacuacaguuaaaaaaaaaaaaaguggaagaguaacaaugcuagacccauagaaggccacuuaacccugaguggagcuuguaggauggaaguugcucugggugcguccacgagugaguagugagugaaugugaaggcccaggacauggccaugacuacuguggacuuuaucaacacucuacacuuaagcuacacuaaauuuacaaauauauauauauauuucuuuaauaguaaauuaaccuuagcuugcuguaacuuuacuacauaaaauuuuaaauuaaaaaaaaccuuuugacucuuuuguaguaacacuuggcuuaaaacacaaacauguuguacaacuguacaaaauauuuucguucuuucuaugcuuauuccauaagugauuuucuauuuuuuuuuuaauuuaucuuuucaucuuuuugguuaaaaucucguacauaagcacacacauuagcuucggccugcacagggucaggauuaucagugucacugucuuccaccuccacaucuggucccacgggaaggucuucaggggcagugacaugccauggagccaucaccuccuguggugacaaugccuuuuucuggaaggcuuccugacagaccugccuggggcuacuugaccauuaacucuuuuuauaaguaaagggaguacacucuaaaauaacaauaaaaaauauaguauaguaaaauauauaaacaagcaacccagucgcauauuacauuaucaaguauuauauaccguguauaauuguaugaacuauacuuguauacagcuagcagugcagucuggcacgaccacaaacacgaggaaucauuguacuacagcuuuacacuggcuaagaucauuuagaagauagggauuuuucagcuccguuuuaaucuuaggagaccacugucacggaugugguucaucauugaccaaaaugggcuuauuugguucaugacuguaauucacuuaaacaucuuaauuauuuaaauaauuuauuuucuggaacugugguuuuacagcuacaucaaaaagaaucucaggauaaaaucaauacaaauuuagggcuuuuaaaauaauuaguucagacacaauaggagaaaaccauugugauucauagcacaacuuguuaaauguauacauagacuucuaaauauggccuuuauggcuuucuccuccguaaggcaggauucuagaaaccucacaacccagaaccucaaguugguaccuaauaguaacaaaucacagccacagccaaggcaucagagaacgugacuugcugcuucuugaagcaaacacacaccacccaaggggcagcucaacaaaaccucgugugguauugucugccuugcucagcauguuguuuacuuuuuaugucacguagaacuuaacaucuugguugucuaauuucuuaguuaguggucauuuaaaagaagcaaacuagaaugugaguuagaaaucacagagggaagcugugaauaguagaugauaaaccagggugagcaagcaaaaaggaggagaacugacagaagcggccgccaggagcggaaggcucacgucacaugacggcugcucagaacgaugacgcugggcgauuaaaaguucagauauuuuucuacaaagucagggaaacauauauaucuuuauugauuuuuuuuuuaaagauacuuuaaaaaugguuagauuuguugcuuaaaauagugaaguuucaguuaaugagaaaauaagcuuugaaaguguuuaucuucccaucauuacuaauuaaguaaaaauauuuucuuuauucucaguauauuuacuuaaaagcuguuuuaugauucuguaggaagaauugaccuuuaucaccuuauuucuuaugcuaagaacaauucuuauggaauuuuaaugauaaucaggguguugaaaauaaaaucuuaagagauacugaauaugcuuugauuccaguuucagaucgucguggcucagguaaaccccgaccaaagagugaaggcuuugagcucuauaauaauucaacucaaaaugggucuccugagaguccucagcugccuugggcagaauauagugaaccaaagaaauugccuggugaugacagacugaugaaaaauagagcugaucaccguuccagccccaacguagcaaguaagagugacacuuuuuugcuuccuaaguacacuugugaucacagucugaagugagaggaggcacuuugugguuuguuaauuauuaaaauuauucucugcaaacauuggcuaacuaggauaugguuuucauaagggauaucauaaguaacauuucucuaacaaaaacuaagauggaaaaacuuuagauucaguugaucccauaagcaaauacauuaauaacaucucuauuugggguugguaaauuaccaagagaaacuaaaauauguuuuacauuuuuuuuuuuuuuuuugagacggagucucacucucucgcccaggcuggagugcagugcaguggcgcgaucucggcuaacugcaagcuccaccuccuggguucaugccauucuccugccuuagcuucccgaguggcugggacuaugggcgcccaccaccacgcccggcuaauuuuuuguauuuuuaguagagacgggguuucaccauguuagccaggauggucucgaucuccugaccucgugaucugcccgccuuggccucccaaagugcugggauuacaggcuugagccaccaugcccagccaauauuuuuuacauuuuuaaaggguuguuaacaaagagaagaagaaauaauagaaggauaugcagcaggagacaaaggcucacaaagccuaaaguauuuacuuucuggccuauuaccaaaaauguuuaccagucccuggccugauacacagagcuacaaagguuuuuuuguagcucugggcucugauuauuuaaaagauggauguggauaugacaagaccugauuucuuaccugccuugauuuuuuuuuuucaucucugugcuggauacucacuagcaguaugaagaugaaugaggucuuuaaggaaauuucauguuauauauagguuguuuauuuaauauuacacuuuuuuuuuuccccccugacuugagcagaucagccuccuaguccuggagggaaaagugcauaugccucuggaacaacagcgaagauaacaucugucucuacuggaaaccucugcacugaggucugauugauugauaagcaaaaggcuucuacugcauuuccauccuuaggguucccuuuggacaucucaguuaucuaguacaauuuuuacucugaauuagcauugauuauaauuucuaaauuugcaguguuuuaucuuuugauuuuuaauauacuagucagguaaaucaguuuuaaauuaauaagucugggcaaaaugaaauguuauuuauucucaguauggaucaaacacuuuuuaaugcaguauuuaacauauacuauuuuuuaaauuuuaaaacagaucauugaaaaucaaguuagucuguaugguuguaaaaagcucacuuuuuuuguucuucacauuuuacaggagcagacgccuccgccuagaccugaagccuaccccauccccacucagacguacaccagagaguauuuuaccuucccagcuuccaaaucccaggaucggauggcuccuccucagaaccaguggccaaauuaugaggaaaagccacauaugcacacagauaguaaucauuccaguauugcaauucagguuagaaaucaaagauuccacacacuuuucucaccucucaaggaggacacacugaguucugagacacaauuaauauuuucuauagaacagcauuguuggccuuuuguuuuuccuuuaaugguuuugugguuaaguuugaggaaaaaaggagacaggauagaauacuuaauaagaaaaaggauuaucuguucucugauguuugauuaacaaaauguuaggaauauaaggccuuacaauuuuuaagacaaaguucacugauucuagaagugagaaauuagaacucaagugguguauuuugcacuguaucaggagcuaucccugccugugggagcucaugguguggcagggaaaugagacagacacaacagacacagcauggucagugcugugggagaagaggccccagcaggggauggagcuucucagucuuggacgagaaccugggcacagcuguaugcacggaagggccuuccaggaggagggaaaggcacagagauguguaguaguucagcaggaacccuggguagaggggaaagggguggcaagaucuaaggcagugaagauaggcggggccagacagaagggcuugacaugacagcuaaggaauuugauuuuuguccacauuaguagacgggugaugccaaucugaguaguuaagcuggggaacguuauccaaugugguuuucuuuuuagagagauaacuguuuguauggugaaggauugggagaagaaauuaaagguaugcuuaaaaauaguuacagucuaggaucugugacaaauacaugcccuggaucgcagacgcucuaggaauucugaagauuagcauucuuagagugguuggaaaagacagaauucagaguugagauggaauuugagcugagccuugaagaaugagaacaguaggcagcggagagaggauugcacugaggagauggacgcugugauacagaugaggaggagccuguuuucugacggcagaaaaugcuccucaggccacagauguuggcuaucaggagauuucaucuuggccuuuugucuggugugcugguccauccugcuguuuuccuaggugggccugaucaccugcaacggcccagucuugggaguuuuggaugcacucugucaccaaaagcuggaguuaucugggagaaggugucuuucuccaaauuucucuuuaaaaauugaguaauuuugugcccuaguccuucuaguaucuuuuguuagaacguaggagaaucugcuucccauaugucaagacaacccaauuuguagugcauacauugaaucccauuuuuaugcacaguauuuccuguuguguggggcuggcauuacgucuucacauuuauaguauacagcugcuacuuguuucuaccucacauggauaaacaauaccuagaggagagaguugaggaacugagaggcaggccagaguguggaaugaaaaguuaugaugggguuuaagcgaggagguggagagugcgagccagcagccggggccagugcaaagucuuaagggagcagagaagugacucaggucagcccuuccggcagcagggagcggcgguaggcacagucucuguuuuuaugugguccauagauuuuauaccccaguaaugagacucuguguacuaaguaaagcucuagcaaaauguugggaguaaauguuccauuuuucugugagacuacugcuuuuugaagugauacuucaucuuuguuguugguuugcuuuuuaaggaaaaggaaauaauuuguuuuccugguuuacaucuuuaauuuguauucaguaacagggcaggaaaaagaugcuugauucagaccucauagugaucauguuuaucugaguagacuccuuucauaugugccauuucucagauuuuagacuagcccuuuggaaaaaguauacucauuuuucucugugucugugugugugugugugugugugugucauuucucucugucucucacagacacacacacacauaccccuaccuuuguguucaacacauuuguagcaauacauuuuggaccuuucugguauuggagcggacguaucgcagaugugugggacuuguccuugcauuacugugcacagcucugucagcccagaaagccaguccuuagcuuguaaaaugcagaaagucacggaugguuacaugguuaagauuuaauaaucacucgucauaguaauuagagaaguaccuguuguugauuuuuacauauuaugaauaaacacacucauugcuuugaaguccaagucacaugucuggcucugcaguggagauggugcugggcacacaggagggugaggaggaugaggaugggcacuggcacugaagggccucgaggcagagagaaaguacagcuuugcuuuuuugcuuuuuuuuuuuuuuuuuuuaaauuuuagucgagacagagacuauguuacccaggcuggucucgaacuccugggcucaagcaguccacccaccucagccucccaaagugcugggauuauaggcgugagccaccacgcuuggccgcuuuuccuucuuuacacagauaaaugcacuguuacuccacauuagccaaugagccuuguagggcagucucagucucuuucuguacacugauuuaacaguuuuucuucugucugaagauaaaauguuuguggauauuugguaauuucuaguaaauggcugaaauauaauaauucuuuuucuuuuugcagcguguuacacguucccaagaagaacuucgagaagauaaagcuuaccaacuugagcggcaucgaauagaggcagcuauggaccgaaagucugauagugauauguggauaaaucagagcuccucacuggacuccaguaccucuagccaggagcaucugaaccauuccucuaagucggucaccccugcuuccacacugaccaaaaguggcccuggccguuggaaaacaccagcagccauaccggccaccccuguggccgucucccagccaauccgaacagaccugccuccgccacccccgccaccuccaguccacuaugccggugauuucgauggaauguccauggauuugccucucccaccacccccuuccgccaaccagauagggcugccgucugcgcagguggcugcugcugaacggagaaagagagaagaacaucagcguugguaugagaaggagaaggcccgccuggaggaggagcgggagaggaagcggagagagcaggagaggaaguugggccagaugcgcacucaguccuuaaacccugcuccguuuucuccccugacugcacagcagaugaagcccgaaaagccuuccacacuccagcggccacaggaaacagucauucgggagcugcagccucagcagcagccccgcacgaucgagcgcagagacuugcaguacauuacagucagcaaagaggagcuuuccucgggggacagucugucccccgacccguggaagcgggacgccaaggagaagcuggagaagcagcagcagaugcacaucguggacaugcugagcaaggagauccaggagcuccagagcaaaccggaccgcagcgccgaggagagcgaccggcugcgcaagcucaugcuggaguggcaguuccagaagagacuccaggagucgaagcagaaggacgaagaugacgaggaggaggaggacgaugauguggacaccaugcugaucaugcagcgccuggaggcugaacgaagagcgaggguaaaggggggagugcuuuggcugugcccaucuguggucccuauuuuagcuucugcguguuucccauggggauagcuaggccccugaucgugauaaggauuaaaagggccccuaggcuuauacuguuuuauuguauguguuacucuuggcugaugucguagagaaaugagucaggccuauaaggcuaaauuuuuuaagacaugcuuugacaaguauuaaauacaauucaaauggaacuugauuguuuucauuagcaaacucauaauuauccuuuuccuuaacacuuccaguugagaaaacaaguauuuguuaaugaccaguaauaaucuugauccaggguaggcaaaauuuuucuuccagggccagauugauacuuuaggcuuugcaggccacggggucucuggcaacccccagcucugcuguuguagcacaaaagcagccacaggcacaaguaaacacaugggugugucucuguaccaauaaaacuuuauuuacagaaacacagggcagaugacugucuggccccuggucuugucagcauuuugugguggugaacaaaagaaacuguucagaucauuacauuuacagucauuaccaaaaauagaaucuucacaguaguuguacuguugaugaagcaagcauuuguuaagguaauaaacaauuauauuccaauuguagcauaaagauauugagaacugauuuuauucuuauuucuccacaguaugaaaaugauuuuuguuuuaaauaaacuaacaaaaguauaaauucguuuaacgcaauaaauugugaugcagaaauuuuagauaaaagcaagacuuuguuacucuauaaagagaacuguuaagaggcauuuacugcuauuaauuugggcauuuauuaauauuaauuuauagagaaugcuauugaccauauuguguucaugaguuuuagugauuuuuuuuucuuuuuuagacacagugcaauauuuugagaaaagauggccagagccauguucuuuuuaucuuuuggauucuguuucuaauuucaacuguuuuuuuaugcuguuaaugguaaagcucuaccaggagcuauuaggucagacauuuuaaucuuucuaccucacaaugaaauuuaaccuuagauaauaauuugugaguccuuagauccuuggagcccaguagugugauucuuuuucgauuugcucugugaauuuuuccugaaaagucucucucacacauacuucuuaauauauacauaucucagccaaaauguguguauauauaaaacuuugcccaaaauucagcuugaauccccuuagacacuuaaguuucuuaaaugaggccaaagugugaauuauuacauuguuuuacuacuauuuuuauuaguauuccucaagucauuaguaguaaacuuccugaugaguagcuguguuuacuguaagcacuguuuuauuugaaaaaccaaccacuacauuaauagcuauuuuacuuuaaaaguagcuuaaaaauuacaguacuuuaaaaguacucugcauuccccuccccaucagagcucucugaaaggugcugggccugcuggcgccaggugcaugcuccucugcucuggccagugucgcuccugggugcacuaagauggauucguuaggauccuaaggacguucauggccuugugucacccacaccccaaaagaugaaaagaugucuuuuccuucgcugcauuuucaacucugaauauacaacuguuguguauggcaaaugagucaacaguaucagcauuucuuauuguuauaacuguauccugacaauaaugaaaaauuagccuuguaguauuucuguaaguaucuuuuucugugaggacuaaacuuuuauuuaaaggucucucagaguuuuuccaaauggguuaaaacacugaauauuucaaagccuuuuaguaugaauugcgauauuuggaaaguuucuuaugaaaauuuaguaaaaaauauuugcuuuuugcuuaguaguucuguuacaauuaguaucuuagucuccaaauaagaaagcuaagggaaauuuugcuguuuuuuauuuucuauguauccuaaugaugaaacucauuuaauaccaugugggcauuuuucuguuucugaauacuagaaguuagucuguaguucuuuaccuuucucaucaaguugucgaaacacagaugacgcaugauagugagaaaauaugccgauggcagauuacaggucuaaaccuaacuuuuuuuuccacacuucaucuuucuuuuuuuuuuucuuucucuguuaccugcagcagacugcuaugccagcaaucucuguucuagauuugguauguucuuguuucuuucccuuugguacuuuuuuccugucuugauuuucuuuucuuucagugguggcuguuugauguuuucaguagauccaguucuccuuagggguguccuccaucaggagauggagucccugacacuuuagaagcaugccuuugaauguuccuagauuuaguuacucuuugcuuuucuccguuaauuuuaaguguuacuguuuguuuaugguuuugaccuuuucucgguuucagucauaaauugauuccguguauucuuacguagucauaaauacaugagcaaaugaaauaaauuuuguaaugaguaaucuauuucauuuuuuucacauuagacauagauuuuaaauauucaguuguuauaaacucagcugaaaggguauugacauuauuugccaguuaagauauaacugucuguugguagaguaagagauuuccagugaacauguauucuauguuuucuuuaauaauauaacauggauuuuaauucaguuuaucagccaugccaauuuaucagucugcugaaaaauacuugagguucauggucuguuguaaauucaaaguguucauugucauauuggggaaguuuggcucaucguuuagggcccauuaugcuugcguaugguaucuuuaucaccugcuagacaauuauacucugauauauuuauauaaacuugaagacaaauucuagucaacuuauaaagacaaaagccaauaucagacgguacauuuaaaaccugugaaucaagguuugacuuuaguggccuuuucaccaaauaauaguccccuuuuccuuccccccucaguuuagcacagcgguaauaacaccuuagagaggaaccuuucuuacaaacaccuucccuccuuggugauuggaaggcauauuuucugagcuuugcauuuuuuuuuuuacaugaaacaaagauuuaaaaguuauacauuuuucucccuacuucuuuguguguuuugauguacauaaguguagcuggaagauauugaucagagucaccuuagugugagauauucauucagcaaauacuugcucagcauccaugacacggugggcacugaccugaggcauugaagauaccagccagcucucaggcccaaagagaguuucuuauacuaugaagaauucugugacacaugaacaguaaaauaaugcuugcaauaagguuuuuguuccauagaaauaauucagagaguuucuuucuuuagaagauaauuauuuugaguauuaauauugaucuuaaccacauguuucugagcauuucuuagcccaguuccccaguacauauuauuaacagcaccucauuauuuauaaaauucuugggugggcacagugguucaugccuguaaucccagcacuuugggaggccgagcaggugaaucaccugaggccaggaguucaagaccagccugaccaacauggugaaaccucgucucuacuaaaaauacaaaaauuagcugggcacaguggcgggcaccuguaaugccagcuacucaggaggcugaggcaugacacuugcucgaacccaggagguggagguugcagugaccagagauugcaccacugcacuccagccuggggaacagagcgagacuuuggcucaaaaaaaaaaaaaaaaaaaaaaaaaacuauagaauucuuuuuauguaagaauuggcagguuacccuaggagacccucaucugugaagauauuagcccucuccuuaauaaggauaagggcaaauaugugacuauauagggagugacacuacccaguaugguucuuaagauauuuucuuagacacaucacaggauuuucagguagguaauuagagaaaugaggcaggucuuuuccuguuuggaagcagcugaguuucauaaaguugggaggcugccugcacucguuucugcucuucccucuggucucuuugugacccaucaccccugucaguccagggccuaccuucuccauccucugugcucacuuccgaccugagacgguagcaccacuuugaugccagcaauauccucauuugauuucuaguccaaacuucucacauacuaaagacucagauauccaccugcccauguaacaucuccacauggagucaaguaagacuuuuggaaugcagcaugcucaaagugaaaucuuugucugcuucacucaccuugcacugcucaucauucugccuucagccuuccccauuucagcugaugcuucgaguugcucaggcaagaaaccucacagucaugcaugacccccuuuuuucucuguucagaaacucuacuggcuugaccuccucacaaccugaccaaucucugugcccccgugaccagagccucucuccuuuuccugccggggucacugcgagagacuggcaggaucccucgguacugucccccagucccuucacaggacagccuugacauagcauacagcagucucacgagaauguccucacagcccuccuaagucucuccuuucacuuagacaggcggucuaaguuugcucgggucucaucuccucuucacacccuugcccacuggcccuccagccugccugccugccuucuagugacccuccacauguugggccgucgggagggucccugccugucuccauggcugacccucuuggcacaugcaggugucucucagaugccaccuuucugggggggcccaccugcccccacugcuucauauggggggggcccaccugcccaugcugcuuuguaucaggggcccacuggccucacuguguccuguguguuuuucuguggacaugcuauacacauuacucaucauuaggcauguuugucucuucuggguagcgccaccuccaugggaacagugaccuuuguccaaguuucuagaagaguucuggagugugguaggcagucgagugagugggaucggauuccaggccaaggucccaagcucucgaaggugugugaccuuccugacuguuagcaucucaagaguaaagcuguuacuagguuguuuccuauuuuaaugacugagaugguguguaagucauguucaaaccaaagucugacuugcuggagggaucuccuucagcacuagauuaugaugaagcccauugugucguuagggcuuuuccuuuauaucgcaugggcaaauccaggacaccuggaauucgucaggaugucugcuuucuccuggcagaguacucuguccuagccuuggaaccugucucuaacuugaguagccgguuaguuaggaccauggagguggccgugacuguggcugcagcuuugccuggcugcagccucgagaaguagcuaguccuuccaccugaugacaaggugugugauucgugccuucauugcuccagguugccacauaacugcauauauuccucucauuuccucaugacaaagcuauucuauggcagagcacaagggccuaagccagcauggaagagauugacccaguaucacacagagcacgugagagccaggguccccaaacccaccaugggagagacuuugccaguacauguugaacauuccuaaucugaaaauucagaauccaaaauccaaaacucuuugagcaccgacauuaugccacaaguagaaaauuccacaccugaccucagugagagguuguagucaaagcuucguuuuauguccaaaauuauuucaaauauguuauaaaauuaccuuuaggcuauauauauaguguauaugaaacagaaaucaauucauauuuagacuuggguccuguuuccaggaaaucucauuacauauaugcaaauaguccaaaaauaaaaaauccaaaauuugaaacacuucugguuccaagcauuuuggauaagggauacucugcuuuguaucacauggaucaggugagagugaagguuuuaacgagaguuuucugaauucauauuacgugcccuuucuaggacacaaaaaugccucuuuuuguaacacuguaguggcaggaaccauuuucucgaaauuuacuugguuugacaaaucucucaguggcuaagcucagguuugucuuguuaacacguuuuaauggaucaucugcugacucagaaaacaugagaacucacaggagaaauuccucccccuugggguaauaauaccagugaaaagauguuuucaaagaguuccgugguucugcugcuuuccuuacaugaaagcccaagcuaggucuucccuccucuuccgcuuucuuguuuuuguuugcuuguuuuugcguggaacuguagaaauuggacaugccccucuugagcaucccagguauagaagggguugaauuaaaagccuuauaaaaauuucaagcaggaauuaguaggaagccuaauuucagaauuguuucuucagagaaaucuaucugggggaagucagacuguauuuugucuauucaaauuggagugccucuagaaugaaaaugggcccugcccagaauaucagagccacaguguagucacagugcaucuucaggaagucucaguuuuacucaaggaauuaggagaagaaauauguauuaaaaccaacacguauauauugcagaauggaauacaaaguuuguaugauugcguaaaacaguugcccuaaaagaacuucaaguuucuguuguaggccucuuugagccacacugucuuccuuguggauuacgguguuaagucucugccacaagggcguuucaccagcuaagcucuagaucuuacaacuucuaauaaaauggucauuuuacuuaaaucugaaaaaagugugugggcugugcuacaggaagggagcuagcacuuacugaggaccaggugcuacaguggaugguuuuuccugugucauuuaauacauucuaccacugugagagaggacuucaguuuccuaaugaggaaaucggucccuaagacauagaguagacuuuugcuuggucuaaaaaccagguguuaugucacuuaccagagguacuccgauucaaucauuaauuuguaauaaaugaucagguguuuucuucauguuuuugucccuaaaauuuuuuuaggguggacauuuuuaaagggagggagcauaggcagaaaaagucuguagaguaaaaggcuuuuuaagggcuuuaacagagucguguuuucaguaauuugucaaaaaguaaaggguauuaugaccccauuuuauguucagauaccaguuucauuuucaugauacaaaauuauaaacacacagaucucaacauauacacacacauauauauguauauaaaaccugaaaauaccuguuuuggggaauguggacuacccauauagcagaaccuugguucaagcuugcuacauacuggcuuucaaaucccaguguaguucucgauuuagaauaacuuucagucugcauggucuugauucaucggguaauaguuauuuuuuaaucuauucugcacucuccucaaagaucacuuccugcaaggcuauuuugguagcauguaacuuuucauucuuuuaaucaaagugcuaaucuaauaggcaguuugccacuggauugcugggugauuaaauuuguaauuuaaguuaaaauauccuuuaaguguuacugaaugugaguaacccauacaauucaguguacuguuuuaagcuauuauuuugaguaaauuaagagauucucguuuuucucauuaaugcuuugugaauggugggaguaaagcaacauagcuuugaagaacaaaacaauuuauguuuuggagauggaaauacgugaguuagccaaagaguggaaagaaacugccuugaugacauuggugcugguugauuugccuuccuuuacgaauaguaacugaugagcugaacacaaguggaggcuccuugcugaccgcauuccagauuuagaagaauagagguuuuuaagaagaaaaugccuguuuuuacagauuuauaaaaaauuaugaaaauaauuguucugauuucuuaaaauauacuucuguuuaaaagaacuaauuggucuaucauuguguaacacuuucuugcucagcgcuuauuuuuaauugaggcuagaaaauauuaacauaaauuaguuugugcuuugugggauaaggaaaaggcccauauugcauuaaugcaauuuuacauucuacccuaauuacuuuucuguagaauauuuaauauucucacuugcuuuauuuugcuauuuuuguuuggcgcuguuucuccuaguucuccuaguuuuucuugaccccugaaauccuugcugaacguuuccauccuuugcucuggccccuggugcaggaagccuguggggagcuguggcugguucugucaacucaagggcaaggcgucaccgacggcuuccuuguggguucuuaguggcaucuacuccugcuauaagcccccuaaaagccagucauccuaacaucccucuugggguauggauagguuguccuaaagagacaguucaauuauuugucucuuugagaagacaauuuuaauuuuuuucuaagauguuuuauuauuguuuauugacaugaaaaagccuaguaacacagguuaauuuauucuuucucaccagauacaguguuuucuucacagaaaucaagggagagugaaguugauuuuuauuuaaaaaaaaaaauacauacaaaaucaauucaaauuccagcacuuaacauuguuauauuucuacuacaaacaauuuauagacaaacugguaauucuguagaaauugaagcacguaggaauuuuauguaagggauuccugcagugguuagagauugaacuagauggcuuuaaguuucauuuuaauccuauaaauauugauuacuucuucaugacacaugauaauacagcuguggguguuccuguagcacaggucuauaccagauaagaaguaaauggagaacacaguuuucaaaguuaccauuaucuuagacuagaauaacagaaaagcugcguguauccaagaccaaaagggagagucuuucuguucugcacugguuguuaauccaggguuccucuuuagaaaagguauuuucaaccuauagugcauagagaugugagcagaaggauaaaggagcuaaaaauugaaaagaagggacuuagguauuugaaggacauccuuaaguauuugaaugauaugaaggaaagguaucuuucuguguuguuucaaaaaggcagaacuggaaugaccaaaaagagaaacaaugagguaaugaauuguuaacauaagaacuucuugacuaguguuaccugaaaacagaauggauuguauugacugagaggucaacauuagguccagacagaagagagccgagauagggcuccuucccaucucagguucagaguccauggugcagaguguaggguaguccugagucgggagggaauucuugaaguccagggugggaucuggagggagcugaugguaaagggcagaggagagagaguggcaggccuugguccccgggaaagauggacgacugcccggcccacuggagucacauaugcugcuucugucccaccuaugcagaggcgagugggggccucccucuucuacaagauauucguaguggaaauuaaaaagggagaggagaaaggagguguuucaguguguucugcagguccaucaaguggggccuguuugagccuguuaauuuacaugaacggguuaacuaaauuuguuccaguaaaagaauugugcuuguugaaugugugaauguagaugauaaauuccaucuuauagccaugauuaauggaggaauaacugggauuuguggcaaccguuuuuagguaauuuauuuuaaaauuguagagcuaaaaaauuguaaaaaguuuuauuuuccaacagugauuuuaaccugguauuuuauauuuaacuuucuguguguguguguuuguguauaugugugucuacuugucuuaaugugugcauuuuaugucuugugcugguggaguuuguggagggagauuaaugucagccuguuguuaguugcaggacgaggagcggaggcggcagcagcaguuagaagagaugcgcaagcgggaagcggaagaccgagcgaggcaagaggaagagcgccggcggcaggaggaggagcgaacaaaacgagacgcugaagaaaagguuaugguccuuuaagggcagcuagaauuuuaccaaguuagccugaacguaaucgauuggcuggggcagagcgggcuggaaguucuguguuucuuaagaagcacgaggcagagcagggccuggcucccccagcuuugugauuggaccugcaacuuuaccccaucuggcccaccuaccucucuucuggacugucuccagauccccuuaucugccaaguuuugucuccuucaaacuucugaacucuugggcguguguagcagugagccucuuugcaaaggguucguuuccucgggcacucaucuuuacugaacauggcccagcuugucauugugaaggugacauugguucagugauugcuuaaauggcauguggaccgugggaagcaguaggagcguaguaagacaguuggcugccauucaacauuucaaauagaugguuuacucaaaucacucacuucugguugaugguaaagagagcagauggcuuagaaaacaugauacaggaaaauuuaguauguaauccaguaaauauccuaaguuauuuauuuucauguguguguguguguuuaaaucaaguaacccuuuuaauugaauuuuaaaaugacagcgaauuuugacauucugagaaauggggauuuugagauguuucucuccauaucucccuuuguccuguguguguggccgacgcccucuggaugaagaggcuguagccguugagcucccugugggggccuguuucaucccgaggggacugcguguugcucugugugguuugagagaagcugcucuucucuguuacuucccuucuaugaagguagaagcuuucaguguuacaacuucugauggcggaaaauuuaguuuuuauuaauaauuccuucuuggauagucuagugaacuauauuaauagaacaguguacuguucacagaaaagaacuuguagggaguuuuuuguagugauaugcucuauuaggauacagaacaaucuaagaguaagcuugauagacaugaugugacuucacuuaaauggaguagagugaauaauguaaggacacucaccucuguugaaauuggugauuucugcauuuuguagaccuuugcccucuaaguuuaucaucauauuaucuguugaaucugaacagcauuugaaguccucucaaagaguuugagcuuucaggauuagguuccccugugagucuuucacuuguguaaugguaagucaacauugaugaucuuucuaaggaaaucagauuuacaaaaugcugagccgcuugaugucuaaguguuggugguuuuugcuguugcuuugcuguuccaugaaagcgcucccuggcugcuuggagggcugugcuuuuccaggucagugccagcuuggcugucccaggccgugcacagugcccauugcuauagcugggcccaguccuggccacgccggagccucggcgggggcagcuggguugucacggcagcacagugcacaugcagagaggaccaggccauguuuuuccugugcugagaaacucuuggguuauuuaauuuuuccaauguguuuucauaacucaugauuauuugaaauacacuuguguuaguaacugcuucuauaauuaaguggucacuguaaaaaggcgaauaaccuauuuuuauaucagaauguccaaaacucauggguuugcuuuguuauagaaaaaugugccauucauuuguuggguagaauaaaguugucuuguaauuguaucugcucuugguauaacuaaaagaggauauuuugauuucuuccuaaaauguuaccaagcaacuguucuucauguuaauacuaagauucuugauaguuccauuuaaaagccacaagaagucauucugguuuauuccucacuccaagggaacacuuacuuuguguagacaagaagaugagagucuuuccuucaggauuucuaaacacagagcaagaagauucaaugaaaaauugggcucagggcaguaauuggggcuggcauuuauucuuaagaguuuucucccucaaaaggugaaggagugacauugcguauucacucuguguguguguguguguguguguguguguguguguguguguguguguagcucuagagggaguagggagaaaauacaggaugaaauugaaaacagggacuaacaacuuuucacugaaugccagcaagcucucuaaaauuaguuuucuuugguugaacaaauuuacaauucauuguacuucauuucacagcauuaaacauuuacucgaggcaguuuauucuguuugcucuuucaucccccuucuuauuuacuuuuuucuugugcucuaaaacuuuugucaaucuuuaacaaaacugugcuguuaccuuuuuuaauguuaaaagaauuuuaacacugucaacuguaguuugugcagauguaugucagaaaaaaauguacaguaugugucaaaauauauuugaauaucuuguugcuguugcuguuaguuccuggcucucuaauuuucugucuguuagggaguuucuuaagauuugaaauacaaguuaagaacuauggaaagcauauuuguuagauuguuacuuugggagaaugaguguuuuuuuuuuuuucuucauuucugguuuccuguuaaucuccuuccugauaacugaaguaaacagggugguucacucauguccuccuuguccaggaaggacugcucuucugcauucaugggggcucagugaaaaagagugcaaguuugccuuuuggaaagugcuggccauagaaagccagugacagccuauuuuuaguuuugcauuaucuuuaaacacagcaguaacagguaaguuaauauccugccaaaaucagaagaggagagagagaaggaaguaacaggagcguggaggaaggaaagaaggaaagcagaggagaauucaguccacugggauaauggaaaggcauaagugacugggaagcaggaggcugagaauccauuccaugcuucugagcaguuuucugucaaauaauccaggauaguauuaauguacuuguaagucuagggagaagacucuggauugaccugcugcuucuguuacauaguaauuguaacuauuaaacuuugacgucagugugaugaugaggauuguucccuuugaaggcccagugggucggcuguucccuucucaccucugaccuuugcacucuugucuauucccgcccgcagaggcgacaggaagaaggguauuacagccgccuggaagccgagaggcgcagacagcacgacgaggcggcgcgcagguugcuggagcccgaggcgcccggucugugccgcccuccgcuuccccgggacuacgagcccccguccccgucccccgcgcccggcgccccuccucccccgccucagcgaaacgccuccuaccucaaaacacagguccucucccccgacucgcuguucacugccaaguuuguugcauacaaugaggaggaggaggaggaggacugcagccuagcaggucaggauaaguacuccagcacaagaaagucucauggggaccuucuuccugccccucuuaaaccacggccaccccccugccagccacgcccggccuccgauggcgucuuucucuccaacucauuccagccacccucagccaaagccaacaguacugcucacaaaaaaggccagccccugcccccuccaaaaaaauccagcuccuaccaucccagccacugcaaagguagagguaaaagagugacaaaucagcucucuuugucuuaaugauuggaaccucagcaucucucugcacacuugcccuguaguaugguccauggcgaucauacuugccuuggaauuuggaugucaugugaucacuggucucggcauggugauccuccucugccucugauugugauguucugugcuaauacucuuugguagauaucuuaguacuccgauuucuuuuacacuuuaaaaaguuccauuucuuugaucagcugacaaucaguccuucucuguuguucccaaaucacuugaaguacuguuggucuuggcuuucauuuucucucucuaccaaugaucuucuauuuguuugaacaagugcuuuucacacgcuguagugucucuagagacaaagguuauaauucuauuauaaguuuccuuuauuuaauguuggcagaacuuucuguucuggauuaaguagccuguggaauagaucacgcgcucucauggugguuugguugguguggccggagcauccgcuaagcugguucacuguuggcuucaugaccuccgugcaggcugccucacgccaggguccagagacccccguuacagggaaauuccucucauccccuuuuccucuaacuggcuucacuccuuccuguuacuugcacucuuagcaccuaguaacaccagcagccagaccuuagcaggcgugcagcugccguuagggaaaccccuaugcugacuguagagcaggacaguugugcaggggacagggccuagaggcugucacaggcguggguucaguagucauuguuuucaagacagcauguuuaaaauauagcugaauucauaaggauucagauuucacacuaaucuuaccuuaaaugaaacuggaauucugguacuaaauaucuucaaauacaagaguauuacuuuuagugaguguaugagagucuucuaaauccugcaucauucugcauaagcaaugcaugggacucgacaauucugaaauugucaaauauucuaagagucaguguaacugucacccuuacaaauaacagauuaauuuugccagaauucugucuuuccccgccccccuggaucagagcuuugaucuacuuugaagguuuaauauauaauaauauuuagguugagucacuuuggaagccaggauuaaaucauuuuaugaaauaucuguuguaaguaucuacaauuugguaccuuuuagagaaauuuacggaauaauaguaaauuuugaagcaggaugccaucagucuccuuguauugaauuuuauaagcugaaccuaagauauuuuuuuaugugucaugacagaaaugugagguuugguagccaaguauuauaaugaggugucacuacucaccaucuuggcucucaguccuaccacuaacccuuauuuuaccgcacacaugaaguaccucacaggaccaggucauagccgacaucugauugcuccaccucuuugaagacuucuucguaauguacagagccgucugcaccgugugcagagcgcauuccgaccuuguguccuccucauuucacuagcauggucucauuccuugcucagcucuguuugugucgcgagcacucugguaaagcaugcuucugcagauggacugggcuucuuccacuggacagugagaggagcagcauuaggaugugaaugaguaaugccagauuugaacauagcacuguaugaaagauucauuacuaaagcuuuuugaaaaugaucugugauuuggaguauucauagagagucagcugaagguauuugauacucuuaagucuaaaaguuccgaaaauucagaagaauuaguuuuaccaguggaagaagccaguaucauucuuaaagcucaaaagauauaauacaauguuuuuaaaacuaagcaagauaaaaaauuuggaacuaaaauugaaaaaaaugucuccaugcgguaauuuaucuaaaggcccgcuauaaauugucguaagguggagauguguuucuguugaaucuuuugagucuuugcugaggauggcgcccucugcaggguggugggaaaccugagugaaggugcagugcagagaggcgccuucaaaaggcagcugugucccgucugcagcacaucagaugaguucugcacagcagguccuuuuguagaagaggagaaacaaaaauguauuuuugugcaaguuguuugaaaaagaauuuuaaugugaaaauauuguacuacuuuuguggccuguuuaauccaauauucauugcugucaguauuugcuaaauaguuugagcauuuauuacugcagccuguauuacacugucagauuuuuccagugugaauuuuucuaaugcuacaauuaauagaaauacauuaacacugauuuacugcauuaugauuuuaacaauauaacauugauuguuacuuggauacacuuagugacauuauuacuuggauacauugaaaacuuuguaucugcaucacaucuuuugauccucaacaauccaccgaagccaguaggaacagggcaaauguugccgauggguugauguuacacucacccagaguugcugugccagucagaggcagagcugggccagugggcaguauuccucccucauagugaagggcgucaggucaacauuuuagcaccuuuugagaguaguaauuggauuacucaggccaccaacagggaugaauuucaaacugaugaaacuuugauacaauaugaggggucuuuuaccuuccuacuuacucaguaaagguauuuuuguauucucugagcacugcaucuuuaucaugaguaaagcuuagaaauaaucagguacuuuaacuuguacuguuucuuucauggaaaaggaccaaacucuuacccaggaucuacuggagcagcuguuggagcccaugacgccugucgggaugcaaaagagaagcgcucuaaaagguauggacgguugcacuagacgaggaacuucaucuguaccugaugagcccuuucacucuucacgacaccuugagauuauguaaacagacuucauggcuucacucugugaccucaccuggauuguaauuaggaaugcuauugccccaaguguucuuaaaacauggaauuugaacucaccagaaaaaucaucaguacuauucuauaacuuauuauuaaauuuggcauauuuauagaugccucucagguacauguaagaugccuuaaaaugcuguauuuuaaaacuguaccccucagguuacacuuaacugguaagagucaccugcuugcuaaaaucuaacuuacaaguuuuuugagaguugacuaugacugggaaaaguuaauguuguagccaagagaacauguugcccuuuuuuucuagauggguuuaaauacagccccugugauuucgauuauaagaaagguuauagcacaauuuaacaaagaaugagugaaaauuuuaaucgcccauuuugcaaacguguguaauuguugacagguuguuucuaguuuguccaguaaucuuugauauugcccucuucugcagccaagaugcagauucaccuggaaguucuggggccccugaaaacuugacauucaaggaacgccagcgucuuuuuucacaaggucaagauguauccaauaaagugaaagcuucucguaaauuaacagaacuggagaaugaacugaacacaaagugaaagaaaaugaggagaacacuuuguauuuaccccaaaaucuuuucaguuguggguuuguaggugcgaguuugaagaggaaaagaggaaggggguuauauuucuaagugauuuacaauuucuguuucuaaaauuguugggauuuagaaauguuucaauuccaagaaauuuuauuuuacuuuaccaugagauugccauuuauguaauuuaaacacugucuaguuucuuaauuaucuaacucacacgaggguaaguuuuuuguugguuucuuuuuuggaguccugaguucaaaggggacagaacuaagggcaggagaagagaauggaugugucuucucucccaucuuccccucaucaucgaccgaggagcacaaagaaguucuguuucuguuuuuuucagaaacuuuauuuuagcugucaagcagagaauagcuugaacuauucagacuauuguuggcacuguuuaguagugaccacacgcucuucuacccgggaaggaacauaugacgacaugcuccucccauguccccugauggugucuguucccacaauauccuucuagucugcaucgugaaguggcuuaggccaaagcuuccugugugaugacgcacguccgagacuguuccaucucauuccucgcaaauuugagcucuucugaucaauucuaaauauuugauuaauuuuaauucugaaagaaaauuuugaggauuuaagcuuaggggauuuuauuuuuauaaauaccagauuauuguuagacuuaauaaaucacuguuaaauuuaaagaugacaguuaccuuggaaaguucacuaauacuucgcuccaaggcgucuguaaaagaagauaucuuuauuggagcaauguucaugugacugggaaugacagaagaaugggagaugaguagggaccccucaagcacagcugucacucagaaauuuuaaauuugaaaaagaaaucgauuuucaucuguaugccgucaaggaaggaauucaguuacagggcaucuguaacuuaaauauuguaagaauaacucauauggaaguucaagcuauuuuuauacuauaauagaguuauuuaauuuuaauuuguugaauuauuaguuaccacugucauuucuucagcuauggauauguggcugauguuggggagacggaccucaguguguuuuauauugucugguguuaagaugauaaauuacuuugugauuacaagcaaauuuucuauuugacaaagcccuugguggaguccaaaugauuuuucuguaccauauuguucucuuacacauacguauguuaggaaaauaggcacacuuucaaagagaauguucucuuacacauacguauguuaggaaaauagacacauuuucaaagagaauguucucuuacauauguuaggaaaauaggcacacuuucaaagagagguauaggggcuuuuuacugccuucgaaaucacuuuuaauaaaaguuguaugauaaaucauuaaaaaugcgaguguaaauauuuuuuuuuaccucuaucaggguuuuuauuugaaagugugcucuuaccauuuccuuguuugaguaagagagugaaugguucugaguguuuaggaaggauuugcuugcuugcagcagaaguucuaggaaaagcaggcaccucccaaauaucuugaggacacuggcagccuuauggugacuaaauccacacuuucuuuaaagagaugcagaugaauuacuuuucuguuaauauauagaaaaauacacaggagaacaugcagauacauguaaauaucuacauacagggauauuuguaugugugguugugaaacccauacacaaguggauuuggccaucuuugggcagugaggucaaaugugaauauguguaaaagugcuuuucagaacugcauuacuaugagaaaacaucaaaacugcuguaguuuuccauuucuacuguauuucaguugcaaccuauuuuuaauaaacuuuguauguauuuaaguguauuugcuauuguuuugaaagugcugacaaaguuuauauuuguaacaucagccuuccucgcccaucucuuuccaucugucucuucuucauuaaacacuuacugaguaugauuucugugucaggcagugguuuucauuuguggggacgugucgugugccucgucacacagcucacggguggugucugagucucauaagccguucugcugcccaggccuuccugaugcuuccuugaucccagcaagcuuaggugggcauucgagccauuucucagugacacugucucuugguggccccuuugaaauaaaauauccguaguaauaaguaaaugguguacauaaggcauccuggugagaagcguccuagugcaagaacccacucgggacggccucguguaaaaggguguguuugauuguaaaacuacacaagucacauugugaggaccugggagcugcgggaggccugggcaugugcgggcgggaccuucuguguggacagggcucagcgcugccucugcgccaucuccugccucugccuauuuccaguggaccuuuuaauggccugugagcagggggaugggacagggcagggauggagaauuuuuagagcuuucauggggggagaaaaggaugggaaguuguugguugaaggaugcaaaguuucagauagacaaaaggaauagguuuucagauccaugugcugcacagcagggugacuguaguccauguauuguaaaaauaaggacguucaugaaggaaggagugugucuuaggguuguagaaacuuguggagaccuuuuugauagaacgagauguuuguguauu

SEQ ID NO: 18200 - RNA, 38286 nt, Homo sapiens
cauguauagaaaaccuuuuuuacaauuuauuuccuguuguuaaucuuuaaaaaugagguucuagcuaagugcaggguuucaguggugaaauuuugaccaugugaacacauaaauaaauauuuacagucuuuggcaaaacacaugacguuucaucaaccuauacgauaaauuuguuuagaaaaacauaaauaauuuacaaaaaauaugguacauucuaaauacucacaucaucgucacucccacaccauuguacgguugaccccacaacacagaaacagaaaaccugcacgcuguugacagucgcuacauuuaaugaaguaucccaacgcuucguuggucucgggaauacagcuccacacgcaaaaaaguaaaaagugcagcaaaacaacaacacaacgaucaaccucaaaggaaacaacaaaauuaauuuuaucaaaaugcaauguguacauuaagacuaaaguuauggauuguuccuguuuggcauagaaaugugaugacuauuaacagaaaggggaaaaagauuugcccccuauccaucaucagacagacagacuucucuuacuaaaccccuuauguggagugggaugagugacuauuuccugcagaaagaucaugcaacuuaaagcaaaaaaacaaaccaaccaacaaaaaaaacaaaaacaaaaacaaacuugugcauauuacacaugacugauuauugggugugccuggcaagacuaaaugcugauucuuuucagcguuugaauuaaaagaauuccauauacagcagauagauaacaguaacaaauauugaacuaaaaucgcuggcaacauuauauauuuaagguuccaucauaaacuccucauuauucucuauguauucuguuacagcuucuagcaugcuucaucgugacaaccuaauauuaucaagccucauauuuucacaggauuauauacuuauuagauguuuguuucuagaaauuauacuacauauguguuacuaggcauauuuaaaauaaguuacugguaaauggaguugcauucuauagucacuuaauaaauauuaacaaaauauuuauaacuggaaccuuaaugaaauguaucaucaaaucagguaaaagcaacuuguccgcaguuaccaaagccuagauacgcguuagaugcgccuuuuccggccugugcgucugcucugguuccucucaggcagcaaagcuggggaaggaagcucaggcaggagccuccccgacgccacagcggcacaagcagcagcuaaagcaccgcacuuugcucugcuaaccuuuuacuuaaaugagguuuugccaaauccacaucuggaaccgcgucacacccauuugcaaggauguuuguucuuugaugaaacugcaucucuacugcacaugagggcuuucauuguaggacaagaggagaguucguuuauuuuuguaacuguuuuacauguuccgauuaguuaaucgguagcuuaugucauuugcuaugccuguugucuucuaaucucuccuuacuaaaacauuacuucaaauuugaauugacccuuguuuauaauuuauuuaaugggauuugugugucauuguagagcaacucuaauucaagaauagugacaacuuuaagcaccaaaaguaguucagcaauauuuuucaugcuuaauuuaucauaauggcuuaugcacaguauucccuucaacuccauauacacauaaauacaauaaguaauuacauuuuauauguaaacgucauucuuuuuaaacaaacaagaaaaagcaauguaauggcaugcccaauuuucacuccacauaaagucucauauaucaccaaacugguuuccucuaguggguuagauguucaucucugaguuccauugauauuuauccucugaaggcacuuggguuugggguugcuggcaggaggugaagaaccaucagaguuaaggucaagggacaggaggugcugcuagagagagaagccacaaggaccacaaugaacugaggugucuagggaccauggcaugcacagggcauugccggaaaugcagcaaaucuuguuuaaauaucuacaaaaagaaaaaaaaaagcaauaaacaauuagcauaacugggccauggguagugauuuauuuuguuuuaccuagaaccagaaauauaauuacuuuaauuaaagaugagaucuaucauauggauggauggauggauggaugaaauggauggguggauggaugagauggguggguggauggaugagaugggucgguggguggguggaugagauggauggauggauggauggaugaaauggauggguggguggaugaaauggguggguggauggauggguggauggaugggguggguggguggaugagauggauggauggauggaugaaaugaguggguggauggauggaugaguggguugguggaugagaugaauggguggauggaugaugagaugguuggguggcuggaugagauggauggauggguggauggauggaugaaauggauugguggauggaugaaauggguggguggauggauggaugaguggguugguagaugagaugaauggguggaugagaugaauugauggauggauggaugaaugagauagguggguugguggagauggauggguggguggauggaugagauggaugaguggguggguggguggcugagauggauggaugggauagaugaguggggguggaugaaauggauggguggauggauggauggaugagauggauggguggguggguggauggacuagauggauagguggauggggcuggguggauggauggaugagauggguggguguguggguggguggauggaugaauggauggauggaugagauggaugguugggugaauggaugagauggaugggcggaugaguagauggauggaugggauggauggauggaugagacagguggauggauggaugagauagguggguggaugagauggauggauggguggguggguggauggagggaugaguggguugguggaugagauggaugagugcauggguggguggcugagauggauggauggauggauaagauggauggauaagugcuggguggauggauggaugaugaguggguggguaaguggaugagaugaguggauggauggaugaguagguggguggaugagaugaguggauggauggaugaguagguggguggaugaguggauggauggaugaguagguggguggaugagaugaguggauggauggaugaguagguggguggaugagauggauggauggauggaugagauggauguauugauagguggauggauggauggaugaguagguaggugaguggaugagaugaauggauggaugggauagaugagugagugggggugaaugaaaugguuggguggauguguggguggauggauggaugaaauggaugaguggguggguggguggauggauuagauggauagguggauggguggguggauggauggauggaugagauaguuggguggaugggugguuggauggaugagauggguggguguguggguggguggauggauggaugguugggugaauggaugagauggguggaugaauggauggauggauggguggauggaugagauauauggguggguggaugaaugauauggauggaugggaggaaaugagaugccuugaaagacauccuaacauaaggagaagaaaaccuccacagaagcaagcagauaaaucaaccccaacaggguuuugcccuguuggccaggcuggucucgaacuccugaccucaggggauccacccgccuuggccucccaaagggcuaggauuacaggcaugagccacugcccccagccaaacacaugauuuucaaugugugauucuugagaagcauccugagccuuauuuacugcaucuguggaaggguaaugcgcauuugaaggcauggaauuagagcagauggaauucaaguuaucuuccaggucuauaauauuuugauucaaauauaccuguagcgagauaacuauagagaaacuccuuccuuccuucuuuccuuccugccugccugccauugcuaaugcaaggguaccaaucuaaaauggcgucaggagccuggaaguggaggaaaucuaggaaacucuaggcuauggcacaaugaggaugggugggaccuguaaauaauuggaaaguguucuaccagaggcauccaaaugcaauuaaaaacaaaacaauccaagcugaccaaaugaaauggcugcuuggaaugugcagggggcucaugugugguauugugcauuagguuuauugcccugauguacagcuuuuguaaguggaagagcgcacuguguaccccuuucccuuucugggugccacaugccuuccccacuaaccugaagugcucacacucaccucugcauucguacuugaggucugagaaauagaccauuucuugagagaagacaaauagacccagccgcccgccagcguagguuuggucauagauagguccugagucugccaugaccuguuuuccuucaugcacuaagacucuaaaaaugguguuuaaaaagaagaagaggaaagaaagacaacaugaacucugugaagcauucaccagugauggaagguuggcuccggacacaagcuguggauacuccgcccagggcuucagugccccagggggcauugcuggcuuucuccuuuggagcuccagccaccccuggugcagcacugauccagggcacgccuuccuucuugcaaccacacuauugucacaaucugugaguucacuuacagucacccaggcaagggcuuuagaggagacucuaccuuugguggggugaggaggaagcuucccacuuccugggaagaugcaccggacucucccuacuucaccuugugcuaaaaccaugagcucaccggcucuccuccccacuguggaagcugcgugggagcaggacuggauacaccaagcccccgacaggaggauggggcaucaauaugaauaaacaggaggcccccuagggaaacguuccagcgaggccacgagccugcacuucacccacacagaucugcccucuauugccagggacucacacacuccuggcaucugugcagaguccagccugaucuuggugcuuauuaacuuugaaaaaacaaaaacaccuugauuuuaaauugaccacauuuuguuugaauaaaaaucaauuauaaauacuguuaagccaagggaaaagauucuguugggcuaacugugucaaaacuucauacaaccguguuuuaaauucagccauuuauaucagguacaaaucuagucuccaauaaagcacaugcuaauucugcaaagaugcaguuauuuuaauugcagguguucuccccugccugggguauucauuaggagaaaauaugguuaucaucccaaaacaaagcagauuguauauucuccuuuucaaccauuuuuuaaaaauacuuaauauuuaguagagaugcaggauagaaaagagaaagcaguuaaugacgaagaauccagaguaaaacaaaaaguuagaauucacuugagcuuauuugucuauuaauguucaaaugugccguccgaugggaagccccuuggaagaaaugcagcugugcugaccugcccucaccugauguagccagucuugggccugugagucaggugccaccuauaggccguguaguccuuccagccaauguuccuggggucgugccauaagguucgcaccugagagagaacauagcacucuugagugccaugggcacccggagccuuaaccacagcucuguaacaccaagcaggaagcaaaaacaugacuuugcaaguucaugcuuaaggcucauggugcuccauaucucucugauguguuuaucauccaaaucucuacuguggauugaagcccauggacagaguguggcucagggcugagagccaaggcaccugacccucagauuccuggauugaagagcccaggcaccugauccucagauuccuggguucaugucuggaucuucucuuuccuugauaugggauguugggcaaaauucuugaaguuuugauauucaauucucccuagcuucaauuuuuaaaauauuuuuuucauauuauaucuuugaucauuauguccuaugcucacucccuaucuccagaagaggguaaaagagguuuaauuuguaaaaggauuagcaacuguauuuaacugguaauuaucaacuguguugaguuguaaccccaggcacagugucuauaauaaaguaagauuauuaaaauaacugugccuggaguuaaaauuaauaaagacaaaaguggggucucuggacugggcuaguccugcugaaacacucugcagccacaguggugcagaggagaugugugggccuggccagccaaccucaccugccccggcguguuccccgugugccacagcgcguuccucaggugcucgcccguccccgugguggaguucaccaccuugagggacacgccggaguagccauaggcccgcgugggcugguccucccaguaggucugcgucaccugcuuccacaucaccacauagaagcggcugcuugacugguaaccaaagacgaagccggcauagucgucgucccggucaguguuuacguagaaugugccacugaaguccacagacccaaacucgucaaaaccuggaugcaacgccauaagguuucguuagaaacaccuuucagguggccgggaguagugacucaugccuguaaucccagcacuuugagaggccgaggugggcagaucaccugaggucaagaguucgagacuggucugaccaauauggugaaaccuugucucuacuaaaaaugcaaaaauuagccgggcauggugguggguaccuguaaucccagcuacucaggaggcugaggcaggagaaucacuugaaccggggaaaaaagguugcagugaacugagauuguaccacuauacuccagccugggggacaagagcaagacuccaucucaaaaaaaaaaaaagaaaaaaaagaaaaaaaaaagaaacagguuucaggcaauccccagcuuggcccugugaccaucugacaguggaugcccagcaggcagggcgggcuccccucaucaucccgaugggcucuuuuaccaugagauuaguggaauugaagguauuucuuuuagauccaacuuacaagaguucugagaggauuaugaggucccauuucauagaccaagucuauaaaauaaaaugguuuacugaaauuucagagacuucagagcggcaggugcauguaccugucaagguuauuuaggcagacaguuucacagaccauggaaggaugggggcuuccagaaagaccacauggcaucccaccugcaugaucuuaaagugcagucugcaucuucugugggcgccucccccggagaaaugcuggcaccaccgccgugucucagagacucaccuacagcgaugccgggguccgaguuggcugucugaaccagcuccuugccuugauggcgaaugacccaguugggaucaauuuggguggucccuuugggauccaaggggaccaucuggaaguuccugaagucugucucacugauggcauuguuuucaggacacacaucaucaauaucugggauguugucauugucaaaaucaucuuuacaaauaucaccccguccaucaccuaugcacaaagaacaagcaaaaacaaaaacaaaaacaaagaagcaaagucgguggucggugguuugccauuugcuuuuccgugucugagaaacaugagugcaucuuucccagaacaucuaagacugagugcuuugcaguguuuuguggauucgugcucaacaaucuccaaaacauuugacuucacaggaaccucaacucuuuucacaaaauuuuugugauaaauacacagcaaaggccagcacagcaaauucacauaaagccauuucucaccguguuccaaacucaaugcugcagguauaaaaccugaauggcugucaaguaauaucaaccugcauuuccagcuuuguguuuggauaguuuucugaaugucuguuauuacuuuucuuagucauccuugccuuuuauagucuauuuggcauuaaagcggaacucacacuaaaaugguuuuuccuagggagacauggacuuccgcuguuuaguggguccuugucaaguuuucagcgggguuguggcaugguggggaguggggaugaggugggccuggugcaaacagggggaccacgaauuugccacauguguccagucuaucagucuacggcgaugacgauaaccugacaggcagauugcaauguacugaauuagcuaucacguggccugccguuuuggaggaaaggcaaguuggauugaauaucucaucauauucuucaacuaguuuccguucuguucaagaacauacuccagcuaccacguggcaggcacauaguugguaucagggcauucugaaaugcugaaaugcugcucugccuaucagcuucucucugucccagucccucccuggggaaaggcugcauggggagcaagccccugcaugcccgaacacggaguccagaugaggcuugcugugcucacuccaucccuucaugcugcucggggagaacacaggagcugcccuucugaucccagcaucucccacguacuucugagucaugcugucucagaugccccucaaguccuuaucucccucugucaaggacguggcuuccaaagagagccugugucagccaggccccacuccaagugagggccacuuucucacagccuccccggaagccccagagcacagcugugcccuuguuuauuacucagggacgcugacuuagaggacugcagcccauccagcuccuuccuugggcccccguggcuaugggccaccuauucaugcucacugcugagcaaagcagcucuuccucucaugcuucacacucgugccacuuuuguuggcuuugcuuucaaaaaaauccuccuuguccccugccuggccccauacaccaaauucccaauucauccuacguucguaacccgcauucuuucuaggagaucgucaacaaucuggaaguuauauggaggcagggauuucuccuccucccgacgugcacacacacuugaggcagcacaccuguugaagggcacacacacagccaagaauguguugagugucaggggagaagaaacucauauugcauggacccacagcuuuaagaggcccaaagucauugcccuuuuuccagcagcagauuuaagaugaucuccgugcauacauaucucugcccuggcggguugcucagaagccauuuuccuccacgcccaugagcugagagagcacccaccguccaaguccuccuggucuggguugaacacaagccggcaguugucccugucaucggggacgccaucguugucaucaucagggucacaggcgucgcccuggccgucucugucauggucagccugguuggcguuggagauguaggggcaguuguccugguuguucugguggccgucgucaucuauguccucguuguugucacacugguccccaacaaggucauuguccacgucggucuaggggauggggcgugagagaaacagcagaggacugccaguuugaggagguggagaggaaccagcaggacgcaagccugagagccggccuccucguccugcagcacaagccccagggccacgcaggggcggcuggcccgaggucacacugacccugacgucaggacaagcacuggggccaggccucucgguccaggaaucucuccacccucugccaccucuccacaguaauucacuucacuaaaggaagaugugcuucuucgcuggaaaagcaugaacuaccagguaauuaugucucuuuuuuacaccauuugcgccauuuacaccauuuacaucauaggauaauauauccuaugagcugcaucaagauaacuguccucccuugucucuuucaaacgcaaaccuggaaaugaagccaauuccuauguuggcaucaggaaaauggggagagaauucugugaagacacaaccucgcuccagcugaugaggugaaggcgucuauucauuuggccuguggccacugagauacaagaauagugcugagauuugaguugaauaaauguuuucaauugaaaucauugaaaacuccauguuauccugucuuuguggagcucauggaaaacucccaaggccccauggaggggacugaugaggaccugagacccgccugcccauggcugcccucaucuggucaggguugugcaccaggggcaguugucacagugaucccccacaccgccaccguccccgcgucccucugaugaggaccuccaaccccgccugucugcggcugcccucaccuggucaggguugugcaccagggggcaguugucacagugaucccccacaccgucaccauccgugucccucuggucaguguuguagacguagggacaauugucucguucauugaagacaucuguaaguguuuaaagggggaagaaaacaaaaacaaaccagaaggacaggugaguuuagaaaaagcacauuguuuuuccuaucacacgaaauugcuuacagccacacuucuauuuaauuauaauaaaaagacgccuaagaauauaguaaaauauaaagacuauuagauuuuagaagaacauaugacauauuucauuacaguucaaauaccuuucauuugaaauagaaccaacuuuuggagauuucuggguaauguugcaggagggguaguugaaugugcugucgccguguaaaucugagcuugcuaaauugcuuauuucucccuaauacccacuuggaaaguauguguugaguucccaggaguuuaucauccaugcacaugaguaggaaaaaaacaauggcagagaguggcaggguuuuuagaugucauaucuuaucuuaagaaaucugaaagugaugaguugcauugauacugaaguuacaaaaauauaaacuagcacugaacuaaacaauaccaucagugacagugucacaaaugacagagcaaaauguuacacggcagcgaguccacaggaagagccagaacugagcugagacgcucgccuugcuuuggucaggugaggucuggagaagggaaguaaggaacaccuaaaaaauaaaaauggaagggacuggagcuugagaucugcauccagcacaucacagacgccauccuggauggggagccgaggagcccccuggccaccacgagcccucagacagcaacccaccacauucccagagaacgagaggaggguggaggcagaaaucaguggaaaagaucagacugagaaacccgcugugagacagaacagcagguugggguggcucagaaaggggguggcuggcgccgggcugggaagaggaccccacgaggcgaaguguggaggagcuggggccgagcuccagcguggaggcgagccugcccccagcucuugcugguucuacagaagcacucgccuggucuccaggcaccccaagagaagggaugaccaugcggugacaguggcacuggguugcagagcucgcuuaccaaggccagcgaacucuccggauaaagcagcaaccgggaucaguggcagagguaaccacaauacacccacguuauucuaacuccuagaagcucaguuugaugaaaacaugaaauggcuucuuggaauuuuugaaugaagggugaacauuagaaaagaugccaugaagaagcacgaggcccaggacugcaaggcuggggucagagagaggaggauaccaaaugcauagcuuucucuagggcgguccuguggcugguguccccugaccuucaggaaaaggcaaggcagaauaagcaugggucccuaugggaauaacugaaugaaucauuuaaucuuauaguaguguaaaaaugaaaggagcuuaucaaaauucagaauaaaacaugaaacuugccaaugccuccaauugcgacccuuaaaaugcaugcauugggccgggcgcgguggcucacgccuguaaucccagcacuuugggaggccaaggcaggcggaucauuugaggucaggagcuugagaccagccuggccaacauggugaaaccucgucucuacuuaaaauacaaaauuagcuaggcgugguggugugcaccugugaucccagcuacucaggaggcugaagcaggagacucacuugaacccaaaagguggagaucgcagugagccaagauggugcuacugcccugggcaacaauagugaaacuccaucucaaaaaaaaaaaaaaagugcacgcaugggaaggagcagaagcacccaccguccccaucaauguccacggagcaggcgucacccucuccauuguugucugugucgaucugggcaggguugugcacguaagggcaguugucacagcgguccccaaccucauccuugucauagucagccuggcggggauugaagaggagcuggcaguuguccuggaaaaccaagaaagggaagacuuuaacgaagaucauaggaaugugugucgggccguuuagcacuuauaaguuauguacucaagguugaugaaaaucaauauagaaaucaaacaaacacaaaagccaguuagggcuggacgguggcucacaccuuuaaucacagcugggcacuguggcucacaccuguaaucccagcacuucaaaaagccagucagggcagggcacggaggcucacaccuuuaaucccagcacuaugggaggcugaggcgggcggaucaccugaggucaggaguucaagaccagggccgggcgcaguggcucacaccuuuaaucccagugcuuuaaaaagccaguuaggcccgggcacaguggcucacaccauuaaucccagcacuuugggaggccaaggcaggcgggucaccugaggucaggaguucgagaccagccuggccaacauggugaaaccccaucucuccuaaaaauacaaaaaugagccgggcgugguggugugcgccuguaaugccaguuacucaggagacugaggcaagagaaucgcuugaacccagaagauggagauugcagugagccaagaucaugccauugcacucaagccugagcgaccaaaaaaaaaaaaaaaaagaguuagcccucgccaaacacuuuuuccauaucaaaucauuuuaucauuauuuaugcaucugucuuuuguugaaaauuuguagauugcuaaggcaaaaaugguauaucauacacuucauggugaggagagauauguaaauaucaaauaaaugaauggauuagugagucaaugucucccaucaaagucagauguaaaaaagcagugaguaaaaucuugaucuauucuugcuagagcuguuuuguguacaaauacauuaaaccauuuguguuugcagcaauuuucuuagaaaaaugguaauauuuuaaauguugccauaaaggcaagucuaucacucaugguggugucagccuugcccaucacuggcuccucagcagaaggagaggaggucuucuauuuuuuugcaguuaaaauagaaaaaauuauucaaaacauuuccggcagcacacccugggcagccccaugcacugagguaaaauccgcuuuugcaaaggacugucuuuauagugaccuuugggaacugccuaugcacaaacgcuugcaggacaauggcaguuacguugacaagggcuguuugguauaaaguggccuccuguggaccucgcugcuccuggaacccagggcaggugcgcggcacaagcugcuccuaccuucucaucggucacaccgucauugucaucgucaucaucacaggcaucgccaaucccguccuugucaaagucuuccugcccagaauuuggcagaugggggcaguuauccugcaauuggagaaggaagaauacuuggaaaaacauuuaggaaagcgccucuuucaggaaugcaggugaaaugaaaccagcauggcgccgaggaaggaagcgugccccaucaguccucgaucucaagcgggagcugagagaggagccaggaggccagaagcgcaugaauuucuucucaacuccugcccuggaaauuaugucaccacuacucacgagggagacaaaagaaacuuguguucggagcccagaaucccagugagguugccaaacaacugcagaaacaagaagagaaugacaagguauugcucugagagaacaugggagagaaaagaggcuuuaguggugcuuuccuucccacagacuucagcucauaaaucaaaaugccaaagcuuauaaacguuuaacccucaccagucaaaaaaucucaaagaaaagagucuuucaaauauguaugugauauguucagaaaccagggcugagaacuugaaauuaucugcuaacucagcuuuucacggugaguggguaaugcauguaauugggcaaaaacuccuuucauuucaguccaguuauaccauaauuuaaagcugagcugugcagacacuaacaacuugagggaauuggaaauccaggaaaagguagagaguagcguguccguuucaguuucaguacaagagccccaagggugugucauccccguggcucaaagcacaucacucguugaaucagaagacagaaccuggggucuugugcuggagcccagaguuucagcacuuacagauuaagaaaggagagcauguugcuugucauggaggacacggaucccagacgggggccccuggcaauggggaggauccagcaccugugugucggguuaauaugggaacgggcacaggggucccuugucaagucucacuuuuaaauccuuuuguguauguguauauauacauauaacuuugcaaauuauauaccauuuucgaaguuauuaaauuuccaucuaaaauuccacaaugauggaaagaauaaucgggauaucuucuagcagcacggacucagcugcagcugaccuucugaaaucaggggcuucaagaaggguaggcuggguagccaagggguguaacauagguugggaucagugccucguugauuuuaaaacauacucauauuuuguuucagugaguauuuggcaucuuuaaucaagcgggacugacagagaaaauuaacacaaaauuugcaagaaugauuaaauauuaaauaaaugaauauauuuauauuuucaaaugauauuuugugucaguuuguggcauuuccaugucugaccuucuuaaggcauaaaacugcacuaaaacauuuuggggcacccugugcgguggacugaguggcaguccccacgauggauguccgcguccuagugucuuggcgcccggggaugucaccugauauggcugaagugaauuucaucuuguaugguaacaaguggaauuaggucaaggacauugaacagugaggcucauccuggauuaucugggugggcccuaaauacaaccacagguguucuuaucaaagagaggcagaggaaguuuccggagagaaaggcacuggagaaaguggugugaagccgaccagaggucagggccaugcagccaccagcgccagaagcccagcgacgccugagccagagaagcugggagaagcagagggagcacggccccgcuagcaccuugacguuguguuucaggccuccagagcugugagauaacagauuccuguuguugugagccucccgggccgugguguucguuccagcggccacaggaaagcaguccagccugggaugggccccgaaggagcuccuucuuccagcugagcagcuccuuauacugcaacacgcuugggcuuugggaagaaaaccauguccuaacucuuuccaagugacauagccuggccagaccugccugagacacaauggccucugcacagccuggagccgagcguggagccggcguccucccucugcucaguuucaggcguuaacgaugcgcgcaauugcaaauaugggccgacgugcccgagguucucugugcccagcagugggcggcgccagagugugccugugucuacuaaggaccuccagagaggggaccagggggaugcauucaaccuggugaucaggcaagaggccugagagacccuccuuccaaauucccugugcugcccccgccccccguccgcguagcguccccggcgccaggaggagggcugaccgccguggccccgugugcccugcgagccccgcgccucaccuugaugcagugguagguggcguugguggcgcagaccagauugagguugggccagccguccagguccgaguccuccccgcagaugagcccgucgcccgcguagccugucuggcacucgcacuuguacauggggucgcugaaguggcccagguagaugcacuccgcgugcuuguggcaguugugugucuuguccuugcauggguuuucgggcucacacaccuacggggagaagggcugcgggguuagcgacaggcaggacgauggcuccggaggcgucgaggcggggcgucgggcaccgcaggccccagcagguccggucccaagcggacccaaguccugaagugggaagggcuuucuggacacgcacuugaggugcuguucguuccugaggcuccguuugugacucagccaucguuucugagccucggcugcagcucaccaagggcugcgcuaacagcggagagguggcggccugacccucacaggcccggcugagcacgccccgcaccccgcgcggagagcagcggcccagccgagcaggugcucagcuuccccgggccagccccucccaugccucucccgggccacgccaccccuuccucuccuuccuccugcugcuuuucugagcucaucugauuuuuccaaagccgcucgcaacacacaaggaaggccggccuugcguacuugcuuuuccgucuuggcugcuuccaggccgaccccgacgggcugguucccucuguaucggggcgggcagggcaggcaguggaagccaggcugaguguugacacagcgaggcaccuugcugguggagaagcagaugucggggaccagggcacacugcggggacaagcagacaugagaggccgcucccgaccucagggcgcccacagcccagggcggggucacccaccucguccagguccucacagugggugccauugcccaagaagcccacagggcaggagccgcaugaccaggacccaucggggaagcugcugcacugggcucccgggaagcagggguuggauaaacagccaucugggugggagaaggcggagcagaguucaccacgcgcccugcgcagcacagaaggaagcccgcccugugggccgucaaacacucugggaugucuuugucaucgaauuguguagucaggaacacucuggugugauucuggaugaucaucaagaggcaucaucuccaagaccgcauugcucagguggacacagugcagcggguugcagaagcacguguacauuaugacuacacgccacgggccacaccacacaacuacccacacgccaccuuccacaacacacaacugccuacgcaccagguuccacaacacacaacuacaugucaggugccacaccacaaaccuaccuacgcgccacguuccggaucacacaacuacccacgugccaccuuccacacuacacaacuacccacacaccauguuccagaccauacaacuaccacgugccaccuuccagaccacacaacugcccaugcaccaccuuccacaacacacaacuacaccccaggugccacacugcacaacuaccuaugcaccacauuccagaccacacaacuacccaugcgucacuuuccacaccacacaaauaccuacgugccauguuccagaccacacagcugcccacgcaccaccuuccacaacacacaacuacaccccaggugccacaccacacaacuaccuaugugccacguuccagaccacacaacuacccacacgccaccuuccacacuacacaacuaccuacacaccauguuccagaccacacaacuaccaugugccacauuccagaccacacaacugcccacacaccaccuuccacaacacacaacugcccacacgucaggugcuauaccacacaacuaccuacaugccacauucuagaccacacaacuacccauguaccauguuccagaccauacaacugcccacgcaccaccuucuacaacacauaacuacaugcaaggugacacaccacacuacuaccuacaugccacguuccagaccacacaacuaccaugugucacauuucacaccacaccgcugcccaugcaccauguuccacaccgcacaacuaccuacacaccauguuucacaacacacagcuacucacaugccacguuucacacuacacaacuacauauuccagaccacacaaccacccagaugccacaguccacaccacacaaccacccagaugccacaguccacaccaugcaacuacccacacaccauguuccauaccacacaacuaucuacaugcuauguucccagccacacaacuacccacaugccacaggccacaccacacaacuacccacacaccacauuccacaccacacaacuacccacacuccacauuccaugccacacaacuacccacacaccacauaccaugccacacaacugcccacauuccacaggccacgccacacaacuacccacauuccacaggccacaccacacaauuacccacacaccacauuccacgccacacaacuacccacauuccacaggccacgccaccuggcaucuuuuuuguuuuuacauuagaaauacaggaggacugaaacacagauguuaaaaguaguuaucuuugcgugugcaacuaaaauugauuuuucuuuucuguguuuuucaucuaguuucccaaagcguuugugcuuuucaucagaauggaagcccggguuucagugcccccgcuucuaccccucacucacccacggggcagcuccucuuguugcacaucugacgcuccugcacaucccccacgcaggccuucccuccguacugaggcucagggcuguugcagacccgggugcgcucccggaucccaccggcacaggugacagugcaggccgaccacggggaccaggggcuccagcggccaucgacugcggggaaagccaaccagggggagcucagagcaagacccgggguggagaacgugaguuggcugagugagagggaagagcaggugggacaugguguucccuacacagccccacaaacugguuucuccccagguuggcugacuacaggucagagcgugaucgcaccacuacgccugcugcaaugguggauuccgggagugacucagaagccaguguuuccaauggcuuugcugcgaucucuuggccuccagaagacaaaucauaccaccucuucuuuuuaauaaaagaauuuuuuuaauagagagggucucgcuauguugcccaggcugcucucaaacuccuggccucaagcaauccuccugccccagccucccacagugcugggauuacaggcaugagccaccgugcccggccccacaccaccauuuacaccgagaagcucagagcuccucgccaagcugucccucugccauggaggguggccucaacucagaagccugguaugacaccgaauguccucacaggcaguucccaugaggcgugagcacagcugaaggcaaucccugcacacccucuuuuucucagcacauccaugcacuucccgagccaggccucccuggggaagcccuugaugcuuugggccaagcgcucuguaacucacacccuagucugcacagacgcagggaaaggcuauuucagagagacacaguucugugcaucugcggcauccucuguccacacucacuacucaguccaaacucacuccccguccacacucacugcccauccacacucacucaguccacacucacucacuuccauccacacucacugcccauccacacucacugcccauacaacucacucccccauucacacucccuccccauccacacucacuccauccacacucacuuccauccacacuuacuccccauccacacucacuccccuauccacacucacucccccauccacauucucccucccccauccacacucucccucuguccacacucacuacucaguccaaacucacuccccauccacacucacucccccauccacacucacucccccauccacacucucccuccaccauccacacucucccucccccauccacacucccuccccauccacacucacuccccauccacacucaccauccacacucacucccauccacacucacuccccauccacacucauucccccuuaaacaccauccacacucacuccccauccacacucacuccccauccacacucauuccccauccacacucauugccccauaaacaccauccacacucacuccccauccacacucacuccccauccacauucacucccaucuauacucacuccccauccacacucauucccauccacagucacuccccauccacacucacucccccauccacacucacuccccauccacacuccccauccacacucacucccauccacacuccccauccacacucauucccccauaaacaccauccacacucacuccccauccacacucauugccccguaaacaccauccacacucacuccccauccacacucacucuccacauucacucccaucuacacucacuccccauccacacucauuccccauccacacucacucuauccacacucacuucccauccacacucacuccccauccacacucauucccauccacacucgccauccacacucacucccauccacacucgccauccacacucacucccauccacacuuacuccccauccacacucauucccccauaaacaccauccacacucacuccccauccacacucauuccccauccacacucacuccauccacacucacuccccguccacacucacucccguccgcacucacucccauccacacucacuccccguccacacucacuccccauccacacucacucccccauccacacucacucccaugacagagcugcggugcuggaucauucuuccuuuaauuacagucuguccugaacuggaaugaaacggggcuaucucagaggagguuugcgcugagcacaggugagcagaauuaaucacaaaggauggguucauuaccgagccaggcccgggauggcagcccccuuugcugcucggcuggggcugggcugggcuggaacaggcccugacaccccggaucccggcuccagcuguggcugcucacugugagcugccugcaagcccgcccacccagggccccgccuucaccguacuuacuugggcauggggcgcccuggcaggcuuuggucucccggccacucccuuugcaauucuugccccccaucuggggcacuggggaguugcagagacggaugcgugugauauugccaacuccacaggucacagagcaugaagaccaaggugaccaguggcuccagccgccguccugccggacuaacacaagaagcggagagagaucaggcugugccgccuagagggguauuugccuguaagcggugugccuuauuaaccgaggagcaucucacagcugcugaggagagggaaggagaaccccucccaucagcugggagaaagagccucaccuggcuagaauccuugcaaaggcccagcaccucgugagggcagcucugucccuugcaaaggucccgaugacugagagaaacgcggccccacccccacaggcacgcgggugucaccugcccgacacucacugcgggugucacacuugcucagacugcaagcccgugucuggauggagggccccaagcagguguugcuggugacgucacaggaccggccucucugcugggucccagagccacacgucacggagcacuggguccacucugcccacggagaccagcccuccucaccguccaccgcugccagaggaagcaaacacgguggcaucaggcccugccucacagacgugccacagaacagaacgggcacagggcagcuggcguggggccacaguucaugcauccaggaaucugaggggccacugccuggcuggggcagguggacaucccaguggcugggccguggcuccgugggacccaaguuugugaccugcacgggaguucagggacugccuuucaagagaagagcaaaaacgccuuucugggucuacuauuagggugcugaggggagcuaaauccauguguguccaggaaagucucuuaaucgauuuuauaaaauagcuugccaaagacaguguugaaucuuuucuacaugagguuucauuaaaguuacaaaaauguaacguauuuccauuuaaccucuguucgcugauuuacauaauguagugaaacauuucaauuauuggugaaaauuacaggucacuuauuuccaaguaaacugaaacaagcuaauaaaaaggagauucccuguaaagaaauucuucauagguaaucacagccgcuaaauggggggaaagagcaaccugacgccagaaaucauucccgugaggagagaagcccagugaaugcgccaugacucaguguucuagaaagcagggaaaugaaagaaaagaaaaauggucaaggaggucuuuuccuggucaugaugcuccugauaacauaaaaugucuccuucuagucuaaugugggcccuuugauuaucaagauuauauuuuuaugcuuugccaggagcauucugacuuugugaauaccuaacaggcacuuuuacgcauauugaauuguugguuuuaauuauaagacuaacuguauaggggauacauuuucugcauguuacaggcaauaaauuugaaacucagaaaaaucccauuuuauucaaaaucacagaguggcagagcgugagcucugagucccuucauucucuguccacaucagagguaaggugcccugaggaugacacagcucuggggccacagggacauucugggaauguuugggggauggugacuaguuuaguuugggagaagcguugccugaucuuagugcagcagcaacuugggguguagaccugaagcaccuugccaacggcacggcacuggggagccacggauggcucaggagcucuggguggggucagcagagcuaacuugggaagggaacucggggcaggggugggaggcagcacagagaccugagggcagcguuggggccaacucagucucugaacgugcacugaguuuccaggguggcccaggaacccccagggugcccacacgugguuccucuccaucucagguucuguuccuuagaauguauuucuaucccuuagaacauauucuucggauaacagucuuugguuuuuguuugucugauuuucuauuguuuuuuccaggaguguguguacagugaucacuugcugccauaacacagucacagaucuacguguguucucugacucucagcuggggcuccaucggggccugcucugggcucaccugcgugaccacugggcucagcuuccucgucugagaagcaucaggacuggccuucccacccccgcguucccagggcuuccacacuccuuucuagccaugagucaguccucaguggaugaccaguggccugggguggcccucugauucucucaccuguacucagggggcugaaccucacucuucucugccaaaaccaaccaaugaauaaauaaacaaacaagcauggaauuccuaaaaaugcaggaugcgcuugccggcuggcgauacucacaguggaggcaggaagggcagcauucgccuuccacaaaggauggacuggcgcagguugcaggcgggcaggugauuugguggcaaaugguuuuaaauuucuacaagugaagaaaggcaugcauggaacacucauuuaaaaggaggggacgcugguacaagggcugagacuagaaggggucgacagaauggcugaauguuuuccauccuacggaccauacauuacagagaugugaaaauaagggcaucuuuuucucccauuagugcugacagccuaacaagaacagggcccccagauggcucuuugcauccauuccauuccuuucucccuucacugagcagcaaggaugcaacagagagcuccaagcuuccuggaaggagggaagaaaagacgggcagcaggaacuccuguuaucuaagguaaugcugaggccauugucagcagaaauagaguaacauuaaaagcuaaauugucugucuguaagacuucaggcaguggcuuguauuucccccaaacguuucugcugagccucaggcucuguuggaaccggauggaauuaaaugcagagucuagggccaugucuggcuucucuguuccuccuguuucuaaccaacuggggacgcuggccagguugcucccccucucugggcucugguucuuuaugugcaaacaaagagguugauucaaguccuaaauacgguuccuggcccuucuguguuucuuacacugaaauuuccucacauagcugaaccgguuucacacaucagcacugaacgcuggcauuuccaggcagucagguucugccaaguguccgaugguggccucuucccccaagagccguguucuggggccucaccuugcagguacacguggugcagcuguccaccacccacguuucauuuuccgcaaagaaccggccauccugccagcaagcugacauguuccuugucuuaggagggccaccaaugagcucccagagaaacugguuaucauucgacuggaaaaucaagugaaacauuuaaguguagacaauaauacuacauauuuagucaucaugcuuguggaugaaaaacaaaguuccuccuucauuaaaaagcucuaaagucaaguaagacuugacucaucccuggguggaaguuccggaaguuguccuccauccucacggggcuuucugagccacagcuucgucacugccugggcuucuggggcuccccauccaccugccuuccuggagagcggaaaucgcguggcucacaucacaccuggaccagugcagagcaacgcuggggcuccuucgacuggggacgccaggugggacuggggugggaacuagguccccaggcagcagccauaacgacaggcagggauacagccaagcuccugcccucgccacccucccugccccggucuccugccaucgacccccucccugccccaggcuccugcccucgccgcccucccugccccggacuccugccccugccgcccucccugcccugggcuccaucuccuggcaucauuuacuucaugcccucuggguacgagugacagucagcaucacugcacccugguuagccauguguauguuguggggcaccguggcccggagcaccucauuauguucagucccuuucucuaaacugcgagcugcccguccugagccccgcaggcaucgcucucucuuccuggccgcgcugugccgcucaaacccauuucacuccugccagccucacaggaacuucccguccugccucuucagcuaugccaacaugcaguccuugaaauaaaauuauuuuccucugcagguguguguguguguguauguguguguauguguguguguauguguguguguguguguacacucauaccuacagauuuaccaaggagguaaauuucccaaaauuaagaauuuauuuuggagacugugcccaggacuguuuuccuugggaauacuucccaagaucuacccaacuucccucuaacaaugcugaauauugagcaaggauccugaggagcccggcagacaccuccccugugaacuguggguuuuuacaucgagcaugaggcacugccaagccagggaauguugauaccugcugagaugggccagcggcggagcugcccaugcccuaugacccccgcggccccugcgugaguacccaccacucucuugagguucucgcugagcugguucacgaggacguggagccccgagagcuccuggaccauguuucccagcuccucgcacgagcguucgcacaccucgggccuccucuccgagcuggggcccacguacucgguggugacaugcggacccaggcgcagcgucucuguguucucacugauggcguugaucucagcugagggcaagcguagaagggccgugagcaucacagaggacggggccagcagcaggggcugggaacagagggaggaugacccgcccuggcucccggagcggccuggugcugggagacacaaggcggaggacugggccagcagcagaggccaggaccacagggaggaccaucugcccuggcucccagaguggccuggugcugggugacaccaggaacagcagggacaggggacaguggcuauuucccacgcugccacaugucacagaaggagcagagcagaaauuagcucaggaguggggagacgcaucagcauaggagaggccugcacaguccaaacgcaggagcaccaguggccacgcaugucacucagacccagguccccucuuugcaaagcuuccgaccacaaaucugcuucuugaacacaucccccauauguucugacggcuccucucgacucuucauccuuuuuuuuucauccccaaacacccuuucuuauggcuccuugcucugcuuuaaagaaaauucacuauccucuugcucaaacagccaguccccuugagacugugccuugcuccuccuggccuucccaccuucccacugcuccuaacuucccaccuucccccaaauucccaccuucccacauucccaccuucccaccgcucccaccuucccaccacucccaccuucccaccacucccaccuucccaccacucccaccuucccaccuucccaucuucccaccuucccaccacucccaccuucccaccuucccaccuucccaccgcucccaccuucccaccuucccaucuucccaucuucccaccuucccaccacucccaccuucccaccuucccaccacucccaccuucccaccuucccaccuucccacugcucccaccuucccaccuucccaccuucccaccacucccaccuucccagugcucccaucuucccaccuucccaccacucccaccuucccaccuucccaccuucccaccuucccacugcucccaccuucccaccuucccacauucgcaccuucccaccuucccacauucccaccuucccaccuucccaccgcucccaccuucccaccuucccaccacucccaccuucccaccuucccacugcucccaccuucccaccuucccaccacuccuaccuucccaccuucccaccgcucccaccuucccaccuucccacauucccaccucucccaccuucccaccucucccaccuucccaccacucccaccuuuccacauucccaccacucccucugaagcccuagaucgugggaccuggguggguauggcauguaauuuacaaauugaccugaggcgagucagggacggaggcgggguccaguccucaggucagcggggccugcgcaguugcagucagggcccaggcucuaggccggagcucaccucacccccauguaggacccugcucccucucaggggugaagaucccaucuuugaaaugccugacuucucucggacaguccauuauugaggaaagacuuagacauuuuacagcgcugucaggcauuccgugauugaguuuuuaaucacuugguuauaaacugugcugcaauucauacuaagcucagaagcuuccccucggauucauguugcccauaaccauguacaaucaggucaauaucaacacauuaauagagacaaagaaaccacccugaguggauuuuacccagcacacuaaucuuuaacuaaccuaggguauuuguuuuucauuccucuaaaaguuaaacaaaagaccgcauauaucuuugcuucugcucuggcucugacaggaauguaguuuuaccugguaguaaaaccuuccagcuaacuugcauuucuccaggcuucugccaguauucucaguuguaaaauaauaauggcucagccucuucacaagguuacucucacuuuuaacaaacaguggaaaaggggaugucauuaccaagaaccaauccaugaacuagcuguuuguauaagaccaauuuuccuuaagucugacauaaccagugaagaagaagucuuuguuguguuggcaaagaucuccaaaugggacauuggcauccaccuggcuuugaguagacuaacucaugggugauugccacauaugguccgguagauauauguauauagauccauacuuauucuacacaucuggagauaacagaucuagauuucucuguguuuuuuuuuuuuuuuuuuuggaagaucuaagaguuucccauaaguuuuaaagguuugcuuuugauaguuccagggauuauugacuuguaccugugagccuaggaaauaccugcugaaggaggcugcaccuacuaggguguaugcugguaacacacacacacacacacacacacacacaagguguuugcucacauagagguguaagucacguuugucauaguagguuaguuuuacucacugaccauuaugacaacugacucaacaugccauggacaaccuuagcucuaguuuaacugaacccacgugaaauuauaguacaaacaugugauuaggaacaccgcgaaggguauauuuucuuucauacaaagaauauuugcauauauguuuuguuuauaaaaacaauauuuuucuauauuagugaaaauacacacgcacgcacacacacacacacacacguauacauauaaauauaucagacugaaaaaacauuauugcaacaaaaaguacccaaaagccccacagccaacugcaccccaggaacccccagaagagcacugccucaugaagcugaggcccuggcacgcagagugcuggagccaagauaacucugccugugcugcaaaucaccccucagguaacaggcacagugagggucguggugggggugacaguuggagcuggaaugaggguuggucuuagaacacccuucucccugcauugaugaucaaaugucuccuuguucuccuuccucacaggacgugcacaaggacccggaccugcaaaguguaacugaagagugggcuacgcaccccgguucugaaguaggcggugggaucacagagucauugugcaccaaagauaccaaaucucacauauuccugauguauagauucaugacauaacaguuuacgcuugucauaauuuggaauugaaauggccuggccuucgugugcacacggccacaccguguggcagacgugagcuccgcuuugaggcugucagacagacccaggcagcagcccugcucccugcucacuggggagcucaacauggcagccacacagcacucccuugggugccagccuucaucuuuguaaaaugaagaaagugaaagugcccaucucacguagucauucugaagauuagaugauguacggcauuuaaugaaccugucauagugaccuucagaauuaaaugcucaagaaaauauuggaaagugugcuuggaaauaugauucacaauuguaacuaacagaaaagaugagaucaucugucaaugauuuaaguagcauagauuuccaucauaugauggagucaacaacuaugaacaguauaagaaaacuucuaggccgggcgugguggcucacaccuguaaucccagcacuuugggaggccaaggugggcagaucacgaggucaggagaucgagaccaucuuggcuaacacgcugaaaccccaucucuacuaaaaauacaaaaaauuagcugggugugguggcgggugccuguagucccagcuacucaggaggcugaggcagaagaguggcgugaacccaggaggcagagcuugcagugagcccagaucgcaccacugcacuccagccugggugacagagugagacucuggcucaaaaaaaaaaaaaaaaaagaaaacuucuguaagucaaguucgacaaauaucuaugacuuuccuuaggcagacaagcaucacacauuaauauacuggaaaaguugucuauauuucaacucauauuaaagcaccagcuauuuauauuuugucuucuauaauaaaauuauuuggaugauuaaaaucuacuuaaaauuaacuguuuaaucaauuuauuauuuucagauaucaacaugucuaaguugaccagcuaagucacucaaagacaauagugguaguuacccaaauauuuuuacuuaaauuuuuacaagcaugaaugcacacacauacacacacacacauacaccaugucacaauagaaauccauccaagccaguauauaaaaugcauuuuucacaacacaccuaccucccuggccuugcuggcaacccuucuugcuuagaauaucuuccacagaguuuucaaacacuagguggacguucugaagcaaacccuguaaguauacacaagcagaaaaauagagcaacagauaaacauccaauguuugaugccaagcuaacugacauucuaaaaauacaaguuggaaucuucaaguagugagaguauuuccuucuacguagcagguuugcaaucucuuuauaaucaguuuuucuguauauaguacuuuugaaauuuuguuuuuaagcaugacacaagaaauggaaguguaauguaagaaaucuaccuagaagaaggaaauguuucauaaauaagagugagauggcccuuggagagguguggccugcuguguguucugggcauguucccauggacguucaaggccauucguuccuugcaagucacucaugauuagcgaguuucugcauuuggcaaagaggcucacagagucccacugguccucucagagacacagacccugggccugcaggagcgccuuccgcagcugaguuaugacggggcugggccaguccuauaugguauggaacuccuggacacccaugagaaauugacucaacaacaagcuaugcaucucuagaccuuuuacucaaauuacugaguuuaaccauguacuuauuuccaaggcccuacacguccgggagggagcaauguaccauacaccauugugauucuaaagaccugcaguuuaagauucauuuccaaacauauuuuaaccaaaauggacaugaaaccauucccucauaaaucacuagcccuuucccuuggaaaagggcaccugcuacuuugcucucccaucauuucgcuacuaaagcaaacauuuaggagugguuuugguugugaucaaaaaagucugggauugcuagaaacauuugaauaggguugauuccuugaucaucaaaccagccucaaucucaacugacgauaauuagugcaguuagggaagcacaccuggggcagcccucucugauuaaucgugguuuagaaaggcgugcguugugugugugugcgcuuguaugugguguuugcaugugaaagggugagugccugugugaaaguacguaugugcugacaacugccuguggcucugcaugcauugugugugcacgugugccuguuuguauacacaugugugauggauguaugugcaugcaugaguuugcaugagguguuuguguguauguauacguguguaugaguaugugugcauuugugcauguguauguguguguacaugugugguucuguguaugcaucuauaugauguucauguguuuaugugugggggaugugugaguguauguaugguguuuguguagguauguaaaugugaugugugugacuguguaugguacuuuugugcacguguguauguguguguucacauguguguggugugcgugcauugcauggcuguggguggugugugcacaccuguuuugugcacacauguauaagugcuuacauaugguugugugcacaugugcaugcaugaguguguucacauguauguguguggugugugugcaugugugguaugugcacacgucugugaaugugagugcaugcaugguguuuauuuguguaugugcaugggugcccacguagggugugugcacgugugugcauguguguguucacauguaugucuguguggugugcaugugugcacaugaguguaugaaugguguuuaugugcgucugcaugugcgugcccauguaugguguuugugugcacaugggcaugcauaugugaggguguguucacaugcauguguauguggugaggugugugugugcgugucuguguguguguguugcgugguguguguacaugugugauguauauacauaugcgagugugagugcauaugcaguguuuguguauaugucuuuggauguguguucauguguuugugagcauguguguuuguguguguguguggugugugugcaugugugcacaugccuguggcugcguguggugggcagugugugcaugugcauguggugugugcacgcaugugugugagcacaugccgggaugugcagugugcuucucuaaggccaggcucugccugcucaagcaucgcaucaccagacgcauuagcagaucaguucccagcuaagcucuuuccucccucacggcggccaccucccugcagagcguacccugaagugacucucucuggcagagccuuuggccacguacauccggcucuuuuccgccugcaggugcucguagaagggcucguccagagcgaagcugucuaugaggucgcagcccacgugcaagcuguaggucucgccagccaccugcacggugacguucuuccacugcgagucagccaggccgacguccuccagggagaccacaugccgggugccgucaauccaguaggugagauccagcguguccgcggggccguuggagacgaucucgaacugccucugggagagaccggggcccuccagagccaacagcgugccccuggacuugccguccugcuugagcugggccgugaggaagaagcccuccuucugccgcaugaucuuggugaucuugcugaggucaucugcguucaccggugggauguagucaaagcgcacgaagcgguaagccggcacgccggggucgggcccgcggaacugcuuggcgccaauggucuugcgguugauguugcugauacugaaaaggucgaaggucgugucuuuguccuggugaccagcugcaaagggaaccgcaguggagaagggugacguaggggaagagggcgagguuggccugacccagggugacaaaccagaaccucgcguguaaggaaauuaacgaggccucccaauaucccgcagcuucucucccuuuuuuaugggaauccuggagccaccucugaugaaaagccacuauccuccgugccagugccgcuacucagagugugggcccaacgcagcugcgggucuguggggucaguuucugccccuggcuggucgaggagcgugugccagaagguaaaucgguggagacaggcagcgcccuguccguucagcuggcccuuugcauagcccgaccuucuuggugagggaaucccggccucgcuugacauccuggcacaugucccaggucacucugucuggcucuuccaucucagaucugaggcugaaaagcagccauccugucuaccaguugauugcucaggaaaaaaccaaauaaaugaauaaacugggaaagacauggaucuuuagccuugcuauugauagagugucagaaagcggcuaaaucguauguugcuuucuuguugagaucaacugccuaaaaccaguuaugucagcagguuguuauuuuguaaaaauguauucuccaacucuuaaugcacccuguggguaaggaucugaaagaguggucaguaucaaguacagaaacaaaugguuuuaagucaccaccuaagcuauuggcaagaaaagugaucagaucucacgaaaaucauaauaguuuaaauaauucaaagccaggcgcgguggcucacaccuguaaucccagcacuuugggaggccgagguggguggaucaugaggucaggagacggagaccaucauggcuaacguggugaaaccccgucucuacuaaaaauacaaaaaauuagccaggcaugguugugggcgcuuguagucccagcuacucgggaggcugaggcaggagaauggcgugaacccgggaggcagagcuugcagugagcccagaucacgccacugcacuccagccugggugacagagcaggacuccgucccagaaaaaaaaaaaaaaguaauacacugaacagaaaguuuagccaaagccuuccuuuucaucuaauauuuagcaaauuagaacaggauaauacacaggguugcugacagaagugggcaauggaccacuuuccauagaguuacuuggcaagaauuaaaagcuuugauucagcaauucuaauuuuguaaccuauccaaaggauauaaucacaaaugcuacuuaagauuuauccacgucaauauuuuuugugucaucauuuaugcuaaugaaaauaaaccaaucuaagugggaauugauugaaaaagaucaggcuuuaucugugaugaaauauuauguggucauuaaaaaucauacuguagaaaaguaaacacaugggaaaauauuuaaaggaggaagaaaguggagcaaaaagaauucaacaaacaccaaauacuugcaguguugugaacauccucuauagaaaaaaggauaaacugugcaacucuagguggaauugcauuuuucucuaacaccugaauuuuccaaagauaaauuaucucaugucauauuggcucagaaguaaguuacuauuugauuuauaaaggagcuagaagguccucacggguaagauuguccaaccacacacuuuauuuugucaucucuccccuugcagcuaagccauaucucacaagccagagagagaccacaggcucugaggacacucaccuugcgugcugggccacacccacagagccagcaggaccagccuccagaccauccugccuccugcagcugagcuccugggaauacaggaaacccuuguuagugaugaguccacagcugcaacccugccugugagcgagacuggcccagugacucacaugaccauugaauaacaguuugcauauaaaacucagcaccaacuggauuuguggcaaacugagagcgaaggaggaaauuuacucuucaagcaggauucuucuaacuauaagauuuguugagcuagcauuugccggcaagcacugcacaucacguucuaaauauuccuauuauuucaucuucauaauagccugggagguaugugcugcucuaauuguccucauuuuacagaugagcaaauggaagaugggcaaguucagcgcuugccuggaguaauucuguucauacgacucguagacaggacuuagauguagaaaguuugaauuuagaaaaauauccagccugacaaaaauaaucugugaacgcauuuuguguaaauauccagcaaaaaacaguuaugcauaaccuaauuaaauagaaugaauaucaacuguaaaaaaaaguuacaaauaaacuuaauuuggugaauuauacuuacaaaacaacagaacacuugacuuagccaucauuuugacccugccucuuuauuuuccugcaggccuguuuuuccauucuuggggauuuuaaguuggcacagcucaguggaggcuggccccgaagucaggagaugugguccaaagcccggcugggcgauuaacccuguggaucucagcuucuccucuuccgggcgagcaugagccugagggucccagggcuccccaggucccuuccagcaauuggucacacccugcucuagguugaagggaagacugagaccccaauucuucccauauuuagaauaucaaaggccguuaacuucucauuguuaauccaaggacucucccucuccagaaacaacauuugguaaccuggaaauccucaccuuccaggaauagagaaacauuccucagaagaagagaaaugcuuggcagcaccugcagaccccccacccaucugcugcugggaccccccccccaaaccaucugcuccccccagugccgccccagggguccuuggugauuguuucaucuguccuggcuccggaagcagcacggccugcggccggagucagcaccaggcugagcaaugcugagcaccagcugugcaaccuagggaaacuuacuuaacuucucugucucaguuuccucauccguagaaugaaacguagcgucauguaaaaugcccaccucaucggguugucaugagagaugaauucggcaaaugaaacuucaccaggggcugacuuagcccagcgagccacaggcauggguuaccggagcagaaugugccucugggucuggggcgcuuucuacucuaacugcccgaggcagcugcaguaauaaugguggugcugauagggccuuucuauggagcucuuaagaggguuuaaugacaggagcgaacacuuggccaugagcuuagaacaguaccugcaugcaguaagcaccacagaacgguguuagaauacacagcucagguacagccuuggcaggcucuucccaccuccccaccucaucagcccacacugccggguacgucgcaguccccuaaggacagcuguguggggcuggcccugcagaggccagccaagaacaggaugguaaaugcgaaaguucuggaugcccagcuucauaaggacagguuagaaaaacuaaaucaaacuccuuugacgaaaccagauccuacugucucugccuugagguagauucuuacaagagcaggaggcuaacaaagcauccccugcugcggauugucaaaggacagugaggcuccaucccacaggaaggaugagcagccaggcuaccuggccucagcccauccagggacaccgggcaugcauggauggagccacggaugagccagugccgcucaccccugccccagccucugcacgccacacauccacguuuaugcuuguguuuuuccaaaagaaagauuucggugccugucugcagcagaauguaguuugaauuugcaaaggucuuuuaaaacucuuuucguaugaacaaucaaaguaaaagauagcuuugcagagagcuaauuguuuaccggccguccaccaccaacagcagucugauuaaacaccagacuccugggugcucagcucccaguccugggcagccaaacccaccuuccuuaagugguagccaggcaaccugccagcucgcuuuucauaugcaaacugccccaagacuguuaaaagucgcugugugucccggcagucacaggauuuuccauagacuuaccacaaauacucucuaguuauguucaaaaccacuuuucagcugcuaauaauguuaacaaucagagucucucuuuaaucuacuaauaauguuaacaaucagagucucucuuuaaucuacuaauaauguuaacgaucagagucucucucuaaucuacuaauaaugauguuaacaaucagagucucucucuaaucuccaguuacuuuucagauauuccgggaguuguuucuaauucucuccucaauaacaaacucucauguggaaucuucuucuucggaaacugaaaacauaaagcguuuacccggguucccaggcagguauauacauugaaauagcagcagccacaacccucagagaggaaggggugcccggcuggugaaagcacagccacggaggaaaagcugaggagcggccacgugccuugcucuucaagcgggcaguagaaacaccacgugaagaaacacuugccauuuaguguuaauagauacaccacccaccuuaaguuaagaaucgaaauugcuccuuuuucuucuccgcuucuuagaguucgagaacucuaauuucuuaaaauuagagcaccauuaaauaauugauugaguuuaagaaauaaucguaccugguuugccaaaaagaugcagugaugacugguuucaguguuccggaccgagucagaaaggcgcaggcucugcuggagcgagagaccggcccugcagugcaggaugcuccgguggacguggccgagcggcucccgggcagcgcggcuuuauaugccgcuucuccugugcagggcugucaaucagacacacgaggaagcacguuuaauucauuccuucgaaggaaugacaucaucccccuucugaucucaccauuugcuccgaguaccugcugcagggguccaaguccagccccucuguacuggaugccgucuccuccuccugcaccccggccccugccagaca

SEQ ID NO: 18201 - RNA, 38286 nt, Homo sapiens
ugucuggcaggggccggggugcaggaggaggagacggcauccaguacagaggggcuggacuuggaccccugcagcagguacucggagcaaauggugagaucagaagggggaugaugucauuccuucgaaggaaugaauuaaacgugcuuccucgugugucugauugacagcccugcacaggagaagcggcauauaaagccgcgcugcccgggagccgcucggccacguccaccggagcauccugcacugcagggccggucucucgcuccagcagagccugcgccuuucugacucgguccggaacacugaaaccagucaucacugcaucuuuuuggcaaaccagguacgauuauuucuuaaacucaaucaauuauuuaauggugcucuaauuuuaagaaauuagaguucucgaacucuaagaagcggagaagaaaaaggagcaauuucgauucuuaacuuaaggugggugguguaucuauuaacacuaaauggcaaguguuucuucacgugguguuucuacugcccgcuugaagagcaaggcacguggccgcuccucagcuuuuccuccguggcugugcuuucaccagccgggcaccccuuccucucugaggguuguggcugcugcuauuucaauguauauaccugccugggaacccggguaaacgcuuuauguuuucaguuuccgaagaagaagauuccacaugagaguuuguuauugaggagagaauuagaaacaacucccggaauaucugaaaaguaacuggagauuagagagagacucugauuguuaacaucauuauuaguagauuagagagagacucugaucguuaacauuauuaguagauuaaagagagacucugauuguuaacauuauuaguagauuaaagagagacucugauuguuaacauuauuagcagcugaaaagugguuuugaacauaacuagagaguauuugugguaagucuauggaaaauccugugacugccgggacacacagcgacuuuuaacagucuuggggcaguuugcauaugaaaagcgagcuggcagguugccuggcuaccacuuaaggaagguggguuuggcugcccaggacugggagcugagcacccaggagucugguguuuaaucagacugcuguuggugguggacggccgguaaacaauuagcucucugcaaagcuaucuuuuacuuugauuguucauacgaaaagaguuuuaaaagaccuuugcaaauucaaacuacauucugcugcagacaggcaccgaaaucuuucuuuuggaaaaacacaagcauaaacguggauguguggcgugcagaggcuggggcaggggugagcggcacuggcucauccguggcuccauccaugcaugcccggugucccuggaugggcugaggccagguagccuggcugcucauccuuccugugggauggagccucacuguccuuugacaauccgcagcaggggaugcuuuguuagccuccugcucuuguaagaaucuaccucaaggcagagacaguaggaucugguuucgucaaaggaguuugauuuaguuuuucuaaccuguccuuaugaagcugggcauccagaacuuucgcauuuaccauccuguucuuggcuggccucugcagggccagccccacacagcuguccuuaggggacugcgacguacccggcagugugggcugaugagguggggaggugggaagagccugccaaggcuguaccugagcuguguauucuaacaccguucuguggugcuuacugcaugcagguacuguucuaagcucauggccaaguguucgcuccugucauuaaacccucuuaagagcuccauagaaaggcccuaucagcaccaccauuauuacugcagcugccucgggcaguuagaguagaaagcgccccagacccagaggcacauucugcuccgguaacccaugccuguggcucgcugggcuaagucagccccuggugaaguuucauuugccgaauucaucucucaugacaacccgaugaggugggcauuuuacaugacgcuacguuucauucuacggaugaggaaacugagacagagaaguuaaguaaguuucccuagguugcacagcuggugcucagcauugcucagccuggugcugacuccggccgcaggccgugcugcuuccggagccaggacagaugaaacaaucaccaaggaccccuggggcggcacuggggggagcagaugguuuggggggggggucccagcagcagauggguggggggucugcaggugcugccaagcauuucucuucuucugaggaauguuucucuauuccuggaaggugaggauuuccagguuaccaaauguuguuucuggagagggagaguccuuggauuaacaaugagaaguuaacggccuuugauauucuaaauaugggaagaauuggggucucagucuucccuucaaccuagagcagggugugaccaauugcuggaagggaccuggggagcccugggacccucaggcucaugcucgcccggaagaggagaagcugagauccacaggguuaaucgcccagccgggcuuuggaccacaucuccugacuucggggccagccuccacugagcugugccaacuuaaaauccccaagaauggaaaaacaggccugcaggaaaauaaagaggcagggucaaaaugauggcuaagucaaguguucuguuguuuuguaaguauaauucaccaaauuaaguuuauuuguaacuuuuuuuuacaguugauauucauucuauuuaauuagguuaugcauaacuguuuuuugcuggauauuuacacaaaaugcguucacagauuauuuuugucaggcuggauauuuuucuaaauucaaacuuucuacaucuaaguccugucuacgagucguaugaacagaauuacuccaggcaagcgcugaacuugcccaucuuccauuugcucaucuguaaaaugaggacaauuagagcagcacauaccucccaggcuauuaugaagaugaaauaauaggaauauuuagaacgugaugugcagugcuugccggcaaaugcuagcucaacaaaucuuauaguuagaagaauccugcuugaagaguaaauuuccuccuucgcucucaguuugccacaaauccaguuggugcugaguuuuauaugcaaacuguuauucaauggucaugugagucacugggccagucucgcucacaggcaggguugcagcuguggacucaucacuaacaaggguuuccuguauucccaggagcucagcugcaggaggcaggauggucuggaggcugguccugcuggcucuguggguguggcccagcacgcaaggugaguguccucagagccuguggucucucucuggcuugugagauauggcuuagcugcaaggggagagaugacaaaauaaagugugugguuggacaaucuuacccgugaggaccuucuagcuccuuuauaaaucaaauaguaacuuacuucugagccaauaugacaugagauaauuuaucuuuggaaaauucagguguuagagaaaaaugcaauuccaccuagaguugcacaguuuauccuuuuuucuauagaggauguucacaacacugcaaguauuugguguuuguugaauucuuuuugcuccacuuucuuccuccuuuaaauauuuucccauguguuuacuuuucuacaguaugauuuuuaaugaccacauaauauuucaucacagauaaagccugaucuuuuucaaucaauucccacuuagauugguuuauuuucauuagcauaaaugaugacacaaaaaauauugacguggauaaaucuuaaguagcauuugugauuauauccuuuggauagguuacaaaauuagaauugcugaaucaaagcuuuuaauucuugccaaguaacucuauggaaagugguccauugcccacuucugucagcaacccuguguauuauccuguucuaauuugcuaaauauuagaugaaaaggaaggcuuuggcuaaacuuucuguucaguguauuacuuuuuuuuuuuuuucugggacggaguccugcucugucacccaggcuggagugcaguggcgugaucugggcucacugcaagcucugccucccggguucacgccauucuccugccucagccucccgaguagcugggacuacaagcgcccacaaccaugccuggcuaauuuuuuguauuuuuaguagagacgggguuucaccacguuagccaugauggucuccgucuccugaccucaugauccacccaccucggccucccaaagugcugggauuacaggugugagccaccgcgccuggcuuugaauuauuuaaacuauuaugauuuucgugagaucugaucacuuuucuugccaauagcuuagguggugacuuaaaaccauuuguuucuguacuugauacugaccacucuuucagauccuuacccacagggugcauuaagaguuggagaauacauuuuuacaaaauaacaaccugcugacauaacugguuuuaggcaguugaucucaacaagaaagcaacauacgauuuagccgcuuucugacacucuaucaauagcaaggcuaaagauccaugucuuucccaguuuauucauuuauuugguuuuuuccugagcaaucaacugguagacaggauggcugcuuuucagccucagaucugagauggaagagccagacagagugaccugggacaugugccaggaugucaagcgaggccgggauucccucaccaagaaggucgggcuaugcaaagggccagcugaacggacagggcgcugccugucuccaccgauuuaccuucuggcacacgcuccucgaccagccaggggcagaaacugaccccacagacccgcagcugcguugggcccacacucugaguagcggcacuggcacggaggauaguggcuuuucaucagagguggcuccaggauucccauaaaaaagggagagaagcugcgggauauugggaggccucguuaauuuccuuacacgcgagguucugguuugucacccugggucaggccaaccucgcccucuuccccuacgucacccuucuccacugcgguucccuuugcagcuggucaccaggacaaagacacgaccuucgaccuuuucaguaucagcaacaucaaccgcaagaccauuggcgccaagcaguuccgcgggcccgaccccggcgugccggcuuaccgcuucgugcgcuuugacuacaucccaccggugaacgcagaugaccucagcaagaucaccaagaucaugcggcagaaggagggcuucuuccucacggcccagcucaagcaggacggcaaguccaggggcacgcuguuggcucuggagggccccggucucucccagaggcaguucgagaucgucuccaacggccccgcggacacgcuggaucucaccuacuggauugacggcacccggcauguggucucccuggaggacgucggccuggcugacucgcaguggaagaacgucaccgugcagguggcuggcgagaccuacagcuugcacgugggcugcgaccucauagacagcuucgcucuggacgagcccuucuacgagcaccugcaggcggaaaagagccggauguacguggccaaaggcucugccagagagagucacuucaggguacgcucugcagggagguggccgccgugagggaggaaagagcuuagcugggaacugaucugcuaaugcgucuggugaugcgaugcuugagcaggcagagccuggccuuagagaagcacacugcacaucccggcaugugcucacacacaugcgugcacacaccacaugcacaugcacacacugcccaccacacgcagccacaggcaugugcacacaugcacacacaccacacacacacacaaacacacaugcucacaaacacaugaacacacauccaaagacauauacacaaacacugcauaugcacucacacucgcauauguauauacaucacacauguacacacaccacgcaacacacacacacagacacgcacacacacaccucaccacauacacaugcaugugaacacacccucacauaugcaugcccaugugcacacaaacaccauacaugggcacgcacaugcagacgcacauaaacaccauucauacacucaugugcacacaugcacaccacacagacauacaugugaacacacacaugcacacacgugcacacacccuacgugggcacccaugcacauacacaaauaaacaccaugcaugcacucacauucacagacgugugcacauaccacacaugcacacacaccacacacauacaugugaacacacucaugcaugcacaugugcacacaaccauauguaagcacuuauacaugugugcacaaaacaggugugcacacaccacccacagccaugcaaugcacgcacaccacacacaugugaacacacacauacacacgugcacaaaaguaccauacacagucacacacaucacauuuacauaccuacacaaacaccauacauacacucacacaucccccacacauaaacacaugaacaucauauagaugcauacacagaaccacacauguacacacacauacacaugcacaaaugcacacauacucauacacacguauacauacacacaaacaccucaugcaaacucaugcaugcacauacauccaucacacauguguauacaaacaggcacacgugcacacacaaugcaugcagagccacaggcaguugucagcacauacguacuuucacacaggcacucacccuuucacaugcaaacaccacauacaagcgcacacacacacaacgcacgccuuucuaaaccacgauuaaucagagagggcugccccaggugugcuucccuaacugcacuaauuaucgucaguugagauugaggcugguuugaugaucaaggaaucaacccuauucaaauguuucuagcaaucccagacuuuuuugaucacaaccaaaaccacuccuaaauguuugcuuuaguagcgaaaugaugggagagcaaaguagcaggugcccuuuuccaagggaaagggcuagugauuuaugagggaaugguuucauguccauuuugguuaaaauauguuuggaaaugaaucuuaaacugcaggucuuuagaaucacaaugguguaugguacauugcucccucccggacguguagggccuuggaaauaaguacaugguuaaacucaguaauuugaguaaaaggucuagagaugcauagcuuguuguugagucaauuucucauggguguccaggaguuccauaccauauaggacuggcccagccccgucauaacucagcugcggaaggcgcuccugcaggcccagggucugugucucugagaggaccagugggacucugugagccucuuugccaaaugcagaaacucgcuaaucaugagugacuugcaaggaacgaauggccuugaacguccaugggaacaugcccagaacacacagcaggccacaccucuccaagggccaucucacucuuauuuaugaaacauuuccuucuucuagguagauuucuuacauuacacuuccauuucuugugucaugcuuaaaaacaaaauuucaaaaguacuauauacagaaaaacugauuauaaagagauugcaaaccugcuacguagaaggaaauacucucacuacuugaagauuccaacuuguauuuuuagaaugucaguuagcuuggcaucaaacauuggauguuuaucuguugcucuauuuuucugcuuguguauacuuacaggguuugcuucagaacguccaccuaguguuugaaaacucuguggaagauauucuaagcaagaaggguugccagcaaggccagggagguagguguguugugaaaaaugcauuuuauauacuggcuuggauggauuucuauugugacaugguguauguguguguguguaugugugugcauucaugcuuguaaaaauuuaaguaaaaauauuuggguaacuaccacuauugucuuugagugacuuagcuggucaacuuagacauguugauaucugaaaauaauaaauugauuaaacaguuaauuuuaaguagauuuuaaucauccaaauaauuuuauuauagaagacaaaauauaaauagcuggugcuuuaauaugaguugaaauauagacaacuuuuccaguauauuaaugugugaugcuugucugccuaaggaaagucauagauauuugucgaacuugacuuacagaaguuuucuuuuuuuuuuuuuuuuuugagccagagucucacucugucacccaggcuggagugcaguggugcgaucugggcucacugcaagcucugccuccuggguucacgccacucuucugccucagccuccugaguagcugggacuacaggcacccgccaccacacccagcuaauuuuuuguauuuuuaguagagaugggguuucagcguguuagccaagauggucucgaucuccugaccucgugaucugcccaccuuggccucccaaagugcugggauuacaggugugagccaccacgcccggccuagaaguuuucuuauacuguucauaguuguugacuccaucauaugauggaaaucuaugcuacuuaaaucauugacagaugaucucaucuuuucuguuaguuacaauugugaaucauauuuccaagcacacuuuccaauauuuucuugagcauuuaauucugaaggucacuaugacagguucauuaaaugccguacaucaucuaaucuucagaaugacuacgugagaugggcacuuucacuuucuucauuuuacaaagaugaaggcuggcacccaagggagugcuguguggcugccauguugagcuccccagugagcagggagcagggcugcugccugggucugucugacagccucaaagcggagcucacgucugccacacgguguggccgugugcacacgaaggccaggccauuucaauuccaaauuaugacaagcguaaacuguuaugucaugaaucuauacaucaggaauaugugagauuugguaucuuuggugcacaaugacucugugaucccaccgccuacuucagaaccggggugcguagcccacucuucaguuacacuuugcagguccggguccuugugcacguccugugaggaaggagaacaaggagacauuugaucaucaaugcagggagaaggguguucuaagaccaacccucauuccagcuccaacugucacccccaccacgacccucacugugccuguuaccugaggggugauuugcagcacaggcagaguuaucuuggcuccagcacucugcgugccagggccucagcuucaugaggcagugcucuucuggggguuccuggggugcaguuggcuguggggcuuuuggguacuuuuuguugcaauaauguuuuuucagucugauauauuuauauguauacgugugugugugugugugugcgugcguguguauuuucacuaauauagaaaaauauuguuuuuauaaacaaaacauauaugcaaauauucuuuguaugaaagaaaauauacccuucgcgguguuccuaaucacauguuuguacuauaauuucacguggguucaguuaaacuagagcuaagguuguccauggcauguugagucaguugucauaauggucagugaguaaaacuaaccuacuaugacaaacgugacuuacaccucuaugugagcaaacaccuuguguguguguguguguguguguguguguuaccagcauacacccuaguaggugcagccuccuucagcagguauuuccuaggcucacagguacaagucaauaaucccuggaacuaucaaaagcaaaccuuuaaaacuuaugggaaacucuuagaucuuccaaaaaaaaaaaaaaaaaaacacagagaaaucuagaucuguuaucuccagauguguagaauaaguauggaucuauauacauauaucuaccggaccauauguggcaaucacccaugaguuagucuacucaaagccagguggaugccaaugucccauuuggagaucuuugccaacacaacaaagacuucuucuucacugguuaugucagacuuaaggaaaauuggucuuauacaaacagcuaguucauggauugguucuugguaaugacauccccuuuuccacuguuuguuaaaagugagaguaaccuugugaagaggcugagccauuauuauuuuacaacugagaauacuggcagaagccuggagaaaugcaaguuagcuggaagguuuuacuaccagguaaaacuacauuccugucagagccagagcagaagcaaagauauaugcggucuuuuguuuaacuuuuagaggaaugaaaaacaaauacccuagguuaguuaaagauuagugugcuggguaaaauccacucagggugguuucuuugucucuauuaauguguugauauugaccugauuguacaugguuaugggcaacaugaauccgaggggaagcuucugagcuuaguaugaauugcagcacaguuuauaaccaagugauuaaaaacucaaucacggaaugccugacagcgcuguaaaaugucuaagucuuuccucaauaauggacuguccgagagaagucaggcauuucaaagaugggaucuucaccccugagagggagcaggguccuacaugggggugaggugagcuccggccuagagccugggcccugacugcaacugcgcaggccccgcugaccugaggacuggaccccgccuccgucccugacucgccucaggucaauuuguaaauuacaugccauacccacccaggucccacgaucuagggcuucagagggaguggugggaauguggaaaggugggaguggugggaaggugggagaggugggaaggugggagaggugggaaugugggaaggugggaaggugggagcggugggaaggugggaagguaggaguggugggaaggugggaaggugggagcagugggaaggugggaaggugggaguggugggaaggugggaaggugggagcggugggaaggugggaaggugggaaugugggaaggugggaaggugcgaaugugggaaggugggaaggugggagcagugggaaggugggaaggugggaaggugggaaggugggaguggugggaaggugggaagaugggagcacugggaaggugggaguggugggaaggugggaaggugggaaggugggagcagugggaaggugggaaggugggaaggugggaguggugggaaggugggaaggugggaguggugggaaggugggaagaugggaagaugggaaggugggaaggugggagcggugggaaggugggaaggugggaaggugggaguggugggaaggugggaagaugggaaggugggaaggugggaguggugggaaggugggaguggugggaaggugggaguggugggaaggugggagcggugggaaggugggaaugugggaaggugggaauuugggggaaggugggaaguuaggagcagugggaaggugggaaggccaggaggagcaaggcacagucucaaggggacuggcuguuugagcaagaggauagugaauuuucuuuaaagcagagcaaggagccauaagaaaggguguuuggggaugaaaaaaaaaggaugaagagucgagaggagccgucagaacauaugggggauguguucaagaagcagauuuguggucggaagcuuugcaaagaggggaccugggucugagugacaugcguggccacuggugcuccugcguuuggacugugcaggccucuccuaugcugaugcgucuccccacuccugagcuaauuucugcucugcuccuucugugacauguggcagcgugggaaauagccacuguccccugucccugcuguuccuggugucacccagcaccaggccacucugggagccagggcagaugguccucccugugguccuggccucugcugcuggcccaguccuccgccuugugucucccagcaccaggccgcuccgggagccagggcgggucauccucccucuguucccagccccugcugcuggccccguccucugugaugcucacggcccuucuacgcuugcccucagcugagaucaacgccaucagugagaacacagagacgcugcgccuggguccgcaugucaccaccgaguacgugggccccagcucggagaggaggcccgaggugugcgaacgcucgugcgaggagcugggaaacaugguccaggagcucucggggcuccacguccucgugaaccagcucagcgagaaccucaagagagugguggguacucacgcaggggccgcgggggucauagggcaugggcagcuccgccgcuggcccaucucagcagguaucaacauucccuggcuuggcagugccucaugcucgauguaaaaacccacaguucacaggggaggugucugccgggcuccucaggauccuugcucaauauucagcauuguuagagggaaguuggguagaucuugggaaguauucccaaggaaaacaguccugggcacagucuccaaaauaaauucuuaauuuugggaaauuuaccuccuugguaaaucuguagguaugaguguacacacacacacacacauacacacacacauacacacacauacacacacacacacaccugcagaggaaaauaauuuuauuucaaggacugcauguuggcauagcugaagaggcaggacgggaaguuccugugaggcuggcaggagugaaauggguuugagcggcacagcgcggccaggaagagagagcgaugccugcggggcucaggacgggcagcucgcaguuuagagaaagggacugaacauaaugaggugcuccgggccacggugccccacaacauacacauggcuaaccagggugcagugaugcugacugucacucguacccagagggcaugaaguaaaugaugccaggagauggagcccagggcagggagggcggcaggggcaggaguccggggcagggagggcggcgagggcaggagccuggggcagggagggggucgauggcaggagaccggggcagggaggguggcgagggcaggagcuuggcuguaucccugccugucguuauggcugcugccuggggaccuaguucccaccccagucccaccuggcguccccagucgaaggagccccagcguugcucugcacugguccaggugugaugugagccacgcgauuuccgcucuccaggaaggcagguggauggggagccccagaagcccaggcagugacgaagcuguggcucagaaagccccgugaggauggaggacaacuuccggaacuuccacccagggaugagucaagucuuacuugacuuuagagcuuuuuaaugaaggaggaacuuuguuuuucauccacaagcaugaugacuaaauauguaguauuauugucuacacuuaaauguuucacuugauuuuccagucgaaugauaaccaguuucucugggagcucauugguggcccuccuaagacaaggaacaugucagcuugcuggcaggauggccgguucuuugcggaaaaugaaacgugggugguggacagcugcaccacguguaccugcaaggugaggccccagaacacggcucuugggggaagaggccaccaucggacacuuggcagaaccugacugccuggaaaugccagcguucagugcugaugugugaaaccgguucagcuaugugaggaaauuucaguguaagaaacacagaagggccaggaaccguauuuaggacuugaaucaaccucuuuguuugcacauaaagaaccagagcccagagagggggagcaaccuggccagcguccccaguugguuagaaacaggaggaacagagaagccagacauggcccuagacucugcauuuaauuccauccgguuccaacagagccugaggcucagcagaaacguuugggggaaauacaagccacugccugaagucuuacagacagacaauuuagcuuuuaauguuacucuauuucugcugacaauggccucagcauuaccuuagauaacaggaguuccugcugcccgucuuuucuucccuccuuccaggaagcuuggagcucucuguugcauccuugcugcucagugaagggagaaaggaauggaauggaugcaaagagccaucugggggcccuguucuuguuaggcugucagcacuaaugggagaaaaagaugcccuuauuuucacaucucuguaauguaugguccguaggauggaaaacauucagccauucugucgaccccuucuagucucagcccuuguaccagcguccccuccuuuuaaaugaguguuccaugcaugccuuucuucacuuguagaaauuuaaaaccauuugccaccaaaucaccugcccgccugcaaccugcgccaguccauccuuuguggaaggcgaaugcugcccuuccugccuccacugugaguaucgccagccggcaagcgcauccugcauuuuuaggaauuccaugcuuguuuguuuauuuauucauugguugguuuuggcagagaagagugagguucagcccccugaguacaggugagagaaucagagggccaccccaggccacuggucauccacugaggacugacucauggcuagaaaggaguguggaagcccugggaacgcgggggugggaaggccaguccugaugcuucucagacgaggaagcugagcccaguggucacgcaggugagcccagagcaggccccgauggagccccagcugagagucagagaacacacguagaucugugacuguguuauggcagcaagugaucacuguacacacacuccuggaaaaaacaauagaaaaucagacaaacaaaaaccaaagacuguuauccgaagaauauguucuaagggauagaaauacauucuaaggaacagaaccugagauggagaggaaccacgugugggcacccuggggguuccugggccacccuggaaacucagugcacguucagagacugaguuggccccaacgcugcccucaggucucugugcugccucccaccccugccccgaguucccuucccaaguuagcucugcugaccccacccagagcuccugagccauccguggcuccccagugccgugccguuggcaaggugcuucaggucuacaccccaaguugcugcugcacuaagaucaggcaacgcuucucccaaacuaaacuagucaccaucccccaaacauucccagaaugucccuguggccccagagcugugucauccucagggcaccuuaccucugauguggacagagaaugaagggacucagagcucacgcucugccacucugugauuuugaauaaaaugggauuuuucugaguuucaaauuuauugccuguaacaugcagaaaauguauccccuauacaguuagucuuauaauuaaaaccaacaauucaauaugcguaaaagugccuguuagguauucacaaagucagaaugcuccuggcaaagcauaaaaauauaaucuugauaaucaaagggcccacauuagacuagaaggagacauuuuauguuaucaggagcaucaugaccaggaaaagaccuccuugaccauuuuucuuuucuuucauuucccugcuuucuagaacacugagucauggcgcauucacugggcuucucuccucacgggaaugauuucuggcgucagguugcucuuuccccccauuuagcggcugugauuaccuaugaagaauuucuuuacagggaaucuccuuuuuauuagcuuguuucaguuuacuuggaaauaagugaccuguaauuuucaccaauaauugaaauguuucacuacauuauguaaaucagcgaacagagguuaaauggaaauacguuacauuuuuguaacuuuaaugaaaccucauguagaaaagauucaacacugucuuuggcaagcuauuuuauaaaaucgauuaagagacuuuccuggacacacauggauuuagcuccccucagcacccuaauaguagacccagaaaggcguuuuugcucuucucuugaaaggcagucccugaacucccgugcaggucacaaacuugggucccacggagccacggcccagccacugggauguccaccugccccagccaggcaguggccccucagauuccuggaugcaugaacuguggccccacgccagcugcccugugcccguucuguucuguggcacgucugugaggcagggccugaugccaccguguuugcuuccucuggcagcgguggacggugaggagggcuggucuccgugggcagaguggacccagugcuccgugacguguggcucugggacccagcagagaggccgguccugugacgucaccagcaacaccugcuuggggcccuccauccagacacgggcuugcagucugagcaagugugacacccgcagugagugucgggcaggugacacccgcgugccuguggggguggggccgcguuucucucagucaucgggaccuuugcaagggacagagcugcccucacgaggugcugggccuuugcaaggauucuagccaggugaggcucuuucucccagcugaugggagggguucuccuucccucuccucagcagcugugagaugcuccucgguuaauaaggcacaccgcuuacaggcaaauaccccucuaggcggcacagccugaucucucuccgcuucuuguguuaguccggcaggacggcggcuggagccacuggucaccuuggucuucaugcucugugaccuguggaguuggcaauaucacacgcauccgucucugcaacuccccagugccccagauggggggcaagaauugcaaagggaguggccgggagaccaaagccugccagggcgccccaugcccaaguaaguacggugaaggcggggcccugggugggcgggcuugcaggcagcucacagugagcagccacagcuggagccgggauccggggugucagggccuguuccagcccagcccagccccagccgagcagcaaagggggcugccaucccgggccuggcucgguaaugaacccauccuuugugauuaauucugcucaccugugcucagcgcaaaccuccucugagauagccccguuucauuccaguucaggacagacuguaauuaaaggaagaaugauccagcaccgcagcucugucaugggagugaguguggaugggggagugaguguggauggggagugaguguggacggggagugaguguggaugggagugagugcggacgggagugaguguggacggggagugaguguggauggagugaguguggauggggaaugaguguggauggggagugaguguggaugguguuuaugggggaaugaguguggauggggaguaaguguggaugggagugaguguggauggcgaguguggaugggagugaguguggauggcgaguguggaugggaaugaguguggauggggagugaguguggaugggaagugaguguggauagagugaguguggauggggaaugaguguggauggggagugaguguagaugggagugaauguggagagugaguguggauggggagugaguguggaugguguuuacggggcaaugaguguggauggggagugaguguggaugguguuuaugggggaaugaguguggauggggaguguggaugggagugaguguggauggggaguguggauggggagugaguguggaugggggagugaguguggauggggagugacuguggaugggaaugaguguggauggggagugaguauagaugggagugaauguggauggggagugaguguggauggggagugaguguggaugguguuuauggggcaaugaguguggauggggaaugaguguggauggggagugaguguggauggggagugaguguggaugguguuuaagggggaaugaguguggauggggagugaguguggaugggagugaguguggauggugaguguggauggggagugaguguggauggggagggaguguggaugggggagggagaguguggaugguggagggagaguguggaugggggagugaguguggaugggggagugaguguggauggggagugaguuuggacugaguagugaguguggacagagggagaguguggaugggggagggagaauguggaugggggagugaguguggauaggggagugaguguggauggggaguaaguguggauggaagugaguguggauggagugaguguggauggggagggagugugaaugggggagugaguuguaugggcagugaguguggaugggcagugaguguggauggaagugagugaguguggacugagugaguguggaugggcagugaguguggacggggagugaguuuggacugaguagugaguguggacagaggaugccgcagaugcacagaacugugucucucugaaauagccuuucccugcgucugugcagacuagggugugaguuacagagcgcuuggcccaaagcaucaagggcuuccccagggaggccuggcucgggaagugcauggaugugcugagaaaaagagggugugcagggauugccuucagcugugcucacgccucaugggaacugccugugaggacauucggugucauaccaggcuucugaguugaggccacccuccauggcagagggacagcuuggcgaggagcucugagcuucucgguguaaauggugguguggggccgggcacgguggcucaugccuguaaucccagcacugugggaggcuggggcaggaggauugcuugaggccaggaguuugagagcagccugggcaacauagcgagacccucucuauuaaaaaaauucuuuuauuaaaaagaagaggugguaugauuugucuucuggaggccaagagaucgcagcaaagccauuggaaacacuggcuucugagucacucccggaauccaccauugcagcaggcguaguggugcgaucacgcucugaccuguagucagccaaccuggggagaaaccaguuuguggggcuguguagggaacaccaugucccaccugcucuucccucucacucagccaacucacguucuccaccccgggucuugcucugagcucccccugguuggcuuuccccgcagucgauggccgcuggagccccugguccccguggucggccugcacugucaccugugccggugggauccgggagcgcacccgggucugcaacagcccugagccucaguacggagggaaggccugcgugggggaugugcaggagcgucagaugugcaacaagaggagcugccccgugggugagugagggguagaagcgggggcacugaaacccgggcuuccauucugaugaaaagcacaaacgcuuugggaaacuagaugaaaaacacagaaaagaaaaaucaauuuuaguugcacacgcaaagauaacuacuuuuaacaucuguguuucaguccuccuguauuucuaauguaaaaacaaaaaagaugccagguggcguggccuguggaauguggguaguuguguggcguggaaugugguguguggguaauugugugguguggccuguggaauguggguaguuguguggcguggccuguggaaugugggcaguuguguggcaugguaugugguguguggguaguuguguggcauggaauguggaguguggguaguugugugguguggaaugugguguguggguaguugugugguguggccuguggcauguggguaguuguguggcugggaacauagcauguagauaguugugugguauggaacaugguguguggguaguugcaugguguggacuguggcaucugggugguugugugguguggacuguggcaucugggugguuguguggucuggaauauguaguuguguagugugaaacguggcaugugaguagcuguguguugugaaacaugguguguagguaguugugcgguguggaacauggugcaugggcagcgguguggugugaaaugugacacaugguaguuguguggucuggaacguggcauguagguaguaguguggugugucaccuugcauguaguuauguguuguagaagguggugcgugggcaguuguauggucuggaacaugguacauggguaguuguguggucuagaauguggcauguagguaguugugugguauagcaccugacgugugggcaguuguguguuguggaagguggugugugggcaguuguguggucuggaauguggcacaugguaguuguguggucuggaacaugguguguagguaguuguguaguguggaagguggcguguggguaguuguguggucuggaacguggcacauagguaguugugugguguggcaccugggguguaguuguguguuguggaagguggugcgugggcagcuguguggucuggaacauggcacguagguauuugugugguguggaaagugacgcauggguaguuguguggucuggaauguggugcauagguaguugugcaguguggcaccugggguguaguuguguguuguggaagguggugcaugggcaguuguguggucuggaagguggcacgugguaguuguauggucuggaacaugguguguggguaguuguguaguguggaagguggcacguggguaguugugugauccggaacguggcgcguagguagguuugugguguggcaccugacauguaguuguguguuguggaaccuggugcguaggcaguuguguguuguggaagguggcguguggguaguugugugguguggcccguggcguguagucauaauguacacgugcuucugcaacccgcugcacuguguccaccugagcaaugcggucuuggagaugaugccucuugaugaucauccagaaucacaccagaguguuccugacuacacaauucgaugacaaagacaucccagaguguuugacggcccacagggcgggcuuccuucugugcugcgcagggcgcguggugaacucugcuccgccuucucccacccagauggcuguuuauccaaccccugcuucccgggagcccagugcagcagcuuccccgauggguccuggucaugcggcuccugcccugugggcuucuugggcaauggcacccacugugaggaccuggacgaggugggugaccccgcccugggcugugggcgcccugaggucgggagcggccucucaugucugcuuguccccgcagugugcccugguccccgacaucugcuucuccaccagcaaggugccucgcugugucaacacucagccuggcuuccacugccugcccugcccgccccgauacagagggaaccagcccgucggggucggccuggaagcagccaagacggaaaagcaaguacgcaaggccggccuuccuuguguguugcgagcggcuuuggaaaaaucagaugagcucagaaaagcagcaggaggaaggagaggaagggguggcguggcccgggagaggcaugggaggggcuggcccggggaagcugagcaccugcucggcugggccgcugcucuccgcgcggggugcggggcgugcucagccgggccugugagggucaggccgccaccucuccgcuguuagcgcagcccuuggugagcugcagccgaggcucagaaacgauggcugagucacaaacggagccucaggaacgaacagcaccucaagugcguguccagaaagcccuucccacuucaggacuuggguccgcuugggaccggaccugcuggggccugcggugcccgacgccccgccucgacgccuccggagccaucguccugccugucgcuaaccccgcagcccuucuccccguaggugugugagcccgaaaacccaugcaaggacaagacacacaacugccacaagcacgcggagugcaucuaccugggccacuucagcgaccccauguacaagugcgagugccagacaggcuacgcgggcgacgggcucaucugcggggaggacucggaccuggacggcuggcccaaccucaaucuggucugcgccaccaacgccaccuaccacugcaucaaggugaggcgcggggcucgcagggcacacggggccacggcggucagcccuccuccuggcgccggggacgcuacgcggacggggggcgggggcagcacagggaauuuggaaggagggucucucaggccucuugccugaucaccagguugaaugcaucccccugguccccucucuggagguccuuaguagacacaggcacacucuggcgccgcccacugcugggcacagagaaccucgggcacgucggcccauauuugcaauugcgcgcaucguuaacgccugaaacugagcagagggaggacgccggcuccacgcucggcuccaggcugugcagaggccauugugucucaggcaggucuggccaggcuaugucacuuggaaagaguuaggacaugguuuucuucccaaagcccaagcguguugcaguauaaggagcugcucagcuggaagaaggagcuccuucggggcccaucccaggcuggacugcuuuccuguggccgcuggaacgaacaccacggcccgggaggcucacaacaacaggaaucuguuaucucacagcucuggaggccugaaacacaacgucaaggugcuagcggggccgugcucccucugcuucucccagcuucucuggcucaggcgucgcugggcuucuggcgcugguggcugcauggcccugaccucuggucggcuucacaccacuuucuccagugccuuucucuccggaaacuuccucugccucucuuugauaagaacaccugugguuguauuuagggcccacccagauaauccaggaugagccucacuguucaauguccuugaccuaauuccacuuguuaccauacaagaugaaauucacuucagccauaucaggugacauccccgggcgccaagacacuaggacgcggacauccaucguggggacugccacucaguccaccgcacagggugccccaaaauguuuuagugcaguuuuaugccuuaagaaggucagacauggaaaugccacaaacugacacaaaauaucauuugaaaauauaaauauauucauuuauuuaauauuuaaucauucuugcaaauuuuguguuaauuuucucugucagucccgcuugauuaaagaugccaaauacucacugaaacaaaauaugaguauguuuuaaaaucaacgaggcacugaucccaaccuauguuacaccccuuggcuacccagccuacccuucuugaagccccugauuucagaaggucagcugcagcugaguccgugcugcuagaagauaucccgauuauucuuuccaucauuguggaauuuuagauggaaauuuaauaacuucgaaaaugguauauaauuugcaaaguuauauguauauauacacauacacaaaaggauuuaaaagugagacuugacaagggaccccugugcccguucccauauuaacccgacacacaggugcuggauccuccccauugccaggggcccccgucugggauccguguccuccaugacaagcaacaugcucuccuuucuuaaucuguaagugcugaaacucugggcuccagcacaagaccccagguucugucuucugauucaacgagugaugugcuuugagccacggggaugacacacccuuggggcucuuguacugaaacugaaacggacacgcuacucucuaccuuuuccuggauuuccaauucccucaaguuguuagugucugcacagcucagcuuuaaauuaugguauaacuggacugaaaugaaaggaguuuuugcccaauuacaugcauuacccacucaccgugaaaagcugaguuagcagauaauuucaaguucucagcccugguuucugaacauaucacauacauauuugaaagacucuuuucuuugagauuuuuugacuggugaggguuaaacguuuauaagcuuuggcauuuugauuuaugagcugaagucugugggaaggaaagcaccacuaaagccucuuuucucucccauguucucucagagcaauaccuugucauucucuucuuguuucugcaguuguuuggcaaccucacugggauucugggcuccgaacacaaguuucuuuugucucccucgugaguaguggugacauaauuuccagggcaggaguugagaagaaauucaugcgcuucuggccuccuggcuccucucucagcucccgcuugagaucgaggacugauggggcacgcuuccuuccucggcgccaugcugguuucauuucaccugcauuccugaaagaggcgcuuuccuaaauguuuuuccaaguauucuuccuucuccaauugcaggauaacugcccccaucugccaaauucugggcaggaagacuuugacaaggacgggauuggcgaugccugugaugaugacgaugacaaugacggugugaccgaugagaagguaggagcagcuugugccgcgcaccugcccuggguuccaggagcagcgagguccacaggaggccacuuuauaccaaacagcccuugucaacguaacugccauuguccugcaagcguuugugcauaggcaguucccaaaggucacuauaaagacaguccuuugcaaaagcggauuuuaccucagugcauggggcugcccagggugugcugccggaaauguuuugaauaauuuuuucuauuuuaacugcaaaaaaauagaagaccuccucuccuucugcugaggagccagugaugggcaaggcugacaccaccaugagugauagacuugccuuuauggcaacauuuaaaauauuaccauuuuucuaagaaaauugcugcaaacacaaaugguuuaauguauuuguacacaaaacagcucuagcaagaauagaucaagauuuuacucacugcuuuuuuacaucugacuuugaugggagacauugacucacuaauccauucauuuauuugauauuuacauaucucuccucaccaugaaguguaugauauaccauuuuugccuuagcaaucuacaaauuuucaacaaaagacagaugcauaaauaaugauaaaaugauuugauauggaaaaaguguuuggcgagggcuaacucuuuuuuuuuuuuuuuuuggucgcucaggcuugagugcaauggcaugaucuuggcucacugcaaucuccaucuucuggguucaagcgauucucuugccucagucuccugaguaacuggcauuacaggcgcacaccaccacgcccggcucauuuuuguauuuuuaggagagaugggguuucaccauguuggccaggcuggucucgaacuccugaccucaggugacccgccugccuuggccucccaaagugcugggauuaauggugugagccacugugcccgggccuaacuggcuuuuuaaagcacugggauuaaaggugugagccacugcgcccggcccuggucuugaacuccugaccucaggugauccgcccgccucagccucccauagugcugggauuaaaggugugagccuccgugcccugcccugacuggcuuuuugaagugcugggauuacaggugugagccacagugcccagcugugauuaaaggugugagccaccguccagcccuaacuggcuuuuguguuuguuugauuucuauauugauuuucaucaaccuugaguacauaacuuauaagugcuaaacggcccgacacacauuccuaugaucuucguuaaagucuucccuuucuugguuuuccaggacaacugccagcuccucuucaauccccgccaggcugacuaugacaaggaugagguuggggaccgcugugacaacugcccuuacgugcacaacccugcccagaucgacacagacaacaauggagagggugacgccugcuccguggacauugauggggacggugggugcuucugcuccuucccaugcgugcacuuuuuuuuuuuuuuugagauggaguuucacuauuguugcccagggcaguagcaccaucuuggcucacugcgaucuccaccuuuuggguucaagugagucuccugcuucagccuccugaguagcugggaucacaggugcacaccaccacgccuagcuaauuuuguauuuuaaguagagacgagguuucaccauguuggccaggcuggucucaagcuccugaccucaaaugauccgccugccuuggccucccaaagugcugggauuacaggcgugagccaccgcgcccggcccaaugcaugcauuuuaagggucgcaauuggaggcauuggcaaguuucauguuuuauucugaauuuugauaagcuccuuucauuuuuacacuacuauaagauuaaaugauucauucaguuauucccauagggacccaugcuuauucugccuugccuuuuccugaaggucaggggacaccagccacaggaccgcccuagagaaagcuaugcauuugguauccuccucucucugaccccagccuugcaguccugggccucgugcuucuucauggcaucuuuucuaauguucacccuucauucaaaaauuccaagaagccauuucauguuuucaucaaacugagcuucuaggaguuagaauaacguggguguauugugguuaccucugccacugaucccgguugcugcuuuauccggagaguucgcuggccuugguaagcgagcucugcaacccagugccacugucaccgcauggucaucccuucucuuggggugccuggagaccaggcgagugcuucuguagaaccagcaagagcugggggcaggcucgccuccacgcuggagcucggccccagcuccuccacacuucgccucgugggguccucuucccagcccggcgccagccacccccuuucugagccaccccaaccugcuguucugucucacagcggguuucucagucugaucuuuuccacugauuucugccuccacccuccucucguucucugggaaugugguggguugcugucugagggcucgugguggccagggggcuccucggcuccccauccaggauggcgucugugaugugcuggaugcagaucucaagcuccagucccuuccauuuuuauuuuuuagguguuccuuacuucccuucuccagaccucaccugaccaaagcaaggcgagcgucucagcucaguucuggcucuuccuguggacucgcugccguguaacauuuugcucugucauuugugacacugucacugaugguauuguuuaguucagugcuaguuuauauuuuuguaacuucaguaucaaugcaacucaucacuuucagauuucuuaagauaagauaugacaucuaaaaacccugccacucucugccauuguuuuuuuccuacucaugugcauggaugauaaacuccugggaacucaacacauacuuuccaaguggguauuagggagaaauaagcaauuuagcaagcucagauuuacacggcgacagcacauucaacuaccccuccugcaacauuacccagaaaucuccaaaaguugguucuauuucaaaugaaagguauuugaacuguaaugaaauaugucauauguucuucuaaaaucuaauagucuuuauauuuuacuauauucuuaggcgucuuuuuauuauaauuaaauagaaguguggcuguaagcaauuucgugugauaggaaaaacaaugugcuuuuucuaaacucaccuguccuucugguuuguuuuuguuuucuucccccuuuaaacacuuacagaugucuucaaugaacgagacaauugucccuacgucuacaacacugaccagagggacacggauggugacggugugggggaucacugugacaacugcccccuggugcacaacccugaccaggugagggcagccgcagacaggcgggguuggagguccucaucagagggacgcggggacgguggcggugugggggaucacugugacaacugccccuggugcacaacccugaccagaugagggcagccaugggcaggcgggucucagguccucaucaguccccuccauggggccuugggaguuuuccaugagcuccacaaagacaggauaacauggaguuuucaaugauuucaauugaaaacauuuauucaacucaaaucucagcacuauucuuguaucucaguggccacaggccaaaugaauagacgccuucaccucaucagcuggagcgagguugugucuucacagaauucucuccccauuuuccugaugccaacauaggaauuggcuucauuuccagguuugcguuugaaagagacaagggaggacaguuaucuugaugcagcucauaggauauauuauccuaugauguaaaugguguaaauggcgcaaaugguguaaaaaagagacauaauuaccugguaguucaugcuuuuccagcgaagaagcacaucuuccuuuagugaagugaauuacuguggagagguggcagaggguggagagauuccuggaccgagaggccuggccccagugcuuguccugacgucagggucagugugaccucgggccagccgccccugcguggcccuggggcuugugcugcaggacgaggaggccggcucucaggcuugcguccugcugguuccucuccaccuccucaaacuggcaguccucugcuguuucucucacgccccauccccuagaccgacguggacaaugaccuuguuggggaccagugugacaacaacgaggacauagaugacgacggccaccagaacaaccaggacaacugccccuacaucuccaacgccaaccaggcugaccaugacagagacggccagggcgacgccugugacccugaugaugacaacgauggcguccccgaugacagggacaacugccggcuuguguucaacccagaccaggaggacuuggacggugggugcucucucagcucaugggcguggaggaaaauggcuucugagcaacccgccagggcagagauauguaugcacggagaucaucuuaaaucugcugcuggaaaaagggcaaugacuuugggccucuuaaagcuguggguccaugcaauaugaguuucuucuccccugacacucaacacauucuuggcugugugugugcccuucaacaggugugcugccucaagugugugugcacgucgggaggaggagaaaucccugccuccauauaacuuccagauuguugacgaucuccuagaaagaaugcggguuacgaacguaggaugaauugggaauuugguguauggggccaggcaggggacaaggaggauuuuuuugaaagcaaagccaacaaaaguggcacgagugugaagcaugagaggaagagcugcuuugcucagcagugagcaugaauagguggcccauagccacgggggcccaaggaaggagcuggaugggcugcaguccucuaagucagcgucccugaguaauaaacaagggcacagcugugcucuggggcuuccggggaggcugugagaaaguggcccucacuuggaguggggccuggcugacacaggcucucuuuggaagccacguccuugacagagggagauaaggacuugaggggcaucugagacagcaugacucagaaguacgugggagaugcugggaucagaagggcagcuccuguguucuccccgagcagcaugaagggauggagugagcacagcaagccucaucuggacuccguguucgggcaugcaggggcuugcuccccaugcagccuuuccccagggagggacugggacagagagaagcugauaggcagagcagcauuucagcauuucagaaugcccugauaccaacuaugugccugccacgugguagcuggaguauguucuugaacagaacggaaacuaguugaagaauaugaugagauauucaauccaacuugccuuuccuccaaaacggcaggccacgugauagcuaauucaguacauugcaaucugccugucagguuaucgucaucgccguagacugauagacuggacacauguggcaaauucguggucccccuguuugcaccaggcccaccucauccccacuccccaccaugccacaaccccgcugaaaacuugacaaggacccacuaaacagcggaaguccaugucucccuaggaaaaaccauuuuagugugaguuccgcuuuaaugccaaauagacuauaaaaggcaaggaugacuaagaaaaguaauaacagacauucagaaaacuauccaaacacaaagcuggaaaugcagguugauauuacuugacagccauucagguuuuauaccugcagcauugaguuuggaacacggugagaaauggcuuuaugugaauuugcugugcuggccuuugcuguguauuuaucacaaaaauuuugugaaaagaguugagguuccugugaagucaaauguuuuggagauuguugagcacgaauccacaaaacacugcaaagcacucagucuuagauguucugggaaagaugcacucauguuucucagacacggaaaagcaaauggcaaaccaccgaccaccgacuuugcuucuuuguuuuuguuuuuguuuuugcuuguucuuugugcauaggugauggacggggugauauuuguaaagaugauuuugacaaugacaacaucccagauauugaugauguguguccugaaaacaaugccaucagugagacagacuucaggaacuuccagaugguccccuuggaucccaaagggaccacccaaauugaucccaacugggucauucgccaucaaggcaaggagcugguucagacagccaacucggaccccggcaucgcuguaggugagucucugagacacggcgguggugccagcauuucuccgggggaggcgcccacagaagaugcagacugcacuuuaagaucaugcaggugggaugccauguggucuuucuggaagcccccauccuuccauggucugugaaacugucugccuaaauaaccuugacagguacaugcaccugccgcucugaagucucugaaauuucaguaaaccauuuuauuuuauagacuuggucuaugaaaugggaccucauaauccucucagaacucuuguaaguuggaucuaaaagaaauaccuucaauuccacuaaucucaugguaaaagagcccaucgggaugaugaggggagcccgcccugccugcugggcauccacugucagauggucacagggccaagcuggggauugccugaaaccuguuucuuuuuuuuuucuuuuuuuucuuuuuuuuuuuuugagauggagucuugcucuugucccccaggcuggaguauagugguacaaucucaguucacugcaaccuuuuuuccccgguucaagugauucuccugccucagccuccugaguagcugggauuacagguacccaccaccaugcccggcuaauuuuugcauuuuuaguagagacaagguuucaccauauuggucagaccagucucgaacucuugaccucaggugaucugcccaccucggccucucaaagugcugggauuacaggcaugagucacuacucccggccaccugaaagguguuucuaacgaaaccuuauggcguugcauccagguuuugacgaguuugggucuguggacuucaguggcacauucuacguaaacacugaccgggacgacgacuaugccggcuucgucuuugguuaccagucaagcagccgcuucuauguggugauguggaagcaggugacgcagaccuacugggaggaccagcccacgcgggccuauggcuacuccggcgugucccucaagguggugaacuccaccacggggacgggcgagcaccugaggaacgcgcuguggcacacggggaacacgccggggcaggugagguuggcuggccaggcccacacaucuccucugcaccacuguggcugcagaguguuucagcaggacuagcccaguccagagaccccacuuuugucuuuauuaauuuuaacuccaggcacaguuauuuuaauaaucuuacuuuauuauagacacugugccugggguuacaacucaacacaguugauaauuaccaguuaaauacaguugcuaauccuuuuacaaauuaaaccucuuuuacccucuucuggagauagggagugagcauaggacauaaugaucaaagauauaauaugaaaaaaauauuuuaaaaauugaagcuagggagaauugaauaucaaaacuucaagaauuuugcccaacaucccauaucaaggaaagagaagauccagacaugaacccaggaaucugaggaucaggugccugggcucuucaauccaggaaucugagggucaggugccuuggcucucagcccugagccacacucuguccaugggcuucaauccacaguagagauuuggaugauaaacacaucagagagauauggagcaccaugagccuuaagcaugaacuugcaaagucauguuuuugcuuccugcuugguguuacagagcugugguuaaggcuccgggugcccauggcacucaagagugcuauguucucucucaggugcgaaccuuauggcacgaccccaggaacauuggcuggaaggacuacacggccuauagguggcaccugacucacaggcccaagacuggcuacaucaggugagggcaggucagcacagcugcauuucuuccaaggggcuucccaucggacggcacauuugaacauuaauagacaaauaagcucaagugaauucuaacuuuuuguuuuacucuggauucuucgucauuaacugcuuucucuuuucuauccugcaucucuacuaaauauuaaguauuuuuaaaaaaugguugaaaaggagaauauacaaucugcuuuguuuugggaugauaaccauauuuucuccuaaugaauaccccaggcaggggagaacaccugcaauuaaaauaacugcaucuuugcagaauuagcaugugcuuuauuggagacuagauuuguaccugauauaaauggcugaauuuaaaacacgguuguaugaaguuuugacacaguuagcccaacagaaucuuuucccuuggcuuaacaguauuuauaauugauuuuuauucaaacaaaauguggucaauuuaaaaucaagguguuuuuguuuuuucaaaguuaauaagcaccaagaucaggcuggacucugcacagaugccaggagugugugagucccuggcaauagagggcagaucugugugggugaagugcaggcucguggccucgcuggaacguuucccuagggggccuccuguuuauucauauugaugccccauccuccugucgggggcuugguguauccaguccugcucccacgcagcuuccacaguggggaggagagccggugagcucaugguuuuagcacaaggugaaguagggagaguccggugcaucuucccaggaagugggaagcuuccuccucaccccaccaaagguagagucuccucuaaagcccuugccugggugacuguaagugaacucacagauugugacaauagugugguugcaagaaggaaggcgugcccuggaucagugcugcaccagggguggcuggagcuccaaaggagaaagccagcaaugcccccuggggcacugaagcccugggcggaguauccacagcuuguguccggagccaaccuuccaucacuggugaaugcuucacagaguucauguugucuuucuuuccucuucuucuuuuuaaacaccauuuuuagagucuuagugcaugaaggaaaacaggucauggcagacucaggaccuaucuaugaccaaaccuacgcuggcgggcggcugggucuauuugucuucucucaagaaauggucuauuucucagaccucaaguacgaaugcagaggugagugugagcacuucagguuaguggggaaggcauguggcacccagaaagggaaagggguacacagugcgcucuuccacuuacaaaagcuguacaucagggcaauaaaccuaaugcacaauaccacacaugagcccccugcacauuccaagcagccauuucauuuggucagcuuggauuguuuuguuuuuaauugcauuuggaugccucugguagaacacuuuccaauuauuuacaggucccacccauccucauugugccauagccuagaguuuccuagauuuccuccacuuccaggcuccugacgccauuuuagauugguacccuugcauuagcaauggcaggcaggcaggaaggaaagaaggaaggaaggaguuucucuauaguuaucucgcuacagguauauuugaaucaaaauauuauagaccuggaagauaacuugaauuccaucugcucuaauuccaugccuucaaaugcgcauuacccuuccacagaugcaguaaauaaggcucaggaugcuucucaagaaucacacauugaaaaucauguguuuggcugggggcaguggcucaugccuguaauccuagcccuuugggaggccaaggcggguggauccccugaggucaggaguucgagaccagccuggccaacagggcaaaacccuguugggguugauuuaucugcuugcuucuguggagguuuucuucuccuuauguuaggaugucuuucaaggcaucucauuuccucccauccauccauaucauucauccacccacccauauaucucauccauccacccauccauccauccauucauccacccaucucauccauucacccaaccauccauccauccacccacccacacacccacccaucucauccauccaaccacccauccacccaacuaucucauccauccauccauccacccacccauccaccuauccaucuaauccauccacccacccacccacucauccauuucauccauccauccacccacacauccacccaaccauuucauucacccccacucacucaucuaucccauccauccauucaucucauccacucaccuaccuacucauccauccauccauccaccuaucaauacauccaucucauccauccauccauccaucucauccacccaccuacucauccauccauccacucaucucauccacccaccuacucauccauccauccacucauccacccaccuacucauccauccauccacucaucucauccacccaccuacucauccauccauccacucaucucauccacuuacccacccacucaucauccauccauccacccagcacuuauccauccaucuuauccauccauccauccaucucagccacccacccaugcacucauccaucucauccaccaacccacucaucccuccauccacccacccacccauccauccaucucauccacccaccuaucucauccauccauccaccugucucauccauccauccaucccauccauccaucuacucauccgcccauccaucucauccauucacccaaccauccaucucauccauccauccauucauccauccacccacccacacacccacccaucucauccauccauccacccagccccauccaccuauccaucuaguccauccacccacccacccauccaucucauccauccauccauccacccauccauuucauccacccccacucaucuaucccauccauccaucucagccacccacccacccacucauccaucucauccauccacccacccauccaucuccaccaacccaccuaucucauucauccauccauccaucaauucaucucauccacccauucaucucaucuaccaacccacucauccauccauccacccacccauuucauccauccaccaauccauuucauccauccauccacccauccauccaucucauccagccacccaaccaucucaucauccauccacccauucaucucauccaccaacccacucauccauccauccacccacucauuucauccauccauccauccaucucauccacccacccaccccauccauccacccauccauccacccacccauuucauccacccacccauccauuucauccauccauccauccauccaucucauccacccacccaccgacccaucucauccauccacccacccaucucauccauccacccauccauuucauccauccauccauccauccauaugauagaucucaucuuuaauuaaaguaauuauauuucugguucuagguaaaacaaaauaaaucacuacccauggcccaguuaugcuaauuguuuauugcuuuuuuuuuucuuuuuguagauauuuaaacaagauuugcugcauuuccggcaaugcccugugcaugccauggucccuagacaccucaguucauugugguccuuguggcuucucucucuagcagcaccuccugucccuugaccuuaacucugaugguucuucaccuccugccagcaaccccaaacccaagugccuucagaggauaaauaucaauggaacucagagaugaacaucuaacccacuagaggaaaccaguuuggugauauaugagacuuuauguggagugaaaauugggcaugccauuacauugcuuuuucuuguuuguuuaaaaagaaugacguuuacauauaaaauguaauuacuuauuguauuuauguguauauggaguugaagggaauacugugcauaagccauuaugauaaauuaagcaugaaaaauauugcugaacuacuuuuggugcuuaaaguugucacuauucuugaauuagaguugcucuacaaugacacacaaaucccauuaaauaaauuauaaacaagggucaauucaaauuugaaguaauguuuuaguaaggagagauuagaagacaacaggcauagcaaaugacauaagcuaccgauuaacuaaucggaacauguaaaacaguuacaaaaauaaacgaacucuccucuuguccuacaaugaaagcccucaugugcaguagagaugcaguuucaucaaagaacaaacauccuugcaaaugggugugacgcgguuccagauguggauuuggcaaaaccucauuuaaguaaaagguuagcagagcaaagugcggugcuuuagcugcugcuugugccgcuguggcgucggggaggcuccugccugagcuuccuuccccagcuuugcugccugagaggaaccagagcagacgcacaggccggaaaaggcgcaucuaacgcguaucuaggcuuugguaacugcggacaaguugcuuuuaccugauuugaugauacauuucauuaagguuccaguuauaaauauuuuguuaauauuuauuaagugacuauagaaugcaacuccauuuaccaguaacuuauuuuaaauaugccuaguaacacauauguaguauaauuucuagaaacaaacaucuaauaaguauauaauccugugaaaauaugaggcuugauaauauuagguugucacgaugaagcaugcuagaagcuguaacagaauacauagagaauaaugaggaguuuaugauggaaccuuaaauauauaauguugccagcgauuuuaguucaauauuuguuacuguuaucuaucugcuguauauggaauucuuuuaauucaaacgcugaaaagaaucagcauuuagucuugccaggcacacccaauaaucagucauguguaauaugcacaaguuuguuuuuguuuuuguuuuuuuuguugguugguuuguuuuuuugcuuuaaguugcaugaucuuucugcaggaaauagucacucaucccacuccacauaagggguuuaguaagagaagucugucugucugaugauggauagggggcaaaucuuuuuccccuuucuguuaauagucaucacauuucuaugccaaacaggaacaauccauaacuuuagucuuaauguacacauugcauuuugauaaaauuaauuuuguuguuuccuuugagguugaucguuguguuguuguuuugcugcacuuuuuacuuuuuugcguguggagcuguauucccgagaccaacgaagcguugggauacuucauuaaauguagcgacugucaacagcgugcagguuuucuguuucuguguuguggggucaaccguacaauggugugggagugacgaugaugugaguauuuagaauguaccauauuuuuuguaaauuauuuauguuuuucuaaacaaauuuaucguauagguugaugaaacgucauguguuuugccaaagacuguaaauauuuauuuauguguucacauggucaaaauuucaccacugaaacccugcacuuagcuagaaccucauuuuuaaagauuaacaacaggaaauaaauuguaaaaaagguuuucuauacaug

SEQ ID NO: 18202 - RNA, 13550 nt, Homo sapiens
uuuagcuauuaaaauauuuuuauugauucuuuaggcaauauaauuauacagaaaauguuuacuuauucacugaaaauaaaauauggcaguugaaaucucucgagguuugaauuucaauaaauaauauuguugcuuugagaaguaguuucagaguguacauccuaauauguguuuuauuguaaauaguuauuuccugaaauauuugaugccuuggaaagucuacaaucuccugcuauuucucuuagcuuaaugaaacugacaucgugucuagaacgagccuugggugauguaagugugagaacucuuucauuauuggcccauuaaauuaucugaaugaacaugaaacuauuuuacaguuguccucaguuuucuugauuauuuuccuauaagauaaaaucauuuaguaugaauuuuuaauauuucccuuuugaaugauuaugaaaucaaaggauuggugucuaaguacuuuucacccuucauuuguacaaacaguugcuucauggauaauguuuuuaauguuuauuggcucauaauacaacuguuacacaauuuuuguuugaauuuuagguauuuuuacugauugggaaggaaugccccuuucuuuuaagagaucugcuuucaucugaggagcuugcucaagucuucagucagucugugguaagcuuguucaucuaaacucauggaguauauuaguccguuuucaugcugcuguuaaagacauacccaagacuaggaagagaaagagguuuaauuggacuuacgguuucacauggcugaggaggccucagaaucauggcaggaggagaaagacauuucuaacagggcggcagcaagggaaaaaugaggaagaagcaaaaguggagaccccugauaaacccaucagaucucaugagacuuauucacuaucaugagaauagcacgggaaagaccgguccccaugauucagcugucucccccugcgucccucccacaacaugggagaauucuggaagauacaauucaaguugagauuuggguggggacacagccaaaccauaucacggaguaagugcaaaacaacaauucacauaugcugagcuuuuguucuucccaaacugaugaugcuuuagggaaaaauuguaucagugauucaagcauauucucccuucccaccuucccuuucaaaauugccccuccuccagcacauagaaagcuuuccuaucccgagugugaauaacucuggggcaccacagggccaaugugaagcauguugccucgaucaauuacauauuaauaacuauaauacuaaauccagaauacaacuuuaacccuuuaaaugagugauaauacaguuuuauuugaaaauuuuaacgugaaauuaucuuuugaaaccauuuaaacuuacaguggaaaaaaauucagauguuaaaaaaaucaugcaguuacuauacuauauuaaaaucucauaaagggcacaugaucaagagacuuaggacuaaugaauaaccuuaggcagcugauugaggcagggucaagauggagaaacccagaagagccuuguguggaagcugugcuugccaagccagggugcuagaugauuuuuggaguaaagaaaucugucuucaguggagcuuuuccauucuuuucuguggaucuuuacuccuuguccgcuuaaagaucauuuucuuuuguggagugcauggaaugaagauaaaaaguacaaaccucuuguuacacugaauucucaaacacauuuuguuucuucgaucuguucuuugguacuugcuuauaugugaugggccuucugcccacuuguggccccuucagcugccaggucacuggcauuuauacaucugauugaccagauagugugaaccaugaguauuucacaaauuauugguagagcaaaaagaucuccugaaguugcauagaagaacugcuuguuaaauguuccaacauucaguagaacugcucuugaucauuuccaccuccugguuuugggucuuccccuugagggaaguucagaaugcguccauauucccuucucaacagccaucuuucacaugcaugaagacaguguucacuuccuucucgagucuucuggaggcucaaccauacuuucuccuaugacaugaauucuuuuagucuuugaacaucuuccauuauguucugaguuucuucuaaguauggcgccucaaacccaaagcaguucucugggcaugacaugacugcaguccauuuauuaggacgccugguuggguguuuucuucacucuguagauagauggugggguggauaagugaugggcuucacgucagacagcuaggaaguggaggcucaagccuggagccaugcugcucgggcaucugcccugcugccucuguuuaaccacacaauugcgugcugcuuaauacagugauauguuucugcuuaucauaucauugucuuuuuacauuuuauuuagauauuaugcacauuugaagcaacuuuauuaaagcaggauaaccugggucagaucuuaucccccauauugauuuuguagccuuugagaccuugguuucaccuuuccaugcuuguauuuuuuucaccuagaugcuggggauaaucauaguaccuuccucauagguuguucuuaggaugaaugaguugauguacauguacaaaaugugucuagcacauauuaaacacucaguaaauguugguuuuauuauuacugcuauauacuagccaaaacuguugacucucaguuaaaaagaggaacacaaauguuaucuucauacuauauugguuuauucaguaauucaguauaauuaacuauguaaugauuugcggauuagaugaaugugcuaaaagucuucguuggcucuccguguggucucaaccugcguaacgucuuauggcauggguuugcgucaccugaagaaauuccuccaaaguaaguugcaagugaagacauuuucuuccuuuuuuggaucuaccaaagaguuuuuuaaauuuugaauuucaugagaaggaaauagauuuugugaaagauaagugaguuuugagauaggauuuugaagcuaaaauugaauauuacuaguguagucaccagagugaugacuggguuauaauuucagugacuuacaccccaaaggcaauucaggggugacaccagaaggauguuaugccauucacguccugggugggugggagacccugaguuucauuagggucuucaucagagugucuguggugcuguugugcugcccaacuacugcacagucuaauuccuacaucgagagaauuuugugcaauuuuuuuuuuugagauagagugucacucugucacccacgcuggagugccaugauacauucucagcucauuacaaccuccuccucccaggcuuaagugauccucccgacucagccuccugaguagcugggacuacaggcacacgccacuaugcccaccuaacuuuuuuguauguuuuguagagauaggauuucaccuuguugcccacacuggucucagacuccugagcucaacugaucugcacgccucggccucccagaguucugggauuacaggcaugagccaccgugaucggacaguuucaugcaauuuaacuuugcuuucuuaauuuuaaauuuguauuuuucacagugaagcuuuuuauaggcaugauugaguacauuuuuguaacagaucucuaugguauuuccuagauacuguucaaugaugauacuguugacggcaggauugggucaguuacugaagaguuaccuucaaaacacuaaacuuacauuggcacaucgcucuuucauaucucuuacaaaccucgaggauuugauuguuuuuccugguaaguacuauguuucacauuuuuccuuauagcuuugcguagauauuugcaaagucaguaaacagcauuaagaggugcacucuugagguggggugaaguaguuguucuucaguagucggauggcuuucagaguugcuugaagaaccuccuacauuuuaccacccaaagcccugccuccucccaccaugcccugggguuguugugggggucacaggaguugcagcugugugagcugagcucuuucuuccucagaugcacuaugagcaacaguggccucaggcuguuguaugauguacauuuucuccuccuuuuaccucuugugucuuuguacucaugaucauuaugccagaaauacuuguaguaauaucaagggucuuuuacaccuucugaaaauguguuuuacuucucuuggucauugugcucaguugguccauccugaacuguugccuaagucacugaagagauguccaugccccacuuuccaagggucaccugcaccucgggcccuuggucagggcaauccuacucucuaacaaguccccugcugcaggggucacgguucagccaccuaaagggguuggcucauuggcaucacucccccagcauguuuccaucuuuuuucaguugaucaguaugauuguguuuaaaaccguguguuauuuuacagauguuacuuaugaggugcuuucaguauuagaagaagugaugaugaaaucugcuuuuauauuaaaaaucauguuaccauauugggaaguugcacuggucaaguucaagucacacagguaacuaaaggguacauggcagagugguuugcagugguuggaggccauucuuucuugaugcccuucacuuucgaugcuuuuugcuguuggaguagaagugaagagaaccuggacugacuugagcagaccugaaaauaaaacaccuucauagagucgcuucaaggaccgccugugauuauauuggaaacauugccuuuuggugcaggugauagaauuauuuuucaggauccacuuuuuaauauuuucuggaagucuuagaaugagugaaacauguucagaaucaugaaacauagauaagccagcuucguccuuacauucuguuucuguuuccugaggagcaaacacauguauggucgccaccagaaggucuggugagcugaucuuuaguuccuuaaaggauauuacccuaauucauucauuuuuaugccuugagaacccacugaaauccugggaugugcauuuuuguuuuuuucuuuuugagacugggucucacccuguccuccaggcugaagugcauuggagccaccucggcucacugcagccuugaacuccugggcucaagcaguccucccaccucagccuccugaguagauaggacuguaagugugcacuacugugccuggcuaauuuuuguacuuuuucuagagaugaggucucaguccauuccccaggcuggucuugagcuccugggcucaagugaucguccuccugacucagccucccgaagugcuggaauuauaggagugagccacugcacccagccucaguauuuucuagaagcaaugaaaugaguuagacaguccuuugaugacauuuuauucuguagaagcuacuaaaaaugguucaucaaacauuaaaacacuggaaaauguuuuuaaaaucacuaguuagugaaacuuuuguucuauguguaagugguuuuguuuuguuuuguuuuguuuuuugagacagagucucacugugucacccuggcuggagugcaguggugugaucucagcucacuguauccucugccuccuagguucaagugauucuugugccucagccucccaaauaucagggacuauaggcaugcaccaccacgccuggcugauuuuuguauuuuuaguagagacgggguuucgucacauuggucaggcuggucucaaagucuuagccucaugugaucugcccgccucagccucccaaagugcugggauuacaggcuugagccacugcgcccagcugguucuguuuugcuucucguauuagcaaguauuaucauuucucuuugcuuuugauaucuagacugcagcaguuauugugauguuggugucaauauuauuuuuguuuuuugcuuguuuuuuacuuagagagucuuagucugucacucaagcuagaguguaguagcacagucauagcucacugcagccuugaacuccuggguucaagcaauccucccgccucagccuccuguguagcuaggacuacaggcagugccacugcacucugcuaauuucuaaauuuuuuguagagaugggguuucccaggcuggucuugaacuccuagccucaagcgauccucccaccuuggcuucccaaaaugcugggauuacaggcaugagccacugcaccuggccuaauauuuauuuuugaaauguggaguuuuaccucuuuucccuucaauuucauagguuugcugacugcgccauauuguugcugacacaacuggagacuggacuuaggaauguuuuugccacacuuaacagauguccaaaaagacuccugacugcugagguaagcuuguuuuuauuauugauugugaucauuguugcuguauuaacaguuuucuguuaccaauuaaaaguuuuuaaaaauguuauucuguuucacauuaaaaugauuuuaauuuagcuaagaacuguggaaggccuaucauuucuauaggauuuauauuuauguuauuuaugauuguuuuugauauuucuguaauauuucuaaacagucuuuaaaacucaaugauaccgugaacguaguaggcacugguucucucucuagcuguguugauggugugucacuguaaccgcgugagauggcugcggucuagccgggagacugaggugaccagugguugaaccugaccuugggaaacuaaucaaaaccuucugaacuugaguuucuccaucuuacaaauggaagacguaggauuuggaggugacuugguguggugccagcccugcagcaggucaugaaagccuuugucucaguuucuugagccccuccauguguguacacacacgcguacacacagcugucucagaguuccacauugacccccggucgcccugucugaggcaagcgucucugaguuuccagccuaccuccucuggcuccuagaauuucucauuucugcuccuuuuuaguaguuaugauaagauccugcugcuuagugacagagaucucgaaauaauauggcugcagugacugaaauaggauagaagugcauuucugccuuucccagaugugaguagcucccacugagauggcagcacccccaucaucagcacucagaccccucugugucgucuuccagugaugagggccaggccuuccuuauggagacuacuacuuccuggcuccagccggcugugucagccaucacaucugcuuuccagccagcaggaagagcaaagauuggugcaugccccucucuaaggacacuuccuggagguagcacaggccuugggccagggcuuagucgcacuugcugccagggaggcauggaagcguuccuggauggccaagugcccagcuucccacgggacgaucuguuguggagggagggcaggugcagccgcuccacaccucggauucucgucucuuucucuagcuuggcuuuugcuuuuugccccucuuuguaggcauuccucaaugcucugccgucaaccccauccucuguuuccucucccugggagaucucauacaauucucugccuuacauuuucaucucugggggaacaacaauuagaaaauacuuugaacccagugaaaaugaaacccaacacauggaaguuuuggacccagcaaaagcagugcugcgagggcagcuuacggccccggagccgggcuccccaguguugcuucucacugacccccaucugaucucugcaguuagaccugcuuauguucacuaaauaucuucaugugaguuuuccucagcaccucacauuuaucuucuuucagaaaggcguuguuucccacagauuuguccucugacgcucccucugucaucucagccucaccagcugcagacuccagcagcgucucguguuuccccaacaccucccguguccacucaguggccagcacagccggugguuuccacccagcugaccuugugcucuuccuguccaaacugagaagccccccgccuggcuccucggcccacccgagcucaucucacgauucuuccuccuucucaaauuucauucucacaguccugcugauucuuuuuuuuaguuaguuuuuuuuuuuugguuuuuuuuuuugaggcagggucuugcuuugucacccaggcugaagugcgguggugcagucauagcucacugcagccucaauccccgggcucaagcgauccucccaccuccgccccccgaguaacugggaccauagaugugugcuacuacaccuggcucauuuuuacauuuuuuuuuuccuuguagagacagagucuugccauguugaccaggcugaucuugaacuccugggcauaagucauccuucugccucagccuuccaaaguuuugggauugcaggugugagccaccauacguggccccacugauuauuuucuaagcugauauucuuacguuauuuaugguuuuuuuucauuuguuuaaccuccucgaugauguccugcugccugccagauggaguucauccucuucacguggcagcaaggccucggguucuaacccugcccuccucuuugguguguucccuguuuggauaccucagugaaauuuaggcuucuugucagcuccagaacuugcuugucuuuccucuuacuuuguuccucacccccagauuuuccgcuccaggucaggggcuguggccacaaaagcgaccuuccagaggcucaucuacucaaagguggaggcugcuuuucucuguguucuguuucugucucaucuuggaggcaguccugcuuugccuuacucgugugcauuucugcagaggucucugcggguucucugaggcaggccuacacguugcugucgccugcugcccaugcccagugccuuccauguaggccacucagcgcgguguggagcgaagcuucaggaaagagcugggccccacccauuagagcccuugcuucaugauaccugcauggggauuggcugcacgguggcacgcaccaucacuguagggccaugcggugcaaauaaauuuggauauuuacuugucauuugacuucauaaauaaauaacauggcuguuuccacagaggauauaaucuaucaaagaauauauuauuagcacaggcuuucacccagaauaaacaggaucaguuuuuaaggcaguacauauaugaagauauuuuauaaaacuuaauaagacacugcagaugcuguuauuauuuacugauuacuuuugugucaugagguuucuucaggaccaguggaagauaugaauaugagugagauuuucugacuucagaagcuuauuuaucaugggagagugagaaggcauuuauacuaacucuguaaaacaaaguagaagcuaauguguguaguugauguagguaaaugaaaaauucugcuuuuuggagaaagugggaauaugugguagacguuggauauuuagaacucagagggaauuuuagggcuagcaauacagauuucagagcuaaagauaacagauuuuagagucaucuguguaguaauguugaagaauauuggcaauaugaaauuuaaaauagauuauuaaacauuuauuauuaaacauuaauaaaucaaaaaacauuucuugagagcuagcuuacacaaaauccugauuucaucacaucacaccgcauggcccuacagugauggagcgugccaccgugcagccaauccucaugcugucaaaucucacugaagugauuucaucaggcugucugucaaaucucacugaagugauuucgucacgcugucugucaaaucucacugaagugauuucgucacgcugucugucaaaucucacugaagugauuucgucaugcugucugucaaaucucacugaagugauuucgucaugcugucugucaaaucucacugaaguccccaaaagccuuuugagauaggcauucuuaacuucuccuuuugcagagaaaaccugcaucuguggaguucaaucgguugccuguagguuucaugucuagaaaauguugcaguugggaucagaacucaggacagcacaugucuguaggccgugccgaugaugcugagaagcagcgugcaugaaauaaaauaaaaacagacaaggcuauucauuggagaaaauaggaagcugugcucccuugugcacaaauaccagucgucaggagaaguauucuguuguaugagcagcgauuugugagggccugggauuguacauuuuagagauaacugggcuaaagcucuguugagagcaguguccuaaugcggcuucauggccagcugcacuguguuuuugcgucuuuuguaauguguuuauuuugucagugacauuccucucauaguguuucuagaugaauguuuguuuuaacaaaaaacuuugggauguguggccauguaccagaauuuuuucuuauuuugcauaguguuaguguauuuguauuuugcuuuaauuguuuauuuucauuucuuuccuuuucugaagucaacagcucuuuauaccaccuuugaucaaguaaguaaguaaacuuguaagguaacuugaaacaaacagaacgcugucuucuuuuaaaauacaaauuaaaaugcaaaauuaaagaucagccauaaaucauauacuuacaggaaaauguccauaguaauauaaaccaaaaaaagcugauaauugauauuuccgguuaauuuuggggcccaguguuaccaaucuagcucccaaagcuauccaaagcucaaaguuggaaaauaccaagggaucuaacaugauuagcuauaauuauuuagaggcuugcauuuuagauuuaggggugacaucuuuuuuguacaggaaauauuccccgcuacuguuacaagugugugggauacauugauucauuuaaucugcauguuggcggugugaauaguagaaaacucacaguugaaaaugccucuugucagccacggagcgcacaggcauuugugugcguaaccccggguagcguucaugugcaccuaaagugugacgacagccuaugggaaaccaagggaagggucaccuguagagguccggacauucgguuuugccuuuaagacaacuauuagauccuaagcgacuguguuguggcugaguuaaaaaugugccuguuuacuugcagagcuucuuccauuaggugaacaaucuguugugauuuuaauguguaagaccuuugguaaugugaggaauugauuagauagugcagcccagucucuagaggaucagaucugugggauugguuggggugguugggcaaaguccauggugaguuaagaaaugacuuuggaagugacucuaauguguacacaaacaacacacaugcacacaccacacauacauacacacacgaacacauaccuccaugcugcauauacacacacaggcauacacacacucuaauguguacacaaacacacaugcacauaccacacauacacacacacacaugaacacauaccuccaugccacacagacacacacaggcauacacauacucuaauguguacacaacacacaugcacacaccacacacgaacucacacauccaugccacauauacacacacaggcauacacacaugcaggcacauacacuacacacacacacacacacacacacaggcacaguugcauauaaacacacaaauguacacacccccacaccacauaugcacauacacauauacacaccacacauauucauagucacauacacaaacacacauguguauacaauuauuaauauagucuuaaagucauucuguugguuaagaaaauauuuccugaacaccuguuugcugaauuuuaaagacuguccauuuaauuugcuuagaccuuagauaacaaguuaggcuaaaaguacuauauccaucaacucugaaaguucuguauguuuauguauggggaccaguuaaccaauguauuuauuuuugauguuuuagauauuggcaaaacacuugaaugaugguaaaaucaaucagcuuccucuuuuccuuggagagccugcuaugguaaguauuagguauuuuccaggcuaauauucuuguauuuauggaugucgucagcacuucucuaaaauuaaauuaauuuuggcuugugguuugcucaagaaaaauacuucugaaacauugcugugcugucucagcuucagccaccaaucagcugauguuugccaagcugucacuccuuaaauguguuuuuuaaaggccugaugauuuagcugcccugucccuaagcaaaauuuguauuuguuuuuuacauguauuugugcuguagaacggacauauauuugugccuuguuaaaugcaacaguuaggccgggugcgguggcucaugccuauaauccuagcacuuugggaggccaaggcgggcagaucacaaggucaagaguucaauaccagucuggucaauauguugaaaccccgucucuacuaaaaaugcaaaaauuagcugggugcgguggcgggcacccaccuacuccugagucccagcuacucaggaggcugaggcgaggaaaauggcuugaacccaggaggcagagguugcagugagcugagauccugccacugcacuccagccugggcaacagagcaagacuccgucugaaaauaaaagcaacagucaaaugugaguaauaagauugaguauuggaugaaaagaggaucauuaauuguuuaaggccaucuauccauuuuuuuauauuuuaugaagauauuucggugacuaauuuggacuacaauagguauuugacauuuauuccuucuaacagucaggcgaccuagaaucaugcucauguucugugacuuuagacuccgugcucuguggacauccauuuuuaccaucaaaaaauaagaugauugaacuaguuuaauguucuuuccaccuugagucucugugaugcuucugaccauuggcgguuugccaagggcagcaguuuucugaccucuuuucccuaaaaccugugggagaggccuuggauuugugucguaagaagcaacagacuuuugaaggugaaagagcagaugagaaagugcaggggcugugcucacacaagaaagagccgugauuucuuuuauugccuuggaaaagcucauuugcaaauguucacacucaguucccuuccuuggaggaaggugaaaacaagaaagacuggaauuugaugaggcuccaguaccaccugggcagcucugcuuuccccacagccucucuggcucccuggucuguccuguggguguaggagaagagcucuccccagcagagucccacccagggcuucagaggacuugauggaugcacucuuuccuucuauucagcaacaccaggcacgucucucugcugcggauacuaacaaaauauuuucucuguuuaauuucugaaaggaauuucucugggauuuccugaaccaucaggaggguccccgcauaagagaucauuuaagccacggggagaucaacuuacaugaauuuucaaaagaaacaacuaaucaguugcuugcauuuucucuuguacugcuacucagauucguugaugacugucugcua

SEQ ID NO: 18203 - RNA, 13476 nt, Homo sapiens
guugucauucauaaaauuuauuuuggaaaaauauuuuaaaaaggaauuucuucauuaacaaaacaguaaaaaacucaaauaacauuugcacaauauuccauaaauacauuuauauacaaaaaaauauagucacauagacccgaagugccuuuguacauauuuaccaaaauuuaaauuauaaaaaacgaacaucacaaaauacucaagcuuuacagauaucaugaaaaauauuuuuacaaauccaaaaaauaacacacaucuuuuccaucuagaaaaagcacaucuucguaucaaaaaggacaauaaaggcaguguuuguguuucuaauucaagaaaagacuggcucauaagaauccaaaauauacacucaggcagugcaugcuucuuaugcguaauucaguucacccauuuaaauauauauucucuuaagagcaacuguccauagugcaacggcgacgucacggaaggcagugccgcaggcggccgggccgcgacaggcugucggcaggcgucgaggaccucaggaggagaaccugcucggucugaacucgguuucucagcagcaguccacgaggccucccuccucuucagcagcauucguuggggcauauauccuuggaauuuuacuuauuuuaagagaaacgggagucuugccaucucacuuccauuuuacaccuggggggccacaagacaaaugggaaguuagccugagaccgauucccgugcuccagcuucaggugcucccaugccgaggaggagggagcggcugcugccugcacugaccucaguugcuaugacgcacucauccuucuccucggauaugacguacaccgacugguacuuggugucuuuugaaguugaacagcccgaguccggccuuuuucuuucagaugcuucuccacuaaaaggaaaauagagaaaauccacaaugaaugcaugagaacauuugggaagagaaacggagcagugguuccaggaagacaccccccagguacccccuccugaugcccggcccgcagcacgcacccccugaguguggucgggguccccuucuccuccccugaggagcccuggggcuggcacuuggugucacgcuugcugugcgcgucccugacggcggugucgucacccuugagguccugcacgagguuauaguccaccgcuggguagcgggccuugaagccauucuugucggcgcugugguccccguggaaguccgccuucuuguugguguucuugaucugcguggccccgaugaugcugacugagauguccuucucacgcuggcaguuggccagguuguucauggucuccgucuccccccggcaggggucggcugggggccggugcuucugcagccucagccggacgcagaccaccacagcggcacagcccagcagcagcaugaggacaaggaugaccccggcgcacacggccacccaggggaauggcccgcccuggcccucuagcuucucagugagguccaccaccgcugggcccgggggcagcucggggagcaggaacuggcaguugggacccccguagccucgggcacacucgcacacauagcgguggccccucucguggcagguggccccauuguggcagggugcgugcucgcaccugcugacgggggcacugcaguuccugcccguguagccaggcgggcaggugcaggagaagucguucacgccaucccggcaggugcccccguuggcgcacggggaggaggcgcagucguccacguugucgucacagugccuccccgagaagccggccuggcagcggcacagguaggcaucaccgagguccacacacuuggcaccuggaacacagggacaugaacaucacgugucuccucguagguuuguucaccaaaaagucacucugaagcaucuaucugucugacacuguagaaaccagacaaaccaaagacagucuguggccugaaugaguccacagcgcaaggugacaugguuuaggaccucaaauacgagagguguccaggucuagcucuacaagucagaaaccacacggccagcaucuggacaggcgcugugcagaacacucugguggcugcauuagucgccacaacagccgggcaagagcaugugccacucgacccagguuucagauggggaaacugaggcuuaacgaggguguccuugcccacaguuacacagcaagugagaggagcaggcacugacaacaggggagggagggaggggaaggaugaccauuccggaaugcuccggcacaucuggggcccagcucuccuugcugugugucuccuuugggcagccagccccucgcugcuagcaggaggcucucuguccucacucagggacacccccaacuacugugcuggguggccacacagcugggccauccucccaagcuggaguggccggcaccugugggcaucacuuacugaaccucaggcggccgcaggugcccgaagcaccuuguggcccugagcaagucauucacugcuuggucuagguuuccacagagaacuucauaacaaaugcccuggccucucucauuccccaggccuuuccagacucaaagauagaguuuccaucgagaauuccuggcggucuggauaaaagugauucauaaacucgaggucacucacaaaugcuuguuuuuaaugccaccucaguauugaccgcucgcccgagucucugagcaaucaccagcugcccccuuaccauuagaacagggugaagagcugcaguagucaauuuucuucucacaguugaagccggaguagcccacggggcagcggcagcuguacccuccaucggggcugucugagcaccgacccccguuaaagcaagggccguccgcacaggucauggcacucaauucacagauuuugccguagaagccgggugggcagguacaggaguagcuguucucgagauccuacacgauggagaggucagaaaaggcuuuccaaaguugcuccaaggagcccacacacuccauucaacaccagggcaccccagcuuccgggugagaugccauggagccuccgacucaccgugcagcucccuccguucuuacaagggcuggggucacacucgucaauccccagcucgcagguggcaccuguguacccaggccggcaagagcaaguguagcuccccuggcccguguuggugcagguggcuccauucuugcagggcuuauggugugugcaguaguucaggucugugaaggguggggacaggaaaaguaggagauaggaagcucgacaucaaaugcaggaagacuuuauuuuuccagugaucaaacagccagggaaguccagggcugcucuggagggagcaggcugccucagggagagaaggcuuacccugguugcagaaaaggcccccccagccuuccuggcaguugcacugccagggcugcuggcaggugccauggagacagccuggauagcggauacacucgucacaguaccggcccugccagcccacucugcaccuuggagaaaagcagaagacucagauggacguugacuguugcuggcuuugcaguggacauucucacccuagaaaccaucuucccgcagcaccagugagccucugguucuccagauuagcagaacacugggucaccuugggagcugcagccugggccugggccccaccagagguucuggcuucuuggguguuagggcagcaccagugucagcaucucaaaaaucacucccugagugauucuaggaugaggcaacauuugagaaccauugaacuauacuaucauuuccugugccaacucuuuuuaaacuacuaucuguaaauucucauagccguuaaggggcuuagacgaaugacaacuccaugaccuuacaugcugccaaacauugauuaaguagaaacaugagaaaacggcccccuguucaaucaaucuuacuggaguuuuucgaaugaucaccuagggcuguuuuuacaaauacaccagcugugaaaagauaacaagaaaaggcaacaaaacaaaacaccaccuugugcagacuuacuugcauuccccugguuugucacaaaauccaugcugcucaucacauccaggcaggcagaucgcuacaagcaaaggaaaaacagggucaagccccacgccaaguacgucccaacagggcugccgcccuuggggccaggacacaacucgccggcuucagucagcaaaucccagcugaguuaaucuucccagguuguggaggacugaccccccugccuaguagccugggacuugacucagcccuggggaugagcauucuucuuaacacaggggcucaaggacaaaagggcucucggaagcccccacccccacccuauccccuuuucuucuaagagagggucagaagucuucccccuccuccucccccacuucccaauucugugcacaaagcuccaccucuuaauaucccagaaagugugugugcagauaagaguggacagcugguaugcagggugccagggcaggacagcugcuccauugucuguccuccacggcagcugccccagcgcaacaaugccggccucccccgcgcccccggccccaccuccucacacacaccccucgcguguacacacacacacacacacacacacgcacacgcaccccuuccgccaaugggagccggcgggugucccugcgccuauccccggagagaucuaaucuauggcacgcgcgagcugggggcggggagagacuucaguguuugaagaaaaaaguuuaaguuucuggcuacccuguggugaagagaggcagggaggaagggugggaggcagcagacuggccagaggcucccgcagggcagggaguagacagugggcuugaggcuuggagcuggcucuugcugccugguuaugaaacucauuaacaagcagcuccacaaguuguuuuuuguuuuuuuguuuuuccccagaaccaguucaggccaaggcaaagcuuagaaggagcucaguaaguuccggagggaauuugggaagcuaaggagcaaggacaucaaggcacucagugaaugggaagacccacccucaaccccaggcacuacccagcuccugccagagguucugggccucccagagccccucuccaagguuguccaguuccaaggaaggagaaugacaguucccuggaguuucugggcagcuccaggaccuacccaauccccagcuguagagaaauccgguaccaaugggcugggacggccaggcgugcaggcgaggccucagucagcuggagagagggcuccugagguccccaugagccagaaccaggagccagcacggccccaacccugcccuagucaccugccugccaugacauugacacaucaauaccuaauaagaggcagguagagccucugucacuauugggaagacauugcuucuccagacaaggugcugccugagcauucaagccagacggggcugugcaccccucgcccacacaggccuuggagaccuggccucagcagcccacaggagugaaagccugcucucuggccagcauagacagugcgugucacagggaguauccggaaaggcguuugcuccagagaggucaagcacaccagcuccagagagaaaauggaacguuucccagugugaugcuguuccagcacugggaacucggguugaaauggugccccugacacacaagcucucucuguguuccucccuuccuuccuccucucccucucuaauacacacacccuggggguagcacuggcuuuacuuccugaccccuggcccugucucuaaaauccucccugauuaagaaaggcaguuccgauaguggauaaacacagccugggauguuaaaaugucugcguugaccccaacccccccacugacgagcugugacuuauagcaauccacuucuguccucugggccucaguuuccccaccagaacaucucuacagucccaagccccccguggcucaggaagccccgucccugcgcgcgguccguguucguggacgagugagccagcggugccuucccagagacucacgcucugugcaguagggcccuuuccagccaggguugcacacuuucuccccacgcuccccacaggugaaguggccgaaggcaucgucccggggacggcagaaaacggagcagcccucuccguaguaguguucgucacacacgaagcgguaggaguacuugagguccgugcggccgcugcugugcagguccugggaccacuccucgcccaccgucaggugccucuggguggccaggcggcugaugagucuuucuggguuuucuacggggagaagaugcuccugguugguucugaacgagaacccugugacucgggacagagcgggggugggccgagacauucagcacgggaaggaggcccaagcugcuccacccugaacuuucuggggcacgugcagaaugaaagcuguccggguuuggcugggggaugggugggcaaaguccaaugcuauuaacuggggaaagcaguuuugggguuuggguuuuguuuuuaccuguugcgaggucaucaggagaaucuguguggagagcuucaauaaucagagagaaggugcccugggagagaggggagaagacguuagacaacccagaaagguaacgaaaagaaaacggcaaaaagcagucauuccuaacagccaggucagcaacagaggccugaaggcugcaggucuggggcagcgugucuggagagggucuccacgcaccuccugccugcucucaccuucccuaaggaaauggaagaacuuuuuaaagagugguuuccugacguguuuuuucagccuguacuacaggauauuacguuguuuuuuuaauuagagagagagagagaaugcaggcaggaugggguggaagaggcccgagggcccuugucauuuuucuugggggaugggcacgcuccgggugguagcggucgcgcugcgcggguaaucgcgccaccaacgcgucuaggagucgggaaaccagaaccuucccacgugaaggggcgccucugacuggagaccuggcacagaggccggauacggaaaucucccgggcgcgcucggccucuccuccucgccccagcgcgguccccuccugcaggccgcggggccccggggcgagguguccgcgcugcugggcuggaguccuggggccgccgcuaggcagaucgcagcgcccaccugcgccucgcgggguccccgaggucccgccaccgagcgcccaaggcgggaucccagcgcguccugcagcccgcccagcuucagggccggcccggcgcgcgcaggugcggcacucaccggccaggugaagccgaaggggaagcggaugggguugcugaacgcggagucggcgcccccgccgucgggcagacugaaggagucgacgcccagcacgggggugacggcgcugccguaggugcagggcggcucgggggacacgcuggccugguagugcuugaggcacacgcggaagaagguccggcaggcgcacggcgguggccccgcgcccccgcggcagcaguugcgguuccccagcagccccuucuuguugacgaacuccugcagcuucaguucgaacaccccagagcuccagaccugcacgggggagggcgggggcgugaggacgcgggucccgcccgagcuagggggcgugaggccuggguggggggugugcggagagccuggaagggcucaggggccgagcgcgcucgcugcacggccggcgcuggggucgucgcccccgggauucaucuuccgggccguggcuggcgcggcccgugccgcuguccgccccuccccgcgcgcuccugccccgcgccccggcuacccgugagaccccgcggggccgcggcgcccccaccugcccgccuaccugacacagcaaggccgagagcaccgccagggccagcgcgcaccgacugcccaugcugcuucgcuccacgcgcgagccuggggggcccccacuucucuccuuagaacagcggcggacgcgcgggggaucgaugggccacggggagcgugggcagaaaagcgcccuugccucgccccagaccgcaggacccaggacuucuuucuuuaaaagccggucuccgccucuucccaaggccgcgguucuuuauauccgcccugcgaggucccgcggcagccccagggaugcccgaggaaaggcagcucucgggggacagcgcggcggcggcgacuuucguuuuccuccuuccucccagcccccgaggaggugagggucgccggcuuccugguuuugucuugagcuucuucgcaggagagggagggggagaaagagaaagagagagaguccagagauugagcuuaauucccaagagagcugcagagcuuccucccgagccgauuagaaagccgcggucuggaaaucccacgggcaaggcgauaauccggggccagcggcgcgcgcugaggggacggucggcggcggcgggugugcgcggcggccccugcggaucgcggcccggugucacucggcggcggcggucguuccgggagcacuccgggcuccgaucuccggugucacagcaaagauccgcgucuuuccgaugaauccagccaaugccauccaguacacacgcgcaggaccggaggggccgggccgugggaggaggcucugcgccgcggcugcccggguuccccugcgcucugcccucggccgggucgggucuccgcgggugcgcgcagaggaucuggcucucgccggcgccugccgcccuuauauucagccggccgcccgcauggcuaaugagaugcaaaucagcagccccccaaucuggcgagagcugucacaaaggagccacuuuuccaaacccuccucucaauggaucgccaaauggucagugagcuguaaaaugugcaacccuccuccccgcccccacccuuccccgcccccccaguccuccccugcccccgcccccagcccccccuuccucccucaccacacaaaacgcacucauuuacauuccugcaaaauguucaccgcaagaaucccccugcuucuggagcuggugccgccgccccguccccuccgcacgcccucccgggccacagacgcccagagacccucggccacacgcggggggcggcgcugcgggccccacuugagcggcgggacgcggccuccgaaacuccgggccgcggcggcagccgaggggucuccuugcgccgacagcgucccgggggcuuggggagggcggcugcgagcaggaggacgaaguucgaggcccgagcucuuggcggggccgccccuucuucggggcaggcgcuuccuaaggaggagucucuugggggcggaggcggggguggcgauucggggagcaucguaggaaaggggcgggcggagcggugggccgagggcugccagagcgaagcggcaguuucgggaaguuuggggagguccgaggcggggacaccuccuggcccaggacggcgacugagccucggggagugcagagccgacgcgcgggcggggccgggacgcccccugggacacccgcauccccgcgccuucgguguccucucgugguccgcggccacugggaguaggggcccgggggccggacagcauauccccggagccaggagaaccuggccuucaacuccccccacagacacgcgcccucccccacaggauccucggccgccgccaccuuccccgggucucggccccucucucccggguaucccccucggccucccuccgccugguaagaagugaguuuggugugugucguucgcguggcugucauuaaggcagccuguuauugugcgaggcugaaucaguggcucuuugugcgcucagcuguaugguaaugcagacagcaccugcuccccgcacaaugcggagagaaagagcuccccuccgcgcgcgccgcggccucugcaacaauguccggcgcauguucuaaagccccuccagccccggcccccaacccacaaccuuuacacaaccgucaccuuauuagguuuuuacacguccaucagacacuagaacuuuuguuuucauuuuuuaaagggaaaugaguuuauugggagggccgagaacacacguaugacacaaugaauuaucuaaauugcccuccuaggcacgauggagaaguaaguuggggcagagacuccuacucuggcaccuagcuuugcacuucucccucucuuuaccaucccgcccguggaucccugcccacccccaacaccuccguagcuucauuaggguuccaggugaguguuggagugcccccuuugauuguagcucagccccaaggaagcagccuggccacaguguccucacuguagguguguuagagcugccuuauuggugagaacagggcaccgucaagguagaacgagacuuucaucccggcaaaugucuugaucaaagugucuaagcagagggaaagucuucaaacaccaaggacaaccacugcagccagaaaucugaaggucacguggugaagucguccagggcaggcccuccggcugcuacgcagcuggaauugcuacucugcggcuccucuucaagugacccagccuguguccugcuaccuuguuucccaaauaccuguaaaguuuuaggaucaacagagauguccacuuuagguuuuccacuguugccucauggaauagcgaagaguuaaccacaagaaacaagcauaugauguuuagugccaggugagaaaggcaggcugggaucaccgugaacccccuacuguuugguucagagcaaauggaggcuucagaagaugcugccacccccaugaugguguccuuuuuggacucuauagggacuugcugucgccacagggaggggccagcucaaauccuaauuuaaucuugccaccuagugucaggauccuuuuuucucuagguugauguuuccuccaaaagcugacuucggagcauucugcuucccuaaggcacaggagcuguucccugugcugggggcugggggugggggugaggguaggugaaaggguuucaggagcagaagaaauguaaaaaaagaagagaaugcgaggucagaauccagaauccucugccugcaacacugaguguagauuucaguaagaaaugaaauaucaggaaccuuuuaauuagaaaauggaaguggaaaacaggcucauuugaaugccuguuuagaaaacuggaaauaaaaaguuccacgcgcaagggcuuaaaccuuggggggaaaaagacuugccccaaaucucuaacaaaccccccucaguaucaaguauuuguuaaauugacauggcacagauuucucgauuacggcggcaaagcggaacugaaaggcaucguaaaauccaucagaauccugcccaaagcguucauucuuuuccaacuuaauuuaugccacgcgauucuguauuggggaaaucaagcagaaagcccuuuucuucuucucccucuccuuccuccuccuccuguucuccuuuuucuuuuccuccuccuccuccucuuucuccuacuccaccuccuuccucuucuuccuucuccuccuucuucuccuucuuccucucccccauuucucuccccccacccccaaguugguuccucucucccucucucuuuaaaaagcugugcuaacggggagacuguuuaacuucagcguuucuauaggagccuguuguaguuuaacuccugcgcaccaguagcugggaugaacaaaggagagacucgagguccaacuauucauccuuucuuugcacuuuaauuuucauugauugggaagacaaggggagcccuuagggauucgagcuggaggggacgacacgccuuuagacgccaucagcccccuagccagccaucugcuccgaaccaaauggcguuuuuucacucccuaacugcaugucucuauacucccacaacuaagcacucugaaccccacaaacgcaggagggagcuuaagccaggguauguuaaauaggcuugccucaguguuggccccggcugccggagucccuccuccccacacuauaaauccucaccuugcucauuaggaaaaaacaggaaacuuucuuuuaaauacuuuuuuaugucucaggaaauuuacuguacaaagugaggcucauuagggcuuagaaggcacccaauacaucagacacagaaguggaaggaggaauuugcugccugguggugguguuuuuuguuuuguuuuguuuucugggcagcacaaccccacaggcugaguaaccccagugucuaggguaagcucaggcuguauaaugaucagagcugcagccacagcaaccacauguggaguucucuguuugcuggagacacugaguaucuccccaccauuuuaugaggccaccugggaauaaaagcuuauggccaucaucuuaucaaauuccagugcggccauccucagcagugugugcaugaccuaauaccauggucacucaauccuauuccaaccccccuuuccaaagaaagguucuauucuccagguucgugugugguggugacuguggugggggcaggagggccugggcagauugcaauaaacaaugcccagaauaggcucagacucuaggccagccacagguucaguuuucuguguaaacaagucuggagacuugagugggguuuguguuuucucagaccaacugaauacuguauacccaacagagagguucucuuauucguaagaagaauuaggguccuuguucagaauaacaagauaaaaaacuuccaggcagcaaaucugguguugaucaaacaugccagcuuacuugaaauaaagaagaagaagaaggggacguagaccaugcuuauuaauuaguauugguaucacaucugcaccaaccacccucugcccauucuccuuccgucaguuuuggaaucugaaagcaguuaacguagcagaggaauggaccugcuggcugccacacgggaaguucucagaggcguccguggcgaagccucuguguccuggagcuaucaugguuacuuccuugcugcuuacuucuuaaagcugucuuuggacacgugaacauagaccuuaccccccaacacacacacucacugggccauguccccugcccagccacgcccacccaagugggugcacagauguguucacacucgguugccgcgcguggacuuacaagcccacgaagccaucguucgucacagccuggaaaagggagggggcaucgaucugguuuauguuuggaccucgaggcuccaccagcgcuggcgcaggcaggaaggaggugagcgccgcccgcgugcacacaaggcgcgcggcccccaggcagccgcgcuuccacagcgggcaggagcgcgacccccggcgcgggcagcucugcgcgaaggugggcgacggugggggcacaagaacagcagccgggggcgaaggaaucagccccgcagcggcuccuaagccuccccgcuggccgcggcugcgccgcuggagacccggcgagugacuuccccggug

SEQ ID NO: 18204 - RNA, 13476 nt, Homo sapiens
caccggggaagucacucgccgggucuccagcggcgcagccgcggccagcggggaggcuuaggagccgcugcggggcugauuccuucgcccccggcugcuguucuugugcccccaccgucgcccaccuucgcgcagagcugcccgcgccgggggucgcgcuccugcccgcuguggaagcgcggcugccugggggccgcgcgccuugugugcacgcgggcggcgcucaccuccuuccugccugcgccagcgcugguggagccucgagguccaaacauaaaccagaucgaugcccccucccuuuuccaggcugugacgaacgauggcuucgugggcuuguaaguccacgcgcggcaaccgagugugaacacaucugugcacccacuugggugggcguggcugggcaggggacauggcccagugaguguguguguugggggguaaggucuauguucacguguccaaagacagcuuuaagaaguaagcagcaaggaaguaaccaugauagcuccaggacacagaggcuucgccacggacgccucugagaacuucccguguggcagccagcagguccauuccucugcuacguuaacugcuuucagauuccaaaacugacggaaggagaaugggcagagggugguuggugcagaugugauaccaauacuaauuaauaagcauggucuacguccccuucuucuucuucuuuauuucaaguaagcuggcauguuugaucaacaccagauuugcugccuggaaguuuuuuaucuuguuauucugaacaaggacccuaauucuucuuacgaauaagagaaccucucuguuggguauacaguauucaguuggucugagaaaacacaaaccccacucaagucuccagacuuguuuacacagaaaacugaaccuguggcuggccuagagucugagccuauucugggcauuguuuauugcaaucugcccaggcccuccugcccccaccacagucaccaccacacacgaaccuggagaauagaaccuuucuuuggaaagggggguuggaauaggauugagugaccaugguauuaggucaugcacacacugcugaggauggccgcacuggaauuugauaagaugauggccauaagcuuuuauucccagguggccucauaaaaugguggggagauacucagugucuccagcaaacagagaacuccacaugugguugcuguggcugcagcucugaucauuauacagccugagcuuacccuagacacugggguuacucagccugugggguugugcugcccagaaaacaaaacaaaacaaaaaacaccaccaccaggcagcaaauuccuccuuccacuucugugucugauguauugggugccuucuaagcccuaaugagccucacuuuguacaguaaauuuccugagacauaaaaaaguauuuaaaagaaaguuuccuguuuuuuccuaaugagcaaggugaggauuuauaguguggggaggagggacuccggcagccggggccaacacugaggcaagccuauuuaacauacccuggcuuaagcucccuccugcguuugugggguucagagugcuuaguugugggaguauagagacaugcaguuagggagugaaaaaacgccauuugguucggagcagauggcuggcuagggggcugauggcgucuaaaggcgugucguccccuccagcucgaaucccuaagggcuccccuugucuucccaaucaaugaaaauuaaagugcaaagaaaggaugaauaguuggaccucgagucucuccuuuguucaucccagcuacuggugcgcaggaguuaaacuacaacaggcuccuauagaaacgcugaaguuaaacagucuccccguuagcacagcuuuuuaaagagagagggagagaggaaccaacuuggggguggggggagagaaaugggggagaggaagaaggagaagaaggaggagaaggaagaagaggaaggagguggaguaggagaaagaggaggaggaggaggaaaagaaaaaggagaacaggaggaggaggaaggagagggagaagaagaaaagggcuuucugcuugauuuccccaauacagaaucgcguggcauaaauuaaguuggaaaagaaugaacgcuuugggcaggauucugauggauuuuacgaugccuuucaguuccgcuuugccgccguaaucgagaaaucugugccaugucaauuuaacaaauacuugauacugagggggguuuguuagagauuuggggcaagucuuuuuccccccaagguuuaagcccuugcgcguggaacuuuuuauuuccaguuuucuaaacaggcauucaaaugagccuguuuuccacuuccauuuucuaauuaaaagguuccugauauuucauuucuuacugaaaucuacacucaguguugcaggcagaggauucuggauucugaccucgcauucucuucuuuuuuuacauuucuucugcuccugaaacccuuucaccuacccucacccccacccccagcccccagcacagggaacagcuccugugccuuagggaagcagaaugcuccgaagucagcuuuuggaggaaacaucaaccuagagaaaaaaggauccugacacuagguggcaagauuaaauuaggauuugagcuggccccucccuguggcgacagcaagucccuauagaguccaaaaaggacaccaucauggggguggcagcaucuucugaagccuccauuugcucugaaccaaacaguaggggguucacggugaucccagccugccuuucucaccuggcacuaaacaucauaugcuuguuucuugugguuaacucuucgcuauuccaugaggcaacaguggaaaaccuaaaguggacaucucuguugauccuaaaacuuuacagguauuugggaaacaagguagcaggacacaggcugggucacuugaagaggagccgcagaguagcaauuccagcugcguagcagccggagggccugcccuggacgacuucaccacgugaccuucagauuucuggcugcagugguuguccuugguguuugaagacuuucccucugcuuagacacuuugaucaagacauuugccgggaugaaagucucguucuaccuugacggugcccuguucucaccaauaaggcagcucuaacacaccuacagugaggacacuguggccaggcugcuuccuuggggcugagcuacaaucaaagggggcacuccaacacucaccuggaacccuaaugaagcuacggagguguugggggugggcagggauccacgggcgggaugguaaagagagggagaagugcaaagcuaggugccagaguaggagucucugccccaacuuacuucuccaucgugccuaggagggcaauuuagauaauucauugugucauacguguguucucggcccucccaauaaacucauuucccuuuaaaaaaugaaaacaaaaguucuagugucugauggacguguaaaaaccuaauaaggugacgguuguguaaagguuguggguugggggccggggcuggaggggcuuuagaacaugcgccggacauuguugcagaggccgcggcgcgcgcggaggggagcucuuucucuccgcauugugcggggagcaggugcugucugcauuaccauacagcugagcgcacaaagagccacugauucagccucgcacaauaacaggcugccuuaaugacagccacgcgaacgacacacaccaaacucacuucuuaccaggcggagggaggccgagggggauacccgggagagaggggccgagacccggggaagguggcggcggccgaggauccugugggggagggcgcgugucuguggggggaguugaaggccagguucuccuggcuccggggauaugcuguccggcccccgggccccuacucccaguggccgcggaccacgagaggacaccgaaggcgcggggaugcgggugucccagggggcgucccggccccgcccgcgcgucggcucugcacuccccgaggcucagucgccguccugggccaggagguguccccgccucggaccuccccaaacuucccgaaacugccgcuucgcucuggcagcccucggcccaccgcuccgcccgccccuuuccuacgaugcuccccgaaucgccacccccgccuccgcccccaagagacuccuccuuaggaagcgccugccccgaagaaggggcggccccgccaagagcucgggccucgaacuucguccuccugcucgcagccgcccuccccaagcccccgggacgcugucggcgcaaggagaccccucggcugccgccgcggcccggaguuucggaggccgcgucccgccgcucaaguggggcccgcagcgccgccccccgcguguggccgagggucucugggcgucuguggcccgggagggcgugcggaggggacggggcggcggcaccagcuccagaagcagggggauucuugcggugaacauuuugcaggaauguaaaugagugcguuuuguguggugagggaggaagggggggcugggggcgggggcaggggaggacugggggggcggggaagggugggggcggggaggaggguugcacauuuuacagcucacugaccauuuggcgauccauugagaggaggguuuggaaaaguggcuccuuugugacagcucucgccagauuggggggcugcugauuugcaucucauuagccaugcgggcggccggcugaauauaagggcggcaggcgccggcgagagccagauccucugcgcgcacccgcggagacccgacccggccgagggcagagcgcaggggaacccgggcagccgcggcgcagagccuccucccacggcccggccccuccgguccugcgcguguguacuggauggcauuggcuggauucaucggaaagacgcggaucuuugcugugacaccggagaucggagcccggagugcucccggaacgaccgccgccgccgagugacaccgggccgcgauccgcaggggccgccgcgcacacccgccgccgccgaccguccccucagcgcgcgccgcuggccccggauuaucgccuugcccgugggauuuccagaccgcggcuuucuaaucggcucgggaggaagcucugcagcucucuugggaauuaagcucaaucucuggacucucucucuuucucuuucucccccucccucuccugcgaagaagcucaagacaaaaccaggaagccggcgacccucaccuccucgggggcugggaggaaggaggaaaacgaaagucgccgccgccgcgcugucccccgagagcugccuuuccucgggcaucccuggggcugccgcgggaccucgcagggcggauauaaagaaccgcggccuugggaagaggcggagaccggcuuuuaaagaaagaaguccuggguccugcggucuggggcgaggcaagggcgcuuuucugcccacgcuccccguggcccaucgaucccccgcgcguccgccgcuguucuaaggagagaagugggggccccccaggcucgcgcguggagcgaagcagcaugggcagucggugcgcgcuggcccuggcggugcucucggccuugcugugucagguaggcgggcaggugggggcgccgcggccccgcggggucucacggguagccggggcgcggggcaggagcgcgcggggaggggcggacagcggcacgggccgcgccagccacggcccggaagaugaaucccgggggcgacgaccccagcgccggccgugcagcgagcgcgcucggccccugagcccuuccaggcucuccgcacaccccccacccaggccucacgcccccuagcucgggcgggacccgcguccucacgcccccgcccucccccgugcaggucuggagcucugggguguucgaacugaagcugcaggaguucgucaacaagaaggggcugcuggggaaccgcaacugcugccgcgggggcgcggggccaccgccgugcgccugccggaccuucuuccgcgugugccucaagcacuaccaggccagcgugucccccgagccgcccugcaccuacggcagcgccgucacccccgugcugggcgucgacuccuucagucugcccgacggcgggggcgccgacuccgcguucagcaaccccauccgcuuccccuucggcuucaccuggccggugagugccgcaccugcgcgcgccgggccggcccugaagcugggcgggcugcaggacgcgcugggaucccgccuugggcgcucgguggcgggaccucggggaccccgcgaggcgcaggugggcgcugcgaucugccuagcggcggccccaggacuccagcccagcagcgcggacaccucgccccggggccccgcggccugcaggaggggaccgcgcuggggcgaggaggagaggccgagcgcgcccgggagauuuccguauccggccucugugccaggucuccagucagaggcgccccuucacgugggaagguucugguuucccgacuccuagacgcguugguggcgcgauuacccgcgcagcgcgaccgcuaccacccggagcgugcccaucccccaagaaaaaugacaagggcccucgggccucuuccaccccauccugccugcauucucucucucucucuaauuaaaaaaacaacguaauauccuguaguacaggcugaaaaaacacgucaggaaaccacucuuuaaaaaguucuuccauuuccuuagggaaggugagagcaggcaggaggugcguggagacccucuccagacacgcugccccagaccugcagccuucaggccucuguugcugaccuggcuguuaggaaugacugcuuuuugccguuuucuuuucguuaccuuucuggguugucuaacgucuucuccccucucucccagggcaccuucucucugauuauugaagcucuccacacagauucuccugaugaccucgcaacagguaaaaacaaaacccaaaccccaaaacugcuuuccccaguuaauagcauuggacuuugcccacccaucccccagccaaacccggacagcuuucauucugcacgugccccagaaaguucaggguggagcagcuugggccuccuucccgugcugaaugucucggcccacccccgcucugucccgagucacaggguucucguucagaaccaaccaggagcaucuucuccccguagaaaacccagaaagacucaucagccgccuggccacccagaggcaccugacggugggcgaggaguggucccaggaccugcacagcagcggccgcacggaccucaaguacuccuaccgcuucgugugugacgaacacuacuacggagagggcugcuccguuuucugccguccccgggacgaugccuucggccacuucaccuguggggagcguggggagaaagugugcaacccuggcuggaaagggcccuacugcacagagcgugagucucugggaaggcaccgcuggcucacucguccacgaacacggaccgcgcgcagggacggggcuuccugagccacggggggcuugggacuguagagauguucugguggggaaacugaggcccagaggacagaaguggauugcuauaagucacagcucgucaguggggggguuggggucaacgcagacauuuuaacaucccaggcuguguuuauccacuaucggaacugccuuucuuaaucagggaggauuuuagagacagggccaggggucaggaaguaaagccagugcuacccccaggguguguguauuagagagggagaggaggaaggaagggaggaacacagagagagcuugugugucaggggcaccauuucaacccgaguucccagugcuggaacagcaucacacugggaaacguuccauuuucucucuggagcuggugugcuugaccucucuggagcaaacgccuuuccggauacucccugugacacgcacugucuaugcuggccagagagcaggcuuucacuccugugggcugcugaggccaggucuccaaggccugugugggcgaggggugcacagccccgucuggcuugaaugcucaggcagcaccuugucuggagaagcaaugucuucccaauagugacagaggcucuaccugccucuuauuagguauugaugugucaaugucauggcaggcaggugacuagggcaggguuggggccgugcuggcuccugguucuggcucauggggaccucaggagcccucucuccagcugacugaggccucgccugcacgccuggccgucccagcccauugguaccggauuucucuacagcuggggauuggguagguccuggagcugcccagaaacuccagggaacugucauucuccuuccuuggaacuggacaaccuuggagaggggcucugggaggcccagaaccucuggcaggagcuggguagugccugggguugagggugggucuucccauucacugagugccuugauguccuugcuccuuagcuucccaaauucccuccggaacuuacugagcuccuucuaagcuuugccuuggccugaacugguucuggggaaaaacaaaaaaacaaaaaacaacuuguggagcugcuuguuaaugaguuucauaaccaggcagcaagagccagcuccaagccucaagcccacugucuacucccugcccugcgggagccucuggccagucugcugccucccacccuuccucccugccucucuucaccacaggguagccagaaacuuaaacuuuuuucuucaaacacugaagucucuccccgcccccagcucgcgcgugccauagauuagaucucuccggggauaggcgcagggacacccgccggcucccauuggcggaaggggugcgugugcguguguguguguguguguguguguacacgcgaggggugugugugaggagguggggccgggggcgcgggggaggccggcauuguugcgcuggggcagcugccguggaggacagacaauggagcagcuguccugcccuggcacccugcauaccagcuguccacucuuaucugcacacacacuuucugggauauuaagagguggagcuuugugcacagaauugggaagugggggaggaggagggggaagacuucugacccucucuuagaagaaaaggggauagggugggggugggggcuuccgagagcccuuuuguccuugagccccuguguuaagaagaaugcucauccccagggcugagucaagucccaggcuacuaggcaggggggucaguccuccacaaccugggaagauuaacucagcugggauuugcugacugaagccggcgaguuguguccuggccccaagggcggcagcccuguugggacguacuuggcguggggcuugacccuguuuuuccuuugcuuguagcgaucugccugccuggaugugaugagcagcauggauuuugugacaaaccaggggaaugcaaguaagucugcacaaggugguguuuuguuuuguugccuuuucuuguuaucuuuucacagcugguguauuuguaaaaacagcccuaggugaucauucgaaaaacuccaguaagauugauugaacagggggccguuuucucauguuucuacuuaaucaauguuuggcagcauguaaggucauggaguugucauucgucuaagccccuuaacggcuaugagaauuuacagauaguaguuuaaaaagaguuggcacaggaaaugauaguauaguucaaugguucucaaauguugccucauccuagaaucacucagggagugauuuuugagaugcugacacuggugcugcccuaacacccaagaagccagaaccucugguggggcccaggcccaggcugcagcucccaaggugacccaguguucugcuaaucuggagaaccagaggcucacuggugcugcgggaagaugguuucuagggugagaauguccacugcaaagccagcaacagucaacguccaucugagucuucugcuuuucuccaaggugcagagugggcuggcagggccgguacugugacgaguguauccgcuauccaggcugucuccauggcaccugccagcagcccuggcagugcaacugccaggaaggcugggggggccuuuucugcaaccaggguaagccuucucucccugaggcagccugcucccuccagagcagcccuggacuucccuggcuguuugaucacuggaaaaauaaagucuuccugcauuugaugucgagcuuccuaucuccuacuuuuccuguccccacccuucacagaccugaacuacugcacacaccauaagcccugcaagaauggagccaccugcaccaacacgggccaggggagcuacacuugcucuugccggccuggguacacaggugccaccugcgagcuggggauugacgagugugaccccagcccuuguaagaacggagggagcugcacggugagucggaggcuccauggcaucucacccggaagcuggggugcccugguguugaauggagugugugggcuccuuggagcaacuuuggaaagccuuuucugaccucuccaucguguaggaucucgagaacagcuacuccuguaccugcccacccggcuucuacggcaaaaucugugaauugagugccaugaccugugcggacggcccuugcuuuaacgggggucggugcucagacagccccgauggaggguacagcugccgcugccccgugggcuacuccggcuucaacugugagaagaaaauugacuacugcagcucuucacccuguucuaaugguaagggggcagcuggugauugcucagagacucgggcgagcggucaauacugagguggcauuaaaaacaagcauuugugagugaccucgaguuuaugaaucacuuuuauccagaccgccaggaauucucgauggaaacucuaucuuugagucuggaaaggccuggggaaugagagaggccagggcauuuguuaugaaguucucuguggaaaccuagaccaagcagugaaugacuugcucagggccacaaggugcuucgggcaccugcggccgccugagguucaguaagugaugcccacaggugccggccacuccagcuugggaggauggcccagcuguguggccacccagcacaguaguugggggugucccugagugaggacagagagccuccugcuagcagcgaggggcuggcugcccaaaggagacacacagcaaggagagcugggccccagaugugccggagcauuccggaauggucauccuuccccucccucccuccccuguugucagugccugcuccucucacuugcuguguaacugugggcaaggacacccucguuaagccucaguuuccccaucugaaaccugggucgaguggcacaugcucuugcccggcuguuguggcgacuaaugcagccaccagaguguucugcacagcgccuguccagaugcuggccgugugguuucugacuuguagagcuagaccuggacaccucucguauuugagguccuaaaccaugucaccuugcgcuguggacucauucaggccacagacugucuuugguuugucugguuucuacagugucagacagauagaugcuucagagugacuuuuuggugaacaaaccuacgaggagacacgugauguucaugucccuguguuccaggugccaaguguguggaccucggugaugccuaccugugccgcugccaggccggcuucucggggaggcacugugacgacaacguggacgacugcgccuccuccccgugcgccaacgggggcaccugccgggauggcgugaacgacuucuccugcaccugcccgccuggcuacacgggcaggaacugcagugcccccgucagcaggugcgagcacgcacccugccacaauggggccaccugccacgagaggggccaccgcuaugugugcgagugugcccgaggcuacgggggucccaacugccaguuccugcuccccgagcugcccccgggcccagcggugguggaccucacugagaagcuagagggccagggcgggccauuccccuggguggccgugugcgccggggucauccuuguccucaugcugcugcugggcugugccgcugugguggucugcguccggcugaggcugcagaagcaccggcccccagccgaccccugccggggggagacggagaccaugaacaaccuggccaacugccagcgugagaaggacaucucagucagcaucaucggggccacgcagaucaagaacaccaacaagaaggcggacuuccacggggaccacagcgccgacaagaauggcuucaaggcccgcuacccagcgguggacuauaaccucgugcaggaccucaagggugacgacaccgccgucagggacgcgcacagcaagcgugacaccaagugccagccccagggcuccucaggggaggagaaggggaccccgaccacacucagggggugcgugcugcgggccgggcaucaggaggggguaccuggggggugucuuccuggaaccacugcuccguuucucuucccaaauguucucaugcauucauuguggauuuucucuauuuuccuuuuaguggagaagcaucugaaagaaaaaggccggacucgggcuguucaacuucaaaagacaccaaguaccagucgguguacgucauauccgaggagaaggaugagugcgucauagcaacugaggucagugcaggcagcagccgcucccuccuccucggcaugggagcaccugaagcuggagcacgggaaucggucucaggcuaacuucccauuugucuuguggccccccagguguaaaauggaagugagauggcaagacucccguuucucuuaaaauaaguaaaauuccaaggauauaugccccaacgaaugcugcugaagaggagggaggccucguggacugcugcugagaaaccgaguucagaccgagcagguucuccuccugagguccucgacgccugccgacagccugucgcggcccggccgccugcggcacugccuuccgugacgucgccguugcacuauggacaguugcucuuaagagaauauauauuuaaaugggugaacugaauuacgcauaagaagcaugcacugccugaguguauauuuuggauucuuaugagccagucuuuucuugaauuagaaacacaaacacugccuuuauuguccuuuuugauacgaagaugugcuuuuucuagauggaaaagauguguguuauuuuuuggauuuguaaaaauauuuuucaugauaucuguaaagcuugaguauuuugugauguucguuuuuuauaauuuaaauuuugguaaauauguacaaaggcacuucgggucuaugugacuauauuuuuuuguauauaaauguauuuauggaauauugugcaaauguuauuugaguuuuuuacuguuuuguuaaugaagaaauuccuuuuuaaaauauuuuuccaaaauaaauuuuaugaaugacaac

SEQ ID NO: 18205 - RNA, 8857 nt, Homo sapiens
cuccagagguuaacuggaauauacaccaaugacagcuugccuggguaugccaaaauaccugcaagaauguccacaucaucuggugauguccccaaauaacaguuuuuaccauagaaagaucguuaacauguuugcuuuaaaagucauuagcagucauaacguacuuacagauucugccuauaaggaauaauacauaauuuuagauauaaaggccccacuaguccagguuuccuuaugccacugugcuuccuacuaaguguugcgaccagcucuugucacuaguugaugacaacuuacuccaguagccacagggcugugacaccauaguuauaggugauuuucauagauuuagccaucccagguucgaaacuaguauccucuagcucuuaaguagcugauaaccuccccaugggagaaacuccauacugcaguuucccauauggugcuauguauaacuaucuuauacaauuaauacaaauugcauauguauacuuauauaauauggacuacuaggacagaacuuuuuaaauuacaaauaaaauagccaaguagacaauuacauuagcaagugauguuaccuaugaaaacgugaggauuuaugguggcaaugcauuucaguuaacagggauguguuaggggacaaugugagccaauguagauuaaggaaauaagccugagaaauuuaucagaauuagccgucaguauucaagcacugaucaacagcaaugugucuuaagggcaggcaucacuggugcugagagaacugggaauugucaacugugagcugcuaggggauggaagaaaccuuaguguagucuuaggagccgcuugcuuaaacagauguaucagaaacauaauaggccaagggucagcccuuugaaaacugacuucagggccuuccuuuccucaggcugcugccuccuaggccagacccuuauuuuggcuuacauuccauaacccuuguaugugcgauagggaaccuguauacaaugcugacacggaaagggaagaccaucgccuuuugccuuucagugucucaucuguaagcagggccgcuggcugaccaagaucaguucugaagguccagccucuuuaaauuccaguucugugaucacaaagccacuguuguuccucauccugccaacugugauacugcugcuucagaauuacuggguuuccuguucaucauacucaccaaccugagguuugguauuucucaaauauucugggcuuccaguacauacuagagccugugauaaucagcuaaugaucagacaaguuuguugggaguuuuaccuaaguauuuuuguguuuuaaaaaccuagggugggaaaugcucagagugagaugguuugacuucauuaggcauauaacccauuuuuauuauaaaaagaaaugcacauauaaguaaaaagaccauuuuaguuagucccaccauucguugguaaccaguucacuaaguguacaucuuugcagauuucugugcauacauacaaauauuuuuacaagaauaggaucauaccaugaauaccaccuauaaugguaugucuguugucaauauagguguuauaauuaagacuguguagccuuccucuguggauguaccaaaauuuauuuaauucccugucacuggacacuuuuguuucacuaauaaguagacacuguguaagcaaucugucaacaucucugcaccucuauuuuugguauaaguauuuccuuaggauaaaaucccagaaauggaauugcaagguauaaaagauuauuaacauuuuucaaggcuuuaagaugccuuuacgguguaucuguuacauccugcuuccacacaaauucuucuguauagccaguacccaagcugcagcucucagcacaggugaagacagccaggaugccccagucaaugcucuugcccagucugucagccuucagguaguuuaggagcugaggcaugaccugagaagagggugacacacaguuagaaagcugcuucacagcagggagcacgagaccuucucagccaggaugauuauagggaucuuggucuuucaauccucauacuacaaagcaggauuauagacauuauacaauuaacauguuuaacaaucuaaaacuuccuuaugacuucaaagccccucucaccuucuguuuggucuuuuccauuugagaaagaaguucacaaguggcuguuaaugaauuauuuucauuacuaauaugccacucaaaagggcugaggcuucuauuugggcaacuuuuacuuuguaucauugcagauguuguuacucuugacucaagaaacacuaauuacuaguaaugaauacagaaaggacaucuaucaauguaguuauagagaccagagaggaaucuuagaaguagucuaacucaaagagugaauaggcagaauagccaccugauauggaaucacuuuauacaaauccugucaccucaauuuggacauugagagcuuuggcacuaagaaccaagcagaguuuuguguaugguccucauaauuccuuuuuuacccaaagaaacaaaccaauauuagcuaugacuuugguaagguuagugaauccauagcucaagagcauuuccacccuacccaaauggauuuugaugcuaacaaauccuuuugggcagggaaggacauuuaucuuuaaugcuuauauccauuuuuucuaacaaauccacaaaccaagauuaaacaguaaagacuccucucauaaaguauauagucaaagacuuuaauuacuagaacaagaaaggaagguauacauuauuuaaaauaacaaaaguuaacagaggcacuaauaauaaugacauaaccacacuggagguggagagcaguguagauauccucauugucacagaagucagucaauagaccgugucugaaaacuaggaaacagaaaaaaacaagacaguuccuuccagggaacuagccccaaggugaggcaggaaacugaugauuuucauuauaggguacccuuccauacugccauguugacccaugugcacaaauuaccuuggugaaguuuuuaauguuuaaaaacaaucauggugauuacacacuaaaugguccuuauuuaaggucauaccuggaauuccaauauucucuuggcaccacaggggcaaucuggaauauccuuuucuugaggaauauuuucaccagaaauccagaugggggcaauaccucugccauaucuaagaaucuaaaaucaaugaagaucauguucaaauaaucaauaccuuaccuauaaguugccaaugguaacaugcuaucuacuccaugaauguuccuacucuugauguagcacugacccaaaaggcaugucacaguucccccaucagaccuggcuguaccagugugccacuaaugccuucucaaucaccucaaagugauuauuucaguuuaucugacucagagggcaucaaaauauaucucccagaugaugcuuuuacuaccuaauguuggcaacuuaauccuaugaauauauugugaagggacuaagaaugagccucugcucuaauugcagaauucugcccagagucugugccuaccuucauaguuaaaaaauuuuaggagggacaaauaccaagugaaacauaguguuuugaaaacuacuacaaacauaaguaaauuucacuguaauaagcuuccuacagcaacugagugguuuucuguauuuugucuaaaagcauaugcauugcuaaaaacugccuuaguguuuaagaccuagaucuauucuuccuguguauuuauuugaaccagugacugguuuaugggaguuuaguuuucuuucgugauuuacguuuaugguaggggagguuaaggagaaaaauguuaacaugucacauuuuacaagccaaaguuaccuguuggaaaugggcaaaaauaaccuuuuuucuuucuggcgggggggccaauggugccuaaaccucauguaccuuaggcaacaucucauucaucucccaucccugaugcuugcuuuagaaaaugaacccuguaugauaaacaguauaaccuuuagucuuuuaguaacuauuaaauggaucagcacugcaaaacaccuuucuacauggcccaucugugugaggaacuccucuaacaagauaacaaaagccugcuuuuauaggcuccuaaggaacagacuaauguuacuaugaaguuauuucuuacagauuauacucauaaaacauggccugaagagaacacgaugaggagcuaugagcuccacuuuaccuguucugguucaagggcuaucugaguuuuaaacuucugaaaaauuuuaucuucccuggauucauguuuugccauggaauccaguucuuccucaagugcuucaccugaaaaaucaacguaacuauuaugaaaaacaggaguaauccccacaacuugacaauucacacauggagaggggacccacuuuuaaucagauagcuuucccuauuuauucacucauucaaguuggaccaucugaauuuccagguacuccauccaacucuauuauauggacuuccauuuagugcaucuccuuaaagcuucaaaauaacagaauggucaagggcuuaggacugcccagcacaucacaggacacccaacaaaugugagcccuuaucauuaguauccucagcugguaggcucacucacucagucaucaaguguucauuucuggccuggagcaguggcucacgccuguaaucccaguacuuugggaggccgaggcgggcagaucaccugaggucaggaguucaagaccagccuggccaacauggugaaaucccguaucuacuaaaaauauaaaaauuagccagacguggugguaggugccuguaaucccagcuacucgggaggcugaggcaggagagucacuugaaccugggaggcagaggcugcagugaaccgagauggugacauugcacuccagccugggcgacagagugagacuccgucucaaaaaaaaaaauguucauuuccuucuccacauuccuuccugggauuacagccacccuaagccacugcuguccccaacagacccgugucucuaaguauaaccauuagucuuuguaauguacguuaaaauagaacugauauaccuugggucagagaagcuaaaauaacugcuuugaugaaacuggaaaggcacugaugguguucacuugcaccaucaggucugauggaggaaguguaggaugccuucagauugauguuccaucaaguauacguggaaaguuucaguauaaccguuaggacacuguaaaugcuguucccucaggcccuacugccuccugccaagucucagguaagacacagcuaccuccaggaagcauuuuucuauucaauucuccuuuuauuuuagaaaauuuuggacauacagaaaaguggaaauacuauaaugaaccgccacauaucauuaaucaguuucaacacuaucaaguccaguguuuccuuucucugccacuuccaccuccauuacucugaaguaaauuccacacauaucacuucauucauaauuaaguuauguaccccucgaaggcaaacucuuuccuuuuauuuaccaauuugaaaaugagucuguucccaaguauccuauaaagaugauuacugaguuuuuuuaaaguaucauuuugaacccauuaaacauaucugaugcaguuagcguccuuguggauguucaaacuguccaucuuuugcaagcaggagccuuuucauguugcuugaguucugacauggcccuaguaauccuuauccuuaaucuuugauaugaccauguucccacauuauaugaacguuuccugaccuaguucuggaaucaaccaccucuccaaagagccuggaguuccuuuuagagagaaaugguacguagacacaaucaacauuaucuuccuccuacgcccaacaucucaguucucaguaacaccaacauaauuacucguuuccuuuccccccaauacacacacaaccaucucaaaauaaaagcaacagucuaguaauaacauguuuauucaaaauacuaacacuguuacauucuuuucauucucagggcauauucuacuagagauguacuguccuauguuuugaagucaccuggaagaguucuuagugugguuauaugacuacaucaagaguuuuuuacuuuugaugauuagggacugcuuuuuaaaacuuacuuuacuccauaaucuuaaaauacucauacaguuccacagucacauuuacacuaacaaggcauauuugaaguccagcuuucauccuugauccugcuacucuaggcucuccuuucuccuaaagauaagcauuuucauuauguaucauguuuaucguauaggcaugaacacacgcgcggccccuuccaggcagucuucagugaugucacguguucccauggcaccuguauuguacucuuaucagucauuauauggacuuuaacuuccccagauauuauuugggcuccuccauaagacugugagcaucugaccacuggaguguugcuucccauuauaucccuguuaucaagcacaaggucaggcacagaguaagacucaaaacauguuuuggaauguaugacugguaugaacuacaaaccaguaagcugauguuuucauuuugagucuauaaaucuaauuuuguggugguuuuguguauggcucaaggcucaaauuguaaaauuuaauauuaugugaccaaagaaaguuauacccagaaccucaauuuccucaccuucaaaauggggcaguuucucacucauuggucugcugucacgauuuuaaugagcucaugcacaaacagcccuuuauauaagguaagugcuggauaaauguuggcuacuauaauaaaauaagccucuaagauacuuggucagcacaaguacuacccaagaguaugcacuguaaguaaacugacaaaauuguguaucuaaaacuggccagaugaaagagaaacuuuuaaggggcccuucugcgugcccgacacugugcuaggcacucacacuaucccgacccgagaaaccgaucugcgacccagaggaacuuaccaagccuccagcaucuugugcagcccuacucaugggaccaucuggauacccacccuugucuuuacagggagcagaacacaccucuuaugugucagaaaacaaaguccaggaaguauauuuuuaccugaggcaauaucugaaaauuguaugcuacagccuccaaagugagucuuccucucaguaccucucuucuaggcacauggagcccuuucuuccaaguauuauguuuaaccacuuaaugaaugaaguccugaaacugcuuacccaugcucccuauaaucucugaguaaucuuccuuuuccacaaccucaggcauaaucucaucuucuguuucuauuacaauuucaaauucuggaaaaaggaaguuguggucuggaauuauaugguccagaugaucugaaacaaaaaggacagcacuauuaguaaucauuuaguuuugaagacagucuaauaauuugcugucucuaaaguacuauauucccuauaguucuggcauuuuagauaaagggucauaaauuaaaugccuauauggugacauuauucagugauucagacuucacagccuuuuuuuuuuuuuuacaaagguguuccaggcaugaaaaauuuuaaaguacuauaccuuuccuaauuuuaccuuuaaaguuguccuggaaauaucuggguugacaaaggcgaugaaacugaacugagacuuaaaaaaaagauuacccaccugguugugcacaagccugcuuaugucccaaucuccagucuagggucugaugcuccuugcugcaguaauaugcuuuguggcaucuggagcacguuuuggggccuaaacagccacaaacccugcagagaugagcaccagacuuaagcuggagacacacugauucuccuguuucugggggaggauucucagaagguggcucauaugaguaaaaaucguuuuuccuggguaguugauuccuaaaaacuaaaaaagaauacagagaaaaguuuuaucuucaaacaaaacagcaauucacauauuuuauccucugcacguaaaacugaaaauaacaacaacaaaaaagaaaugaaaguuuuugcuuucaggaauaagcuuuuaaaauccagaaacuagauuucguccgguacacgcaacugaguugccuccuagaggugguuugaguuaaucaaauuaauaagacugaucguuaagaacgacugccaaaaauacgaaaaagcuacugggauccaucuuuccaagacaauuucuauuaucugaauuaacaccauaccugguacccacugauuaaaagcuggggguuaccaaugcgcgugggcacaguuagaagcuuauguagcaaaaaugagcacauccuggaagggcccgggagaaggugcuccuggggcagcgcggagagggagcucugaggcuggggcggcagcggugcuugccgccgucccccuggucgcucccggaauuaacgccgcgcacgcgucggaggcauggccccgucccgaccccguuuggcggcucaccucgcaggccggcacagcacggcugcucgcggcagcagaagaggaagaugcagcgguggaaggcguccgggcggccaggcagcggcgcauacaccugcagcaggaaggagagcgggcggccgcacagcucgcaggccagggccuggggccccggcagcccggccgcgcccagccaugccggccgcccgcccaccuugcuggggaacugcucgcugcgcagucgccacgccggcgccgacucggcgaagcccagcuccacaggccuggccccggcggcagccaugcggggcgcgggcuggcguggggcgcagcccacagcugggucg

SEQ ID NO: 18206 - RNA, 2819 nt, Homo sapiens
gcagugacauacugcggcugaucaagguagcggagagccagagcuccucccggggcgugggguggagguggcuccguuucccagaguggggugauucacgucuugaggucucggccggugugagagcccagccuguuccccuuucugcgcccauccccggcucggccgccaccccgcccgcccgccccauuccguuccccugagcuggccgggccggagccucauuuuguuuucuacuuuuuucucuccuaugugcauccccccaggagcuggcuaaauaugaauacauggaagaacaaguaaucuuaacugaaaaagguaauucaacaguggcgggacgggggacaagcguucggugccugucaccuucgccaaggccauuaccgccccugcucccccuucuugcagaucugcuagaagaugguuuuggagagcaccccuuuuaccacugccugguugcagaagugccgaaagagcacuggacuccggaagguaaccccucgcccuuuccagaagccagagagaccaaguguuauguaagaaguagugucggcuguguagaaccacugacuacacaggccgaaguuacugagaacuuggacagaaaaaauagccagcaaguguucaaacuacugaggaaaaaaaaaaauuagauaugcugcacuuaagaauacuagggcagguuaaaagagcuguuuaaguaaguaucagagugcuguggagacucggaaguguuuaagcugcuuaaguaaguauaagugcuguggagacccggaagaguuagauauaaugucauuuguuguaauucaguuucauaaaaugguucuuguuugacccuaacguaacaguuuuuguaauuguguuaaaucacauuuuuuucuuuaauuugucccaaucuucagguuacagucucuagcuucgccauguacauggcccuuccguguacauggaugggcggggagguaacuaaaagauccuuuacacaauaaaguagaugaucaugauaaaugagguaagguccuauuaucacacacuucaaacacgguagaucagaaacccacuaugauacucgcuuccugucuguuugcuaaggaauauaaaauggcuagaaaguuuaauuugaaaccuuugccuccauuuggaauaguagacaccaguuaagagggugucagaugccuuuuuuuuuuuuuuuuuuuuggcuggucccuguugauuggucagaagacagcucagcuaaaaggggaaguugucugggugguugcuuuuuuucugacgucuguuccucaggcuggaagaaaugagcagaaaacaagggaugaguacuuuuuagaguaugugcauguuacguaauaccuguuucugggcaaugcugcuucuucugacucaacaaauggggagagcaaauugaaaaugcguaaauuggaaggcaaguucugaaauuaaacguuguacuuuggccugauguucugaccuuuaaggaagcaagaguuuguaaacuuccaaauauuuacuauucugaacugccguguaaaccugacguauucccaagucaacauaccaguauaccaauaggaugugaauaauguguguguugaguuuaaaaccauagcaguuuugcucuggcaaguaaugaaagcguucucgcuuccugagugugagcuccagcagacugcagaguggccaguccacaguuguagccugacuucagugaguucugaugugugcuuuuugcaaauacauguucucagaacagugagaucauccagcaguggccuggacugcacucacauaaaaaucaugagacagccauggcuacuuguuucuguaauacaugcauguguguuuuuuaaaaccuaugauaggccucugauucugcagcugcaacuuuuauggaauguuuuccuucuccacaucucaugugaugcucuuauuacaggacacagcauuguugguuuugccauguacuauuuuaccuaugacccguggauuggcaaguuauuguaucuugaggacuucuucgugaugagugauuauagagguacgauugaguucggagcagagggucugaagagaguucagaguuauaaaugcuuacaaugacuuuuuaaauuguacucuuucuuuuuaggcuuuggcauaggaucagaaauucugaagaaucuaagccagguaugucuuaguuuuugguuuccaaauuuguaaguuuacuggauuauuuuaaugauggaauaaaaauugggucuugagagcaggcugaaaugucacugaguguguguuuuacucucucauaauagguugcaaugaggugucgcugcagcagcaugcacuucuugguagcagaauggaaugaaccauccaucaacuucuauaaaagaagaggugcuucugaucuguccagugaagaggguuggagacuguucaagaucgacaaggaguacuugcuaaaaauggcaacagaggagugaggagugcugcuguagaugacaaccuccauucuauuuuagaauaaauucccaacuucucuugcuuucuaugcuguuuguagugaaauaauagaaugagcacccauuccaaagcuuuauuaccaguggcguuguugcauguuugaaaugaggucuguuuaaaguggcaaucucagaugcaguuuggagagucagaucuuucuccuugaauaucuuucgauaaacaacaagguggugugaucuuaauauauuugaaaaaaacuucauucucgugagucauuuaaauguguacaauguacacacugguacuuagaguuucuguuugauucuuuuuuaauaaacuacucuuugauuuaa

SEQ ID NO: 18207 - RNA, 2317 nt, Homo sapiens
ggugagcgggccggaagccggagcagccgaggagucugcagcagccgcguggcggagucugggcgaggaggucaacgcuccuggaaacuugggcucguccucgcgccucugcuccaggagcaaugacgauggucacgcccuggucgcacccuggaugcgguucuacuccaacagcugcugccugugccuccauguccgcaccagcaccauccuguuaggugucugguaccugaucaucaacgccgugguacuccugauuuuguugagugcccuggcugauccggaucaguaucacuuuucaaguucugaacugggaggugauuuugaguucauggaugacgccaauacgugcauugccauugcgauuucucuucucaugauacugauaucaugagaauuaaggcuaauuacguaauuaaggcuaauuacgaagcauacaggcaacacgcauucuggaucaucccauucuucuguuaccagauuuuuuuuuuuuuccgagacggagucucgcucugucgcccgggcuggagugcaguggugcgaucucaguucauugcaagcuccaccucccggguucacgccauucuccugccucagccucuccgaguaacugggacuacaggcgccagccaccacgcccggcuaauuuuuuguauuuuuaguagagacgggguuucaccguggucuccaucuccugaccuccugauccacccccuucggccucccaaagugcugggauuacaagcgugagccaccgcaccuggcccuguuaccagaucuuugauuuugcucugaacaccuugguugcaaucacugugcuuguuuauccaaacuccauucaggaauacauacgacaacugccuccuaauuuucccuacagagaugaugucaugucagugaauccaccuguuugguccuuauuauucuucuguuuauuagcauuaucuuaacuuuuaaggguuacuugauuagcuguguuuggaacugcugcagauagaugaacggcaggaacuccuccgauguccugguuuauguuaccagcaaugacacuaaggugcuccuaccccgguaugaugauaccacugugaauggugcugccaaggagccgccgccacccuaggugcugccaaggagccgccgccacccuaggugucugccuaagccuuugagugggcggagcugggggcagcagcuugacuuuucagauaucugagcaauagucauguuauuucacuuuucaggugagcucucugcgcuuguuuguugccgaagugcuacuuuuuaagauuuagauguuagguugaaaccuguaguuuuccucaacauaugcuuuguuagaacacugugauagauuggcuguagaauacuuucuguaggauuggggguguaacaggcuucacuaacccucccuaggaauguaaacuucccccaaaucuagauggaccuagagucagagaagucugcuuucauaccugugggaccccaaaguugggcaguuagucauacguuucucucuguucccucucuuuugaaaguguaaaauaaaaccaaaaauagacaacuuuucuuaaaccuuuccaauguagagaacaaaaucuuacgaaaacaggaaugccaauucuguaaucauuuuucuaauuagguaaauagaaguccuuauguauguguuucaagaauuucccccauaacauccuuuaugacaaguucaauggcaguuuguguuuggugguaaaggauuuucuccauggccugacuuaaaaccauuggaaagcaccaggcagugggagcaguaaccaccugaugucuguucuccugcauccccuguccagggucauggggcggcgugccucaucuauguuagaggguaaaacugauguguuuagugcugcgugggaucuggugcuccucuucaggauucacauccccacccagggccugcuuuuacugaguguucugcccuagccugguucaaggaagucaugcaacugacuuuaucaaguggaauugggauauauuuguuauauauuuaccuaaaaacauggaaaggauuuuccuccuucuuccccugcaagguacauucuacagcuuugaacuuccaaguaugccuagucaccuuuuaaaauguaaaaguuuucagaaaaaugaggauugcuuuccuuuuaugcacuuauuaucuugacuaccuaaguugcaagguauuuuuauauauucauauguucaaaagccagcaacucuccuguugguccauuauugaaugugcugugaaugaagucuuuugcaauuaaaaugagauucgcccacauccaagaugaaaaaa

SEQ ID NO: 18208 - RNA, 3959 nt, Homo sapiens
uuuugcgaacggcgagcagcggcggcggcgcggagagacgcagcggagguuuuccugguuucggaccccagcggccggauggugaaauccucccugcagcggauccucaauagccacugcuucgccagagagaaggaaggggauaaacccagcgccaccauccacgccagccgcaccaugccgcuccuaagccugcacagccgcggcggcagcagcagugagagguaagugccccgcccccguccgaagcuuccagaagcgccggccgcgcaggccugcggggggccguccucggggcgccagauagguccccggcgcgcgagauccgccccuuugucaaggccagaaucgcgccggggacgagguaggcgcagggcgggccuggaggucccccccggccuuagcagugcucucgggggagucggguuuggggggcaagggugcggaguuggauuuggggggcaccguccggggcgccugauuugcgggaggggcaugggucggaggucggauuugggcgcaggacggggagucgggggaggcgugugucuuuugcgggguucgcgggaugggacucggcuucggaggaggggagaggcuucuggucgaggguuggauuugcggggcgcagacugggaauucgguuuggaggaagggugugcggucgggucggauuugggaggcgcacgauggggcaaucugguugggggcggggucggccuuggggggcugguccgcggacaggcagggcccgcggggcuggugaaucugcacuuuucggucccggccgucgagcgugcgcugcgggagcggggagcgcuuugcgguggacgagcucccgcgggucccuguugccucgauguggccccugcacgcgacggaccucgugggccccguuuuucgccccugagcgagucggucuggauggcccgggacgcgccgggcgaggccgcgcacguagacggcacccagggcuucuccgcgggggccgccggggagcuggggguggcgcacuccgacagcccggcagcgcccugggaagacccccgccgcuucccgggaagacgcgucccgcuuccgggggcgcgggugccagcugcgguugugggggagcccgcggggucucggucgagcuuucccgacugcgucccccgaggugggcgucgcucagccccggaucgggagguugggccgcggugcuggcggugccgcgguuugggggccgugcaaaauggaggcaacuuuggggccuguuuacccugcgcagcaaauggcugcuggcgcugccggcugcgcgauugugaaaaucucccccggggcgcgaggccgcgucugccuggaugacgcaaccgggagggcccgggccuggagcgggggcgggggggcgggcggccgggagccggagcggggcgcguccuccaugaggucaggcuaggcccgcccggucuucgcggggacaagcaagagucccagauuuuggccguagugcaggguggaaaggggaagccgcgacagaacugaaaaggggaagcgcuggcugucuugguggccggggggugaggcucugccccggcggggcugcgugaggggaaggggccccccgcccugggaagguugggcuguccugggcggcgccgcccgaggagucggggcucagugacugcugcccuuguaggugcuuggggcaggcguuggagcugccuucgggaagccucgggggugugggaccgggugggccccugccugggcggggcggggucuuuuggccgaggcagggguggggaugugcugaaggccgcccggacgcccuggaggggucuccgcccggagccuggcgcugccucgugaccugcaucaucuucaguuccagggucucccuccacugcuguaguaacccggguccggggccucgguggugcuccugaugccccucacccaccccugaagaucccaggugggcgagggaauagucagagggaucacaaucuuucagcuaacuuauucuacuccgugaguauggggccgggccugcuggggcugcucuggggccacagguacuuucuugugcaccuugcugcccguaccugugauugaauguaaucgugggaacccugaguuucaucagagccggcgcacagucuccugcagcccaggcguugccugagcucaacacggccuaggcccaagcuuuagcgcugccggguucuuggaguccuguggggugagucaggguucugaauugggcugcacccccuggacaggaugaucggcugaauguaacagaggaacuaacguccaacgacaagacgaggauucucaacguccaguccaggcucacagacgccaaacgcauuaacuggcgaacagugcugaguggcggcagccucuacaucgagaucccgggcggcgcgcugcccgaggggagcaaggacaggugaggggcaaggacaggcagggagugcucacccaggggagcagggaccaggugaggggcaaggacaggcggggagugcucacccaggggagcagggaccaggugcggguugcugcccaaggggugcagggacagaugagggagggcacugccuucaggcagcacauaugggggccaccaucgcuuuguugguggggacaggguccccccuuuuuuuuuuuuuugagauggagucuugcuuuuguugcccaggcuggagugcaguggcaugaucuuggcucacugcaaccucugccuuccggguucaagcgauucuccugccucagccucccgaguagcugggcuuacaggcgcccgccaccgaugcccagcuaauuuuuguguuuuuaguagagacgagguuucgcuauguuggccaggcuggucuugaacuccugaccucgugauccgcccaccucggccucccaaagugcugggauuacaggcgugagcuaccgcucccggccuggggucccuuuuuaaaaagugcacuccaaauucguacccugggauucuacccuccaagggaugccaggcagugucagagcuuuucugucauggggcaugcacgugggugggugcagcggugcugcucaacacuguggugucaggacggccccacccagaggacgaucugggccccagggggacccuggaguagagcgggccucaggguagcugcuaaggcccaggagguaggcaggugggucgggccagccgagacgcugacacucgcugcagcuuugcaguucuccuggaguucgcugaggagcagcugcgagccgaccaugucuucauuugcuuccacaagaaccgcgaggacagagguaggugacccguaucgccugcaguagggugcgugggggugccugcgccgccccuucauucucagcccgcaggcacggucucccugcggggguggggggugcgggcgggggguucuggucggcagggguucugacggcuucucccccgcagccgccuugcuccgaaccuucagcuuuuugggcuuugagauugugagaccggggcauccccuuguccccaagagacccgacgcuugcuucauggccuacacguucgagagagagucuucgggagaggaggaggaguagggccgccucggggcugggcauccggccccuggggccaccccuugucagccggguggguaggaaccguagacucgcucaucucgccuggguuuguccgcauguuguaaucgugcaaauaaacgcucacuccgaauuagcgguguauuucuugaaguuuaauauuguguuugugauacugaaguauuugcuuuaauucuaaauaaaaauuuauauuuuacuuuuuuauugcugguuuaagaugauucagauuauccuuguacuuugaggagaaguuucuuauuuggagucuuuuggaaacagucuuagucuuuuaacuuggaaagaugagguauuaauccccuccauugcucuccaaaagccaauaaagugau

SEQ ID NO: 18209 - RNA, 32287 nt, Homo sapiens
ggaguuaauaucguccgaguuuuuauacauugcauauauugaaacuuugagccaugugaaaaacauuagucucuagguugcagauuuuccuacccuaguggagcugacuauaaugaguacugucuguuuccauuauaucuucuguuugugaagguggaaagagucucaaaaauuuagauagggagagacagauuuauauaguucagugaaagaagaggagaggauuauuagaaaagggaagaugaauuguggggaggugauaaauuucaauggcuuaagcauucuacuguuuuuaaauuuugauagugacuaacaaaaugcuggaaaaugaaaauuguuaauguauagaacuuaacaguagguaguuuuaucuucacagaaauuuuaaaauauaaugaucuuucugaaguauuuuaugucuucaguuuugcugcaugcaaaaaauaauauaaauuaaucaaaugggauucauuacauuauacaaauuaacuagauaaauuguggguuuuuuaauuuuagagaugaagaaaaugugggagcuaugaaucaguauagaacaagaacucugaguaucacuucuucaggcagugcuguaagcuguucaacaauuccuccaguaaguagucauucaacauguacugaauguuuauuacaucacuacugugaucugauugccuugucucauuaaacaauaauguaugccuuucagguacagacuucuguugauugcuuuuugacuugucuugaaaccaguacuuucuuugauuuuaauaaaugaauguugcucaaaggaugugguagaguuguguccugccaccauuauguguaaaaugaaggccaaaugacuuuuuguugguaaaacucaaaacaccuucuuuuucaauuguccugauuuuaggcagccuguugacuaaauuucaaguaauuuuuucuuagaauacaaacugaugaguuucaaaaaauuaauguaggucacuugauaaauugaucagguuugagguggaugagucauucuucauaugagcugaagauuaaugagcuuggucacugugaggauuauaagguguguaagccucagacacuuggacguacauguuaaugguauaaaauuuuguuguuguuguuuguuuuuguuuuuguuuuuuuuuugagauggaguuuugcucuugucauccaggccggaggucauccaggcuagagugcaguggcaugaucucagcccacugcaaccuccgccuccuggguucaagcaauucuccugccucagcuucccgaguagcuuggauuacaggcgccuaccaccauggcuggcuaauuuuuguauuuuuaguagagacaagguuucaccauguuggccaggcuggucucgaacuccugaccucaggugauccacccaccucagccucccaaagugcugggauuucaggcgugagccacugcgcccagccauuuguacuuggauauaaguacaaauuuggccgggcauaguggcucagaccugugaucccagcacuuugggggccaagguggaaggaucgcuugagcccaagaguuucaggccagccugggcaacauagcaagaccccugucuacaaaaaauuuaaaaguuagccagguguagugguauacaccuguauucccagcuacucaggagacugaggcagaaagaucacucaagcccaggagguugcagccaccgugaacuguguuccugccacugcacuccaaccugggcaacacagcaagacccugucucaaaaaaaaaaagaagacccuuguuccuggcuuugcagaguuuugcagcuaucuucuuuuuuaggagaaaaguugaaugauacaagguuauauacaguuauuaaauaacagacuguagugcuucagagaaagaaaaggucauugugaacugaguauuucacauuucuuauucaucuuguaagucaugugacuugcacaguguaucuuaacugauaaguaacuugaauuuaugaucaaaagacauaugaagacuuuuccaugggugauugcuaccaucaggucaauucuacagcugaaacugugaaggcauucuuggauauauucagcaauacugaaugcuuucaaaaauaauuuucuauacaaaaucuacucuaaaagccuacuuuuaaccuaaaaagcagaggaacaagcaguuucaucuuguuuuuuccaucaguuuucaugauggacacuagguggcacuaugguaauuuuuuaaaaauucugccuauacacuauauuuuuugcuauauaaucuguauuucuguuuggaauuuaauuucuccuauauaacaguuucuauauaguacugucaguguuuggaaucuuaaaauucauggugucaauauauaaauagaacagauauuagcaguguacuuuuugaaaugguucauuaucaguaauacuaauuuaugaaaucuuuccaggaacuggugaaacagaaggugaaacgucaguugacaaaacagcaaaaaucagcugucagacgucgauugcagaaaggagaagcaaauauauuuaccaagcaacguagggaaaacaugcaaaauaucaaaucaaguuuggaagcagccagcuuuuggggagaauaauauauuuaggaucuuggauauguuuaauauauuuuuuaaaguuacuguaauuccuuuuugagcccucauuugucuuuuuugagccaaggcuaucauauauuaauaaauaaacccucuuucaucuauaaauuuggucauucaguaugugucuugcaaagaauaauuaccugccaaagcaguccauuuuuuucaaaguaauuuggguaacuacaguuacguaacuuuauuagagacauuugcauauuuuuaaaaaucuaaauaacauuuuuguuguuuucuguuuguugaggaugauaugcuacaaugcacauaaagcaauuagaacaauguuuagcacauucuuaagcauucaauaaaacauggcuauuagaaucauaaugauucugaaauucugcugacaauuugguugcauuuuauuuggcaacuggaggacuucacugucuuauuuuucuuuagaaguaaagauaagccuuuggaaguaaagauaagccagugaugcacaauuugcuuaauuaauugauuaauaaucuguuuugugccacuuacauugguaauguggucaugagaauggaaacuuacuugagauagucuaccacaauuuuuacaguuggcagcuuguaagcaggccugaguagcagaagaguuagggguuggggaagguggaguagaaugaggaaugaaauguucuuucucauaugcuuauuauauaaguggguccggaacauguucucaccucaagguuaacaaauaccuaaugcaggaaagaaaauacauagccauggucccuuccucaaggacuuuauaauucagugagauguaaagaugagugcuuaaguguaugcaccugauuauugucucuucauugccgcauaagucggaaaaggggaucacuugcagcgaaaaauggccacuagauggcaauaucaccccauagucaccaaacaggauuacuugcaucccuaauuauguucuaccagagggaauauaguacagacuuuuccaagauugauaaagacagcagauucccuuucaccuuugccaaauuaacucuacuagcuauuugcaagaccuguaauuaucuaauaaauuggcuuaaauauauagaagcuagaaaaugccaauuccucuucccucaaaaguuaccugacauucaaauauuuaaauacccuugcuuugcauuuuagauauaucuuugaauucagguauucauuuuguauaaucucucaacuuuuaagcauuuuuauaauguaaaguugaaaacagcuuaauagaaccacagaauguuuauuuuggagucauuuucuuauauucagagcuaugaaagcaaauugggaauaaagccuuauccugcucagcuuuaccuaguugacucaguugacuuuugaguaucuacuacauaaaaagcccauuacuauuaagaaacucaagacaaacaugauuuuuaccuuuaauagccuaagauuucuugugggccaaggaauuaauuauuccaaucagaaauggaggccuuaccucauuugggcaaagauuagugcuaguuauugaagauuuacuaauaaaugaucuguuaaggaauuuaguuuuuuuuggauauguuguuuugguuguugaaaacuaagguauaauuauaauaguuauuuuuugaagauauguuuggcuagccaucaauuagaaguuagagaguuuguccuaacagauaagcuauaacccucacauuuuaaaacaugcauagugaacaaugaacaaaaacaaauucaaaauuuuacuaauguaaagcuguauauugugauuguuaaaacacuuuuuuuugccuaggaguuccagauuuaaauccugguucuacacuucccaaaccucagguaccuucuguggccucucuaaccucaauuuuuuuacuuguaaaauggggacauuuaauaguauaccucagugucgugaagacuaaaugaaguaccacuuguaaagaguuuauuacagugccugacauauacuguaugguuaguacugcuaaaaugacuucuuaagguuaccaaaaggaaaauuccacaagcugaccaccuuuccuauugugauggucacugguauuucagcuaugauccuuuguuguguauuuauccagacugaaagauguuuuucuaguaaccaucuugcaucgucuuagucuccccauuaaauaaacuuuuccuacaaacuaugcgguuuauauuugugcuaacuuugugguauugauagccauuggucuguucuuuggcacauagcuggcuaucuuugagguuucuccaaaaccauagauguuuaauggauacuaaucagaguuagugcagcucgagauaaucauucuuuuagccaacugcuuaguaaauuuucugacaaaauacauagcugucuaauuaaaaaacucugccugaugcugccuuccagguugcuacuuacaaaggauagagggaugaguuauguuagguucucagagcacuuucugaaguguagguuuauuucacugucacagauucagcacucugggugggcuacaguucgccaugcccagucuucuuuaucccuccuuagaacaucucccuagagagcaucaggccauaucuuaauucgcccuugcuuuaguuuaugaaguacuggagccaucuuaugcaccuguguaaggaggcuggagauuaaaguucagaaaagccauggguuacacaguuguguaauaaccaggaguauggggauaacuccaaagcuacaauacuuuuauagagaacugugucauucacaaaaccuauguuguuagauuuuaaagacugcaaguuuuucuuuuaccuuaauauuguaaauaaugacauuaaaaauauuaacauuuugcaguagaggccgaacaagaugaccaaauagaaaccuccaccaaucauucuccccacaaaaacaccaaauugaacaacaauccguauaaaaaagcacuuucauaagaaccaaaaaucagaugagagaucacaguaccuaguuuuaacuuaccacugaaagaggcacugaagaggguaggaaaaacagucuugaauugcugaugccaccacucccccaucccuuggcagcggccacaugguguggcaagagaaugugcacuugggggaugaagagugcagugacugugggacuuugcauuaaaacucagugcugcccugucacagcagaaagcaacaccagacagaacucagugcccauggagggagcauuuagaccagccccagccagaggggaauugccugucucaguggucaacaccugaauuuuggcaagacuugccaccacaggccgaagugcucuggguccuaaauaagcuugaaaggcagucuaggccacaaggacugcaauuucuggacaacaaguugggcugggcguggaaucaguggacuuggaagacacaugacuuagugagaaaccaaccaggcuggccaaaggaguacuucagccaccucacccaguuccacacagcacagcuugcagcuccaggacagacuacuuccuuuugaggagaggagaggaaaguagagaggccuuugucuggcagcuuggauaccagcucaaccauagugcacagggcaacaggcagagucuugaggcccccacuucaggcccuaccuccuggacaacauuucuagacacacccugagccagaagggaacccacugccuuaaaaggaaggacccaguccaggcaggauucaucaccugcugacuaaagagcuuuugggcccugaguagugagcagugauagccaggcaguacucaccauaggccuugggugcaacucagagaugugcuggcuucaggugugacccugcauauucccagcuguggugccuacagacagagacucuugcuugaaaaaaaaaaaaaaaaaaaaaggagagggaagaauaaaggggacuuugccuugcacuguaaguaccagcuuggccacaguggaguagaggaccaagcgggcuuuugaggucccugauuccaggccuuggcucuuggacagcauuuauggaccuuuucugggccagaggggaucccacugcccugaaggaagagucccaggacugccagcacucaacacaagcugacugaagaacacuugggccuugagugaacacugguaguagccaggugguacucaccaugggccucgggugguggugaccauggagagagacuccuuugcuuguggaaaagggagggaagaguuggaagagcuuugucuguggcuugggugccagcucagccacaguagaauagagcaccagguagauuacuaagguuuccaacuccaggcccugguucccagaugguaucugugggccugccuggggccaaaaggaauucugcuacccugaauggaaggcaacugauuguaggguccuagggccuugagugaacguaggcaguagccaagcagugguuacugcaggccuugggcaagacccagugcuguguuagcuucagaucugacauagcacugucccagcgguggugguggccacagaagugcuugugucacccuucccccaguuccaggcagcucagcacaaagaaagagacuccauuuauuugggagaaaauaagggaagagaguaagucuugccugguaaucuagagaauucuucuggaucuuauacaagaccaccaaggugguaccuuuaugaaucugcaagagccauagcauuacugggcuugggguacccccuaaugcagauacagcuacagugaccaaaaaguuaaauuaugacaacuaagucccuucaaauaccuggaaagccuucacaagaagcacagguacaaacaagcccagacagugaagauuauaguaaauaccuaaaucucauaccuagacaucaaugaacauccacaagcuucaaaaccauucaggaaaacgagacuccaccaaacaaacagaauaagccaccaaggaccaauacuggagggauagagauaugugaccuuucggacagagaauucaaaacagcuguuuugaggaaaaucagcaaaauucaagaaaauagaaggaauucagaauccuaucagaugaauuuaacacagagacggaaauauuuaaaaauaaucaagcagaaaugcuggagcugaaaaauguaacugacauacuaaagaaugcaucagaguucuuuaacagcagaaaugaucagacagaagaaagaauuagugagcuugaaaacaggcuauuugaaaauacacagucagagaagacaaaagaaaaaggaauaaaaaagaaugaaacaagccuacaagaucuagauaauagcuucaaaggagcaaaucuuagaguuauuggccuuaaagaggaaauagagagggagaugggguagaaaguuuauucaaagggauaauaacagagaacuuuccauaccuaaagaaagaugucaauauucaaguacaagaaaauuauagaacaccaagcagauuuaacccaaauaagauuaccucacgacauuuaauaaucagacucucaaaggucaaggauaaagagaauccuaaaagcagcaagagaaacaaauaauuuaaaaugcagcccuaauacaucuggcagcagacuucucuguggauaccuuacaggccaggagagaguggcauaacauauuuaaagcgcugaagaaaaaaaaaaaacuuuuauccuagaauacuauauccagcaaaaauaucauucaaauaugaaggacaaauaaagacuuucccagacaaacaaaagcugagggauuucauaaacaucagaccuguucuacaagaaaugcuaacaggaguucuaucugagagaaaagagcauuaaugagcaauaagaaaucugaagguacaaaacuuacugguaauaguaaguacacaggcaaacaaaauauuauaacacaguaauugugcugcccauaucuugcagagaaagaauaagagcugaaccaauaaaaaauaauaacuacaaccaguuuucaagacauacacaguacaauaagauauaaauagaaagaauaaaaaguuuaaaaguagggggacaaaguuaaaguguagaguuuuuaucaguuugucuuuuuugcuuguuuguugguuuaugcaguuaguguugucauugguuuaaaauaauggguuauaagauauuauuugcaagccucaugguaacaucaaauaaaaaaagguacaacagauacacaaaaaauaaaaagcaagaaauugauacauacugccagagaaaaucaccuucacugaaaggaagaugaaaaggaagaaaagaggagaggaccacaaaacaaccagaaaacaaauaacaaaauggcagguuaaguccuuaguuaucaauaauaacauugaauguaaauggauuucacucuccaaucaaaagacauagaaugguugaguggauuuaaaaaaaaaaaaaaaaaacaaaugaucuguugccuaccagaaacacacuucaucuacaaagauacagauagacugaaaauauagggauggaaaaagauaucccaugcaaauggaaaccaaaaaagagcaagaguagcuauauuucagacgaaauagauuuuaauauaaaaacuauaaaaggcagucacgggucacaauaugauaaaagagucaauucagcaagaggauguaacaauuuuaaguguauauacacccaacacugaaguacccagauauauaaagcaaauguuauuagagcugaagauagauagaacccaauacaauacuaucuguagacuucaacacuccacuuucagcauuggacagauuuuccagauagaaaaucaacaaagaaguaucagacuuacuuugcacuauagaccaauuucauccaacagcugcggaaugaauacacauuauuuuccucagcacaugagucauucucaaggauaaaucauguguuaggccaccaaacaagucuuuaaaacauucaaaaaaugaaauuauaucauguaucuucucugaucauaauggaauaaaaucagaaaucaauaacgaggaauuuugaaaacuauacaaacacauagaaauuaaacaauauguuccugaauaaccagugggucaaugaagaaguuaagaaggaaauauuaaaaugucuuaaaacaaaugauaacagaaacacaacauaccaaaaccuaugcaauacagcaaaagaaguacuaagagaaaauuuuauagcuauaggcaccuauaugaaaaaguagaaaaaacuuuaaacaaccuaacaaugcaucuuaaagaacuagaaaagcaaaagcaaugcaaacccaaauuaguagaagaaaagaaauaauaaagaucagagcagaaauaaaugaaauugaaaugaagaaaacgauacaaaagaucaauggaacaaaaaguugauuuuuugaaaagauaaaagugacacagcuuuagucugaauuuuaagaaaaaagagagaagagcaaaguaaguaaaaucagaaaugaaaagggagacauuacaauugacaccacagaaagucaaaggaucauuagagaccacuaugaacaacaguaugcaaauaaauugaaaaaucuaggagaaauggacacauuccuagacacaaccucccaggauugaacuaugaagaaauccaaauccugaauuaaccaauaacaaguaacaugauugaagccauaauaaaaagucucccagcaaagaaaagcugaggaacccauggcuucacugcugaauguuaccaaacauuuaaagaaguacuaacacaaauccuacacaaauuauucugaaaaauguagaaggaaauacuuccaaacucauucugcaaggccagcauuacccugauaccaaaaccagaaaaaaacacaucaaaaaaagaaaacuagaggccaauagcccugaugaacauugauacaaaaauccucaaggaaauacuaacaaaucaaauucaacaacacguuaaaaagauaauuuauaaugaccaagugggauuuaccccacggaugcaaugauguuuaaacauacacaaaccaaucgugauacaucauaucaacagaaugaaggacaaaaaccaugugaucauuucaauugaugcugaaaaaauaaaguggaugaaauucaauaucccuucaugauaaaaaaaaaacucucaaaaaacuggauacagaaggaacauaccucaacauaaugaaagccauauaugacagacccacaacuaguaucauccugaaugaggaaaaacugaaagacuuuccucuaagauucggaagacaacaaagauguccacuuucaccacuguuauucaacaugguucuggaaguccuagcuugagcaaucagaaaaaagaaggaaauaaauggcauccaaauuugaaaggaaaaagucaaauuauccuuguuuacagacaauaagaucuuauauuuggaaaaaccuaaagacuccaccaaaaaacaaacucuuagaacugauuuuaaaaauucaguagucgcaggauacaaagucaacauacaaaauguaguagcauuucuauaugccaacaucaaacaaucugaaaaauaaaucaaggaaguaaucucauuuacaauagcuauaaauaaguuaaaauaccuaggaauuaacuuagccaaagaagugaaagaacucuauaaugaaaacuauaaaauauugaugaaagaaauugaagaggacaccaaacaacuggaaagagagcccauguucauggacuagaaaaaucaauauuguuaaaauguccauacuacccaaagcaagcuagggauucaauguaauccuuaucaaaauaccaaugacauuguucacagaaauagaaaaaacaauucuaaaauguauauagaaacaaaaaugcccagaauagccaaagcuauccugagcaaaaagaacaaaacuagaguaaucacauuaucugacuucauauugcugaaaaaauuaaguggauaaaauucaauaucccuucaugauuaaaaaaaaaacucucaaaaaacugcauacagaaggaacauaccucaacauaauaaaaaccauauaugacagacccaccaacuaguagagcuacaguaaccaaaacagcaugguacuggcauaaaaacagacauauacaccaauggaacagacuagagaacccagaaacaaaucuguacaucuauagugaacucauuuucaacaaaggugcaaagaguauacauuggggaaagaacagugucuucaauaacgcugggaaaacuggaucuccauaugcagaagaaaaaaacuagaccccugccucuuaccauguacaaaaaucaaaucaaaaugaauuaaagacuuaagucgaggaccucaaacuaugaaauuacuacaagaaaacauugggaaaacucuuuaggucauugaaauaggcaaagauuucuugaguaauaccccagaagcacaggcaaccaaaguaaaaauagacagaugagaucacaucaaauuuaaaagccucugcacagcaaaggaaacgaucaacaaaacgaagagacaacccacagaauuguagaaaauauuugaaaacuauccaacugacaagggauuaauaaccagaauaaauaaggugcuccaauaacucaauaggaaaaaaaauuuaguaaucugauuuaaaaaugggcaaaagaucugaauagacauuacucaaaagaagacauacaaaugacaaacaguuguaugaaaaggugcucaacaucauggauuaucagagaaauguaaaucaaaacuacaaugagauaucuucucacuccaguuaaaauggccuuuauccaaaagacaggcaagaacaaacacugggcugggcacaguggcucaugccuauaaucccagcacuuugagaagccgaggcagaaagauuucucaagcccaggcauucaagaccagccuaggcaacauggcaaaaccuugucuacaaaaaaaaaaaaaaaaaauuagccaggcaugguggugcaugccugugguccuagcuacuggggagacugaggugggagggucaccugaaccugggaguuccaggcugcagugagcugugaucaugucacugcacuccagccucuccaaccugggugauagagugauagagugagacccugucucaaauuaaaaaaaaaaaaaugcuggcaaggauauggagaaaauggaacccucauacaauguuggugggaauguaaacuaauacaaccacuauuggagaacaguuuggagguuccucaaaaucuaaaaauagaguuaccauauuauccagcaaucccacugcuaaggauauacccaaaagaaauaaauucguauauugaaaagauauucgcacucccauguuuguugcagcacuguucauaauagcuaagauuuugaagcaaccuaaguguccaucaacagaugaagggauaaagaaaaugugguacauauacacaauggagugcuauucagccauaaaaaagaaugagauccugucauuugcaaaaacauggauggaagugggggucauuauguugagugaaauaagccagguacagaaagacaaacuucacauguucucacccauuuguaggagcuaaaaauuaaaacaauugaacucaaggagguaagagaagaacaaugguuacuagaggcugagagguaggguugggagaaaaauggggaugguuaauggguaccaaagaauacuuagaaugauuuagaccuaguguuugauagcacaacagguugacgacagucaauaauaauuuauuauacauuuaaaaauaacuaaacaacuauaauuggaucauuuguagcacaaagaaaggguaaaugcuugagcugaugaauuccucauuuacccugaugugauucuuaugcaucauaugccuguagcaaaauaucucauguaucccauaaauauauacaccuacuauguacucacaaaaauuaaaaauaagaaauuucuuaaacuaacauuuuauauaacauuuacacuuaauugcauaaguagaaguaugccucauauuuaaaauauuacuugggacauuuauuacaagacuauguccuucuagauuuuaaaaaagaaaagauaacuauuugaaauaaaugaaucaccaggcauggcaugugccugcaauuccagcuacuugggaggcugcgguaggaggauggcuugaacccaggaauuugagaccagccuggacaacauagugagacccccaaaucauuuuuuuaaauuaaaaaaaaaaaaacuuuaaaaaaaagaauuaaaaaacccucuuacuauaaugcuacuguuggcugaagagguuuggccuagauuaggaagaaaauguacauguucacacaucaguaauucaagugugugggguauauaaagugauauuggggaggagaguacacagauuuucuuuuuuuuacgauaaacuuuugcuggcuuggaggccgccccuguuuuuuuugagagacaagaauaaacacauggaacaacuacaugacaauauagagaaggcuguacccaagagccugguaucacugauaauugcuggggaaauuccaagcacagucugaaugaaagggcagcauaauuuggugaauuguuuuggggaaugaagguuugggugaauaggugaacuaaaaaagaaaacuuucaaagaggaaaucaugcagaaaauucagaagacagaaaugaaugucguguguuugcugugcuguaauugggaaaaugguguuuugguguugugagagcaaagggccaaauucaagcuuauuuugaaauauuuuuuaaaguugauuauuaggaaaaagugacuguagauuuugaaaaaauacugcagaguauuuaaaaaaaauuuuuuuuuuuagaaacacgucuugcccugucacacaggcugguauaugugguacauauacacaaugcagugcuauucagccauaaaaaaaagaaugagaucugguuauuugcaacaacauggcucacugcaacaaagauagcucacugcaaccucaaacuccuaggcucaagcaauccuccugccccagcuuccccaguaccagggacuacagaugcauaccaccacacccaguuaauucuuuuuuuuuuuuuagagauggggucucacuaugcuccccaggcugauuucaaacuccuuaccccaagugauccuccugccuuggccuccugaagugcugggguuacaggcaggagccauagugcccagcccagugauuuuauuuuaaugaggaaggaguggggcuaagggaauuagucuguugauguuagaaaggguuugagggaauuuggaauagaaucuaaaauguugcccaguuaguagacuaaauauuaaggcugagacaaucugaaauagaaccuuauucuauuggacuuguaguuacagugauucucuaucaccuuguucuuauuuuagggaugagaaaauaucuuuagauguaaaaguacuugcucaaaaucacauagaguaaauaagggguggaaggagugggaggaaaaaauguaacugauaaguaccaaaacggugaaugguaggaaaaccagcauauuccaguggccuaaggcuuguauucagccugggagucucuucugcagagucuuggaggcccauaaaauuugacuugcccuccuggugccauggaaguaugagagaagacaguauucacaaccagguuuugauuccauccuccaucaaguuuucucacuuuuuagaaaacaaagcuuuuuccuauuacaggucuuucuaucuucucaguguacacccaagaaaacccaucgcaauagacagaagcccuuaguggaagauuccuggguuuuuguuuuguuuugagggcaaugcugggggacugcuuucuuuuugggcucaaggcuauugagauaccuugagaagcucagaagaaaauauacucuaauuuggucuuucuccaauuuucaauuuguggacaaauaggucccucuuucuaugccgugucuuauuuccccuuuaaacagauuuugaagagaaauaaugcuuguucuuuuuuuaaaauuuuuuuuaccgcacaacacuccuuuauguuucuucuuugucagcagaaugcaugcuaaguguagaacucuaguggcgacugcauaggaagugaaguagaaauuauaguuuacagugugaaauggauggcacaaggcuuuuaucuuaauguaagcauauccauaaguguagccuggauugauuuaagaguauacugaugaugcaaucuuuacaggaagcuucaacugaaauauauggagcugugaaauuacuagguugcuugaacccaaaaucuccaucaacuaaucuuaggcuuauaucauuuguuuaaaccaauaaauagucuccuagguauuuuaaacuaauaauuuuugcauagucuagauuuuccuuuuacuuugcucauuauuuuugcagaaauuuaaauauucuauaugacuuacacccccaagaaaugugacuuucuagguaacccauagaaggggugugugucucaucccuuggcuugccccuuauagaagaccucuucucucuuuauuugaggaguagcucagaaacucagcuggaauucaaaugucucuuuuagaaucaaucugaucacuuuacagccacauuuuguauaaaguuuuuuccuaugcacccaaugauacaaauuucuguccuggaaagggugugugcuaucugagaaaauggagaggaaccaauaauuagauaaacuuuuaugaaagagaaaauaucauuauaaaggccacuagcaaaauccacuccaaaaacaaaccgaaauuguuuuaacuaucuuuuuaaaaauacauauuaggcuggaagucagccaaccaucguuaauaagcucaguuaucacaaacgacauccagugacccaagggcuuggcaucauuaucuccaaucuuguuaaguuugaacauccaaauucucccacuuaaauaacucugaguuuauccuuaaaguguuaaccugugaacuagcaaagccucccucaguaucuuugaccucugaaguauuucuugaauaaucaauuuuacuccucucagagaccaaauaccaagacagcucuggguaauugguuauaugagaccaucaagauaacauggaccuauucaggguccccguauauauaccaaucaaaaagcugacauaaaugagagguugaauuucauugugcuuuaugguuaugagaguugacuuugcauuggcaaggaaaaagagcaguuuacuagugguuuuuucauaauguucuauaaaacugaagaaauguacauucuuguaaucuggagaugagauauuaaucaauuuucuaguuauuuuucauguaguucaacagauuaguuccuauuaaugaaacaaguaucuaggauaaaguucuuuuauguuacuuguauuuguaaacuuuugccuagaaaccaucugaaguugccuuuccaacucacccucucaauaaauaccuugauucaaacaucucauuugucccuuccaagcugacaguauauaaauuagcacugcagccguucauucuuuuaacuuguucuuucccagcugagaguaaacaaaguugaugcuauacagccauucauuccuccuacugcucucuuccuaguugaggcuaaacaaagcugacacuaaacagucauuagcuaucaccucugcgaagucaacuucuucccagccuuucuucuucguccucccacacacccuuagaaacacuccugacaacagcuuugacccucuuuugccaauucugcauuuagacccuuccaguuccuuccacucauuucccauuagaaucugaaaggagcuguugucagucauuucccguuguuuucauaaacuauuuguucuccauauuaaggcauuuaaugauuugauuccaauuccuuuucauuugaucuauuuuaucuuaaauuguacauuuuuaagaauuagaaaguaagugaagaaauuauuucaggauagauaaucuuccuaaaucucaaucaagguccacucccucucucagucaccugauucacuagagaugaguaguauaagucaucucaggcuuaguuacugcaggcuuauuauuuaaagccugcaugucuugaacugaaaucucuugaggaccuggaguuucacuaaccucaccugcagccucaccaacaggcccacucuccuguuucaauuaccuuagcuucuuccuccagagcagaguaccuuauggcaacaugagagaguuccuucuuguuucuaacugaagaugauucuucaauguauccauuauauuuucuaacauucugcagguuauuuuaacaaauggccccuaccuucuuaucauuuuuauaacuguaaugagccaucuaacaacaaaacuguuacuggaauuaagaucucagcucacugcaaccucugccucccagguucaagcaauucuccugcaucagcuuccuaaguagcugugauuacaggcauguaccaucacacccagcuaauuuuuguauuuuuaguagagaugggguuucaccauguugaccaggcuggucucaaacuccugaccucaagggauccacccgucucggccucccaaagugcugcgauuauaggcaugagccaccaugccuggccaggaaugaauuuuuuuuuaccagaaaaauuauuauuuccaucuacuuuuuuguugcauuaugcauaaaauuaugcaaaauauaccaccuugauuucccaucuugaagaacucuguucucucuggaagauugguaaaugugcuauuucccugagccuucuucuuaccauugggugguaaguuuugaucacugaauaugucaguuguaugucauuucucauccucugauuaguacacucugacaagauuuguaaaaacaucauuuugguuuuacuuuguuugaauacuuuuguuuuugguauaugccaacagaugguugagguuuacacugaaaucuaaugugaacuuuagaauuugugcuaaaauagacacacuauucagggguuucucagguucuuccaucucuaucagaugcuucuuacaucaaauaaagaauaguaagaaauaguuguuuuucuagacuaucuuacaauagcauuuuaagguaaaaagucuuuaugggcauuuaagaaggaaaugcauaaacaaaguuuuaagaaaacuucugcugaaggauugggcuuaauaggaaugaagaaacuaugcuaucuaacuggaauguuguauaauccaccuuucuuagaauuccuuuuucauuucucaaaauacaacucauuaaaaaucaugauauuuauacggacuucucuucaugaagcuguuuuggagcucuccaugaagaugcucaauaguuugcuuuuuaaagaaaaaccuuauggaaauugaagauuaguuuucuuuuuuucuuucuuucuuuuuuuuuuuuuuuuuuuuuugagacagugucucacucuugucacccaggcuggagugcaguggcgcgaucucggcucaccgcaacuuccgccuccuggguucaagcaauucuccugccucagccuccugaguagcugggauuacggcaugcgccaccaagcccagcuaauuuuuguauuuuuaguagagaugggguuucgcuauguggccaggcuggucucgaacuccugaccucagguuauccaccuaccucagccucccaaaguggugggauuacaggcgugagcaacugcacuuggcaagaagauuaguuuucucaacaaauucuuaccuuucauuguaauuaauauuagaagugaacaucuuugaauuccucauauugauuugugucucucauacugaugaauggauaacaaucagauugacugugggaauagaagugauuuguuugaagaccacugcacccuuaggaaacaaauauaugaacuuacagaaggcuaaaaaaucugugauaauauuugugcucauuuguaauacaggcauagaaaaauguauguuagaacugaaagagagcauccagcuuaaucccuuaauuuuacagaagaggacucugagcccaaaaaugaguggcuucuuuaagguuauauagauaaugaacaugaaacccuggucuuaaugaucccacguucaguguugcuuucaccaaaaugcaaccaaaauauuuuuaaauacugcuggaauuauauuuaagcauauagaaaugcccauuuauugacugaaauccaaacauuucuuuuuuuuuuaauauuaucaggcuuacuucuuugagaaguccauaucauuuuucuugguucucuaguggugauauuaaauaucuugguuuucaauucaauaucacauugaaaguacuucauuuauacuuuguguccaaucaauggauaauagcuuuuuuguccacaaagcaucuaauuucuguuuuagaugauaaacuccuggacagcaaggacauugacaauuuccuauuuggcacagcucauauaaagugcacuuugggacccuguuuaaagaaaaugucuuaacaugaagggccacuucuuucaaguucuuaucuuauacaaugucuuugcacucuggggcaacccugugucuguguucuguguggcauauacucccugcgggcauuugcuaagugauagucaugauaugguuuggcugcguccccacccaaauuucauccuuuuuuuuuuuuuuuuuuugagacagagucucacucuguugccccagcuggaguccagcagcacaaucucggcucacugcaaccucugccuccccagguucaagcaauucuccugccucagccucccgaguagcugggauuacaggcaugcaccaccacgcccagcugauuuuuguauuuuuaguagagcuggaguuucaccauguuggccagacuggucucgaacuccugaccucaggugacccgccugccucggccucccaaagugcugggauuacaggugugagccaccacaccuggaaccaaaucucaucuugaauuguaguucccauaaucaccacguguggugugagggaccugaugggagguaauugaaucaggggggugauuacccccaugcuguucucaugauagugaguaaguucucaugagaucugaugguuuuauaaggaguuuugccucuuugcuuggcacuucuucuuccugcugccaugugaagaaggauguguuugucuccccuuccaccauaauuguaaguuuccugaggccuccccagccaugcugaacugugugucaauuaagccucuuuccuuuauaaauuacccagucuuggguaugucuuuauuagcagcaugaacuaauacagugaguauaauaggaauuauuauucuaguucgguuccaucuauuuccuuuuaugaagccugcucuucuacaaacuagcugaagaagcugaucacauggaagguauuucauuuuuauacagucuuuaaaggucuacuuucaguucaucauaaaauacaaccuaguuauggaaucugaaaauuggaagaaacacuggaaagcaaucuuuguggcuacccuggaaaaauauuuuaaauaaaaguuugacaauccucaacaaccuccuucaacaaguaacauugguuacaaccacuaaaauuaguuauuuuauaucugguauaaauccuuauuauggaaaaggaauccugugacuuauauuuaugucuucuauggaaagauuauuuaacaaaguguuacagguaguauagaucaugaauagguagaaaaagaauuucuguuuucuuaagaucuuuaaaggccaggcaugguggcucaugccuguaauucuagcacuuugguaggccgagauggguggaucacuugaggccaggaguuugagaccacccugggcaacauggugaaacccccucucuacuaaaaauacacaaauuagccaggugcgguggcgugggccuguggucccagcuacuagaaagccuaaggugggaggaccguuugagacugagaagucaaggcugcagugagcccggaucaugccauugcacuccagccugcaugacaaagugagacucugucucaaaaaaaaaaaaaaaaaaggauacagcuagggacuaaauuaagccuugcauuugaauucaggagccacucuucuggaagccaaggcuuguuaccccccacaacccucccaaauuuuagucacuucuauugggcaggggcaaguaaaaccugacagacugucuuacagcuugccugggaacauuuguuucccuauuuacccuucaaagugaaucauucccaagguugacuuuaauuaauucugauguaauucacuuccuuucacuuaauaauuauuaaaaauuucagggcagggugcaguggcucacgccuguaaucgcagcacuuugggggcccagacaggaugauugcuugagcccaggaguuugagaccagccugggcaacacagugagaccccaucucuacagaaaauuuaaaaauuagccaggcgugguggcgugugccucccaacuacuuggggugcugagaugggaagauugcuugaguccagggcucaagccccucacuugagucaaggcugcggugaguuaugaucacgccacugcacuccagccuggaggacaguaugagacccuauuaaaaagaaaaauaaaacaaagaaacaggacgagaaaauacauauauguuucuuaagguaguuauugaaagauuuuuuuaaaaaauugagacagggucuuacuuugucaccaaggcuggagugcaguggcacaaucugggcucacugcagccucgacuuuccaggcucaaaccauccuccugccuuagcccuccaaguagcugggaucacaggcaugcaccaccacacccagcuaauuuuuguauuuuuuguagaguuaggguuucgccauguugcccaggcuggucuggaacucuugggcucaagcgaucugcccgccucagccucccaaagugcuggaauuacaggcaugauaaacugcacccagccccauaaucuuuauagcacuccuuuaccaaagaagaauuacacugaaaauuuagauuuauagggauuauacuguuaacauauagcuggcaguccugagcuggaagcugucuugucauucaggaaauuuccuggagaaauaaccuuccugauuccauauuccugggggcaacacaauugaagauggagggccagaagaaauacucaagucagaaagcugcacagcauucagacaaaaucugguuggagaggaaagcuguuuucauaauuuagcgagcuuccccagcuagccuguagguggguguguuuaacagaagaaagcaaugggaacccgccugucagccagccuuucgagcuaauuagcucagcauacaacaaagauaagugagccugggaagagggcccccugaggggucuuuagauucugggaaaugucugauuggcagauguuaaaagggauuccuugguaauccagugcaucaaugagcugcagaaauucagcccaggacugcaagaauucaggcaugaggacacucuguacaggaggcucacacaggcagacccaagauggacagaaccuuggaaucucugagacacaucauugcccaagucuugccucacagagauccggcucuagucuucaaagacuguaaguacugaagggggaaaaguuuuuugacuuuuuagaaaauaguccuaaacgucaagucacauccuauuuaaguaagauuucuccuaaaucucugcagucguaugcuguguucuaagugauauuuuaacuuguuccugacuucagccagaagaacgauuucauuucaccuacaggcauuaggcacuggguuauucugucagugauacaucuugcuaacuacuuagaagucucuucuacaauccaagaccugccuaagacuuaaugaacuuuuucugaugcuuuuuaaguaaagcaaagcugacugguguugagauuaaaccuaaaaauaauuuggaaaugauacuagaauauaucaauauuuguuaaccuguuuaauacuccacaacacauauuagcuauguuaauucaaguaucguguuugucugaaaauauuuguugcaaaccagaauuaacaguaaaucaccacugaacuuuuaaauuuugauaacagauuauaaugcuuuaguuaaaaggccaauaaaaugagaugccuccuaaccucagcaacacucccuguguggacccccuaccaccaucaccaauuuauacagcauggcaaaguuauuucaaaaucuuuuuuuuaaugauuuaaaaauaauucaaucaagauuuccaauucuagcaauacuauuaaaccauuugucauauaacuucguuucuggaaccaauuugauuuccugcugcugcaaaacagacuaucuucauguuguaucuuaucuacaguggguuucauauuacaaagggcuucugaaauagaacugcccaaaagguaaaaugcauauggaauuuuuuuuaacuucaauagguugcagcuuuccucuuugugaaucuaguuguguuugucuccaucaaaacaucaaugguuugaauuuuugcuuucugauugcugaauaacguuccauuccagauguccucuuagcuuagauuucucauauguauguugaagaaagaggaauguuaggccauuuaauucuauaaauuuuuccucuuagauguuaaauuguaaccaaucuguccuuuaaggcauaaagugaaagccuuuucuuucucuagcucucuuuuuaaauauugucuuuaggcauuugccaauaacuauguuagaucuaauaaaaaucacucucuccacuacucuagccuggagucuauucagguuuguuauguuuuuuaagcgaaaaggggaggaaagaaugucucucuccuacaauagaacugauucacuagugagggauaaaagggcucucgggcugcccaagcuuuggauaaauuguauaggaccaggguucuuaugcugagcauuuaaauaggggaagcaguuaaaaaaaaaauaggggggacguuuuucacuggcccauugaaaacuuaauaaguucaaaugugaaacuguauagcucauuuuuuagcugaacuaaauugcugcgauuguuuacaguuuagaaaagaagauagacuagaaaaaggauuacaauaaagcauacauuaaguucugucauccaggacuuugcaggacuucuuuuauaugggagaacaaauaaguguccuguuuuauauauuucauucauuaacauagaaccuauauuugaccagagagcauugccuguuuacccuagaauggacugcuacucggcaacugcuugcauggcuuaauagacgugaauauuaaacugccgauucucucccuucuuuucuaaucugaaaaaugacuaaaugacaguaagccaaauggcacauuucuguaccaggaguuuuccuaacuuuaaaacauccaaccacuuaccaaucucguggaauaagugggaaugggcugcuuacuuucugggacaggacauuaaaagucugucuggagccuaugccauugcccuggcaagcuguaggugcugcacacgccagaguuuggcauauggucccauuuucuuuggcauacccauaaguugcugccaccacacuccuauuggcagccuguaaaaagcugccaccagccuugaauggcagguucugagcaguccccucuccuccuagucacugcuggcuccuccuccacucuaaccugcuccaagcucuuucugccagaaggaaagagcugagcacuugagcacaucacugccaauuccuuaagaaaaauugcuaccuuacuuuccuacaagaugaaagcugauccaagaauuuuuaaaacccagcccaguugaacaaaagaauaaacacacacaaacacacaaacacacacacaugcacacacaaaacacuuuuaaauuuuuucuuaauuuaucuuccaugaaugcaaacacaguuuuucucucuucacucuuugguuauacauaauccagggaguguaaaugaucaugcaauucauuuauugcccucaguuggcuuuugauuugcuuaaaaacaagcaauaguaacugaauuuucucuucaaguugguuagaaaaagcacccagagaguuuucuggucugaaacagaugcacaugggaauaguuacauucauuuaaagaaauaaaauucaaaugcuuucucagaugaggaagcucuucaaaugguauuuugcaauacauuaaaccugucauuuuauuuuauacaaggcguucaucuggcaauaguugugauuuguuucuuuuuuuauuuucucuucuagaaggaaauaaauuccauaacacuuuuuuccuuuucccuauuucacauuucauaugaaaaauaauggaaagagguuuuaaauaagauggacucccaauuugaaauuuguucaucuaagcugacacuggacuguucuccccugcauaaaugucucuauuuuaaaacaaguagcacuggaagucuccacacuaccaggcagaaucucugcaaaguauagcuugucuccauauugcuuuccauucuuggcuuugugcaauauccaauuucguuucaugugucaugcaucacaaccaaagcugagcuauccuaaaagcagccccuguccacucuuuugaagaaguguguuaacuuacuauucauuugccacuguuugacaauuccuugcguacuuucucaaaagaaaucaccacaugacuucaagauagcuaugcuuucagauccuaaucugaguguuaacucuucauauuacaagagcacaauacauuuaucugccaucuuugagcucuuucuucaaccauuuaauaguaaggcuaagacaucaaguccucaucaugugauaggcacuguacuagaaacauuuauucuucacaguaagcuaguaauguagguacaauuguuguuagaggugaggaaacugaggcacacagagguuaaaaugacgugcccaaggucacucaaggucacacagcuaguaugugauagagccaggaaucaaauucugucuuccaacuccuuaccuugaaacacuaugagacauugccucucagaagugcuaguuaccaugucauuaguguuguaauagcaguacagguugaguaugccuuaucugaaaugcuugggaccagaaguguuguagauuucagauuauuuuuggauuucagaauauuugcauuauauauacuuuagcaccccaaaucugaaaaucugaaaucugaaaugcuucaaugaacauuuccuuggagucucaugucagcaauuaaauguucuggauuuuggaacauucuggauuuuagguuuuuggauuugggaugcucgacuuauaucuguuaggaaaacagaggggagaaaaaggaacucuaccaggagcauagagggagcccauuaaauaaucacauuugaacagaagugugacaagaaaguggugaggggcagauaauuuuugaugagauagaacagcuuguccaaagacaaacugggcaauacaagaaccaugugcugggggaggcagagacagacugaggaggcagguugggucaugcugacaugccggcaauagggagccauuggaguuaacaguaaauuaguucuggaaguuuauggccuuauguugcguugcggaaaaguuuauauugacauugguuagagguacacauccgaauaccuaaguuagggaacacugcagcuuuuucuuagcaagaaaccauuugccaacucagacaagaugcaagauuuguaaaugucaaacaugccuaugaggagaaaccacuuucacugacugaaggccaaaaucagggcaaacuuucucaaaaagauuguuuaaaaaguaucuuaauugucacuguagccaugagaaugaguugguuucuagcauugacuuaugaagugacauguaagauuucacugagauuuuuucccaaauuuuauaaugaaaaaguaagauggauccuuuacuaagcguugaaaaauuggaagcaaauuucucacauauuugaggugcauuaacucuuccauuugggagaacauuuuucugcaugaaagguuuuauuuauaucagauaggugaauacuuuacuucaaagaguacguuuuuugcccuuuggaaaaacuggaccagacuacagggcuauuaaaaacaucuuaguaaucaugaaucuagcuauaugcagcaugagagagcaagaauccucaggagucaaguacuuuauccaccccaugcuuuuuaguacaguuaugugaaaucaauaaauuuauaguuuucacauuucacagaaaggaauggaguaggauguaaaggcugaagauucuugugcaguaaaaucccuauacauauugcauugcauuccaccaccccugaaaaaauacaguuuaaaaccacaaaaaaaagccaaacaaaaauaaacccuauagugcuugcuagcuuauuuuaaaauaaugagugcaucuuaauuacaguaauuugaacucugcuaauuuuagcaucuaaacuauggaugucuguuugacugaagccuauucaaaugcuaauuuuacuuuauuuaucauagggccuaauuauuuuuauuugaauuuauacuaaggaagaaauauaaauuuuaguacagcuaucaauggcauaagagcugguucuuuuuuuuuuucaguaaauauacauuugacagaguuuaaaguuaaauguauaaaagucucaacccuagaagacagguuuucaaacuggaaaaaauagguagcuucuugaucacuuuauggcuuuaucuguccuaguacauuuauuucucauagaaaaguaagauuuaacagaucaaaauaaauaugauagacaccuauccugugagaucaaaucugggaccucuucauugacugcucucccaucucaccagaggucuuugguggugguugcuguuguuuuuaacaguuaagauuuguuagucugaacucaauuuuaacaacuucugaaacucauguguuaaguuacagcccauaauaggauacagaugcauaagggugaguuucuaaguuaugaucuucuguuuaaaugacacgguuuuacugauuaugugcuacagauugauuuaagaaauguaagacaacuuuagaagccuuucauaaaagaaucuucuuuuuguaauacauuucauauugauguuuuaaccccaaacacucuuacuucuuuuccuccauguucaaaugcccauguaaguuuagucugucaagguaguuaaaacauuucuauuuuaaaagaaaaaaaaaagaauccuauugaaagauugacaaaauagacaauuauuacacuccccauaguucuuuauauuuuuuucucuaguguccaugaaauguuugaauuaugguuucgguuuuuuuuuccuccugcgaugauaaucaguugaucccuauuuugaucucaucccguuaagcagcugugagaaaccaucauuucgucaccacuccuuuggcacuuauggccugugcuauuuaguuuacauuucccucauguggcucuguacuaaguguuacagcuucaaugugguguuuuuguccacaccuaaguuguaaguuccaggagggcagagcuguaccuuguacuuuucuguaacccccagguaacucccacaggaacacacaccuagcagugcacaaucagacauuuuuggauugccaaugguugauuuuucuuccucgcaugaaggggguaagauucugcccacugucagguguucuccuuuacgaugaaauaaacugugccaagacccuuuuaagccauuuaucuucugacuccauuaucacaggcuaauuacaugcaggguuaaguugauagccagaugauacagaagacagcaucaagaaagucggggcucuaaagacaaacacacccucucggcuagagcucugccuuggguuggcccuaucacacucucucagaaucauuccauaugccauguuggcacaauggcuuaaauugcccauccuuacauucauccauuagaucuacccccgacugugagucaccaaagucaugcacgcaccaugcucuuuagagccaaacucugugccuugugcauaaacccugguuagauagcuguggcaggaucuugagcauucuuauaaugacuguuuccagggaaggaagaugcauuacacaaagccacauuuacacuuauuugaccauuuugacuaagaagaacugaucagcaaagcaaccagcaugacuaauccuuuauugguugucuaaaaucauugguccucuaaagucucuuuuauuuauuuuuauuuuuuuauuuuuauuaauuuugagacagagucucgcucugucacccaggcuggaguguaguggcaugaucucagcucauuguaaccucugccuccuggguucaagggauucuccugucucagccuaccaaguagcugggauuacaggcgcccacuacugcaccuagcuaauuuuuguaauuuuaguugagaugagguuucaccauguuggccagucuggucucaaacuccugaccucaagugauccgcccaccucggccucccagagugcugggauuacagacgugagccacugcgccuggccuaaagucucuuuuaaauacagugcaaugucauuacccaauagaaugugagaaagauauguacuuucugauuggauaaauaggguacaucaggcuucuauuuuaugcagcuuuugagauugaaugacaucaucugacccaaugugcacauauaaaccacauauguggaaucaggcaugcugcuuaacuaugguauacuuaaaaacuuuuuaauuugucuuugugauucccucuuacaccuucauuaauuuuuccccuucuuccuuaaaaaauuacccugugcuuccaaauauacauaaaauaaguguuauuuaaauuuuccccuaaaaggauuuacaguucaucgguuuuaaauucuaaaggugaaaauuaagcaaaaaaguaugauaucccuuuugcauguuuugcagagucuccugagagguuaacuuuguaaaacaaccugaaggaucauaauuuccucaggaauauguuugggguaaggagugggaaugaaagaagaagaaaaaaagcaaacaaaagaagaaacacaaccagcuuuccaguuggugaagaguuaagcucugaccugggagcguuaccaaaggaaagucccucugcugggaacaaagcaagacuccaagcugucucaguccugcugugugcuguggcuaccuuugaaagugucuacacaaaagaaaaaggggccccgagauuccuacauguuguacccuguguguccacaagauuccauuagccuggccaaaacuuggcaaaggcugaguauaguuagaaacaacuagacagcaacucuguuugucaguguccugggguucagcuaagcccagcacaagacccaaagguaccacauuuuucaacucauuuucaugaauguaaaucagcgucacaccuugagcuuacccuuucaauuguuuaggguuccuuuuccuguugcuccucaagaaaacuaggaaauaacauugguaaaaacaaguuguacaugauugaauugcuaaaauacuaauuaacuuuauuuaaaaauaucaccugcuagggauaauuuaauuaaagguuauauuaaaauauuacauaacauaaauccaucuguucagagguagauaaucaauuuagaaauauggcugccgggcacgguggcucacgccuauaaucccagcccuuugggaggccaaggcggguggaucaccugaggucaggaguucaagaccagccugaccaacaugguaaaacaccaccucuacuaaaaauacaaaaauuagcugggcgugguggcaggcgccuguacuuccagcuacucaggaagcugaggcaggagaaucgcuucaacccaggagguggaggcugcagugagcugagaaagcuccauuacacaccagcugggcgacaaaaguaaaacuccaucucaaaaaauauauauauaugguaaucaucuugaaagccucuuaaugauuuauccuuaaauggcagccuuuccaauuugucuuuguuuucgacaagagaaauucuacccagcuagaauauuuccucauguaagucuuaaagaaauuuguucuuuuuuuucugucaaauuuauaauggauuuuuaagaucccuuuuuguggacaaaugacugucuucuaugcaggacuugugucauauuagguaauugaacuaagcaaugaacuauaugguuucuacuuuccugaagaauacacuguuaugaaaauuaauuuaaaauaaaauuagcuccucaugguaguuuuugcuaggagcaggucuauugccuuuagcauccaugggaaagugaaaaauugggaccaaaaaaauccacauuuucaaauuuugagacauguagcauuuuauccauuuauuuucuggcuauuagggaguucucacuuuaccagugaauguuaucaaaagaucuuucucuuuucuaucccugaacucugcaccuaucuuggaaauaaauagcacaauguguucaguuagagaaucuucagguuguagacuauuucuggacuauuuaaugacuuaguuuccaaaacaggaacaguuaguuucaaagaugcaauaugaagacauauauucaugcccucucuuuucuuccuuuacuuccuccagucacaaauaauagcuaacacucuaguacuuacaaugugugaaguucuuuucugagcauuuuc

SEQ ID NO: 18210 - RNA, 681 nt, Homo sapiens
uagaaugaggaaugaaauguucuuucucauaugcuuauuauauaaguggguccggaacauguucucaccucaagguuaacaaauaccuaaugcaggaaagaaaauacauagccauggucccuuccucaaggacuuuauaauucagugagauguaaagaugagugcuuaaguguaugcaccugauuauugucucuucauugccgcauaagucggaaaaggggaucacuugcagcgaaaaauggccacuagauggcaauaucaccccauagucaccaaacaggauuacuugcaucccuaauuauguucuaccagagggaauauaguacagacuuuuccaagauugauaaagacagcagauucccuuucaccuuugccaaauuaacucuacuagcuauuugcaagaccuguaauuaucuaauaaauuggcuuaaauauauagaagcuagaaaaugccaauuccucuucccucaaaaguuaccugacauucaaauauuuaaauacccuugcuuugcauuuuagauauaucuuugaauucagguauucauuuuguauaaucucucaacuuuuaagcauuuuuauaauguaaaguugaaaacagcuuaauagaaccacagaauguuuauuuuggagucauuuucuuauauucagagcuaugaaagcaaauugggaauaaagccuuau

SEQ ID NO: 18211 - RNA, 7030 nt, Homo sapiens
agaugagauggcaacacugcuuuauuaggccgggccagccaggagcagacacacggcuccucaguacacauucccccaccccugccucggugcuccccacucagggcugggccauggagggggcagcguaggucuggaagcgcuugugcgcucgcuggugcgugagcagucucagggacaugguguccacggccaucuccagcccgggcugcuggguuaucuccacuguguagucauuggccugcagggguggcacaucagcagggucuggggaccgucucccccucccacguaucccaggcuacucaccagcugcagggaggccagcauggaacgacacaccucgaaggccggcuggccagccaccagcuccgcaaagggacaccacucauugagcugggggaaccgugagaccagcugguccccauagguguggaugucaaagggcacaugcugcuccugcacaggggaggggcauguuggcugcggagagaggcaaggcccuggacagacccguggcacacagcucugguucccagcggccccgccucaccugcuccuggagcagaggcugcacuguguccucccagucccugaugcgcuggcucagcucugucuccuggacaaacuucugggagguggcgaugaagagcuccuaggggaggaucagcaggagcuacugccucccaagcaggggccugggcaccgcucaccugucccccuccccuccccgucucccucuaacccaggccuaccacauuccuucgaaccagcuccucguagcucagggacaucggcacugcgucugggaagggguagcugugagcugggcagcuaaggggccacgcucuccccugcccccagcuccaguggccccucagcacuccuagcccgcugcccaccuaccaaggucagcggcuucccuggggucugcucccucgggcuccauguacuccucaggcucuagaaagucaucugcugggaggugggagagugaacagcacgcaggcagcuagucggcaggugccaagccccaccccacccccuggcaggcacccaccugcugcccccaggucuuccagggaauccuccaggugguccuccucugcaggccgcagccacugcucagccaccuguccagagaaagcaucugugaggggcacugucaccucccaucagggccaccacgggguccuagaucacagcugaccagcugggacuugccucccuccucugcagcuuccggagaguuuccaacugcuccuucacguguguccaguacaggaccuccaugucugcagacaaaggccuugugagggcucccucguccuucccaggccccgugccaguccacccaaggcuuugggugacaccaggugggggaagagguaggggaaggagaguaaaacugucuuccccgaggacuucagccucaccugcaaaggacggacccuuucgccgaagccgccugcugucggcauggucugcaucugugaaagaacaugcucagcaccagccaggccaagagcugcccacagcauugggaaaagggugcugauccuccuccacuggcccuggcccagcccccagcucccagugguccggagugcacaccacacccacucacaggcagccagguaccacugguggaaguccugcagcuuggcagcgcccuuccucuugcgcuucugucccagagccuccuccacacaggggggcacagaguaaggccuaccugggggcaaacagggacugucuuagagccgcugggggaucagggugcaaagcccacucccacccccccaccucaugccccaggaaacccagccagggguaccugaguggagguaccuuccacccaauuaccuuucuugaagggcuuagacuccaaggagucaaagggguccaggcucugccaggggucuggagucuccugggcacagagcacaagaaggcgcuggagaaguagggggugcacagccgucccucccaaaggaguaggggaugcacagccacccucccaaaggaagaguaggggguacacagccgcgcucccaaaggaggaguagggggugcacagccacccucccaaaggaggaguaggggguucacagccacccucccaaaggaguaggggguacacagccacccucccagaggaguagggggugcacagccgccuucccaaagcccaggcaacaagugcagugacagccuggggcagagccgaccacacucaaauccuggaucacagaggggaacacuagagagagggugggagcccagagucgcaugagggggucuuuaagagagcaagugcaaagggccacaggcugggaacaccacaggccagcaggagcaagagcaugaugggcaggcagccaguccucgaauccgcccaucccucccugccgggggucagggccccaacacuccuaccuucacgcaggaugcaggcucuggggcccccucccgcucccgcagcauguaccuccugggcagggcagcacucugcaaagacagucacaggguccccacuucuccucuuucuccccucaaggcucuggguaccccaggaacuccaccuuggguuaacaucaagaacccuacaagggucgggcgugguggcucaugccuguaaucccagcacuuugggaggccaaggcgggcagaucacccgaggucaagaguuugagaccagccuggccaacauggugaaacccccgccucuacuaaaaaugcaaaaaaaauuagccgggugugguggcgcacaccuguaaucccaccuacucgggaggccgaggcaggagaaucgcuugaacccaggaggcagagguugcagugagccgauaucacaccacugcacuccagccugggcaaaagaacaagacuccguccaaaaaaaaaaaaaaaaccuacagggaccggacacaguggcucacgccuauaaucccagugcuuugagaggccaaggcggguagaucacuugagcccaggaguucaagaccagccugggcaaugcagugagaccccgucucuacaaaaaauacaaaaauuagccggguguggugguacacgccuguagucccagcuacucgggaggcugagguggaaggaucaccugagccuagagagagucaaggcugcaaugagccaagaucaggccacugcacucuagccugggcaacagagcaagacccugucucaaaaauaaauaaauaaaauaagauaaaaauaaacccugcuaguacucucuggggguauuaaaacaaaaacccuaagaaaaacuuuaaaacacaaacagugggccgggcgugguggcucacgccuguaaucccagugcuuugggaggccaagacgggcagaucacgaagucaggagauugagaccauccuggccaacauggugaaaccccgucucuacuaaaaauacaaaaaauuagccaggcaugguggcgggcgccuguagucccagcuacuugggaggcugagggaggagaauggcgugaacccgggaggcggagcuugcagugagccaagaucgcaccacugcacuccagccugggggacagagcaaaacuccaucucaaaaaacaaacagaaaacacaaacaguggucacgggguacucuucuucaaaacuaggaaaaaugaauagaauaugacaaauauccaugccaucuaccaacuagagugaagaaacguuaacauuuccucuguaugcaucagguugauuuuguuuuaaugaauaaaaaggaaggauuucuuggcucuaggcuggguacaguugaccccggggguugagggaggcagcaauggccuccagacacucccuccuaccagcccgacugcagagaggcgccuuggcaaccggcggccaucccagguugccgugagcucgacagggcucaaauccuuggacgccagcccacuacucugaggagcaucaguucugcucagagaggggaggaacacagaagcugcucuucaaaagggcugguugcaggacgggcugcaagacaggugggcuucugccccagaccaguggucuggggccaaggccauaccacuguccuccuugugcaaggugacucggccccagagccaggguugccaguucacagcucagguucugcaggccuccaugugggucccaccugcugcgggcuccuggacuccuugggcuccagagcggccuugggggccgaggccucaggaagcucuacugccuccucugcauccucguccucgcccccacccaggggcaucgggccuucuggagaggggccuaggcagggagcaagagagugaucagcuccaaggagugccgagaccagacggcaccaaagggacccugauggcuacuuccucccucagcuuuagucacggagcccagaggauuuggcgggugccuugcaccauccucgucgugcuccugugcucugugcucugcuugguucauuuuauuucuuagcaaauguuccucuuuaaaugcagccauccacaucugcccagagaggagacccaggagggcagucagagggcagucagugaaccaagaugggcugaggcucaccgggggcuguggcugcuuccccggggcgaggccucacucccaugggccacagaaggggcaugaggcuggcagcugagagcagccccuuggagcccuguccacugggugcugccucccugguccccucuuuggcugcccugccagucccaccggggagcucucuucucaccuggcuccugggagaagccgagugcugggacagggcuccugcacacggaaacuuccauuggcugcuccucaguccucccggugucugggagagacagggaucagacaaggucagcccagccccucuccaagauggucccugcccgguguucaacaagccucuccaaggggccagcaggagggcagagaccagcagacuccaggccuugggcuggggggagacagcagggcccugagccaggcaccaggucucuggcacugagaccauguuaacuuguaaucaaggcacagcagaugggugggaugagcaccagccaaccugucuagacuagagcaggcacccagagacagggagcucccaagaccagagguggcaagcacagggcaccccacaagaguccaaccagaagacccucccuuccuucccaccaagccccccgcauccaagcccucacccuucugggucccuggcaugggggaaacgcccgcugguuccaugggggacaugcccucuggcuccaacaugaaggccccucugggguggggaacgcacguguucauccugaaauccuuccggcuggccaggaccucacccugacggcugugcuggcaaaaacacgccugcuguagagacccuucccaggcaggccucccuccccgucgcugggcucagaucccuaccuguacaggggauuguuguucuucuccauuucaucaggggccaccagggccaugggcaggagggggaugaugaggaccuccugcauggaggccaagggugggugagccaggcacccuuccacuccaguggagaacaggacccacauggggcaaugacaccuucccacaccccaucagcucaacacagccccagggaaagugcugaccucaccccagccuaagaggggccaggccaggacucacacugggcgucugaucauucuugagauccacguuaguccgggagucagggaagucauccagcgacaggaacuggagggagacagagcucgugggggcggagcccaggcaaacacacagugggcggggaccacaugccaaagaaacucaccucauucucugccuccugggggaccccggagcuggcaaccccauuggcccuguccuccugcaccgaagagagcugcuuggcccgccugagagagaagcacaucccgugggcaucccaggagcugcaggggccucccuggccacaugcagggcagcacagugaguggcugcagaacucaccucuuuccagagaugaaaucaagggccugguagacgagugaguagagguauuccaccuggugaccagaugcaggcagugaggacccagaaaggaggggcccacccccaaggccuucccagcuauccaucggugcccccacgaggccuggccaccaccaccaaaccuccaguacaagaaaccaccaauuuugguuccaaaaauaauucucaaaucaaaccaggaaucucaugagaauuacuuuaccagcugaggccacccacaucucuccucugcccucuaugguccacgcagccgcgagcguggccuucucaacgugugacccugacagcacugugguucccacagugugccucaucacacgguccuugguggugaggccccucgugcuuggcacccacucugccgacggccugcagcccugcugcuccuccgcccgugugcucccgccagcaucaccccagccccuccuccuguccuggcccugcccugucccagcuccugccgccacggggccugcaggacagagcccgucacucacuuccuguccuucuccuccacagaacagaggccccaccgugaggguggugguuguggacuuucuaggugcugacaaugaggcacccacaaguaggggacggggaaggggaaggugggugcagguggcacccugggcuguguccaagugcacacagcaggugucauucccccaagacaacagagcccaacagcacaaaagacccucccugccuggcugugcgauuuuaaauuaaaaauuguucuugguguuggaaggugcugaggaauuggcugagaccugaggagagagggagguaggucacagacgggacgaccacugcaccugccccagaaggagagccgacuguggucccacuggccaccaaaaugccaagaccagcgucaagcagggcccaccuucuuacuguagacgcaggcagagcccuggaucaacaacgcugccucaaugaaguucauuguggucuugccuucgucaaaagaaaugcagaucugauccagc

SEQ ID NO: 18212 - RNA, 2468 nt, Homo sapiens
uuuuuuuuuuuuuguaguuuauguaaaaauuuauuugaccaaaauguagaaaaagugauacuauuacauaugauacaguugcaagaaucuaaaguaaaguguggauuuuauuccauugcacaauuugcuaguguauuuccuggguaguguggugcugaauaaauaggagugggguggugaggugggguggguaagggauucagauaagccagaagcagggugauuuuuagucggaauugcaaacuuuagucggcccccacacgcugcuggggaauguggaauguuccagcucugagauguuaacugagaaaagagaagucaaacaaagccgauacgugcagcccugucuacagaauccuucauuacccaguuuaaucaggaguuucuuggucuuuuauuaacuuggucccaaagaaggaauucaaguccuagauaaguaaaucuucaauuugcuauucccugaaguauggaaaugaagucgggccaauuuuuaaucucugcugccagagaggcccuuucugcuaauagauaaaaacucuuuugcucaacuuaguaaugacuuguagucuuuuggauauggcugaucugaauuggacugaacuccaccauauuccuggugagugggucauuacuggaaugagacauuugcucuucagagaacaacuuuauuuuaauuuuccuugagauugagucucacucugucgaccaggcuggagugcaguggugcgaucuccgcucacugcaaucuccacuuccuggguucaagcgauccuccugccucagccucccgaguagcugggacuacaggcaggcgucaccauaauuuuuguauuuuuaguagaggcaugguuucgccauguuggcugggcuggucucgaacuccugaccucaagugaucuguccuguuggcugggcuggucuggaacuccugaccucaagugaucuguccuguccucccaaaguguugggauuacaggcaaaagccacugugcccggccagagaacaacuuuagaaugaaggaaauaugcaaaaggacaucacaucaaggaucuauuaauuaccaucuauuaauuacuauauguggguaauuaugacuauuucccaagcauucuacguugacugcuugagaggauguuuguccugcaugguggagaguggagaaggaccaggauucuuagguuaaucuaucuguggguuaugacuucccacaauagccacccccggcccccaccagcccuuuuauuggcucuggauggaaaaucccuacccaugugauggucccuggucucuccuauaguuugaccaacaguugacccaaaagguuguggucuucagcguuuuaaucauauccacgacuagauacuggggucuguguucuucaaaguguggggcugccuauucucccaggaaccaaauggccucugucuuaagaaacuaugcuuacuaggaaauacccugccuaccuuaggaauaaaugcaacuuaaggaaaaaauaagagagcugaaaaaguuggugccauuugacaaaaaaagggaaggcaugagauuuaacucgugcucaaagcuucuccaauacaaaauauuuggucauguauucauaauuugcuugacauuuccagcaaagcgaagauggcaauaacaaaaggaacuucuuacaagagaagagaaagacccacggagcuccggaguuucuguuggaacaagacucuucuguuuugcuuauauacaguuaagcucguuuagugucugauccagugucugauguaagcccacguucucuucuuuggccugggcaaguuucucuuccaggucaucaauugucuuuuccaguuuugcaaccguucucucugcaaauucagcacgggucucagccucuuucaguuugucacacagaaguuuaauuucuucuucacauuuguccuccuuuucagaauacuuuucagacgcagccuccagagauuucagauuguuaguaacauucuugaguucuucuucaaggucaccacauuuuaguucagacaccuccacacgcuccucugcccucuccagcucacccuccaggaagaccagcuuacgagcuaccucccaguauuugcggucagccucuuccgcaaugugcuuggccucuuugagcugcagcuccugaauuuccaucuucuccucauccuucauggcccgguuuucuaucaccuucauuccucucucacucucaucugcagcuuuuucugccuccuccagcuucugcggggccguggccagucuuuccugagcccuguccaacuucuccucaacgagcuggaugcgucgguugagggcggccacaucaccuuuagcuuucucgcgccgcucacacucaccgcccagcucccgcugcaggcccugcgcggucuuacgccucguccgccugcugcugcagggccuagaucuggcguuucacugccuccagguagcugaggccggccauggc

SEQ ID NO: 18213 - RNA, 355 nt, Homo sapiens
caugucccagaagcaagaagaagagaacccugcagaggaggccggcgaggagaagcaggacacgcaggagaaagaagguauucucccugagagagcugaagaggcaaagcuaaaggccaaauacccaagccuaggacaaaagccuggaggcuccgacuuccucaugaagagacuccagaaagggcaaaaguacuuugacucaggagacuacaacauggccaaagccaagaugaagaauaagcagcugccaagugcaggaccagacaagaaccuggugacuggugaucacaucccaccccacaggaucugccccagagaaaguccucgcucgucaccagcaagcuugcgggguaac

SEQ ID NO: 18214 - RNA, 3735 nt, Homo sapiens
uagaaagaaagagcaugguaaaaaagccugaaacuuuauuguaaaaaaaaaaaaaaaaagaaaaugaaaaacacucuaaaacccugagcuggcugggggugucgucagagaucagaaggacagggagaaggcucgguaacccagguuggugaagacauccacccggcagcuguugccugcagcugucaggaccuggaggaaagaggggcaugacuggccugcccacaccccugccucccagccgcuccgcggccccugccggacccaccuugcacucaggcgcggcaggcugcugguugaggcugaggcugagcagcccuggggaggagccaggcaccugggccuucagcuccccgcucagcugccacugguugacgcagcggcccuggccagcugacagaaucugcagaggacagggaaggugcucaggggucaggacugaagggaagagucaguggggguggcagaagugagacacagggccucaccagguccugguagaaggugacgugcuucuguggcgcccggauggggaagauggugguggguguggaggaucggaggugccagagggugagggcugggcccccuccacagaccuggacagaaaggugggaguccccagcugugaaccacaggcccacagcugacagggcccggagcugccaucccaucccacagucugcccagcucaccauccagucggaaucaguugccaaacauccaauccagcgcccauuguggggccucgagcacuccugggauggggaggggaggagggaaagaggugaagaccuggagaauucaaggaguugggggagaagaggacaauggccacggucacacccucaccucgugcuuauagaccucgaucgucuggaccuccuuggcugugcgcaggucugcggggaaagaacugugaguggugccccacuugccucagccuccuucacugccaucuugcccuccaaccagccaccugcuuaccccaaagucgaacagcuccauccucgccaccugacagcaccucugggcuccuuucccgcagugccaggcaguggauguagucuguguggccccggaggacccucugcauguagaggggcgaugucaggaggagaccuaggaagagugccucucccugaccuagaccugcucuagggcuccaggacccugcucaccgugaaagucccaguuucaagguccauagugugcaacugacagucucccccagccaggaugagggaauucuccuguggaggagcaggaugaggcagaaagucaaugucaaaucaggauaggcagagggugaaggaucaaaguuuggaccaagaacagucacauggggcucagaccuuggggaccagcagcaaagcguugaucucaggcacuuccaggcugguccuggggaaggaaaggcaaggucagugaggaaguggcuucacccugaugcacccucuauccacguggcccugcucaccuguauggaggcugacgacgccacagcuccuuacagcccuucaaaagagaaaauaccaggugaccucaaaggcucucucuggguccaggcaccccagcccuuucccaagcucgacuccuuaccuucuugagcaucuccgcccaaagccaggccuucaccuccccauccccagcacuaagcagaugucgaucgguggaaaccaugcuauagacgggcccaucaugggcuaaagagaaaugcagaacugagugagccaaucccacccaaaguccugaagccagacuccacagguauacccaccuuggaaagucaccaccggcuucuuacuuuccucuuuggcuucugagcucaaagcagaggacaagcugcagggacagcggaggggacccaggagucagaaacgggggcauccgucccaugagggccaagugccagggcuaauggguggacagcggcagaggguaccugaagauggcaaucugcccguaauuguugccagccgccagaaacuucccacauggugagacgcucugggagaagauggucauauggagccgcugcaaggccuggaacaccucugucugcagggaaagacuggaugaggccugccugggacguaugaaaccucccauccacagauuccucccugcuucccccaaaaccugccaggccucccacuguccugacuucucagccuucuuuugaggcggccccgccccaagccagcaccugcccaugcagucccauggguggcuccaagaagacacugaagaaggggagaguugaggugaugccucagggaccucugagcaagcacccaggccucuccugccagcuuccucaacugacaaauggagcucacagaagauuccaucacaauuagaugagcuaguguauagacaagagcuuuacauggggcugucacucagugcuuaagccggguguggugguucaugccuguaauccagcgcucugggaggccaggaguuugagagcagccugggcaacauagugagacucugucucaaaaaaaauuuaaaaauguggggccgggcgcaguggcucacgccuguaaucccagcacuuuggcaggccaaggcagguggaccaccugaggucaggaguucaagaccagccugaccaacauggagaaacccugucucugcuaaaaaugcaaaauuagcugggagugguggcgcaugccuguaaucucagcuacucaggaggcugaggcaggagaauugcuugaaucugggaggcggagguugcggugaacccagauggagccacugcacuccagcuugggcaacaagagugaaauuccaucucaaaaaaaaaaaaaaaaaaaaaauuuggccgggcgugguggcucacaccuguaauccuagcacuuugagaagccaaggcaggcagauuaccugaggucaggaguucgagaccagccuggucaacauggugaaacccugucucuacuaaaaacacgaaaauuagcugggcaugguggcacacgccuauagucccagcuacuuggagggcugaggcaggagaaucgcuugaaccugggaggcggagguugcagugagcugagaucgcgccacugcacucuagccuaggugacagagugagacucugucucaaaaaaaaaaaaaaagugcuuugcaagaacuagaaaauuaaaaaaaaaaaaaaaguaccucuacuaccccaacauagaaaaacguacugauuuauaauuccuacucucugacuugcguuaagccccugaagcacuucuggguuacuaucccgccccccuggucagagucugagucccacaaauagcccaggcaaaacagggcucagggcacgauucccugcccgccccgucccagccaugcgugaacuacaaaccccagaaggcaacgcgcaccacguccgucucaccugacccagaggcaccgcgagcggcacagcucgcuccaucuccagaacuacaagucccagagugcuccgcgcgcgacgcaaccucacgaggccuuacgugccuagagcgguuccucuccguggcgcccuaccgccuucggcgcgaagguggcuggugcguaccgucccgaacccuaggagccgaggugagcgccgcgaagacccccgacauuaagaagugguguccaccgcagcccccuuaagccggauacccucccccaccccgaggagcaagccugccuuccgccacgcgccgcccgucuuccgcgcccgcgcagaaccucgcggcugug

SEQ ID NO: 18215 - RNA, 3735 nt, Homo sapiens
cacagccgcgagguucugcgcgggcgcggaagacgggcggcgcguggcggaaggcaggcuugcuccucggggugggggaggguauccggcuuaagggggcugcgguggacaccacuucuuaaugucgggggucuucgcggcgcucaccucggcuccuaggguucgggacgguacgcaccagccaccuucgcgccgaaggcgguagggcgccacggagaggaaccgcucuaggcacguaaggccucgugagguugcgucgcgcgcggagcacucugggacuuguaguucuggagauggagcgagcugugccgcucgcggugccucugggucaggugagacggacguggugcgcguugccuucugggguuuguaguucacgcauggcugggacggggcgggcagggaaucgugcccugagcccuguuuugccugggcuauuugugggacucagacucugaccaggggggcgggauaguaacccagaagugcuucaggggcuuaacgcaagucagagaguaggaauuauaaaucaguacguuuuucuauguugggguaguagagguacuuuuuuuuuuuuuuuaauuuucuaguucuugcaaagcacuuuuuuuuuuuuuuugagacagagucucacucugucaccuaggcuagagugcaguggcgcgaucucagcucacugcaaccuccgccucccagguucaagcgauucuccugccucagcccuccaaguagcugggacuauaggcgugugccaccaugcccagcuaauuuucguguuuuuaguagagacaggguuucaccauguugaccaggcuggucucgaacuccugaccucagguaaucugccugccuuggcuucucaaagugcuaggauuacaggugugagccaccacgcccggccaaauuuuuuuuuuuuuuuuuuuuuugagauggaauuucacucuuguugcccaagcuggagugcaguggcuccaucuggguucaccgcaaccuccgccucccagauucaagcaauucuccugccucagccuccugaguagcugagauuacaggcaugcgccaccacucccagcuaauuuugcauuuuuagcagagacaggguuucuccauguuggucaggcuggucuugaacuccugaccucaggugguccaccugccuuggccugccaaagugcugggauuacaggcgugagccacugcgcccggccccacauuuuuaaauuuuuuuugagacagagucucacuauguugcccaggcugcucucaaacuccuggccucccagagcgcuggauuacaggcaugaaccaccacacccggcuuaagcacugagugacagccccauguaaagcucuugucuauacacuagcucaucuaauugugauggaaucuucugugagcuccauuugucaguugaggaagcuggcaggagaggccugggugcuugcucagaggucccugaggcaucaccucaacucuccccuucuucagugucuucuuggagccacccaugggacugcaugggcaggugcuggcuuggggcggggccgccucaaaagaaggcugagaagucaggacagugggaggccuggcagguuuugggggaagcagggaggaaucuguggaugggagguuucauacgucccaggcaggccucauccagucuuucccugcagacagagguguuccaggccuugcagcggcuccauaugaccaucuucucccagagcgucucaccaugugggaaguuucuggcggcuggcaacaauuacgggcagauugccaucuucagguacccucugccgcuguccacccauuagcccuggcacuuggcccucaugggacggaugcccccguuucugacuccuggguccccuccgcugucccugcagcuuguccucugcuuugagcucagaagccaaagaggaaaguaagaagccgguggugacuuuccaagguggguauaccuguggagucuggcuucaggacuuugggugggauuggcucacucaguucugcauuucucuuuagcccaugaugggcccgucuauagcaugguuuccaccgaucgacaucugcuuagugcuggggauggggaggugaaggccuggcuuugggcggagaugcucaagaagguaaggagucgagcuugggaaagggcuggggugccuggacccagagagagccuuugaggucaccugguauuuucucuuuugaagggcuguaaggagcuguggcgucgucagccuccauacaggugagcagggccacguggauagagggugcaucagggugaagccacuuccucacugaccuugccuuuccuuccccaggaccagccuggaagugccugagaucaacgcuuugcugcugguccccaaggucugagccccaugugacuguucuugguccaaacuuugauccuucacccucugccuauccugauuugacauugacuuucugccucauccugcuccuccacaggagaauucccucauccuggcugggggagacugucaguugcacacuauggaccuugaaacugggacuuucacggugagcaggguccuggagcccuagagcaggucuaggucagggagaggcacucuuccuaggucuccuccugacaucgccccucuacaugcagaggguccuccggggccacacagacuacauccacugccuggcacugcgggaaaggagcccagaggugcugucagguggcgaggauggagcuguucgacuuugggguaagcagguggcugguuggagggcaagauggcagugaaggaggcugaggcaaguggggcaccacucacaguucuuuccccgcagaccugcgcacagccaaggagguccagacgaucgaggucuauaagcacgaggugagggugugaccguggccauuguccucuucucccccaacuccuugaauucuccaggucuucaccucuuucccuccuccccuccccaucccaggagugcucgaggccccacaaugggcgcuggauuggauguuuggcaacugauuccgacuggauggugagcugggcagacugugggaugggauggcagcuccgggcccugucagcugugggccugugguucacagcuggggacucccaccuuucuguccaggucuguggagggggcccagcccucacccucuggcaccuccgauccuccacacccaccaccaucuuccccauccgggcgccacagaagcacgucaccuucuaccaggaccuggugaggcccugugucucacuucugccacccccacugacucuucccuucaguccugaccccugagcaccuucccuguccucugcagauucugucagcuggccagggccgcugcgucaaccaguggcagcugagcggggagcugaaggcccaggugccuggcuccuccccagggcugcucagccucagccucaaccagcagccugccgcgccugagugcaagguggguccggcaggggccgcggagcggcugggaggcaggggugugggcaggccagucaugccccucuuuccuccagguccugacagcugcaggcaacagcugccggguggaugucuucaccaaccuggguuaccgagccuucucccuguccuucugaucucugacgacacccccagccagcucaggguuuuagaguguuuuucauuuucuuuuuuuuuuuuuuuuuacaauaaaguuucaggcuuuuuuaccaugcucuuucuuucua

SEQ ID NO: 18216 - RNA, 2889 nt, Homo sapiens
gcaucugggaaaucauucgggaggaggugggagcugggagggggcuccggucagggaggaggccacguuugggagaaggcagaaggcucagucuuagggggcggggcuggccuggagaggggcgaggucugacuccgagucccgcccccaggcgcugcagcaccuccugcccccuuccggcugcuuuggcccauccuugggggcgcucugagccugaccuucgugcuggggcugcuuucuggcuuuuuggucuggagacgaugccgcaggagagagaaguucaccaguaagugugcccuggccugcccagcccugucagcacucgaccuuuucucugcugcugacgaccccaccucuuaucuugcagcccccauagaggagaccggcggagagggcugcccagcuguggcgcugauccagugacaaugugcccccugccagccggggcucgcccacucaucauucauucauccauucuagagccagucucugccucccagacgcggcgggagccaagcuccuccaaccacaagggggguggggggcggugaaucaccucugaggccugggcccaggguucaggggaaccuuccaaggugucugguugcccugccucuggcuccagaacagaaagggagccucacgcuggcucacacaaaacagcugacacugacuaaggaacugcagcauuugcacaggggaggggggugcccuccuuccuagaggcccugggggccaggcugacuuggggggcagacuugacacuaggccccacucacucagauguccugaaauuccaccacgggggucacccugggggguuagggaccuauuuuuaacacuagggggcuggcccacuaggagggcuggcccuaagauacagacccccccaacuccccaaagcggggaggagauauuuauuuuggggagaguuuggaggggagggagaauuuauuaauaaaagaaucuuuaacuuuaaaugguuuggagaggcagugauccccgacugacuccccugagcuggagggagggagugagucagccagccgcgggggcgggggugaggcucugacucacacauucucaaugccuggaacucagccggcaaggaccuggcuggcccuaacaguuuuccagggaagaucuugaggagaaaccccagcaucccgcgccucugcccucuccaccauccccaaaagccccagguuccagacugaagccuuccuuugcucagcaaucuuuauucaguucuucuugggggugggaugccucccuucccaugcucccaccccucccaucccagaacuccguugggcucaguguccucuguugagggaaggucuuggugcccagaugccuacucugcaggagagggaggaaccuugucccuuugcgggagucgcuggucucuucuguuguggggaagaaggaaggugggaggggcacuguccaccagcacucagagcuccauuauguccccagcugggguugcaggguaggggggacugggggugucccccagccucagcagacggagggccucagggaugaggcugccaggauagcgccagagaagcagcucagagcaagggcuccuagaagaggaaaugacugucagggcauggagcugaggcuggccuagcugagcaccucccaccagguccagguccccaggggcuccuggguucccagcacuuuccaaagagccaagaugggaaacaacccagaggucagcuagagcuaaaaauggcacgaugaggcagggccugaggucagcugugaggaccgccugugauucugcagaaggccuggccaguggaggaaccuaccugagugggggcagggcuggggagaaggucaugggggggcugcaguagggguggucauugugcaggcugaguugagagaaguggguggccauguucuccucagacagaaacugcuugcgcagaggcucccuggggagagauggcagagaggcaggcugggauacugacacaggaggcagccuguuggggaccagaggugacagagaucuuguugggagucccucccugcccccaaacucacugcuccuccuccaggcgccgcuuggugcucaugggcacagcuccucggagaggggagcugggaaaaaaagagagccuggugcaccccacccucuuggccccuucccaaggaucugcccgccuaagccugcagcaucagccaggagccccaagcccauuccugucucagcuggugccgguccccgcucuccuggaccauccagcaggguaccucggaagucucgacccucagccgcagccccagucccaucucagcucacgccuaagccccgccgauucgccccaccccguauucauccugcagaccaguccugagcacccagccaaagcuccugcggcccuuggucaggcccacccugguccccuacacgcaccuggcguccaggccccaagucacccccaaggcggcccgcgggaggcgcugggccccucccugggggccucgcugcaagggcugcugcaggaucauuggguuuugggguccugcgggugggaucugggcgacaggggaggagucucugagggcguggccaagagaggaugggcguggcuuuaggcgggcacagccgcgagguucugcgcgggcgcggaagacgggcggcgcguggcggaaggcaggcuugcuccucggggugggggaggguauccggcuuaagggggcugcgguggacaccacuucuuaaugucgggggucuucgcggcgcucaccucggcuccuaggguucgggacgguacgcaccagccaccuucgcgccgaaggcgguagggcgccacggagaggaaccgcucuaggcacguaaggccucgugagguugcgucg

SEQ ID NO: 18217 - RNA, 2056 nt, Homo sapiens
cggccgugggucccugccggccggcggcgggcgcagacagcggcgggcgcaggacgugcacuauggcucggggcucgcugcgccgguugcugcggcuccucgugcuggggcucuggcuggcguugcugcgcuccguggccggggagcaagcgccagguacgcgggacuccggggucggggaaccccgggccggggcucgggagccggacugggugucuggagaacagcgccgaacugggggaacaggcggauguggggaucuggggucagguggccuucaaacagcucgcucccggcugugggaaguuccaucacucuccaagcuucauucacaauccgggccucaguuucucccaccguccaauugggguuggggggggucuucaguuccacaaguccgaaguacuucgaauggagagagaaagugagugagggcgggauguuuagucuaggaaggggcacgcccccagccugguccguacagggucuaacuagccccagugaucgacgaguuggggaggccgucgagaggcacuagggucugugcccucuauaccauguggggugcccccuuccauccggugacuucagugcccagcuaugcggggggagggacuggggucgggcccggugcccaggagugagucacccgccggcggcagggggguuguggggaccugaccccccccacccccagcgucccgcgcuacgcccucccucccggagcugccgugucccggucgggccgugcggucaccugugaggaaugcgcggggagggcgccggugacucacguuauucgagccggccgacccugaccucagaccccagaauagccgagucccgcccccagccucugacccgaggcccccuccccaggcaccgcccccugcucccgcggcagcuccuggagcgcggaccuggacaagugcauggacugcgcgucuugcagggcgcgaccgcacagcgacuucugccugggcugugaguggggggcagggccaguggccagcggaccccagacugggagggaggguggcuggugcgcagagcggggccgagagcuuugcaucugggaaaucauucgggaggaggugggagcugggagggggcuccggucagggaggaggccacguuugggagaaggcagaaggcucagucuuagggggcggggcuggccuggagaggggcgaggucugacuccgagucccgcccccaggcgcugcagcaccuccugcccccuuccggcugcuuuggcccauccuugggggcgcucugagccugaccuucgugcuggggcugcuuucuggcuuuuuggucuggagacgaugccgcaggagagagaaguucaccaguaagugugcccuggccugcccagcccugucagcacucgaccuuuucucugcugcugacgaccccaccucuuaucuugcagcccccauagaggagaccggcggagagggcugcccagcuguggcgcugauccagugacaaugugcccccugccagccggggcucgcccacucaucauucauucauccauucuagagccagucucugccucccagacgcggcgggagccaagcuccuccaaccacaagggggguggggggcggugaaucaccucugaggccugggcccaggguucaggggaaccuuccaaggugucugguugcccugccucuggcuccagaacagaaagggagccucacgcuggcucacacaaaacagcugacacugacuaaggaacugcagcauuugcacaggggaggggggugcccuccuuccuagaggcccugggggccaggcugacuuggggggcagacuugacacuaggccccacucacucagauguccugaaauuccaccacgggggucacccugggggguuagggaccuauuuuuaacacuagggggcuggcccacuaggagggcuggcccuaagauacagacccccccaacuccccaaagcggggaggagauauuuauuuuggggagaguuuggaggggagggagaauuuauuaauaaaagaaucuuuaacuuuaaaugguuugg

SEQ ID NO: 18218 - RNA, 3478 nt, Homo sapiens
ugucccgacacucggccuaggaauuucccuuaucuccuucgcaggugaguccggggcuagugugcguguuggagagacgccucuuggggccgggugcagggugguggcggcguggguaggggugcgugcgaacucgggcugcggccaccuggaugggcgagucccugagggggucggccgguccgcgcccaagccuccgaggugauaggguccuucggggcucccaaggguuaaacgccccuccccccuccccagggacaaagacuccgaaaccccuggcgccccucccccaccugccuugccucucggggcggggcgccccuccccccucccccucaccugggggagcggaccuugcggccacugcagcuauagaaccccuccagggcgcgcggcucccaggcugggguggucgggugggccggggcgcccucggacagagucuuuuucaugcagugcaugaaaaagaaaggggcaggggcacacucagaggggagaggccugggcgccuauaccagcgcggccccgacccuaacucggccagaggccuaagggccggaccugagcgcuggggcaccgugccccagccagucuccccaagguggucugcuccgcccaggccuggggcccccggcuaaugaguagagccugcccuccgaccgcugccggccgggaaaaguuuagguccaagccguacaaugaaaguacucugggcagugggaggccacagcccggcccuagucagaagugauucccuccacgaccuccaacacugaggggacacaggugcaggccagguggcggugggagaacugguguugaggggagucuagcacggcauuuucgucuagaauucauaggaaaaggcccucagccuugaggcuaugcucuccggcgccuagggcaggucagaaggguggggccagggaguuauccacuggcuuugggggaggaacugcuuuuagaugggggauuaaugaugcuuuucuucaucucuccugguccuggugucugccagccugggguguggaaccaaguugugagggacauuggguggugggaggaagcuuaggaucuccaaucuuaguguugaaauuaacaaguuuugguugggcacgguggcucacaccuguaaucccagcacuuugggaggcuugaggcgggcagaucaccugaggucaggaguucgagacccgccuggccaacuugaugaaacccuguuucuacuaaaaauacaaaaauuaagaccaggugugguggcucaugccuguaaucccagcacucugggaggcugaggcgggaggaucacgaagucaggagaucgagaccauccuggcuaacacagugaaaccccgucucuacuaaaaauacaaaaaaauuagccgggcgugguggugagcgccuguagucccagcuacucgggaggcugaggcaggagaauggcgugaaccggggaggcagaacuugcagugagccgagaucccgccacugcacuccaggcugggcgacagagcgagacuccgucuuaaaaaaaaaaaaaaaaaauuagccgggcgugguggugugcaccuguaaucccagcuacuugggaggcugaggcaggagaaucgcuugaaccugggaggcagagguugcagugaguggagauggcaccacugcacucuagccugggccacagagcgagacuccucgucucaaacaaacaaacaaaacaaauggacaaguuuugagccuuaaacucagggcuagaauugaaccauucuacacggaaacugcuuggaaaucgcaccguccugucauccugcuuuuugccgccuugcagccugaucacuggcucuggccuuggacugucauuguauagguuucauccuguuaucuuucauuugcauucaggauagccagggcagggcugcuugcacagucacugucaucagccagugccugucacauaacuagaaagaauaauaaaugcuaaagcauuaaguguccauuuugcccacgagaagugaggcucagggagcaugucuugacugaguuccaggaugugaugaccacuuuccagggugcaugccccuagaguccuguccacauguggccugaggucugggccugccaggccucaccuuguugugcuucugucccaaacacagugcagcuccuucaaccucgccauggccucugccggaaugcagauccugggagucguccugacacugcugggcugggugaauggccuggucuccugugcccugcccauguggaaggugaccgcuuucaucggcaacagcaucgugguggcccagguggugugggagggccuguggauguccugcguggugcagagcaccggccagaugcagugcaagguguacgacucacugcuggcgcugccacaggaccugcaggcugcacgugcccucugugucaucgcccuccuuguggcccuguucggcuugcuggucuaccuugcuggggccaaguguaccaccuguguggaggagaaggauuccaaggcccgccuggugcucaccucugggauugucuuugucaucucagggguccugacgcuaauccccgugugcuggacggcgcaugccaucauccgggacuucuauaacccccugguggcugaggcccaaaagcgggagcugggggccucccucuacuugggcugggcggccucaggccuuuuguugcugggugggggguugcugugcugcacuugccccucgggggggucccagggccccagccauuacauggcccgcuacucaacaucugccccugccaucucucgggggcccucugaguacccuaccaagaauuacgucugacguggaggggaaugggggcuccgcuggcgcuagagccauccagaaguggcagugcccaacagcuuugggauggguucguaccuuuuguuucugccuccugcuauuuuucuuuugacugaggauauuuaaaauucauuugaaaacugagccaagguguugacucagacucucacuuaggcucugcuguuucucacccuuggaugauggagccaaagaggggaugcuuugagauucuggaucuugacaugcccaucuuagaagccagucaagcuauggaacuaaugcggaggcugcuugcugugcuggcuuugcaacaagacagacuguccccaagaguuccugcugcugcugggggcugggcuucccuagaugucacuggacagcugccccccauccuacucaggucucuggagcuccucucuucaccccuggaaaaacaaaugaucuguuaacaaaggacugcccaccuccggaacuucugaccucuguuuccuccguccugauaagacguccaccccccagggccaggucccagcuauguagacccccgcccccaccuccaacacugcacccuucugcccugccccccucgucucacccccuuuacacucacauuuuuaucaaauaaagcauguuuuguuagu

SEQ ID NO: 18219 - RNA, 9029 nt, Homo sapiens
caggcccuggcugcgcccggcugcccuggugggcuacacuguguugucggguguggccggcuggcgugcucucaccgcccccuccaccagugcucggcuccgggcauuuggauggcaggcugcugcccgccuacugguauuuggggcccggggagugggucuggguucaggggcuccaggcucccugcccugcuaccugcgcauggacgcacuggcgcugcuugggggacugguaaauguagcccgucugcccgagcgcuggggaccuggccgcuuugacuacuggggcaacucccaccagaucaugcaccugcugagcgugggcuccauccugcagcugcacgccggcgucgugcccgaccugcucugggcugcccaccacgccuguccccgggacugagcugccaugccagccugcccacagcagccuccuagaguuagcaacaccagguguuccucccaacucgucugcaaggggcuggcuccuuggaugcuuccagcucaugagaugucucagcaggagcccuguucacccguucuucccuguggacugaccucuuccacccacgccguggcgcuccaacuuccuucccugccuuuucccuccaagcuccuauuuuacugugucagcuggaaggaaaccuuucccucuugggaccucuuuacccucugugaccugugggguuagaccagagagggacucuggggucacgucuugcucugagaguucaaguccugccaggccgccagcccagagccuccucacccuauccuguuccucccaccaggccuguggccagucuuccugaucuccaucuuucugcccugcauaccagcccucccagcagccacaagcuugcccgcccuggcucccucugcccagagacuauggaguaaggcauucaggacaaaaggaccaagggggcguggacccgucuuguaccagcuggccacaggcacaagggcugcagcugcuucuuccaggaaacugacacagggagcucagcggccucagauccugggaccccugggccgugccugcccuccaccuugagugccauacucccaacagcuccagguacccaccgggggaugugccugcucaggaaaccucuuugcuccacacagcauggggcuucagcugcuggcccaaggccaggagcgcuggguucugcagcagggcucagccucaggggcguuaagacccuggaugacaucaauaaagggacaggaagggccauguugccacaugagcaagcuugggugcucccaagguucaaauacuuuuuauuagacacggccaggcagagaagaccaugggaguucccgaggggccccagcuuucaagggcgacgggagagacacaggauaaaagguuaaaagugcagaggcagagucuggggcucagguugggucuaggguguccucaaacaggcugaggagguuccgaggcucaaaggaggggaaggagccccgaggaggcucugaguugaugucacuuagguccagggcaucccugggaggagagaguagugacacucaggauccaaaagcuagcccugcccaccccagccccuggaccugcuuaccugggugugcaccugcuccgggggguggaggugcuccccacaguccgggccaggacagccucaggggagagugaaggccugcaggagggcaggcgagacaaggaggguguccagggcuagggagugccggaugaaaccagcucugucccugugcaggcuccaggcucccgccugacaaacaggcagggagccacagucagggacaauaaaaacuuggugcacucugaaagcagcacuuggacagccuucaaaguccuuccaucuggcugcacuccaaggcccccucuguccuuuucagaacacauggacuuggaggcagauuugaaauaaacuuuuaguaaauguaagccuuucuggaacuucuugucugcuaucaagugccccgagggaugaggugauguguuuguaaggaaggggcuaacggcagaguccccaagagcugucugcccugagcgugugguuuccuaauuacagccucucacucaagacaccaggccccagggaccaaggacuuguucccagggcagggcuccccagacuccagaggcuuucucuucccagagaagggacaauguuuuaucccugggcacuggcagccuccacuggggucggggcugcgcggccagccacucccuggggugcuggugcccuaagugugaagccaugcccugaacggccaguccacaugcccagcugcauuaagccuggccaggccacacacccccagucuugguccccuuccccaggaugugaugggggccagguuugugggagugguccccauucaccacgaaucuccauggagccccggugauaucccccaccuucccccuagccccccauacccugcacuugaacccacccuaggcugucgucaucccaguugcuggagaggcugcuguccaggagcaaacugcaggguggugagccaggcgggguggcuggcgggcccaggggcuguagccagcuggcagggugagccagcccaugccagagccagcagagcagggcaagcagggccugugggggagaggagcucaggaugugggugggcggacccccggggcuggggagcagggcaggcagccgccacugucgggagcuuaccugccacagggcccacccucggcucagggccuccgcugccaugcaccacagcacaccccaggcccgcggcugccucaacacaggcagugccagcagggccucggccguggcccgcagcuuggggucuggcuccagcaucaugacaaggacagaacgcagcucggaagacagaccugcccaugaggaagggccacaucggggucccagaacaccgacugcacccugagcccagcagugccuccauggccagccacuaucuccccaggagcccguggcagcacccccucccgcccucaccuacucaccggcagugaacucagggggcagguagcccuggcgcagcugcugccagcccuccccaccguggggcagcuccauguugcaugccacuuccaggauggugaggcccagacuggcagggacgggauggggacagaaaggggcaggguuggcccugggacacagacccaguccagggcugccucuuggaggugggugggagagggcugcugucuucaucagucagggaggggcggaagcagggggaagggacaccccaacaggccugaucaugaacccugggcaggauggggacaucauggaauaugggcucugugcccagggagcccacaagccacaguggugaguccucccagugcccugauggacaggcaccacaguuacugcuggcagguauuacuauccugaugaucagggcagugguuaccaguguggacccuggaacccagcaccuagggccagucucagcuaugccacuugcuagcagugggcuccggcaaggcccuuaaucuggcuguaaauggagugacaauuguuucuccuguggagcugugaggaggcagguuacacaaaguggcucuggaggguucgaggcucacaggcagccugaccagagacgcucuccacuggagggcagggauggcgucucagccuuguggcucugaggccggguguccugggcuaggguggagcuucccuccuggggaauggagcuuccgucccaggaagggccucccacagccugccaaacaccuggcgugccccgguccccaccugaacacauccgcugcugucccauaggagcccugcagcagcucgggggccauguagcgggggucucccuccuggaccucaccagcuccugcuguacccagcuccaccagcaguccgaagucacccagcuugcagcggccccggggccccaggaagauguuggcaggcuugacaucaaggugcaccaggcccuggcugugcagaugggccagggcaagcagcgugucccgcagguagccccagaccugggccucaggcaggcuggcaccccaggccucacaguguugcugcaggcugggcccgcacagcuccgucugcagguacaggaugccgcccuccucccaggccugcuccagccgcacgcagcaugggugcugccccaccuucucguggcugcccaccucggccaacuugcgggcccgguccuuggggccccggaauggugacauggaacgcuuuaccgcauagagccggccguccuccuuggagcgcaccuggaagggaggugguacccacgcacacagugagggugagccacaaguggcacaaucacauagggggacaaccuggcagaccccauuaaggguucacacacggggcacggugguguagcuggcaucugucucagaccccugcccaggguaauaacaaaaccagacaaaccuccaucccucgggcugggucuguggagacccagcgacggaggagccagggccgaccugcacugaccccaggggaccucuuggaugugucacgagguggaaaaagcagcugcagagcaacacaggcagcccaggcuguggugugaaaagugggcuccccugugagaaagcugaccugggggccaauguuguuuguacuuuuuaacaaaauugucuucauacaggacucauacaagggaaaacuccucucuaaaagaaaauauaaaugacuggaaacuguguuuaagaaaagcaagauggcaggcaggggguagcucaaagccugccagccuggggagggcuggccaggcacugcacucagggccagugccagaggcugggccgacucgccaaggacgcugcacagcuggcgccagggccggaggagauggcacaggggcugcugcagggcgugccagacucuggacaaggggccaguaugcacagagcaaccccuggaggggccugcauuggggaugaugggagcagccaagucaaauguggagggagccugugagcccagcagggacaggcuguagggaacggaaggggaucaggcugcccaggacacuguccugccaagggaggugcagaaacacaaaggaggucccccagaugggccuagaagccguccccucacucaccuugaagaccucuccguaggagccauggcccaggcggcugagccucuggaagcucugcuggaagaaggacucuggccggcuugggucauacccagggcucugcagagucucugaggccucgccccggaaugacacccgccggggcugcagcuggugccagccugggguccgaggagggaagaggcggcugaugggaaugcugcccuuggcagggggcggaggugggaggcuccggcugagcccccugggccucuugagggagaauccagguucugcguggcggaaguaggcugggacugggaugggggugccacucagagguggcggggugcccuccgugggcaugggcauggccagugcaggaggcccugggggcagagacagaggcugaguacagggcagcauguccacucugauaccaccuggcccuguggcuccaaagaggccacagaagagagcuaugucuauaccacacacuuauucuacuuuaaacggcaaugggagcaauaagcaccuaccaagaaaaggcagaggacagauucauacucaccugcccaccaggcuguuguauuuuagagaugauagaaacauaagaggaaaaccauggggcccguguucuugagggucuugcagucggguuaagagcaaggcaguuuggagucagacgggcugcgccugcaucccugcccucaucacggccagcucuuugauccuaaacuacacaaccucuuccgagacuacacgggcccacgaucccuuaucuccaauuccaaagugaaaacccggaaucccucaagugucuuucuuuuucauaacugucgugccaaaacccaguuagugguguccacuuccagaauggcagugugugcagcuccguggaccccugccccagugaaacagcacaacugaugacgauuauucaaaagcaagcacugaaagccucugggcauggugcccagggcacacagcaaacaaagguuuacacaagaaaaccugccaaggccugggaauaauggcaagccuguuggcaccugagccaugacacuccugcccucccaccuccagcaccccucuccccccgccuagcacugggggcagguguggccaagaagaagggcucccucucccccagcuccccgucaaggguuaggguguuugcccaggagggccagguucucagcacuucucaacccucccagcuccacauggcagaggcuaaauuccagcugaguguggcagacaggccaggggcuccuuucuuccaccugcccccaagcauagaauagaggcuauaucucaggcccggcaggcugggaacauggagccccagcucauuuguaggaaggaggcuccacacugggagagggcaaccaagaaggccagaggcuccugcccaacccagcgaccugcuccuaaagcaauagcagcacucagagaggugccccgcuguccugcccccaguuccacagcauggcucagacagagauuuagccuagggguagacguaggucauaaauagagcucuccccacccaccaacccccugaaaauuggcuugauuugaaacagugcguagggaaguucaaguuuaaaggggcugucaaaaucaguggaaguuuugguggugcgccauuaagaagagacugguacccgcauuagggcaaccagcugaaccauaggccagcuaguuuaccacagagaaguggagaaagagcuagcuaggaagagccugccugcugucagaacaaaccucacugaccucaaaagccacccugucaaaggagcucaaaauuaauuggaucuggccaggcacaguggcucaugccuguaaucccagcauuuuaggaggcugaggugaguaaaucaccugaggugaggaguucgaguccagccuggccaacauggugaaaccccaucucuacuaaaaauacaaaaauuagcugggugugguggugcaugccuguagucccagcuacucgggaggcugaggcaggggaauugcuugaaccugggaggcagagauuacagugagccaagaucaugccacugcacuccagccugggcaacagagcgagacucugucucaaaaaaaaaaaaaaauuuaauuggauuggaccguggaacacuuuaugccccaagguauuguuuguuuguuuguuuuugagacagggucucacucuguugcccaggcuggagugcagugguaugaucucggcccacugcagccuccgacucccagguucaaguaauucucuugccucagccuccugaguagcugggauuacaggcgugugccaacacacuagaauaauuuuuauauuuuuaguagagaugugguuucaccauguuggugaggcuggugcaccaaaguauuauaaaaaacaauagagcggcugggugugguggcucacgccuguaaucccagcacuucgggaggcaagguggguggaucacuugaggucaagacuucgagaccagccuggccuacauggugaaaccccaucucuacuaaagauacaaauuuuugccgggcgugcuggugcaugccuguagucccagcuacucagaggcugaggcaggagaaaugcuugaacccaggagguggaaguugcggugagccgagauugcggcauugcacuccaacugggcgacaagagcaaaacuccaucucaaaaaaauauacauaauaguaaauaaaaaauuaaaaagagcagucuccaguaccugagggaguacaggggugaggggagcgaugcuaccugggccuggcuggcaggcugcccuccaucuuguggagacucuuccucugacucuaacuaccucagagucccagcccaggguuucuccaagucaggagccaggguguugggauccuggaggucacuggucacaagcacagccuccaggcccaacccuggcacacucggggaccugggccugugcaucuuaacccaguucucccaccgucccugcccuacgacuuacguucuagcaugacuggccuggcccaacagccucaguggugggacgggggaggcaggagcaggggcucccacgugaauccagggugucccugagcuaaggccaggcgggggugaccuccgcagcuuccggggcccugggcgaucgggccgucucgccucacccucucaccaggcccgacacaucugcuggccaccuuucccgguagacgguaaguuccucccaggcagggccgcggcugacuucacuccguggguguggggaagcccuggcgaacagagcaguggacgggcugucacgagggaagaggggcuguugcagaagaagagaggcugucccggggcaggggcugucacggaggaaggacugucacggggagggcggcggcgcgggguugauggacagcaggcggggucuccgggaggggcgaguagggcgggaccgccgcugggaaggggcucgaggcaagggaaccaggaauuggggaggacgggaggcaggggcucgcgggggcgggccugaggggacgcgagcgggccgccggggaggccugaggggcagggguaacgcagaccuggcgaggcggaggggagcggcgagguggccacgccgaggccccucacggcggggucugggcucaccuggggcgacugggcggggcgcggguccgcgagggcccagauuccggguccgcggaggccacgggaccccucggguggcucagcgggccggagucugccgucgacuguuccggacgcccgggcggaggacucccgugagggggaacggcccgugaacgcgcgcggagcugcucgcgccaaaaauuccaaaccggccucgaggcuccucccccuccccagugcagcccgucaggggugcccgggcuccgaggcuccgccccucgugcugcgugcgcgccgccgagccgccccg

SEQ ID NO: 18220 - RNA, 4339 nt, Homo sapiens
ccggccggcgggaacuaggagccugggcggagccuggcguccccucccgcguccggccgcgcccguccuccuggcugcagagagacuaccggccaccgccgccgccgccgccgcgagcugucccugcggcgcgucugccuuggcggagccgaccgcagugcgcucaggcguccggugcguccccagccuccgccccggcgcgggggcgacggacucgcgcgugcgcagcgccggaggggcgcgggcugggacccccuagccagcgcgugcgccgaucgagcgcagggcgaugggugggcgccgggcgccgggcgccaggcagugaugggccuucccgcgcugcggccccacugaggaggaggcucggggacagcaggagcacgggcugcccgcgcggugcggaccauggcguuccuggccgggccgcgccugcuggacugggccagcucgccgccgcaccugcaguucaauaaguucgugcugaccggguaccggcccgccagcagcggcucgggcugccugcgcagccucuucuaccugcacaacgaacugggcaacaucuacacgcacggugagccgcgucccgcaacgcgcuucccacacccccggccgcccuaccugcguugggccgggggcacugaggccgaggagggccccagcgcccaaguccagggcugccccggcccuggcaccgccaguagccgcggugacaaagcugccauugucccgggccgcgcugccagcuuccguuuucccggcgggugggggccgggucaggagaggggagcagaguagggucugagccugcuuaaucccucugagccccagggguagggagcaugguguccggccucuguaaucccagcgcccugggaacccccucccgccagcacccagccgggagaugguguugacugcgaugaggagggcccgggaggagccucccagcgccgccguccugacgcccccgccccaagccgcucugucuuggggcuccgccugguggcggcuccuucuucccccaacaggcguccggccccuccuccgcgccccgcggagcucugcugacacagcccugcccguccuugagcugccccaggcgggcaaggggcccugagcggccuggcccagccugggugccuuucccgagcuuuugccaggccacauucucacaagggugggcagccuucggagccccguuuggccccugggaggccaguacuagaggccggcagggagggguggagaccucccagaaagggcuaggcuggaaucaaacuccccagggagaggucuggggagaugggacaagccccucgaagcccccuucccuucauucuggacuugucuucccccaccuggccucaccccuuuauagaagauaaaaaggcccagugccuccauuugucuggacacuuauggagaggggaggacuuggguugggaagagcaagccaaguggccccgggcuggcaucacugcucauguguccucuucacaacucaacuugagguuucgcugccuuagccuucuccugugaccugcuuguauggggagagcagugugggagugggacggccuaggccuguccucugccauugcuuaccugcugggcucacccggggccggucacucagccccuccaagucuguuuccucaccugcaaaguggggaucauggucucuacuucccagaccauccugagccaugauaaguaaccagugccaaaagccuuuugcccagggccugucucuggccaaggccaggccgccaacuggaugacagcauuaccuggaccugucuugcccuguccuguguugugucugaaccgugguccccuugaggaugugacugaaacuaucugguagaugacugucucccucccuagggcuggcccugcugggcuuccuggugcuggugccaaugaccaugcccuggggucagcugggcaaggauggcuggcugggaggcacacauugcguggccugccuugcacccccugcaggcuccgugcucuaucaccucuuuaugugccaccaagggggcagcgcuguguacgcccggcuccucgcccuggacauguguggggucugccuugucaacacccuuggugagucagggcccaagggaugggagcuggagccaccggcgggagaggcauggggcacgcauacaagccauggguagggaagggcggguggacccucacaaugacaugcccucuccuguucucuccucuugugcaggggcccugcccaucauccacugcacccuggccugcaggcccuggcugcgcccggcugcccuggugggcuacacuguguugucggguguggccggcuggcgugcucucaccgcccccuccaccagugcucggcuccgggcauuuggauggcaggcugcugcccgccuacugguauuuggggcccggggagugggucuggguucaggggcuccaggcucccugcccugcuaccugcgcauggacgcacuggcgcugcuugggggacugguaaauguagcccgucugcccgagcgcuggggaccuggccgcuuugacuacuggggcaacucccaccagaucaugcaccugcugagcgugggcuccauccugcagcugcacgccggcgucgugcccgaccugcucugggcugcccaccacgccuguccccgggacugagcugccaugccagccugcccacagcagccuccuagaguuagcaacaccagguguuccucccaacucgucugcaaggggcuggcuccuuggaugcuuccagcucaugagaugucucagcaggagcccuguucacccguucuucccuguggacugaccucuuccacccacgccguggcgcuccaacuuccuucccugccuuuucccuccaagcuccuauuuuacugugucagcuggaaggaaaccuuucccucuugggaccucuuuacccucugugaccugugggguuagaccagagagggacucuggggucacgucuugcucugagaguucaaguccugccaggccgccagcccagagccuccucacccuauccuguuccucccaccaggccuguggccagucuuccugaucuccaucuuucugcccugcauaccagcccucccagcagccacaagcuugcccgcccuggcucccucugcccagagacuauggaguaaggcauucaggacaaaaggaccaagggggcguggacccgucuuguaccagcuggccacaggcacaagggcugcagcugcuucuuccaggaaacugacacagggagcucagcggccucagauccugggaccccugggccgugccugcccuccaccuugagugccauacucccaacagcuccagguacccaccgggggaugugccugcucaggaaaccucuuugcuccacacagcauggggcuucagcugcuggcccaaggccaggagcgcuggguucugcagcagggcucagccucaggggcguuaagacccuggaugacaucaauaaagggacaggaagggccauguugccacaugagcaagcuugggugcucccaagguucaaauacuuuuuauuagacacggccaggcagagaagaccaugggaguucccgaggggccccagcuuucaagggcgacgggagagacacaggauaaaagguuaaaagugcagaggcagagucuggggcucagguugggucuaggguguccucaaacaggcugaggagguuccgaggcucaaaggaggggaaggagccccgaggaggcucugaguugaugucacuuagguccagggcaucccugggaggagagaguagugacacucaggauccaaaagcuagcccugcccaccccagccccuggaccugcuuaccugggugugcaccugcuccgggggguggaggugcuccccacaguccgggccaggacagccucaggggagagugaaggccugcaggagggcaggcgagacaaggaggguguccagggcuagggagugccggaugaaaccagcucugucccugugcaggcuccaggcucccgccugacaaacaggcagggagccacagucagggacaauaaaaacuuggugcacucugaaagcagcacuuggacagccuucaaaguccuuccaucuggcugcacuccaaggcccccucuguccuuuucagaacacauggacuuggaggcagauuugaaauaaacuuuuaguaaauguaagccuuucuggaacuucuugucugcuaucaagugccccgagggaugaggugauguguuuguaaggaaggggcuaacggcagaguccccaagagcugucugcccugagcgugugguuuccuaauua

SEQ ID NO: 18221 - RNA, 19517 nt, Homo sapiens
cgcgacgcgcguuugcgugcugacgcacgcaguuagucgugcugacgugcagcgcggcccaggcggggugcgaguggcgcaguuggagcccguugcggccccugaggaagcgaggaggcgucggcgucggcugaggcgggcggaccggcgaggcgaggcggcggccccaggcccgagggacucgggagcucgagcagcggcggcggcaagaccucucccccucggaggcggcgggcggaggcggcgggugagagggugagggagccagcgagccgggugggggaggggcggcggccccggcgcgaggccaaagcgcgcggagaacugcccaggccgccgagcuccuccgcgcgcacgcgcgcucgacgcccuucgcuggcgcggacgcccucgccucccuucccccuucccgccguuccugucgcgcgcgggcuucacccccccccgccccucccccaugacaacggcguucgcagccgccuguacucggguucgcgagcgcccuuggugaggggggagggcgcgcgccucggcuucacuccuccccccaacaugugccgccgagguggccuuccugcagcugccguuuucggcccuuaaguggcggggaaggggcggcggcggggggcuugcuccuggacccuugcccccgguuccagaucuccuuuccucgggcuucucuucggcguugggcugcccgugucgggggccucccagacugcgggacgccgcgcagcccccucccccauuccgcaaggccgaaaauaggcccccggcgcugcggggagggccuugaacuucgugggccggauuuaaaugguuuaggauucccggcuaucagccuuugaguuguuaguggcggggagaaaccccaaaucuuaaaaacugugaagaaagugaacguguucaguuuacauuuguaagguagaccgugcguucccuuuuuacacuuuuucaacgucucccgagaauucguguucaaacuaaggaggcuuuuggagaccuucguugggaagaaaacgccagacucauauauaaguuuucugguugguuucaggcguucuuuggcacacagcucuucugaagcuugguuuccacucggcuucaguuaggacgaaucuggaucagaauuucagaguguuguguugucuuucauccuaagugcgugggcuuagggcucuucuaaagcuacuauuuuagcuuucuggguucuuuguguccacucagccgcucuggagcgccccggugcugagcuggcugugcuugcugauguccauuuuuuucgacaacccuugucuccccuuuuucuccccuuuugguaccguuuucuuuuuugcauauuuuacuguugaauucaaauauaucuuucuacuucauuguuagcuuaccacucggauaauuucccaacagaaaaggguguuuuugucuuccuuuguacuuuuuacuuucugcuuuuaacuuggguaacuuuugcauauccacugucuauggcccccacuuuaagaguuuuguaauaucguuugguuuggugauuugugugugguguugaucuuccuacuuucugugucuuaacacaccccuuagaugccguggggucgucgucuuuuuuugugggguggacuagguggcucauucccuaaaaguucuccgaaacauugugaccuaauauccuuugcuuagcaccuacugguuuuucuuuuuuuuuuuuuuccgagacggagucuagcucuguuggcaggccggagugcaguggcgcgaucucggcucacugcaaccuuccgccucccggguucaagcgauucuccugcuucagccucuggaguugcugagauuacaggcaaucgccgccgcccagcuaauuuuuguauuuuugguagagauggaguuucaccguguuggccaggcuggugucaaucuccugaucuggugauccgcccaccucggccucccaaagugcagguguuacaggcgugagccaccguacccggccugguuuuccuuucuuaaggaguggggggauuuuugugugaggugguauggaagugugggugaaugguuaagcugaagaauuaagugcaggucaaaaacaugcugcaggggaagcagaaauuaagugggguaggggagaggcgaagaaggaccuaguuuuaaaccgugaggaggauugguacuagaagaugaaaaugaggauugggguguagagaaauugauuuuuugagccauacaguuuuucauuuuuuccuggauuucugcuugccuuauccagguuuagccucuucugucaccuucugcuuucaauauugggucugcuacugggcuuggguagggacccauccuuaggcgcaugcgcuaguauauuuuuccaaacauuuguaugaugcuucuucauucuggaauuuucuaaaugcauccuucccuucuauccaguucuuuuacaucuuugauuacucucuccgcuuuacguauuccuuaggguuuuuucuuaguaguauuuucucauauaugcauguucuaggaaacuaucuuggagaggaugagggugagaaagagaguauauguaauaggagaaaggaauagaguauguguagccaaggaaucuaaccaggaaagcugggacuugagaauuuuucagaaucacguuaggguugggacaaguugaaaggcuagaaccugggaggaggcaugggguuaacacaggagagaaggaagaggcagggcugagagagaaaaacuaggaagugcuauccaggggauugguggggaaagccaacgguuggacauuaaugaaagugggguguagagaggguuucuacauagauuuagggcaagguauauggagaagguaugggaacgguuggaacagaggaggcugguuugauguguuuaaauagagcagaguugaaaacagguaauauuugacagcuggcaagacagggaggaacugcaaauuguuguaaauccuauugagaggaaggaaauugaaggaauaaaauaucaggauaguugauaggaucuuuaaauauuuggaaucaaggaaauggcccuuaccugggaggugaaguauaugacgauuauccaagguucauguguguuucugaugugcaugcuggccuuuaguuggggugugaggcugcacauucugaaccaacuagucugcuguucagauaccuaggggcuguguaguuuauuucauauucguauaggguggucugaaauccuuagguaaguuuuugggagagucuuuggacauggacuagaggccguugggugccacagaucugugucugguguuuguugugaccaggaggcuuugguugguuaccagagguuaggaauuagaguaguugguaaacacaccacuugugcauuuuggggccaaaggagaacaaaaagggacaguguggagagauuuuagaggaacaagauccuuguuugccuaggguggaaaaagaagaaaauuuagguguagggagggauuauuuagaauucugugcaagggcauugagagaaaggcuguaagaacugggcugugauuugguagaaaggaaauuuggaagggcaaagaagugguuuucuugggagaccaggaggaugguggagcauuauacagcgaagacuuagugugaagaucaauguugaauuagggaugaaggagagcagggacuuggguguggggcgguaagugguuaguuuggggccaggggccugacccgugucuccccgcucccccucaggagcgguggugccccccccgggcacggggccauguacaacgggaucgggcugccgacgccccggggcagcggcaccaacggcuacguccagcgcaaccugucccuggugcggggccgccggggugagcggccugacuacaagggagaggaggaacugcggcgccuggaggcugcccuggugaagcggccuaauccugacauccuggaccacgagcgcaagcggcgcgucgagcugcgaugccucgagcuggaggagaugauggaagagcaggggugagggagagcugggggagagucaagcacugaaugagugcagagcuggggguguuaggugggauguauagggagcuuagggugguugaaagaggccuggcaaagaguugugguaggggaggaggcagaugagcucuagagaagugaaaacaguuaagggacagugcagagugggaaaugagaaggcugugugucuggggcauagaugggagccugagguacuaaauggaggcacgugggagaagggaggggccauugaggaacaaaaauguguuuuaaggaagagaugggaaagcagagaccagguagaggagcuagguaagcugauagguguugucauugguagaaaagaagaagauaaauggauguaaggauugaggccuuggaaaguagcauaggcaggaaaagaggaauuagaagaauacgugaagaagugggaaucaugggcugggaagggaaauuuuggaaaaggagcccauuaaggcagaaaacucuuuuagagcagugguuuuaaacuucagcaauggugauccuuuuauacaguaucccuuacuuuggaaucccaggaaguaaaaggcacauucuuguugaaguuggggaggagcacuuggaacccugcuugcuuaacuuuuuucuuuuggucccugagguguagcauauuuaaaauccacuguucuagagggaguaguaaguagagggaagaaagaugaugggaaaagaucagacagaagggacuuuugggugagcgaaaaguucugugugcgcauggagagggaggggccccuuuugggaaugagggaaauggaaaccugggacuggggaaaguguccugucgagcuuaacccugaagggauuuguucuucagguacgaggaacagcaaauucaggaaaaaguggcgaccuuucgacucauguugcuggagaaggaugugaacccugggggcaaggaggagaccccagggcagaggccagcgugaguguugcgcucucccucgaugacucuggacucuacucuggcugcuggcugcugcugcuguccuuuuccuuacgugggacuuccucccugcuuucgucugccuuucccaugccuuauuuggcuccugcuuauacuuguguucugaauauggcucuguccuuuauauuuccuucagacuuuugcccuucuuuucucuagggucacggagacucaccaguuggcagaauuaaaugagaagaagaaugaaagacuccgugcugccuuuggcaucagugauucuuacguagauggcagcucuuuugauccucagcgucgugcccgagaagcuaaacaaccagcuccugagccucccaaaccuuacagguauacaaggccaagaaaccacugucagcuucuuuucuugauuguaagcuccaugcucuauuuuugucuuuuugcgggcugguuucuucccaaacucuucagauuuuguucuucugaaguugagguguccaaaaaaauguguccaaggguuagucacagugggucacgcgcguaaucccagcauuuugggaagcucaggcaggagaucacuugaggccaggaguuugagaccagccugggcgauguagugagaccccaucucuacaaaaagaaaaaaagcugguugguggcacaugccuguaguccaggcugcuuggagagguggaggcaggagggucuuuugagcccacaaguuggagguuacggugugagcuguguugcugccacugcaccccaccugaggcaacagagcgagacucuuauuuuuuuauuuuuauuacuauuuuuuuagacucugucuuuuaaagaaaagaaaggaauguuuguucuaccacccaucucugcugcuuuucauuuuucccuagccuuguucgggagucuagcaguucucgcucaccaaccccaaagcagaagaagaagaaaaagaagaaagauagaggacgguaaguuaguuggaaagugacucugauagccagaggaccaauccugugguguaccuuucucucuggaaguggacaguucuggcuuccacaaagcaggagauaguugucagggaggagggaguuaccauugaggccucaacuagaagaaauaccugaguuucucaguggggaaguguugaguuugcaguucugcuaauuaagauuggccagcagcauuuuggauucuggaauuuucuuuuucauuuugagguuuguugacuuaaggaguuacuugugcuuguuggagaaagaagaaauaaguccugggcuuaggucuggggcauuagugcuauuaggacauucaaguguuuuagaaaccuuuuuaggagagagauuguaagugggagggccaggaaagaagccaagcaggaugagcuugcuuuugaauccaucuuuagcaggucagagagcagcucuccucgacgggagagaaagaaaagcucaaagaagaagaagcacagguaugaggugggaauacuugaaugacuggagaagguuugcugaauucaggcagagguguuucuuauguuuuuucuucucuuuuuuccaacaggucagaaucugaguccaagaaacguaagcauagguaagagcucuuuaacucauagggggcgcaguggcauguggaguggugauuuuuuuuucuuggagugaagcucaauuccuugaucuuccuugugucaacacucccucuuuccauuucacuuuugguuuuauuuccuuuuuuaaagaaguuacuuuuaacaaccuuuccuuauuucccaggucucccacuccaaagagcaaacguaaaucuaaggacaaaaagcgaaagcggugagugaauuuguggggaauuugcuuaggaaguaagugaacgccaccuuagugggagggaguugaaugaguuaugucccugacugguaaaggguugagggauacgugaggagaauccagggcagguacagcaguacccugagcuguggugguggucuuccuucaggucucgaaguacaacaccagcccccaagagccgccgggcccaccguucaacuucugcugacucugcuuccuccuccgauacuucccgcagucgguaagggguaguccaggaggaagggagggagagggaaugauggguuaauuaauuuaauauuuauugagcgcccacggugugcuaggcgcugcacagaccauucggaagacacggucccugcccucuaggagcugacaggcuaaagcaacaggauggacagacauauacauuuccccuucucuuuuuuuuuuuguuuuuguuuauuuguuauuuuuguuucguucugauguauauggacugccagaauaggggggguggugguuuguucguggugucugggggaggaaggaauccuuacccuggcuuccuuaaucggggaaggcuuccugaaggaggugggcucagaggugaguugugaaugaagcggguagggagugggcuggguggaugguuuggggauguuugggggaggugaguaaagggguagagggagaacgcucuuugggauuguguugggaaaagaagaaccaaaguggacuguacuugcauuucagugaaugauuugaguugugcgacuaaaggcuuuuuggaagaggguuguccaguuaggaaagguggaugggaguuggggaggggguuuucuguucucccuuugagcugauuuccuuccucucccacguccucaauuaacuccugcaggucucgaagugcugcagcuaaaacucauacaacugccuuggcugggcgaaguccuuccccugcuucagggcgacgcggggagggagaugcgccuuucagugaaccagguacuaccagcacacaacggccuaguagcccggagacugcuacgaaacagccuagcagcccuuaugaagacaaagauaaagacaagaaggagguauguuccugaguuggugauguucauuggauugcaaauguauagauuuaggauagacaugugaugugaaagggagagguaauaacuuauuaaaauaaauaaauucaguuuuuuuuccugcauuucucuccuaguucucuuacugcaucugcagaacuuuuaguguuguuacuagacugaauugugaacccuuuagaaucaaaucucacuggauguuagguuuuauauugugucuuguuuauacauagauagaacuggaacaaacguuguaucuuaucuguguacuccguaugaugccucuaguuucuucucuuuuuucauuaaaugcuggucaugucucaccaaaacuuuuuaauccauugcguugccaccaauaguuugaaugaaacacugaaauagucuucaguagucuucuguuccaauuuuaagcauuaaucauuuccucuugcuuuagugauuacagucugaauucuuggccucuaucaucaauuuuccaugucauccaggguuaccuuuccaaauuacaaguugguugaccucagaaacuuaacuacuuccuuauugcuuuugaauuauauuuaaggcuuuuaauagucuggucuuuuucucauuuccuguacucuacccauccugggcugcuuuuuuacucuucacacaaaucauguucucacaucuuuauucaugcuguuucuuuucguuuaauagaguuauucuucaaaggugaaguugccauucgcuuuaggaaacugcuuauuuuuccauuuaaagauaguuuuuuuccauucuuauaacauuuuguagugguauuuguuaaauguaguagugcauuaguuauuugcauuuuguguuucuuuuaguuuuaagauucuggcuauccauauauucauauguuuucaccacugugcuuuauaugauuccuuguuauugaaugaaagugaucgcuuguggucagaggguguguaaaagaaaaguuaucauuggaaaggguguugggaucuuaggggugaugugaaguuuuggcguuuaugaaucccuaucccugcucucucuuccacucuuagaaaucugcaacucgaccuagccccucuccggaaaggagcagcacaggcccagaaccaccugcucccacuccgcuccuugcugagcgacauggcggcuccccacaaccccuugcaaccacccccuuaagccaggagccagugaaccccccaucugaggccucuccaacucgggaccguucaccaccuaagucucccgagaaacuuccccagucuucuuccucagagagcagcccaccauccccucaaccuaccaaaguuucucggcaugccagcucuuccccagaaaguccuaaaccugcuccagcuccagggucccaccgagagauuucuucuucucccacaucuaagaaucgcucacauggccgagcaaaacgggauaaaucacauucucauacccccucccguaggauggggaggucccguagcccugccaccgcuaagagagggcgaucucggucucgaaccccuaccaagagaggucauucucgaucccgaucuccccaguggcguagguccaggucugcacagagguggggaagaucuagaagcccccagcgacguggccgcucuaggucuccucagcgaccaggcuggucuaggagcagaaauacccagagaagaggcaggucuaggucagcaaggcgagggaggucccacucuagauccccagccacuagggguagaucucguucuagaacaccagcccgccggggcaggucccgcucuagaacaccugccaggcggagaucacgauccagaacucccaccaggcguaggucucggucuagaacaccagcccggaggggcaggucucggucuagaacaccugcuaggcgcagaucuaggacccgaucaccaguacgacgcaggucucguaguagaucaccagccaggagaaguggcaggucacgcucuagaaccccagcuagacguggccgcucacgcuccagaaccccagccagacguggccgcucacgcucuagaaccccagcuagacgcaguggucgcucacgcuccagaacaccagccaggagagggaggucucggucuaggacaccaagacgaggaagaucccgcaguagaagcuuaguuagacguggaagaucucacucuagaacaccucaaagaagaggcagaucuggcucaucuucagagcggaaaaacaaauccagaacaucucaaagaagaagcagguccaauucaagcccagaaaugaagaaaucucgcauuucuucaaggcggagcaggucucucucuucaccacgguccaaagcaaaaucucgcuugucuuugaggcgcagccuuucagggucuuccccaugcccuaaacaaaagucacagacaccacccaggcgcagucgcucuggauccucccaaccuaaagcuaaaucuagaacgccacccagacgcagucgcuccaguucuucuccgccaccuaaacagaaaucuaagacaccaucaagacaaagucauuccaguucaucuccucauccuaaagugaaaucuggaacaccaccgaggcaaggguccauaacaaguccccaggccaaugagcaaucuguaacgccacagagacggagcuguuuugaaucaucaccugacccugaguugaaaucuaggaccccuucuagacauagcugcucaggguccucuccuccuagagugaaaucuagcacaccucccagacagagcccaucuaggucaucaucuccacaacccaaagugaaggcaauaauaucaccaagacaaagaagccauucuggcuccucuucuccaaguccuaguagggugacgucgagaacaacuccacggcgaagcagaucaguaucucccugcuccaauguggaauccagauuguugccaagauacagucauucuggguccuccucaccagauaccaaagugaaaccugaaacaccgccaagacaaagucacucagggucuauuucaccauaccccaaaguaaaggcccaaacuccaccggggccaagucuuucuggaucaaagucaccauguccccaagagaagucuaaagacucacuaguucaaaguugcccuggaucccucucucucugugcaggaguaaaaucuagcacaccaccaggcgagagcuauuuuggugucucaucucugcaacugaaaggacaaucucaaacuucaccagaccacagaucugauacuucaaguccagaagugagacagagucauucagaaucaccaucucugcagagcaaaucucaaacaucaccuaagggaggucgguccaggucuucaucuccagucacugagcuggcauccagaucuccaauaagacaagauagaggugaguucucagcgaguccuauguugaaaucuggaaugucuccugagcagagcagguuccagucugacucuucuucauauccuacaguggacucgaauucucucuuggggcagaguagauuggagacugcugaaucaaaagagaaaauggccuuacccccucaggaggaugcuacugcaucaccuccuagacagaaagacaaauuuagucccuuuccaguacaggauaggccugagucuucacugguauucaaagacacacuuagaaccccgccaagggaaagaaguggugcugggucaucuccagaaacaaaagagcaaaauagugcauugccuacgucaagccaagaugaagaguuaauggaggugguagagaagucugaagaacccgcaggccaaauccugucucauuugucuucagaacuuaaagaaauguccacaaguaacuuugaaucaucuccugaaguagaagaaaggccugcugugucuuugacucuugaucagagccagucacaggcuucuuuggaagcaguagaagucccuucaauggccucaucuuggggugggccacauuuuucuccagaacauaaagaacugucuaacuccccacucagggagaacagcuuuggaucaccuuuagaauuuagaaacucaggcccacuugguacagaaaugaauacuggauuuucuucugagguuaaagaagauuugaauggaccguuucuuaaucagcuggaaacagauccaucucuagacaugaaagaacaaucgacaagauccucuggacacagcaguucugaguuauccccagaugcaguggaaaaggcagggaugucuucaaaucagagcaucucuucaccugugcuugaugcuguacccagaacacccucgagagaaagaaguaguucugcaucuucuccugaaaugaaagaugguuuacccagaacuccaucaaggagaagcaggucugggucuucuccaggacuuagagaugggucugggacucccucgaggcacagccugucuggguccucuccuggaaugaaagauauaccuagaacgccaucuagagggagaagcgaaugugauucuuccccagaaccgaaagcuuugccucagacuccuaggccgaggagucguucuccaucauccccagagcucaacaacaagugucuuaccccccagagagaaagaagcgggucagaaucaucaguugaucagaaaacuguggcucggacuccccuggggcagagaagucguucgggauccucucaagaacuugaugugaaacccagugcauccccucaggaaagaagugagucagacucuucuccagauucuaaagccaagacaagaaccccacuucggcagaggagucggucuggaucaucuccagagguugacagcaaaucucgacuauccccucggcgcaguaggucugguuccuccccugaagugaaagauaagccaagagcagcacccagggcacagagugguucugauuccucuccugaaccuaaagcuccagccccucgggcccuucccagacgaagcagaucagguucaucaagcaaaggcagaggcccuucuccugaaggaagcagcaguaccgaguccucuccugaacauccgcccaaauccagaacugcucgcagagguuccaggucaucaccagagcccaagaccaagucucguacaccaccucgacgucgcagcucucgaucaucuccggagcuaacaaggaaggccagacugucccguagaagccgcucugccucauccucaccagaaacucgcucuagaacucccccaaggcaccggagaagucccucagugucuuccccggagccagccgaaaaaucgaggucuucacgccgacggcgcucagcuucaucuccacgcacuaagacaaccucaaggagaggccgcucuccuucgccaaagccucguggacuccagaggucccguucccgcucaaggagagagaaaacaagaacaacccgacgucgagauaggucuggaucuucucagucaaccucucggcgaagacagcggagccggucaaggucgcggguuacucggcggcggaggggaggcucugguuaucacucaaggucaccugcccggcaggaaaguucccggaccuccucucgacgccgaagaggccgcucucggacacccccaaccagucggaagcguucucgcucacgcacaucaccagccccguggaaacgcucuagaucucgagccucuccagccacucaccggcgauccagguccagaaccccccugauaagccgacguagguccagaucucgaacuucaccagucagccggagacggucaagguccaggacuucagugacucgacgaagaucccggucaagagcauccccagugagcagaaggcgauccagauccagaacgccaccaguaacccgccgucguucaaggucuagaacgccaacaacacgccgccgcucccguucuagaacuccaccagugacucgcagaagguccagauccaggacuccaccaguaaccaggaggcgaucucgaagcagaacuucgccuaucacucgcagaagaucaagauccagaacaucuccggucacccgaaggagaucucgaucucgcacaucuccaguaacucgaagaaggucccgcucucgaaccucaccagugacacgccgccgcucuaggucccggacaccuccagcuauucggcgccgcucuagaucucgaacgccacuguuaccacgcaaacguucucgaagucgcucaccacuugcuauccgccgccgcuccagaucccguacuccacgaacagcucgggguaaacgguccuuaacaagaucuccuccagccauccgcaggcguucugcaucuggaaguaguucugaucguucacgaucugcuacuccuccagcaacaagaaaucauucugguucacggacaccuccaguagcacucaacaguuccagaaugagcugcuucagucguccuagcauguccccaacaccucuugaucgcugcagaucaccuggaaugcuugaaccccuuggcagcucuagaacacccaugucuguccugcagcaagccggcggcuccaugauggaugguccagguccccgaauaccugaccaccagagaacaucugugccagaaaaucaugcucaguccaggauugcacuugcccugacagcuaucagucuuggcaccgcucggccuccuccguccaugucugcugcuggccuugcugcaagaaugucccagguuccagccccggugccucucaugagucucagaaccgcaccagcagccaaccuugccagcaggauuccugcagccucugcggcagccaugaaccuagccagcgccaggacaccugccauuccaacagcagugaaccuggcugacucucgaacgccagcugcagcagcggccaugaacuuggccagccccagaacagcgguggcaccuucggcugugaaccuggcugacccucgcacucccacagccccagcugugaaccuagcaggggccagaaccccagcugccuuggcagcucugagucucacaggcucuggcacaccaccaacugcugcaaacuaucccuccagcuccagaacaccacaggcuccagccucugcaaaccugguggguccucggucugcacaugccacagcuccugugaauauugccggcuccagaaccgccgcagccuuggcccccgcgagccucaccagugcuaggauggcuccagcauugucuggugcaaaccucaccagccccagggugccccuuucugccuacgagcgugucaguggcagaaccucaccaccgcuccuugaccgagcuagguccagaacaccaccgucugccccaagccaaucuaggaugaccucugaacgggcucccuccccuuccucuagaaugggccaggcuccuucacagucucuucucccuccagcacaggaucagccgaggucuccugugccuucugcuuuuucagaccaaucccguuguuugauugcccagaccaccccuguagcagggucucagucccuuuccucuggggcaguggcaacgaccacguccucugcuggugaucacaauggcaugcucucugucccugccccuggggugccccacucugaugugggggagccaccugccucuacuggggcccagcagccuucugcauuagccgcccugcagccagcaaaggagcggcggaguuccuccucgucgucgucguccucuagcuccuccucuucuucaucaucgucgucgucguccuccuccuccucuggcuccaguucuagugacucagagggcucuagccuuccugugcaaccugagguggcacugaagaggugagggagcuugacuuuuagaaaucuucagugggggagguauuggggauggguuggggaguggggagggagaaaccaugucacaggugcuuggcucuuggaggagguauggggaccuugacccucaagcuggggguagaagagaaugcuggggcagggggcggagggaggaggaaugggacagauaaaagucuccgaagguucauucucuagaggauaaugauaaguuuuccgucucuacagaggacagaacuagaggaaauggacuuaauuuuacagcaggagggauggcaguuagaccucaagaggaacucccugggcuggaaggaucuucagaggucaucccaucccucucccugccuccaggcaggacggccccuuccccagccaaccugcacucacaggggccuccccaagcugcggcucuccgaggaaggagacuacccagcuucagcuuccacaccugagcccagaggccuuauuccuccaucagggacauucuugagguuuaaccuugaucccuuaugcugcgggccccagccuguugcuucuguuagcagagguugggucagcucgcaccacugcucuccagagaauugcuggcucacguggcucggagagcucccagcgccuuucucaggcaccccuccccccacugccguuccuccaggccaaggaagguaggguuggggcuggggcagcuugucuccuugugacacuccucuccucccacaggguccccagccccaccccagccccaaaggaggcuguucgagagggacguccuccggagccaaccccagccaaacggaagaggcgcucuagcaguuccaguuccagcuccuccucuucaucuuccuccuccuccuccuccuccucuucuuccuccuccucuuccucuucuucuucuuccuccucaucuuccuccuccucgucgucuuccuccccuuccccugcuaagccuggcccucaggccuugcccaaaccugcaagccccaagaagccacccccuggcgagcggaggugagugcugucuugccugaguugaaaggugggugggggagugacuuguccagagaaggggcccuggggugugagcuccccgcugggugucucacguggccuugggcaucugguugugggggaggaggcacuugcucuccucuccccaugcucguugcacccuguucuggcgaagggcugcgccauccacagcggcgcucaggccaggaccaggggguccuugguuucuuccucucccucccucaacacauagccuguucccaggguucuagcuuugucucccuguugcuacugccagggcucuggucuggccaccaucaucuucucccgacucuguccacagccuccucccugucuccccgucuccacgccauucucuuccacauguagccagagggaccuuucuaaaacgcacaucuggcuacuucccuccacuccacaaauccuucgggacgcccuguggccugcaggacaaagccccaccucugcgggaguggcgugugaggcucuucaccaacgggccuugcccgcccuguguucuccuccugcccgcccccacacaugcccugugcuccagccacacccagcgccuugcagucuaaggagagcccaugccuuuggacaugcuguuccuucugccuggaauuuccuuguccgccuggugaacuccucguucugcaagacuccgcucaaaacagcaccuucgagaagacugcccugccccuucccugccuugccccaugucccccucccuuggguccccagagccacgcacauccagcccugcuucccacacacggggccgugcgugccuuucuucaccacugagcuccuucaagggcagggacugucuuuaucuuugcaucccccgcugcacccugugccugcccacugggcacucgguggauggugugcgggcggaugggugagugagcggacaaaggugggucugaggcuggcccuguguggugugagguuugguggucaggaccugggcgggugguccugagugcuggcccgugugcuugaaaggguguggugcuauuggguccuacuguguuccccaggucccgcagcccccggaagccaauagacucccucagggacucucggucccucagcuacucgccuguggagcgucgccgucccucgccccagcccucaccacgggaccagcagagguaaggccaacugcaggugucagcacccagccugucuggccgccacugcuuucuacaaagaagaaagcuuugcgguuguggcuauguggugccugagguggugccacccuguggccugaugucuguccuguguugcagcagcagcagugagcgggguucccggagaggccagcguggggacagccgcucccccagccacaagcgcaggagggagacaccuagcccucggcccaugagacaccgcuccuccaggugcguguccuggaaggcugaugcccccuuccgggagccaguuguggugguggguggcggccccauuuugggaguggcccagaaacuggccuugagggcuggggugggaacucccuguugacccauaucuucucuugcaggucuccauaaauugucuuugggggauuccaccacacccaaugcucuggagccacaaggagugucccuucuuccccagcagagccgugggaggguccuugucugcucuccuuugaaccuuggcagcccuuggauggagggcucccuuucccuccccuuuuuuuuuucuuuguuccugugaaauguuaaucuccgugaguucuuccugguucauguguucugggggguuuggggugggagggaaugcagaugggaguugggggaggggaggauacaguucaggauaccccagccuggagucagggccagggaggcauggccccacuuguauccagaaguucccaggggugauugugauggugguugggacuggagguuguauaagguguucuuggaaggaaggggcaggaguuggaauuaguuggucccuacugucccccaugagguugugaaccccuccccccaacuuuucauguuucuuaaaggcauuuugguuuuuuaaaaucuguacagcaagagcaacuuuuucugucaaauaaaaaugagaaaugcaggaacugggucuguagacuguuuauuaaagguguguuaagggggcagccacuucccuccgugauuacagcccccagcguggguggaccuguguggguccgucuugggguucccucguugaacaugcugucaaaccaggacacuggcuccagcuuguguuucugcucuuggccaucgucugggaguggacaugcaggcuauggggguggggggcacuuagaaggagaaaggccuaaaacuggaaucucuugucccugaggcuggcucuggucuuugugucucucccaguccuucccuuuccucccccuggcgugguugguguggcuggcuagcugcuaacaauggcuugggucucagggcaacccagguccccauggugccuuuaagcagcaggcugggccaaguucucagccagggucucaggaucugggagacaggacagcacaggaacugccaagcacaagccccaaaaggagcccacagggagugggacccaucccagggaggggcgggaaaaagaggcagcaaccaggcagacucccaaaucucuuuuauugggggaaaugggccucuuggggguccucacugcacggcuuguucauuggcacugcuucccgaguccuggggcuucaucacaucgggcagcucuggcgggcuggaaaacggcucgaugcacagggccucaaaggugucaucuguggaggaagca

SEQ ID NO: 18222 - RNA, 19517 nt, Homo sapiens
ugcuuccuccacagaugacaccuuugaggcccugugcaucgagccguuuuccagcccgccagagcugcccgaugugaugaagccccaggacucgggaagcagugccaaugaacaagccgugcagugaggacccccaagaggcccauuucccccaauaaaagagauuugggagucugccugguugcugccucuuuuucccgccccucccugggaugggucccacucccugugggcuccuuuuggggcuugugcuuggcaguuccugugcuguccugucucccagauccugagacccuggcugagaacuuggcccagccugcugcuuaaaggcaccauggggaccuggguugcccugagacccaagccauuguuagcagcuagccagccacaccaaccacgccagggggaggaaagggaaggacugggagagacacaaagaccagagccagccucagggacaagagauuccaguuuuaggccuuucuccuucuaagugccccccacccccauagccugcauguccacucccagacgauggccaagagcagaaacacaagcuggagccaguguccugguuugacagcauguucaacgagggaaccccaagacggacccacacagguccacccacgcugggggcuguaaucacggagggaaguggcugcccccuuaacacaccuuuaauaaacagucuacagacccaguuccugcauuucucauuuuuauuugacagaaaaaguugcucuugcuguacagauuuuaaaaaaccaaaaugccuuuaagaaacaugaaaaguuggggggagggguucacaaccucaugggggacaguagggaccaacuaauuccaacuccugccccuuccuuccaagaacaccuuauacaaccuccagucccaaccaccaucacaaucaccccugggaacuucuggauacaaguggggccaugccucccuggcccugacuccaggcugggguauccugaacuguauccuccccucccccaacucccaucugcauucccucccaccccaaaccccccagaacacaugaaccaggaagaacucacggagauuaacauuucacaggaacaaagaaaaaaaaaaggggagggaaagggagcccuccauccaagggcugccaagguucaaaggagagcagacaaggacccucccacggcucugcuggggaagaagggacacuccuuguggcuccagagcauugggugugguggaaucccccaaagacaauuuauggagaccugcaagagaagauaugggucaacagggaguucccaccccagcccucaaggccaguuucugggccacucccaaaauggggccgccacccaccaccacaacuggcucccggaagggggcaucagccuuccaggacacgcaccuggaggagcggugucucaugggccgagggcuaggugucucccuccugcgcuuguggcugggggagcggcuguccccacgcuggccucuccgggaaccccgcucacugcugcugcugcaacacaggacagacaucaggccacaggguggcaccaccucaggcaccacauagccacaaccgcaaagcuuucuucuuuguagaaagcaguggcggccagacaggcugggugcugacaccugcaguuggccuuaccucugcuggucccguggugagggcuggggcgagggacggcgacgcuccacaggcgaguagcugagggaccgagagucccugagggagucuauuggcuuccgggggcugcgggaccuggggaacacaguaggacccaauagcaccacacccuuucaagcacacgggccagcacucaggaccacccgcccagguccugaccaccaaaccucacaccacacagggccagccucagacccaccuuuguccgcucacucacccauccgcccgcacaccauccaccgagugcccagugggcaggcacagggugcagcgggggaugcaaagauaaagacagucccugcccuugaaggagcucaguggugaagaaaggcacgcacggccccgugugugggaagcagggcuggaugugcguggcucuggggacccaagggagggggacauggggcaaggcagggaaggggcagggcagucuucucgaaggugcuguuuugagcggagucuugcagaacgaggaguucaccaggcggacaaggaaauuccaggcagaaggaacagcauguccaaaggcaugggcucuccuuagacugcaaggcgcuggguguggcuggagcacagggcaugugugggggcgggcaggaggagaacacagggcgggcaaggcccguuggugaagagccucacacgccacucccgcagagguggggcuuuguccugcaggccacagggcgucccgaaggauuuguggaguggagggaaguagccagaugugcguuuuagaaaggucccucuggcuacauguggaagagaauggcguggagacggggagacagggaggaggcuguggacagagucgggagaagaugaugguggccagaccagagcccuggcaguagcaacagggagacaaagcuagaacccugggaacaggcuauguguugagggagggagaggaagaaaccaaggacccccugguccuggccugagcgccgcuguggauggcgcagcccuucgccagaacagggugcaacgagcauggggagaggagagcaagugccuccucccccacaaccagaugcccaaggccacgugagacacccagcggggagcucacaccccagggccccuucucuggacaagucacucccccacccaccuuucaacucaggcaagacagcacucaccuccgcucgccaggggguggcuucuuggggcuugcagguuugggcaaggccugagggccaggcuuagcaggggaaggggaggaagacgacgaggaggaggaagaugaggaggaagaagaagaagaggaagaggaggaggaagaagaggaggaggaggaggaggaggaagaugaagaggaggagcuggaacuggaacugcuagagcgccucuuccguuuggcugggguuggcuccggaggacgucccucucgaacagccuccuuuggggcugggguggggcuggggacccugugggaggagaggagugucacaaggagacaagcugccccagccccaacccuaccuuccuuggccuggaggaacggcaguggggggaggggugccugagaaaggcgcugggagcucuccgagccacgugagccagcaauucucuggagagcaguggugcgagcugacccaaccucugcuaacagaagcaacaggcuggggcccgcagcauaagggaucaagguuaaaccucaagaaugucccugauggaggaauaaggccucugggcucagguguggaagcugaagcuggguagucuccuuccucggagagccgcagcuuggggaggccccugugagugcagguuggcuggggaaggggccguccugccuggaggcagggagagggaugggaugaccucugaagauccuuccagcccagggaguuccucuugaggucuaacugccaucccuccugcuguaaaauuaaguccauuuccucuaguucuguccucuguagagacggaaaacuuaucauuauccucuagagaaugaaccuucggagacuuuuaucugucccauuccuccucccuccgcccccugccccagcauucucuucuacccccagcuugagggucaagguccccauaccuccuccaagagccaagcaccugugacaugguuucucccuccccacuccccaacccauccccaauaccucccccacugaagauuucuaaaagucaagcucccucaccucuucagugccaccucagguugcacaggaaggcuagagcccucugagucacuagaacuggagccagaggaggaggaggacgacgacgacgaugaugaagaagaggaggagcuagaggacgacgacgacgaggaggaacuccgccgcuccuuugcuggcugcagggcggcuaaugcagaaggcugcugggccccaguagaggcagguggcucccccacaucagaguggggcaccccaggggcagggacagagagcaugccauugugaucaccagcagaggacguggucguugccacugccccagaggaaagggacugagacccugcuacagggguggucugggcaaucaaacaacgggauuggucugaaaaagcagaaggcacaggagaccucggcugauccugugcuggagggagaagagacugugaaggagccuggcccauucuagaggaaggggagggagcccguucagaggucauccuagauuggcuuggggcagacggugguguucuggaccuagcucggucaaggagcgguggugagguucugccacugacacgcucguaggcagaaaggggcacccuggggcuggugagguuugcaccagacaaugcuggagccauccuagcacuggugaggcucgcgggggccaaggcugcggcgguucuggagccggcaauauucacaggagcuguggcaugugcagaccgaggacccaccagguuugcagaggcuggagccugugguguucuggagcuggagggauaguuugcagcaguugguggugugccagagccugugagacucagagcugccaaggcagcugggguucuggccccugcuagguucacagcuggggcugugggagugcgagggucagccagguucacagccgaaggugccaccgcuguucuggggcuggccaaguucauggccgcugcugcagcuggcguucgagagucagccagguucacugcuguuggaauggcagguguccuggcgcuggcuagguucauggcugccgcagaggcugcaggaauccugcuggcaagguuggcugcuggugcgguucugagacucaugagaggcaccggggcuggaaccugggacauucuugcagcaaggccagcagcagacauggacggaggaggccgagcggugccaagacugauagcugucagggcaagugcaauccuggacugagcaugauuuucuggcacagauguucucugguggucagguauucggggaccuggaccauccaucauggagccgccggcuugcugcaggacagacauggguguucuagagcugccaagggguucaagcauuccaggugaucugcagcgaucaagagguguuggggacaugcuaggacgacugaagcagcucauucuggaacuguugagugcuacuggagguguccgugaaccagaaugauuucuuguugcuggaggaguagcagaucgugaacgaucagaacuacuuccagaugcagaacgccugcggauggcuggaggagaucuuguuaaggaccguuuaccccgagcuguucguggaguacgggaucuggagcggcggcggauagcaaguggugagcgacuucgagaacguuugcgugguaacaguggcguucgagaucuagagcggcgccgaauagcuggagguguccgggaccuagagcggcggcgugucacuggugagguucgagagcgggaccuucuucgaguuacuggagaugugcgagaucgagaucuccuucgggugaccggagauguucuggaucuugaucuucugcgagugauaggcgaaguucugcuucgagaucgccuccugguuacugguggaguccuggaucuggaccuucugcgagucacugguggaguucuagaacgggagcggcggcguguuguuggcguucuagaccuugaacgacggcggguuacugguggcguucuggaucuggaucgccuucugcucacuggggaugcucuugaccgggaucuucgucgagucacugaaguccuggaccuugaccgucuccggcugacuggugaaguucgagaucuggaccuacgucggcuuaucagggggguucuggaccuggaucgccggugaguggcuggagaggcucgagaucuagagcguuuccacggggcuggugaugugcgugagcgagaacgcuuccgacugguuggggguguccgagagcggccucuucggcgucgagaggagguccgggaacuuuccugccgggcaggugaccuugagugauaaccagagccuccccuccgccgccgaguaacccgcgaccuugaccggcuccgcugucuucgccgagagguugacugagaagauccagaccuaucucgacgucggguuguucuuguuuucucucuccuugagcgggaacgggaccucuggaguccacgaggcuuuggcgaaggagagcggccucuccuugagguugucuuagugcguggagaugaagcugagcgccgucggcgugaagaccucgauuuuucggcuggcuccggggaagacacugagggacuucuccggugccuugggggaguucuagagcgaguuucuggugaggaugaggcagagcggcuucuacgggacagucuggccuuccuuguuagcuccggagaugaucgagagcugcgacgucgaggugguguacgagacuuggucuugggcucuggugaugaccuggaaccucugcgagcaguucuggauuugggcggauguucaggagaggacucgguacugcugcuuccuucaggagaagggccucugccuuugcuugaugaaccugaucugcuucgucugggaagggcccgaggggcuggagcuuuagguucaggagaggaaucagaaccacucugugcccugggugcugcucuuggcuuaucuuucacuucaggggaggaaccagaccuacugcgccgaggggauagucgagauuugcugucaaccucuggagaugauccagaccgacuccucugccgaagugggguucuugucuuggcuuuagaaucuggagaagagucugacucacuucuuuccugaggggaugcacuggguuucacaucaaguucuugagaggaucccgaacgacuucucugccccaggggaguccgagccacaguuuucugaucaacugaugauucugacccgcuucuuucucucugggggguaagacacuuguuguugagcucuggggaugauggagaacgacuccucggccuaggagucugaggcaaagcuuucgguucuggggaagaaucacauucgcuucucccucuagauggcguucuagguauaucuuucauuccaggagaggacccagacaggcugugccucgagggagucccagacccaucucuaaguccuggagaagacccagaccugcuucuccuugauggaguucuggguaaaccaucuuucauuucaggagaagaugcagaacuacuucuuucucucgaggguguucuggguacagcaucaagcacaggugaagagaugcucugauuugaagacaucccugccuuuuccacugcaucuggggauaacucagaacugcuguguccagaggaucuugucgauuguucuuucaugucuagagauggaucuguuuccagcugauuaagaaacgguccauucaaaucuucuuuaaccucagaagaaaauccaguauucauuucuguaccaagugggccugaguuucuaaauucuaaaggugauccaaagcuguucucccugaguggggaguuagacaguucuuuauguucuggagaaaaauguggcccaccccaagaugaggccauugaagggacuucuacugcuuccaaagaagccugugacuggcucugaucaagagucaaagacacagcaggccuuucuucuacuucaggagaugauucaaaguuacuuguggacauuucuuuaaguucugaagacaaaugagacaggauuuggccugcggguucuucagacuucucuaccaccuccauuaacucuucaucuuggcuugacguaggcaaugcacuauuuugcucuuuuguuucuggagaugacccagcaccacuucuuucccuuggcgggguucuaagugugucuuugaauaccagugaagacucaggccuauccuguacuggaaagggacuaaauuugucuuucugucuaggaggugaugcaguagcauccuccugaggggguaaggccauuuucucuuuugauucagcagucuccaaucuacucugccccaagagagaauucgaguccacuguaggauaugaagaagagucagacuggaaccugcucugcucaggagacauuccagauuucaacauaggacucgcugagaacucaccucuaucuugucuuauuggagaucuggaugccagcucagugacuggagaugaagaccuggaccgaccucccuuaggugauguuugagauuugcucugcagagauggugauucugaaugacucugucucacuucuggacuugaaguaucagaucuguggucuggugaaguuugagauuguccuuucaguugcagagaugagacaccaaaauagcucucgccugguggugugcuagauuuuacuccugcacagagagagagggauccagggcaacuuugaacuagugagucuuuagacuucucuuggggacauggugacuuugauccagaaagacuuggccccgguggaguuugggccuuuacuuugggguauggugaaauagacccugagugacuuugucuuggcgguguuucagguuucacuuugguaucuggugaggaggacccagaaugacuguaucuuggcaacaaucuggauuccacauuggagcagggagauacugaucugcuucgccguggaguuguucucgacgucacccuacuaggacuuggagaagaggagccagaauggcuucuuugucuuggugauauuauugccuucacuuuggguuguggagaugaugaccuagaugggcucugucugggaggugugcuagauuucacucuaggaggagaggacccugagcagcuaugucuagaagggguccuagauuucaacucagggucaggugaugauucaaaacagcuccgucucuguggcguuacagauugcucauuggccuggggacuuguuauggacccuugccucggugguguuccagauuucacuuuaggaugaggagaugaacuggaaugacuuugucuugauggugucuuagauuucuguuuagguggcggagaagaacuggagcgacugcgucuggguggcguucuagauuuagcuuuagguugggaggauccagagcgacugcgccuggguggugucugugacuuuuguuuagggcauggggaagacccugaaaggcugcgccucaaagacaagcgagauuuugcuuuggaccguggugaagagagagaccugcuccgccuugaagaaaugcgagauuucuucauuucugggcuugaauuggaccugcuucuucuuugagauguucuggauuuguuuuuccgcucugaagaugagccagaucugccucuucuuugagguguucuagagugagaucuuccacgucuaacuaagcuucuacugcgggaucuuccucgucuugguguccuagaccgagaccucccucuccuggcugguguucuggagcgugagcgaccacugcgucuagcugggguucuagagcgugagcggccacgucuggcugggguucuggagcgugagcggccacgucuagcugggguucuagagcgugaccugccacuucuccuggcuggugaucuacuacgagaccugcgucguacuggugaucggguccuagaucugcgccuagcagguguucuagaccgagaccugccccuccgggcugguguucuagaccgagaccuacgccuggugggaguucuggaucgugaucuccgccuggcagguguucuagagcgggaccugccccggcgggcugguguucuagaacgagaucuaccccuaguggcuggggaucuagagugggaccucccucgccuugcugaccuagaccugccucuucucuggguauuucugcuccuagaccagccuggucgcugaggagaccuagagcggccacgucgcugggggcuucuagaucuuccccaccucugugcagaccuggaccuacgccacuggggagaucgggaucgagaaugaccucucuugguagggguucgagaccgagaucgcccucucuuagcgguggcagggcuacgggaccuccccauccuacgggaggggguaugagaaugugauuuaucccguuuugcucggccaugugagcgauucuuagaugugggagaagaagaaaucucucggugggacccuggagcuggagcagguuuaggacuuucuggggaagagcuggcaugccgagaaacuuugguagguugaggggauggugggcugcucucugaggaagaagacuggggaaguuucucgggagacuuagguggugaacggucccgaguuggagaggccucagaugggggguucacuggcuccuggcuuaagggggugguugcaagggguuguggggagccgccaugucgcucagcaaggagcggagugggagcaggugguucugggccugugcugcuccuuuccggagaggggcuaggucgaguugcagauuucuaagaguggaagagagagcagggauagggauucauaaacgccaaaacuucacaucaccccuaagaucccaacacccuuuccaaugauaacuuuucuuuuacacacccucugaccacaagcgaucacuuucauucaauaacaaggaaucauauaaagcacaguggugaaaacauaugaauauauggauagccagaaucuuaaaacuaaaagaaacacaaaaugcaaauaacuaaugcacuacuacauuuaacaaauaccacuacaaaauguuauaagaauggaaaaaaacuaucuuuaaauggaaaaauaagcaguuuccuaaagcgaauggcaacuucaccuuugaagaauaacucuauuaaacgaaaagaaacagcaugaauaaagaugugagaacaugauuugugugaagaguaaaaaagcagcccaggauggguagaguacaggaaaugagaaaaagaccagacuauuaaaagccuuaaauauaauucaaaagcaauaaggaaguaguuaaguuucugaggucaaccaacuuguaauuuggaaagguaacccuggaugacauggaaaauugaugauagaggccaagaauucagacuguaaucacuaaagcaagaggaaaugauuaaugcuuaaaauuggaacagaagacuacugaagacuauuucaguguuucauucaaacuauugguggcaacgcaauggauuaaaaaguuuuggugagacaugaccagcauuuaaugaaaaaagagaagaaacuagaggcaucauacggaguacacagauaagauacaacguuuguuccaguucuaucuauguauaaacaagacacaauauaaaaccuaacauccagugagauuugauucuaaaggguucacaauucagucuaguaacaacacuaaaaguucugcagaugcaguaagagaacuaggagagaaaugcaggaaaaaaaacugaauuuauuuauuuuaauaaguuauuaccucucccuuucacaucacaugucuauccuaaaucuauacauuugcaauccaaugaacaucaccaacucaggaacauaccuccuucuugucuuuaucuuugucuucauaagggcugcuaggcuguuucguagcagucuccgggcuacuaggccguugugugcugguaguaccugguucacugaaaggcgcaucucccuccccgcgucgcccugaagcaggggaaggacuucgcccagccaaggcaguuguaugaguuuuagcugcagcacuucgagaccugcaggaguuaauugaggacgugggagaggaaggaaaucagcucaaagggagaacagaaaacccccuccccaacucccauccaccuuuccuaacuggacaacccucuuccaaaaagccuuuagucgcacaacucaaaucauucacugaaaugcaaguacaguccacuuugguucuucuuuucccaacacaaucccaaagagcguucucccucuaccccuuuacucaccucccccaaacauccccaaaccauccacccagcccacucccuacccgcuucauucacaacucaccucugagcccaccuccuucaggaagccuuccccgauuaaggaagccaggguaaggauuccuuccucccccagacaccacgaacaaaccaccacccccccuauucuggcaguccauauacaucagaacgaaacaaaaauaacaaauaaacaaaaacaaaaaaaaaaagagaaggggaaauguauaugucuguccauccuguugcuuuagccugucagcuccuagagggcagggaccgugucuuccgaauggucugugcagcgccuagcacaccgugggcgcucaauaaauauuaaauuaauuaacccaucauucccucucccucccuuccuccuggacuaccccuuaccgacugcgggaaguaucggaggaggaagcagagucagcagaaguugaacggugggcccggcggcucuugggggcugguguuguacuucgagaccugaaggaagaccaccaccacagcucaggguacugcuguaccugcccuggauucuccucacguaucccucaacccuuuaccagucagggacauaacucauucaacucccucccacuaagguggcguucacuuacuuccuaagcaaauuccccacaaauucacucaccgcuuucgcuuuuuguccuuagauuuacguuugcucuuuggagugggagaccugggaaauaaggaaagguuguuaaaaguaacuucuuuaaaaaaggaaauaaaaccaaaagugaaauggaaagagggaguguugacacaaggaagaucaaggaauugagcuucacuccaagaaaaaaaaaucaccacuccacaugccacugcgcccccuaugaguuaaagagcucuuaccuaugcuuacguuucuuggacucagauucugaccuguuggaaaaaagagaagaaaaaacauaagaaacaccucugccugaauucagcaaaccuucuccagucauucaaguauucccaccucauaccugugcuucuucuucuuugagcuuuucuuucucucccgucgaggagagcugcucucugaccugcuaaagauggauucaaaagcaagcucauccugcuuggcuucuuuccuggcccucccacuuacaaucucucuccuaaaaagguuucuaaaacacuugaauguccuaauagcacuaaugccccagaccuaagcccaggacuuauuucuucuuucuccaacaagcacaaguaacuccuuaagucaacaaaccucaaaaugaaaaagaaaauuccagaauccaaaaugcugcuggccaaucuuaauuagcagaacugcaaacucaacacuuccccacugagaaacucagguauuucuucuaguugaggccucaaugguaacucccuccucccugacaacuaucuccugcuuuguggaagccagaacuguccacuuccagagagaaagguacaccacaggauugguccucuggcuaucagagucacuuuccaacuaacuuaccguccucuaucuuucuucuuuuucuucuucuucugcuuugggguuggugagcgagaacugcuagacucccgaacaaggcuagggaaaaaugaaaagcagcagagaugggugguagaacaaacauuccuuucuuuucuuuaaaagacagagucuaaaaaaauaguaauaaaaauaaaaaaauaagagucucgcucuguugccucagguggggugcaguggcagcaacacagcucacaccguaaccuccaacuugugggcucaaaagacccuccugccuccaccucuccaagcagccuggacuacaggcaugugccaccaaccagcuuuuuuucuuuuuguagagauggggucucacuacaucgcccaggcuggucucaaacuccuggccucaagugaucuccugccugagcuucccaaaaugcugggauuacgcgcgugacccacugugacuaacccuuggacacauuuuuuuggacaccucaacuucagaagaacaaaaucugaagaguuugggaagaaaccagcccgcaaaaagacaaaaauagagcauggagcuuacaaucaagaaaagaagcugacagugguuucuuggccuuguauaccuguaagguuugggaggcucaggagcugguuguuuagcuucucgggcacgacgcugaggaucaaaagagcugccaucuacguaagaaucacugaugccaaaggcagcacggagucuuucauucuucuucucauuuaauucugccaacuggugagucuccgugacccuagagaaaagaagggcaaaagucugaaggaaauauaaaggacagagccauauucagaacacaaguauaagcaggagccaaauaaggcaugggaaaggcagacgaaagcagggaggaagucccacguaaggaaaaggacagcagcagcagccagcagccagaguagaguccagagucaucgagggagagcgcaacacucacgcuggccucugcccuggggucuccuccuugcccccaggguucacauccuucuccagcaacaugagucgaaaggucgccacuuuuuccugaauuugcuguuccucguaccugaagaacaaaucccuucaggguuaagcucgacaggacacuuuccccagucccagguuuccauuucccucauucccaaaaggggccccucccucuccaugcgcacacagaacuuuucgcucacccaaaagucccuucugucugaucuuuucccaucaucuuucuucccucuacuuacuacucccucuagaacaguggauuuuaaauaugcuacaccucagggaccaaaagaaaaaaguuaagcaagcaggguuccaagugcuccuccccaacuucaacaagaaugugccuuuuacuuccugggauuccaaaguaagggauacuguauaaaaggaucaccauugcugaaguuuaaaaccacugcucuaaaagaguuuucugccuuaaugggcuccuuuuccaaaauuucccuucccagcccaugauucccacuucuucacguauucuucuaauuccucuuuuccugccuaugcuacuuuccaaggccucaauccuuacauccauuuaucuucuucuuuucuaccaaugacaacaccuaucagcuuaccuagcuccucuaccuggucucugcuuucccaucucuuccuuaaaacacauuuuuguuccucaauggccccucccuucucccacgugccuccauuuaguaccucaggcucccaucuaugccccagacacacagccuucucauuucccacucugcacugucccuuaacuguuuucacuucucuagagcucaucugccuccuccccuaccacaacucuuugccaggccucuuucaaccacccuaagcucccuauacaucccaccuaacacccccagcucugcacucauucagugcuugacucucccccagcucucccucaccccugcucuuccaucaucuccuccagcucgaggcaucgcagcucgacgcgccgcuugcgcucgugguccaggaugucaggauuaggccgcuucaccagggcagccuccaggcgccgcaguuccuccucucccuuguagucaggccgcucaccccggcggccccgcaccagggacagguugcgcuggacguagccguuggugccgcugccccggggcgucggcagcccgaucccguuguacauggccccgugcccggggggggcaccaccgcuccugagggggagcggggagacacgggucaggccccuggccccaaacuaaccacuuaccgccccacacccaagucccugcucuccuucaucccuaauucaacauugaucuucacacuaagucuucgcuguauaaugcuccaccauccuccuggucucccaagaaaaccacuucuuugcccuuccaaauuuccuuucuaccaaaucacagcccaguucuuacagccuuucucucaaugcccuugcacagaauucuaaauaaucccucccuacaccuaaauuuucuucuuuuuccacccuaggcaaacaaggaucuuguuccucuaaaaucucuccacacugucccuuuuuguucuccuuuggccccaaaaugcacaagugguguguuuaccaacuacucuaauuccuaaccucugguaaccaaccaaagccuccuggucacaacaaacaccagacacagaucuguggcacccaacggccucuaguccauguccaaagacucucccaaaaacuuaccuaaggauuucagaccacccuauacgaauaugaaauaaacuacacagccccuagguaucugaacagcagacuaguugguucagaaugugcagccucacaccccaacuaaaggccagcaugcacaucagaaacacacaugaaccuuggauaaucgucauauacuucaccucccagguaagggccauuuccuugauuccaaauauuuaaagauccuaucaacuauccugauauuuuauuccuucaauuuccuuccucucaauaggauuuacaacaauuugcaguuccucccugucuugccagcugucaaauauuaccuguuuucaacucugcucuauuuaaacacaucaaaccagccuccucuguuccaaccguucccauaccuucuccauauaccuugcccuaaaucuauguagaaacccucucuacaccccacuuucauuaauguccaaccguuggcuuuccccaccaauccccuggauagcacuuccuaguuuuucucucucagcccugccucuuccuucucuccuguguuaaccccaugccuccucccagguucuagccuuucaacuugucccaacccuaacgugauucugaaaaauucucaagucccagcuuuccugguuagauuccuuggcuacacauacucuauuccuuucuccuauuacauauacucucuuucucacccucauccucuccaagauaguuuccuagaacaugcauauaugagaaaauacuacuaagaaaaaacccuaaggaauacguaaagcggagagaguaaucaaagauguaaaagaacuggauagaagggaaggaugcauuuagaaaauuccagaaugaagaagcaucauacaaauguuuggaaaaauauacuagcgcaugcgccuaaggaugggucccuacccaagcccaguagcagacccaauauugaaagcagaaggugacagaagaggcuaaaccuggauaaggcaagcagaaauccaggaaaaaaugaaaaacuguauggcucaaaaaaucaauuucucuacaccccaauccucauuuucaucuucuaguaccaauccuccucacgguuuaaaacuagguccuucuucgccucuccccuaccccacuuaauuucugcuuccccugcagcauguuuuugaccugcacuuaauucuucagcuuaaccauucacccacacuuccauaccaccucacacaaaaauccccccacuccuuaagaaaggaaaaccaggccggguacgguggcucacgccuguaacaccugcacuuugggaggccgaggugggcggaucaccagaucaggagauugacaccagccuggccaacacggugaaacuccaucucuaccaaaaauacaaaaauuagcugggcggcggcgauugccuguaaucucagcaacuccagaggcugaagcaggagaaucgcuugaacccgggaggcggaagguugcagugagccgagaucgcgccacugcacuccggccugccaacagagcuagacuccgucucggaaaaaaaaaaaaaagaaaaaccaguaggugcuaagcaaaggauauuaggucacaauguuucggagaacuuuuagggaaugagccaccuaguccaccccacaaaaaaagacgacgaccccacggcaucuaagggguguguuaagacacagaaaguaggaagaucaacaccacacacaaaucaccaaaccaaacgauauuacaaaacucuuaaagugggggccauagacaguggauaugcaaaaguuacccaaguuaaaagcagaaaguaaaaaguacaaaggaagacaaaaacacccuuuucuguugggaaauuauccgagugguaagcuaacaaugaaguagaaagauauauuugaauucaacaguaaaauaugcaaaaaagaaaacgguaccaaaaggggagaaaaaggggagacaaggguugucgaaaaaaauggacaucagcaagcacagccagcucagcaccggggcgcuccagagcggcugaguggacacaaagaacccagaaagcuaaaauaguagcuuuagaagagcccuaagcccacgcacuuaggaugaaagacaacacaacacucugaaauucugauccagauucguccuaacugaagccgaguggaaaccaagcuucagaagagcugugugccaaagaacgccugaaaccaaccagaaaacuuauauaugagucuggcguuuucuucccaacgaaggucuccaaaagccuccuuaguuugaacacgaauucucgggagacguugaaaaaguguaaaaagggaacgcacggucuaccuuacaaauguaaacugaacacguucacuuucuucacaguuuuuaagauuugggguuucuccccgccacuaacaacucaaaggcugauagccgggaauccuaaaccauuuaaauccggcccacgaaguucaaggcccuccccgcagcgccgggggccuauuuucggccuugcggaaugggggagggggcugcgcggcgucccgcagucugggaggcccccgacacgggcagcccaacgccgaagagaagcccgaggaaaggagaucuggaaccgggggcaaggguccaggagcaagccccccgccgccgccccuuccccgccacuuaagggccgaaaacggcagcugcaggaaggccaccucggcggcacauguuggggggaggagugaagccgaggcgcgcgcccuccccccucaccaagggcgcucgcgaacccgaguacaggcggcugcgaacgccguugucaugggggaggggcgggggggggugaagcccgcgcgcgacaggaacggcgggaagggggaagggaggcgagggcguccgcgccagcgaagggcgucgagcgcgcgugcgcgcggaggagcucggcggccugggcaguucuccgcgcgcuuuggccucgcgccggggccgccgccccucccccacccggcucgcuggcucccucacccucucacccgccgccuccgcccgccgccuccgagggggagaggucuugccgccgccgcugcucgagcucccgagucccucgggccuggggccgccgccucgccucgccgguccgcccgccucagccgacgccgacgccuccucgcuuccucaggggccgcaacgggcuccaacugcgccacucgcaccccgccugggccgcgcugcacgucagcacgacuaacugcgugcgucagcacgcaaacgcgcgucgcg

SEQ ID NO: 18223 - RNA, 6540 nt, Homo sapiens
uaaugaagcacacaccacaccgccccgccccggcgcgagaccgguccaacgcugcggagauccagaggccggcggcgcccggaaacacccgcggaggccgaggcagggcggggccgggcgccggggccgggucgcugggcgggcggcacagcccgggggaggucaacgggccggccgggcgucccggggacgcgucucccccacggugcgaagugguacggcucgcaggggcggggcccaggucaugugacgcggccgcggccgccauuuuguucugcggugcugguauuuagagcgcagcggcugacgggccggaucgccuucgccgccgcccgcccgcaaaccuucgugcccggcccguccucgcccccgccuccgccaccgccucggcccgcagagcuugcccccuccccacccgcagacauguccgaguccaagagcggccccgaguaugcuucguuuuucgccgucaugggcgccucggccgccauggucuucagcggugagcgcggcggcgggagggacucgggggcgggggcgcgcgcguugcucaugcccgcagcucgccgggguccggugugugacgucacucugacguaaucccgagcugucgggggcgcccgggccucgugugacagcgggcgggggucggcgccccgagggcugcggggagccgccggggguccggggcgcagggcgugcgggccuggccggggugugagucucggggguccgggccggcggcccugccagccgggucgugcgguugcggggguggggcggcggcgccgcugccauauuagccccgggagcggcgagagggaggcuggggugggggcgcgaggggggcggcgcgaggggggccgauucugcgggcaggugacaucacaccucgaaggccccagugcgcgggcggcggcgcggguccggcccaggaacgcccagccggucgcuggagcuuuccggcugguggggagcccaugucccccacgggagguccucagcccucgcccuuauggcggccggccccgagggucaggugggucucacccacaggcagguacuuccgguuggagcugguuacaguugcccaauacccgugucgcugugugggcuguuugggaaagcugggcugagggcuugguucggagagcccgcggagacccgggugggaguguguggaaguggagggagcggggagacagcagcaucggcgcuggcggggcuguguagcuugcagagggucugugcucugaggugggugagaggguggcauggguguccgaguuuaugggauccagucguugcccucaggacugaggcuuccaguugugguccuaaugaauggaggggugaaugaaugaccuuccuuucccucccugaggccugaaguugggaggggcuucccugggcuuggagaaggggccuucuaggguucuugguggcacccugcuuuugaaauugggccuugacagguccugggcguccaauuuagugacaauuggucucccugggagaauggcacuugggcuagggcuaggcccaggaauguggguccgacgaguuaaguucuggcccagucucagccuccguggacuggccuggccuggucugauuuccgccuccgugguuaggucugguuuuagcuuugaugaccgugcccugccccacccugccugguggccuggggaggcuccuagugcagauauguggaggguuugaacuccaaacagucucugcugacuguaaacaccuguggggugggggcuuggagcucucuguucucuugcgggccuccuucugccugggccugucugccauucgugagugagcccuggccuucccgucgugugcaaguaaggggucauuugugguggaagaaguggucuagacuucuccuucccccuaggcaccgccugcucuuuccacagacucaaggcuucucccaacaggcugccgagcccuuccccccagccuccucuguucuuugcccucagaaugccuucagagauuccauuuugccuggccaccugugggguauuagcuuguggcugucacucauucauccaaacaaucuugauugagcgcuuacuaugugccagguacugguaggacagcagugaacaaaaugggauccccgcccauguggaacuuaaauucuagcuguugcugcuugcccuugaagcccugaguuuguccaccaagcccuuuuucugcacccagcuccuuuccucucucuccgucaagaccuacacaggucuuugggcagccugaccagcaggugucuggaaauugagaacacgguauugcuggccuaggccuuuccugcuuaucccuggcucuucgggauaaacguggcuuacuguggcucuccaggagcugaccucugacuucacuuggccaauucagacaacugcuuuuuuuuuuuuuuuuuuuuuucuccccuccucaagacagggucuugcucuguuucccaggcuggagugcagugguguggucauggcucacuacagccucaaccucccaggcucaagcaauccuccugccucagccuccugaauaacuaggacuacaggcacaggcuaccaugcccagcuaauuuuuuuuuuuuagagacagggucucgccauguggcucaggcuggucucaaacuccuuguugccucaaacgauccaccugcuucugccucguaaagggcugggauuauaggcaugagccaccaugacuggcucaacuucugacuucauuucugccuucucagcaugcuuuccuccaggaccuggcuucaccugcugugccgaccuaaacaagcccccugcccuccaguggccucugcuguugccacaacgccaaccuccagcuguguccccagcuccuggcccuuggccugccuggcacugacggauuggucuuaaaccgaaugagguccacaaaccucuugcaggcccccgucccagcuuccccuuuuuuuucucaugacaaauguccuguucuuucuucaucauguccuucaagaaguugucauuugcuccuuuucuguauuuccugugacuuccucccugcuggcgagugccuuguauuuuaugcuuguguuucugcaacugcuuucuggccccccacucuuucuguggcugcugagccuagugccgcucacaggucugccuucugcagucuggucaggcuuggccuccggacuggaguccagggugcucaugguauuccgcuccugguggccaucccuuucuucccugugcuccucuuggugccuccucccccugccagccacaugauucuuccugcugcccucuguagaaaagggccuggcucacuuccugccucugguggacuacuggccucacaggguccacuacuuggguugcugaguucccuguauucagucuccugccaacgugucugccaugcucuggucucuugugcauacaugaugcaguuggaugugguccugggccugcagugggagcccccuaaaaugcacuguaauugcucuauaugcuugccagggaaaaaaugcacuguaaccaggaguucaggacaggcgcugggacaggcccugggccccagucugcaggugcacuggguguuggcauggcaugucugggcaccuccaagguggcguggaggaggccguguggcucccuggcccaggucccagccuccuuccucccucuauagucacucccuggauacccagcaccgucgucuugggugccucugcaggugcuauccagagcccuugucuuauugccuuguuuuucugugacuccucucucccgccaacuugggauacuugucugugaagcccuuccccagcacccccuucuccgcucuccuggagcaugucucugugccuggaggucaccgcgccuguguccucaccccugcugagugcugggacacaggguaggcaaguuuuguggcccaaauauaucaauaaaauaugaagaggaaugguagggguaguccuggucccuuccaccucugacauauguagucuucugcaggucaggcuguuugugugugugugugugugugugugugugugugugugugugucugucagagauucacucuuguuguuuguuugagacggagucucucugugucgcccaggcuggagugcaguggcgugaucuugacucacugcaaccuccacuccuggguucaggcgauucuccugccucagccucccuaguaacugggaugacaggcaugcgccaccacuccuggcuaauuuuuguauuuuuaguagagacgagguuucaccauguuacccaggcuaaucucgaacuucugacaccaggugauccgcccgccuuggccuccuaaagugcugggauuacaggcgugagccacugcgccuggccaagucaggcugguuauugaucugcuccccuaaaagaccauggcaugaguucugugggcagagagggggcagggaguugccagugcaguccccacaagcagcucaguaggccccugugguggcccuggagggcagcuggcagaagucagaaaggcaaaugagcccccgugacacugcuguguccacagaauucuccacuuugagaauagggcccaggagaggggaacugaaaagaaaggcaacauucucuugggagaggaaggagggacagcucuggaggagacaggccacccuggagcccagcccaccagcacuguugcggugggaggcuugggcccucuggccaggcuccugugugcuuggagccaccccgugugcaggggagaccucucugggaggucagcugaggccucguaguuggacuguugaugauccccgucgucuucucugcccccauccucuucuuggcucacccugucuccugucugguagagaagauucuccaaucugucaaggguucaggccugcuguguggcugagggugcugagagcugcccuuucuggcagaauguuuggcccuccuagguuaauauuuggggcugggagcguuggggagcuuggccugggcagugagucaagggagcucuggccugggugacaagaguggccaggucagcugcuucugacccuccggucacacccuguagcaguggcuuugccauccccaagaccuuugguggcuuuuccagcauguuguccugggcaguagccccaagggucgacugacccugaccccacaugggggcugcugaggcugcacugaggcucccuggggugacagguggguucacugcagagccaggagccccagaugggucacgccgccccaagagcugcugcuggaggaagagcuggacucugagggugggggccucacguagaggaaggaggaguggcuguccuggccuccuuuugcuugcccguggcuguuccuccuggguccucuugcccugggcuggaugccuucuucggcucccccucugcaugugauaacuugggguggcccuuggagcugugccaaagcuacaccucgggguccuagucucaacuggccugcguacugcugugggcucaccccgccuuccucccacagcccugggcgcugccuauggcacagccaagagcgguaccggcauugcggccaugucugucaugcggccggagcagaucaugaaguccaucaucccaguggucauggcuggcaucaucgccaucuacggccuggugguggcaguccucaucgccaacucccugaaugacgacaucagccucuacaagugagcacuggggucaggccccugcccagggcuggaggacugcagggaggggggcgguucaccuguggguggugacccggacccuugucucccccugguuggcaggcugcugaugucaguccucucuucucgcccccaggagcuuccuccagcugggcgccggccugagcgugggccugagcggccuggcagccggcuuugccaucggcaucgugggggacgcuggcgugcggggcaccgcccagcagccccgacuauucgugggcaugauccugauucucaucuucgccgaggugcucggccucuacggucucaucgucgcccucauccucuccacaaaguagacccucuccgagcccaccagccacagaauauuauguaaagaccaccccuccucauuccagaacgaacagccugacacauacgcacggggccgccgcccccaguaguuggucuuguacaugcgcaguguccuagugcccaucgucuguuuccccggccuugcccccgcccgccccgugccguggacaucugggcccacucaucgccccuccaggcccccggcgccccacccccuagagugcucuguguaugcggaugauuuagaauugucauuucucuuuacuggauguuuauuuauaaagaucuggccuguuccugcgucugcggagcggcccuugucucccagcuaucuauaaccuuagcuagagugucgccuuguggguuccuguugcugagacuuccuggauggagccgcccucaccgccgggcccguggcccugcgcggagcuguguccaauaaaguucuuggaugugacg

SEQ ID NO: 18224 - RNA, 12408 nt, Homo sapiens
gcuguguacaccgccgaggccucagcagcacuuggccugugacccacucccucccgugacagccuccuguugccucugugacacuguccuacugcuccuccaccucccuggccauugcgugggccccgugaucugucccuacccguccccugccccaccaggggccaccucgccuggcccacugcuccaaggucugagcuuccuccccucugcccagugcuaucacgucacauguccaaaagugaacacuuucuccuccuucauccccgccccugacacgcggaauccucaccuccagcaaccccguccugucccugugcucgguggcccaggcgucagcaagacggcuggucccugcguuaagagcacuuucaauaaggacagauggagccucucguauaaccuucaccggcccccugcaagagaagcgcgauaauggcgcccccaucuacccaguuacccaaaccaaaaucccggcgucgcccgcagucaccucccuggcggccucgggggcccagcuccgagccggaguccccgucagaccugggaggcaggagugggcggggcuugaggcuugcccgcaaggagggagagaaagcuucgggggcggccccugagccccgguucaggauugggcagcccggccgggaaggggcggccuucccucccggaaggggcguggcucuucagaggcggcaaauugcaaggagacgccgccgccuucaugcugccggcgggcugcucgcgccggugaggccugcgcggcaggagggggugggaggaugcgggcgggccgguagccaggcgcggggcccgaggcccgacgcuggccgaggugcugagccgccggugcgucccccaggcugguggccgagcugcagggcgcccuggacgccugcgcacagcgacaauugcaauuggagcagagccugcgcguuugccgucggcugcugcaugccugguacgcggaccccggacccacuggccagaccucccucgggcccucagagucccgccccgagcgcccagggcugggagaccgggcgcagccgcccacuucggagcuguggguugucagugccacccuccuuacccugcaggcucugagcugggggccugccgcggggcccggcggcccccucgggucuguuugggcugggcccugccuccuggccgugcgacggcugcccgugucuuugcagggaaccaacugggacccgggcuuugaagccaccuccagggccagaaacuaauggagaggacccccuuccagguaaaccuccaccacccgccuucuccaggugcugcucuggccugucugcuggcgugcaguugugaggaacccuccugggggacaguggggagagaucccugcauaauucuuggcuuucacagcaugcacacccaguccacaagaccucaaagaguuggaguuucugacccaggcacuggagaaggcuguacgaguucgaagaggcaucacuaaggccggagagagagacaaggcccccagccugaaaucuagguccauugucaccucuucuggcacgacagccuccgccccaccgcauuccccaggccaagcugguggccaugcuucagacacgagacccaccaagggccuccgccagaccacggugccugccaagggccacccugagcgccggcugcugucagugggggaugggacccguguugggaugggagcccgaacccccaggccuggggcgggccucagggaccagcaaauggccccauccgcugcuccucaggccccagaagccuucacacucaaggagaagggguagguuucccggacccucacuggagggacuucugucucugccuccucagacccuggcuagcaaggagccugggauuuggggugacagggaaggcagggcaucgagcccuguggcauaccccugaggcucaugcucagaagcuggcagaaugaagcagcuguguggugguguccagguuggcaccaucaggucagggaaguacuggagccuguccuccucucuucucuguggcuguccccuuauuugcccaggccagaggcuccagaugggcucuggagggcgugggaucugcucacagggccccgcucacagggcccccucuucucucuaauggggcagcacuggacgaugcuucuccuauggccacucuggaagcccuauccaagggggcucauccuugguggggucgggugugggagaggggcaagaagccucaucccugauugggcucugagcaggaagugggacuuguagaccccagagcaaggcgaugcuccucugaacacgggcuucuccgacaggcaccugcugcggcugccugcggcauucaggaaagcagcuucccagaacucgaggugaggcugaggucuuuggcuggacggggguaggggagaaccgggaggcaucaccagcucggggacagguucgagauacuuuccagugggucucuuuguccucuuugcugagugggaucacugucgauguuaaaaaucugccagccggucagcuuuguccccuuguccuagucaguguccucuugguucccugcggccucuggaggccccuccuggcauucagcagagccagacgcccagccugggguccccacccuggcccuugccuaccucccaaggcccagcuuacuggcuggaauaaccgugucccucugugguuccucugugcaccccacgugugcaccccagccugugggcccagcucaguuccacacagaccagugauuccacggaugccgccgcugccaaaacccaguuccuccagaacaugcagacagcuguauccuugcugggcuugugggagcccugggggccucuagcucugaaccuggcagguuugcagagcagccccaggaggggcuggcgugggauggccagggccacuccccaggccccguucuuggugggagcagaggggcuuuggcugcagggaaguuuuccugacccauauccagucaggcgggccccagcccaggcucagugcuguggagguggaggcggaggcggggcgccugcggaaggccugcucgcugcugagacugcgcaugagggaggagcucucggcaggucaguggguccugggucuguaucaggaggaguguggagggccagugcagggaggguuuccagacugccacgggccccaccugcucucccugacucuucugcagcccccauggacuggaugcaggaguaccgcugccugcucacgcuggaggggcugcaggccauggugggccagugucugcacaggcugcaggagcugcgugcaggugagaccccgcccccacccugccaccugcacugaggucugggccggggacagggugcuuuagccaggcuugucugcgccucagggaagggugagcagcccagggaccagaugcaaguuggugggccccuccaccccucccacgccacuccccagugugcuggguccucaccagucguccuaugggagcagucagccuuccucuccuccucagggcagcucucccaccucgcugcuccccgcacacagaaccucauugcucugagcaguugcuuauucacccaguuguugaaaaacuagcaugugagggccgggcgcgguggcucacgccuguaaucccagcgcuuugggaggccaaggcggguggaucaugaggucaggagaucaagaccauccuggcuaacacggugaaacccugucucuacuaaaaauauaaaaaaguagccaggcgugguggugggcgccuguagucccagcuacuugggaggcugaggcaggagaauggcgugaacccaggaggaggagcuugcagugagcugagauugcgccacugcauuccagccugggcgacagagugagaugccgucucagaaaaagaaaaaguagcgugugaggccgggcacaguggcucacgccuguaaucccagcacuuugggaggccaaggcaggcggaucauuugaggucaggaguucaagaccagccuggccgacaugacgaaagcccaucucuacuaaaaauacaaaaauuaacuggguaugauggcgcacaccuguaaucccagcuacuugggaggcugaggcacaagaauugcuugaauccagaaggcagagauugcagugagcugagauugcaccacugcacuccagccugggugacagagugagacuccgucuccaaaaaaaaaaaaaaagagaaaguagcucgugagaaucagcuccugggaggugacucgccugggauugcgugaggugguuauuuauagaacuuguuuccuccuuuguauuuucuaauugcuugaaguuuuaagagugaagauacaucauuugucaaaaggaaagacaaucucauaaaagucaugcauaaacacaguaaagaaauuaggcaggcagagggccaccccacagaggacucccugccagcaaguccaggcccaagacacaccaucuugcauggggcuguccugaaagcccaccuuucuccuaaaggcagggcagguggugcagaugcgggagggccaggcacacaggaaaagcggggcccuggguucggcugcuaccccaaaggccacauucuccugugcacacagcgguggcggaacagccaccaagaccauguccuguggggaggccccccggagccucgccguccuguggggguagagcggagccugcauggagcccccagcugcuugucuacuccagcacccaggagcugcagacccuggcggcccucaagcugcgaguggcugugcuggaccagcagauccacuuggaaaaggugcuucuggaagaggaggugggggugcaacagagguccgcagccuugaggacccgaggguaggggcuugacugcuccaccccccaggacccaggaggaugggggcaagccuggggucuguguguguggguugggaagugcaugggucagacggggcugggacggcaggagggagccuggagccucagaaggagggaggagggcugaagcaugggggccucgaagccugucccaggauugccccccgccuaggugccccugagaccuuggcccugcccugcccugcccccagguccugauggcugaacuccucccccugguaagcgcugcacagccgcaggggccgcccuggcuggcccugugccgggcugugcacagccugcucugcgagggaggagcacguguccuuaccauccugcgggaugaaccugcagucugagccuuucccaugcugcccucggccuguucagauggggauugggggugucuucccuggcacugugcucggggacccagagaugccugugcuucccugggaaaccuggugaacuggaccagguggccucacuggcucuucucaggacaacuaagccugcuggucagggcuggcuuucagccuuccuaaggcuccuggacuccagaggccagcggggagccuuuccuggcucccucuguuuucucucacuguagaccaaagagccgcuugugugauauuaaagccacuuuagaaagcauuuguguuuauuuauguuuuugagacagucucacucugucgccuaggcuagagugcaguggcgugaucucagcucacugcaaccuccgcuucuggguucaggcgauucuccugccucagccucccgaguagcugggacuacaggcuucggccaccacgccuggcuauuuuuuuuuuuuuuuuuuuuuuuuuuuuuuuaguaaagaugggguuucaccaugugggccaggcuggucucaaacuuucgaccucaggugauccucccaccucacccucccaacgugcugggauuauaggugugagccaccgugccuggcugaaagcauauguauuuaaaucaugccaagguaggacuuggugagcccuuguuguuucuuuaugauuuuaucaaguuauaucacugguugauacaugucaugcugaaaaagaauauaucaaguguauuuaucaagauuauaagugggccgggugugguggcucacgccuguaaucccagcacuuggggaggcugaagugggagaauugcuugaggccaggaguuugagaccaguuugaacaacagugagaccccaucucuacacaaaauuugaaaaugagccgggcauggcgugucugccuguaaucccagcuacuugggaggcuaaggcgggaggaucgcuugagccucgcacuuugagccugcagugagccaugauugcaccacugugcuccaaccugggugacagagcgagacucugucucgauaucccuucuguauaaaggacgggacaaggccacucaaggcaggcccagcauugcugaaagcccugcccccuguaggcuguaggcuguaugcauucaucggaggacacgaaaaccacaaggccauauuggagaacaggccggccacugucucugccacagccacacggcucugcuucccacugucuccuggugcccaugcccagcucccccuccuggcgcuggugcuggggcagguguggggucaccgguucacacugagccuccaccaggaagggccuuuuaccucuucacccuuuagccacuccacucucaccuccuccaagccuccuucccuuccccaggaaggcaggaaagagcaugggucaggguugggcccucugcagccacagagguguuugcaacaugacuuguuucuugcccugggacugggcaagauucucaaggagucagccccaguuguccagguuuguccccacugucaugcugggugaugguggugaugaccucaggggccggcauagagauuacuugauguggcaucuaaagugcuggccacaggcugggcgugguggcucacaccuguaaucccaacacuuugggaggaugaggcaggcagaucaccugaggucaggaguucaugaccagccuggccaacauguugaaacccugucuccauucaaaauauaaaaacuaaaggccaggcacgggggcuuaugccuguaaucccggcacuuugggaggccaaggcggacggaucaugaagucaggagauugagaccauccuggcuaacacggugaaaccccgucucuacuaaaaauacaaaaaauuagccaggcuugguagugcgcaucugucaucccaguuacuugggaggcugaggcaggagaaucgcuugagcccaggagguggagguugcagugagccgagaucacaccacugcacuccagccugggugacagagcaagacuccgucucaaaaaaaaaacccugcuggccacagaggccgugguguuggccauggccagugcucguaguguucuuuaaacgaaccugcacugagggcccgaggcaucccagacauuuugggagcuggggccaggugcucuguguggacagugccggagcuccaccaagcgcugcucugggcagggaccugcgacagggaagaugaccggccucuucaccaaggugcccccccuggacagggcagcaggacaggagguggaugacaccuggagaaagccgggucuucugagaaccagauggagcgucgcagguaggucgugcuuguaaagggccuuauaguccagcgggccagaaacacgcucggacccagagucccaaguugagggcugcuggggaccagaugacagagaccaagacaggaaaccaaaaaccaugguccucguugcauugagggggcgccuccagggacagggcagcuccacccccugccaccgcagccuggcagcagccccagggucgcaccccuugugcagaucagccagccucgccccucccggcaaccccauugcugccuccaggcuuaugcccaggugccucuaucugcaggagccacugacucauuugaaacccccaaccacgcugcgaccguacacccccguggcuuuccagagcagguggucucuaccugacguuauuucacuggcugacuuggcucauggcucaucccccaugccuacuggaugucugccucaggaggacaggggugcuauccccccuaccccggccaggcccugaugggagccagaugugcacugacucaaugauccaccaaucccgggggccaacccagaggacagugguguccuggagcagggaggcggccuagauagcuuuguggggguccugaggaggccccaacacaggaguccagggcgggaaagacaagccgccuccucggacuaacgcccgcccaccccgauuccccgccaaaacccagagguagcagcugacuccucgggcucccggcuggcgucaccgccucuggagccaaugggcucugacguggcgagccuggaacgccacugggacugcgcgggcguccacaccacccaccgagcgcggccaccgcguuggcggcaugagcgcgcucgagccucccccagcggcgcccgccucgccccccgggccgggucuggcgcacccggaaccccccggggcccugcgcgcccugcucuuggccaccggcggcgcugggggcucguggccucgcugcauucugccguucggugccguggccgugcuggcuggugcggcugccacggccaucaccuucucgcugcggggaccccgccuggaccuggcccagggcucgucgcuggccgcgcucagugcgggccuggggcuucugaccgccgccuuccugugcuggcgcgcucggcggaggcgaagggccgggcgcagggagccgggggcgcccugagccgcgggcgaggcccccucccaucgaggucaccgcgagccggccgccccucccuccaaccucgccccggccgggcgggcgcagugccaagcguggucgcagaggccgccccccacaccccauccccaaaucguuucuucuggaacccuuugggcagagaaggccaccggccguuucccucccucccucucugcuuucccucucuucccuccuccguccaacgucgcauuucagcuuuugacuuggcgcgcagagcuggcgcgaccgcagagcggccuggcugggcagcggucugcgaggcugggggaucgacccggcgcgagggugcugggugcagggcagcgcgacgcgggcucggccacaccacccgccguugggagccggcgcugugucugcuccugggcugucugccuucggagcucgguuggaaaccccccgaggcauaauaggcgcucgauaaaugugcaauaggugaacaugugguggcuugcaggcgucuggggggagacagcagguucugggcugggcagggaauuauuggaucaacgggcaucuuacaggaaagacucucagcucccugccgccuaggacuguccagcccaucuaugcccucuccccagccugugccccaaagcuggagcugccacucuaggggugaggggugggguggggagggggaggcgaagcacugcggccugaguugcagguggggggaggggaggcggagcuucuuuguugcagaaggugccaggagggggcagggccaguggagaggugggaggugggagaggccccagccaggggcugggacagguggcugggucccuggggagcaauaagucccgcuugggcgcuguggggaggcccuuccuaacucccaaacaccaucugugagggcugggggugggggcagaguagcgugugcagaggacuguuccuggggagaggcccugugaccagcggccuccucccuggggagcuggcgguacaauggcccucugggcccacggccucccgccgcugcugcugacccagaugaacaauuggggcagggcugagccccaggcaccuacuuucccccaccccagaagccaccagacguucugcagaccccaguccuggcucacagggaagcugagcuggagacaaagccagccccucugaugaggguggaagaggcugcuggccacugucccucuugcagccuggcuggcagccagucuggcaguggcccugacguccagagacagcuuggguuuccccagaggcuugucucuggccagugggaccccucugucaggccugggcuuuucucuccacugucccagaaugaugaucucagcccccauaguccccccaggguuccucccacccuuaggguggggugucgggggguggggguugggagccagaaggaccuugaagagggugguugggacguuucagguucuaagcuugacccacagagcggagcgugagccccgucagguugaggucccucaacuuguaaaggacacaauucccauucucuuuaucaggaagcugaggggcaggggcccuguggcagagagagagccccuuagcccucucuguucaguccuccggugcccccaucccugugcaucuguggcugucacaugcagauguguggcaaggagaaggugcccaccagccagugucaguugcuccaggagccaagccaggugcccuaucacccugucuucccguuccuccccuccauggucaggcccuccugcucccuccucugguccuucaguuuccccuaggaggcuuccguguccuccugccccuccucuccccaacagcgggaugcgucuaccucuccauucucuuccuccugguccuugcucaucucuggucguguccaggguagcacccacguggccuccuccaccagcugcaggccuggccucccaucugaaacggggcauucaggccucgaugcuggcccugcacggaacuuguucccugccccucccugggaugcuuggccuccucugucaaggaccugaaagucggaggggaggagguuucucugaccagagcuguuccuggacccucuuugguggugucgcucccaggcacagcuaccccauccccagcuaguccccaggccacccagcugggcuucugccucaguuucccugcccaaacgugcugugacguagggcagugggcuccggguugcgaccagccccuucccaugauuaaacccuacucccugccccugcagagggguccucaacagcuaaccaagcccccgaaccccaagaagccaccccaucccacccuccagcuuccauguccucccugccagcugggcccguggcagaggugccccuagaaacuugcagacccagggagcuuugggaucagaaucuggccuggugcaggggaugcuggccucaugucuuagcccagcucaggcccaugggggugccccccuuccucaacaugggcaggagacacuccaauuugugcagcucucgacuugggccugaugccacuugagacucaucaaauccaacagcuucagagcgcgugcugaguaacaggcaucuggcaggugaggaaacaggagcccaagacaugcagccagaaauggggcaguuggauucaaaauuagaccugaccgaauccuggguuccuucuacucgaguagaugcugcuuuggggaugacccuucaacuggugguuacuuggcuucccuaccuggggaacauccagggccucugcugucagacccggggccuugccugccugauggucuucagggaggaggcgacccagacccccguccagcacguggcacagccccaggagcaguaaagaccuggcugugggcccaggacccugcuggguggucccccacgggcugcgaaggcugagcugccccccuccagaccccucccgccagcgcauuccuggcuccccggccccuccccuggcucccgggccucccagcccccuuccccgcuggcccagcccgcgucugaaucugcuucugauuccagcucugcgaugaggcccccuccccuccccugccuccuucccgacccgagcagccccgcccccggcugggcccgggcuugcgccugcugcgccccccacccccuccuggcacagcucguccgcccucgcugcagccgggaggaggcggcggcccgugcaccgcaggccccgcccgcccacggcccuucccgggaggccgggagaccugcuccgcccggcccucggugggugagugcgagcggcggguggggccuccgcgggcggaggcaccgggagcgggggcgacgccugucaucgcucuaggcccagcgggaggacgcgccaacauccccgcugcugugcugggcccggggcgugcccgccgcugcucccaccucugggccgggcuggggccgcccgggggcccuguuccucggcauugcgggccuggugggcagagccgcggagagggcuucuuuuccccaagggcagcgucuuggggcccggccacuggcugacccgcagcggcuccggccaugccuggcuggcccugggggcugcugcugacggcaggcacgcucuucgccgcccugaguccugggccgccggcgcccgccgaccccugccacgaugaggggggugcgccccgcggcugcgugccag

SEQ ID NO: 18225 - RNA, 5360 nt, Homo sapiens
cuugcccgcaaggagggagagaaagcuucgggggcggccccugagccccgguucaggauugggcagcccggccgggaaggggcggccuucccucccggaaggggcguggcucuucagaggcggcaaauugcaaggagacgccgccgccuucaugcugccggcgggcugcucgcgccggugaggccugcgcggcaggagggggugggaggaugcgggcgggccgguagccaggcgcggggcccgaggcccgacgcuggccgaggugcugagccgccggugcgucccccaggcugguggccgagcugcagggcgcccuggacgccugcgcacagcgacaauugcaauuggagcagagccugcgcguuugccgucggcugcugcaugccugguacgcggaccccggacccacuggccagaccucccucgggcccucagagucccgccccgagcgcccagggcugggagaccgggcgcagccgcccacuucggagcuguggguugucagugccacccuccuuacccugcaggcucugagcugggggccugccgcggggcccggcggcccccucgggucuguuugggcugggcccugccuccuggccgugcgacggcugcccgugucuuugcagggaaccaacugggacccgggcuuugaagccaccuccagggccagaaacuaauggagaggacccccuuccagguaaaccuccaccacccgccuucuccaggugcugcucuggccugucugcuggcgugcaguugugaggaacccuccugggggacaguggggagagaucccugcauaauucuuggcuuucacagcaugcacacccaguccacaagaccucaaagaguuggaguuucugacccaggcacuggagaaggcuguacgaguucgaagaggcaucacuaaggccggagagagagacaaggcccccagccugaaaucuagguccauugucaccucuucuggcacgacagccuccgccccaccgcauuccccaggccaagcugguggccaugcuucagacacgagacccaccaagggccuccgccagaccacggugccugccaagggccacccugagcgccggcugcugucagugggggaugggacccguguugggaugggagcccgaacccccaggccuggggcgggccucagggaccagcaaauggccccauccgcugcuccucaggccccagaagccuucacacucaaggagaagggguagguuucccggacccucacuggagggacuucugucucugccuccucagacccuggcuagcaaggagccugggauuuggggugacagggaaggcagggcaucgagcccuguggcauaccccugaggcucaugcucagaagcuggcagaaugaagcagcuguguggugguguccagguuggcaccaucaggucagggaaguacuggagccuguccuccucucuucucuguggcuguccccuuauuugcccaggccagaggcuccagaugggcucuggagggcgugggaucugcucacagggccccgcucacagggcccccucuucucucuaauggggcagcacuggacgaugcuucuccuauggccacucuggaagcccuauccaagggggcucauccuugguggggucgggugugggagaggggcaagaagccucaucccugauugggcucugagcaggaagugggacuuguagaccccagagcaaggcgaugcuccucugaacacgggcuucuccgacaggcaccugcugcggcugccugcggcauucaggaaagcagcuucccagaacucgaggugaggcugaggucuuuggcuggacggggguaggggagaaccgggaggcaucaccagcucggggacagguucgagauacuuuccagugggucucuuuguccucuuugcugagugggaucacugucgauguuaaaaaucugccagccggucagcuuuguccccuuguccuagucaguguccucuugguucccugcggccucuggaggccccuccuggcauucagcagagccagacgcccagccugggguccccacccuggcccuugccuaccucccaaggcccagcuuacuggcuggaauaaccgugucccucugugguuccucugugcaccccacgugugcaccccagccugugggcccagcucaguuccacacagaccagugauuccacggaugccgccgcugccaaaacccaguuccuccagaacaugcagacagcuguauccuugcugggcuugugggagcccugggggccucuagcucugaaccuggcagguuugcagagcagccccaggaggggcuggcgugggauggccagggccacuccccaggccccguucuuggugggagcagaggggcuuuggcugcagggaaguuuuccugacccauauccagucaggcgggccccagcccaggcucagugcuguggagguggaggcggaggcggggcgccugcggaaggccugcucgcugcugagacugcgcaugagggaggagcucucggcaggucaguggguccugggucuguaucaggaggaguguggagggccagugcagggaggguuuccagacugccacgggccccaccugcucucccugacucuucugcagcccccauggacuggaugcaggaguaccgcugccugcucacgcuggaggggcugcaggccauggugggccagugucugcacaggcugcaggagcugcgugcaggugagaccccgcccccacccugccaccugcacugaggucugggccggggacagggugcuuuagccaggcuugucugcgccucagggaagggugagcagcccagggaccagaugcaaguuggugggccccuccaccccucccacgccacuccccagugugcuggguccucaccagucguccuaugggagcagucagccuuccucuccuccucagggcagcucucccaccucgcugcuccccgcacacagaaccucauugcucugagcaguugcuuauucacccaguuguugaaaaacuagcaugugagggccgggcgcgguggcucacgccuguaaucccagcgcuuugggaggccaaggcggguggaucaugaggucaggagaucaagaccauccuggcuaacacggugaaacccugucucuacuaaaaauauaaaaaaguagccaggcgugguggugggcgccuguagucccagcuacuugggaggcugaggcaggagaauggcgugaacccaggaggaggagcuugcagugagcugagauugcgccacugcauuccagccugggcgacagagugagaugccgucucagaaaaagaaaaaguagcgugugaggccgggcacaguggcucacgccuguaaucccagcacuuugggaggccaaggcaggcggaucauuugaggucaggaguucaagaccagccuggccgacaugacgaaagcccaucucuacuaaaaauacaaaaauuaacuggguaugauggcgcacaccuguaaucccagcuacuugggaggcugaggcacaagaauugcuugaauccagaaggcagagauugcagugagcugagauugcaccacugcacuccagccugggugacagagugagacuccgucuccaaaaaaaaaaaaaaagagaaaguagcucgugagaaucagcuccugggaggugacucgccugggauugcgugaggugguuauuuauagaacuuguuuccuccuuuguauuuucuaauugcuugaaguuuuaagagugaagauacaucauuugucaaaaggaaagacaaucucauaaaagucaugcauaaacacaguaaagaaauuaggcaggcagagggccaccccacagaggacucccugccagcaaguccaggcccaagacacaccaucuugcauggggcuguccugaaagcccaccuuucuccuaaaggcagggcagguggugcagaugcgggagggccaggcacacaggaaaagcggggcccuggguucggcugcuaccccaaaggccacauucuccugugcacacagcgguggcggaacagccaccaagaccauguccuguggggaggccccccggagccucgccguccuguggggguagagcggagccugcauggagcccccagcugcuugucuacuccagcacccaggagcugcagacccuggcggcccucaagcugcgaguggcugugcuggaccagcagauccacuuggaaaaggugcuucuggaagaggaggugggggugcaacagagguccgcagccuugaggacccgaggguaggggcuugacugcuccaccccccaggacccaggaggaugggggcaagccuggggucuguguguguggguugggaagugcaugggucagacggggcugggacggcaggagggagccuggagccucagaaggagggaggagggcugaagcaugggggccucgaagccugucccaggauugccccccgccuaggugccccugagaccuuggcccugcccugcccugcccccagguccugauggcugaacuccucccccugguaagcgcugcacagccgcaggggccgcccuggcuggcccugugccgggcugugcacagccugcucugcgagggaggagcacguguccuuaccauccugcgggaugaaccugcagucugagccuuucccaugcugcccucggccuguucagauggggauugggggugucuucccuggcacugugcucggggacccagagaugccugugcuucccugggaaaccuggugaacuggaccagguggccucacuggcucuucucaggacaacuaagccugcuggucagggcuggcuuucagccuuccuaaggcuccuggacuccagaggccagcggggagccuuuccuggcucccucuguuuucucucacuguagaccaaagagccgcuugugugauauuaaagccacuuuagaaagcauuuguguuuauuuauguuuuugagacagucucacucugucgccuaggcuagagugcaguggcgugaucucagcucacugcaaccuccgcuucuggguucaggcgauucuccugccucagccucccgaguagcugggacuacaggcuucggccaccacgccuggcuauuuuuuuuuuuuuuuuuuuuuuuuuuuuuuuaguaaagaugggguuucaccaugugggccaggcuggucucaaacuuucgaccucaggugauccucccaccucacccucccaacgugcugggauuauaggugugagccaccgugccuggcugaaagcauauguauuuaaaucaugccaagguaggacuuggugagcccuuguuguuucuuuaugauuuuaucaa

SEQ ID NO: 18226 - RNA, 5831 nt, Homo sapiens
ucgaucgacucgcuccggcuccccucgccguccuggacacggcggagugcggagccgcccguaagguacggaggccgcgagccaggggccgggaaccggcugcuggguggcugggagagcacggccaggggaagccggccagcaggacggagcaagggcggucaccggaggaaaggggagcucggggguccagccagacugcgcccuuucccaucagggccugccgcuggccugcuacgcaugcgcagccgcagcgcucggcuuuccccggcccauccgccgccuugcgcacgcgcagcccgccccugcggcagaguggcgcccgcgcgugacuccccccugccggcugcggaggugggggggggacggcgcccccgccgugugcguggggcggggauggagcacgcgcccuggagccccggagccagguaucacgcgugugacgcgugucccugaaccuaccugcgcuucuugucccaacucuaaaaugggaaugauaagcgccauucggcagcgccuugugggucuauaaucuacuuagcacagagagugucuucuaaguacuucacauccuucucugcagaugcucugaccuuugaccccugccguucagcucuagggcccgugcaggccacaccaugaacaccuccccaggcacggugggcagugacccggucauccuggccacugcaggcuacgaccacaccgugcgcuucuggcaggcccacagcggcaucugcacccggacggugcagcaccaggacuccguauccuccacccggggcgggcagggcggcgcuggggggaugccucguguggggaccacagccugugugaaggccagaugguggaggccuggggggcccuggccucagggcuaccuucccgucauccuccuuaacagucccagcaggugaaugccuuggaggucacaccggaccgcagcaugauugcugcugcagguaucugugauccuugaucucuaaacuccugagcucuggugggucgaccucagcacagccaagcuucaguucagccugugucccuagguuaccagcacauccgcauguaugaucucaacuccaauaacccuaaccccaucaucagcuacgacggcgucaacaagaacaucgcgucugugggcuuccacgaagacggccgcuggauguacacgggcggcgaggacugcacagccaggaucugggaccucaggugcgguggggagggggcgugcugcccggggcuggggugggcugcucugggagaccguuuuagguuggguucucuucaagcagaggcugagacagggagcuuccugugggcgacuuacugagagaagugaggacaggaggagagugaauugcaucagagcgcgaguccugccuugagcccggagccagcuuguuauuccccuuccaccagccacuggcuuaggcucccugcuggagcagagggcccugcgucccaaguauuucccaagaggcagguccuucagcagagggaggggaggaauggccaggccgaggccaucuggguagggcaccaacaagcccagauggacagcaugugccccggcccggcccgcaggucccggaaccugcagugccagcggaucuuccaggugaacgcacccauuaacugcgugugccugcaccccaaccaggugaggggugcucauggggccaggcacccugggacuuuggagggcugggcuugggcccugccucaccaccccugcaccccaggcagagcucaucgugggugaccagagcggggcuauccacaucugggacuugaaaacagaccacaacgagcagcugaucccugagcccgaggucuccaucacguccgcccacaucgaucccgacgccagcuacauggcagcugucaauagcaccgugaguccugguggcaggugcugggugcgggcagcuuggcacucagcccucagccucugcaggugggcuuauuccuggaugucccuuagcggcccccuccugcuuuccccaucccgggcacuaacacccaccuugccagcaaagccagaagccuuagugucgcucccgauggcuuaguccugucugcaggucggucacuccgcuuucuggagucucucccaagucgauccacuucccucuuuucacucuguugccuccuggucccagucacccuuguuucuggugacggcugacacacucucugaggcuuccuuucccccucccugaccuccccuggccccugacacguucucucuuggaugcuucuaguggugccuggucaguaucagccagguggcgucauuccccugaggagacccggggcugcuggccucgcccguaggcugcuguggcguggccccugcucuucucuccagccucauuuuuuuucauuaacuucauuuaaucccagugcaucacuuguaccucuugcccccggauuucccuucugcuggccuuugucaugcugucucucuagcuggugcccuucuccugucuacuuccguuggccaucggcauccuccaggaaggagaauuugaguccuuggccaggcguggccuccuguucuuggcuugccagguguggcccuugcuuggggccaggcuucccaggugccuucugcaggcaggaccagaggggccugccugccccucacccgggguccccaugcacaguuggcccccaguguuggcccccagggcauccuucccugugucucagaccugaggccuugggcccuccgugacgguccuccugaccucuagggaaacugcuaugucuggaaucugacggggggcauuggugacgaggugacccagcucauccccaagacuaagaucccugcccacacgcgcuacgcccugcagugucgcuucagccccgacuccacgugcgugcagggccugcuggcccgggaggggaccugccugggcugggggcuggagaggggaggggcugcuggauggaguggcugcugcuggacacgccccaugcccacccacuaggcuccucgccaccugcucggcugaucagacgugcaagaucuggaggacguccaacuucucccugaugacggagcugagcaucaagagcggcaaccccggggaguccucccgcggcuggauguggggcugcgccuucucgggggacucccaguacaucgucacuggugagccccgcccuggccucccccaucccuggcccccggcgcuggccuccagagccagcccaccucggcugcagcuuccccucugcuggggccgccugcuuggccugcaccugcgcucuuagcccugcacaaucucccccuccagcuuccucggacaaccuggcccggcucugguguguggagacuggagagaucaagagagaguauggcggccaccagaaggcuguugucugccuggccuucaaugacagugugcugggcuagccugugaccccucgggacugccuggugcaggugguggcagcuggagggacccaugcagcacccaggucagagcagacccuccccugccggccugcgccagcuggaccugauggcccccuguggcgccuugaccugcugggccaggcugcccugggacucucagcccccaguugcuuauccagaugugacagagcucgacccaagccaggcugcacacuccuggacugggcuagccugcacugccugggaaagucggccgagggcccaaagcugcugaggggucugaggcuggugcccacccccaagcuaguguguucucugccccucccugcccgcguuucagggccucgguccauagagaacaccaccaccauggccagguggaaggguuuauuagucccugccagcagcuguccucccuggugcagguggccuggccagcccacuggauuggggacgggccaggcugggccaggucgggggcucagucugggagguaauaaaagcagaccgacacgcagauguugcucgggaagcagaugucgaugcagagauaaaucagccgcugucuccggggcccuguggcgagggugccgugaaucuccaagggcuccgcccccagcuccucaaaccaucccgagggccuggccuucccccacagcgguccugacucacccucugcucgccgggcccaguagauggggguccucaugcacaggcgcugcaccaaagcccccgccugggcgggguccacuucgaggcuccccugcacugccagcagcuccugggugugguggguguccuggcuggggacccaagccucuuggaccuguugagaaggcucuggugggcggugggacagggcugcucccugcuccuggcuuggcagggccggguacccuccaacccccagugauguccccacccucagcucuugucagcagccugggcuuagggcggagagagcuuccuguucccugaaaccacagcuccagccugucccguacugggcugcacacaggacccuuugucuagccccuggcccgggccugcgcccagcaggacggcucaccuuggagguauccaccagcagccgcagggucucccgaucacuguccuccaucaggcggaggaagcagaccuggugcuccucagggcgguaacagaugcagcccuggggaggcaggggggugaggcggggccccccagaccgacaccugccagggugaccccucccugcccacucacgcucugcccgucgaacagcaccgcccagcugugguugcucugagguggggucacugugauggucgccgcguuccgggccacguccaccaggaugguuugguugggccggggcaugugggggcucgggagggucauucgcagcgucugcagccuuggcuggcagugggaguuggaguucagccgggcagcugugcaaccccagcacagccuccagcucugggcugcaggacuccugacaccccugagugggcccuuccaccccuugguccucuggcugucugcuccuagguggugucacugccugcuccgcacccuugcucugcuggaggcugggauaugccagcuucccuucucccuuuccacuguccaugucccuggugcugaggaggggcucaccuugggagggcccugagcagagccaagaagcccuccagccacaacccccacagcggccagcaccagcagcagcagcagcaggagcaggcucacggcucuccagcccccgcaggagggcuuggucuucaccugggcgugcaucagggucagaagggucaugaggguuagacaucagggagcaagugggcuggggaagggaggggcuggguggccuggggcacccccuggguccuugcugcaggaguaacgggaggcacucaccccuguaggcccagguuuggggcgcucagcacagcagcuugcugguuccauccugcagccccugcucacaaugugccgauugucugcgucccuugucugcagccuuggccaggggaaacucagaacagaaccccuccccuccugacccugcgccucccccucagcucuggaucugauauccaggucagagccaggacagccccuccucccaccugggggaugccugucaccaggcccggcuccagacaccuggccugugcagacuggagcucagggucugggaggcguagggcucggccgcguggaaauccaguccggcugaccgacuggagggcagcccaggcccggccagggugacucgcuaagugugguugggguggauuucguuuuccuaaaguggccugagucugucagguuauccuugacucccagaguugggcacagggccugacacgccacaagcugucaauacgugccuguucagugaaugacaggu

SEQ ID NO: 18227 - RNA, 558 nt, Homo sapiens
ucuuuucggggucgaguccgagggggaagagguuuguuaauacguucgccaugugcuacgaucuugggacgaacugagccacgagcguggcuuugagggccguccgaacgcugcaggccggccaggucccugggcguccaggccuggccuacgcaccacuuugucccuuagcguuuaaagguuucuucccgaaucucaggcccucagcuaccugcagguaagacugggccgggcuuggguucccuuauucucccagucugugaugaauugcuuugacuucugacaccucguaugaaaacugcacgugcagucugauuauuuagcaagacugaggcuugagggugcgcacuccugacggggagcugagaguggaaacagguguugcccgaaacgaaggaguggggacuuaaugucuguauuuuggcgcugacuuucagguuucgucgcgagccggcugcaaguuuugaaccuaaguaaaccucaauccggagggccuagcgguaaggugggcgcugugucuauugaagugcuuagcaauaaagaaagguagugaguuga

SEQ ID NO: 18228 - RNA, 41519 nt, Homo sapiens
aagugcgggucgcgcuuccggcggcgucccggggccaggggggugcgccuuucuccgcgucggggcggcccggagcgcgguggcgcggcgcgggguaaguggcgguccccacggggcaaguggcgguccccacggggcagcggccuagagaggcggaccccgcaguguccgggucccgggcccucacccgcgcccacugcaacccgacuccggagcuccgagcaucccuuaguuuuaagucauggcgggugcgaacgggucucugcugcaggcggcuccgugacagcuccugcuucacauggguagaggagagacggcaaacgucggggcucccaggacuucgcggcggcaguccuaacccgugcacugagucgggcggggcgggcggcagcgucugaguagagagcucucuagaccaggccuggugucucccgggcuuuccuaggugccuguuugcgagcuggucagcugggcuguaguugaguucucccagggagugugggaggaaagguuaugcccaccagagacccaggguccugacggcuggagguccgcaguggggaaggugggcagagguguugcucagauguccccauuccuguuucguuugcacagagggguuuucuggugcguccugguccaccauggccaaaccaacaagcaaagauucaggcuugaaggagaaguuuaagauucuguugggacugggaacaccgaggccaaaucccaggucugcagaggguaaacagacggaguuuaucaucaccgcggaaauacugagagugagugagcuaccugugucuuugcuaggcuagagggaaaugcagagaaggcuggguuuggucuugcaccagguucugugggagacggguugcuggcaacugucuacacaggaaugcugucuccaguacuuggaggccgacauguccuuccucaggagacuucgaaagucaggaucuuggugaccugguucaggcacacuugaguuacuauucagauguugaugaaagaaagcccaucuuauagaugaggccugaguaucaucaucuucacagguaaggauauguccagguguuacaugauaagaugugaguuccugggagaaguagguucuuuauuuuauuuuuuuuuugagacugagucuugcucuguugccuaggcuggagugcaguggcacaaucucugcucgcugcuaccucugccucccaguuucaagugguucuccugccucagccuccugaguagcugggacuacagacacgugccaccacacccauuuaauuuuuguauuuuuaguagagauggaguuucacuaucuuggccaggcuggucuugaacugcugaccucaggugaucugcccgcuuuggccucccaaagugcugggauuacaggcaugagccaucgcacaugggcuaggucguuaucuuuuauguguguuugugucuuugucacacaugccuggcauuguguuuugcccaugaguaaaugcugaauuuuugcacuuguaaaguuuucuacuuagaaacaacuaaaacguucaucaacugaugaauaaaauauaguccauccuggcugggugcgguggcucacgccugucaucccagcacuuugggaggccgaggcggguggaucaccugaggucaggaguuugagaccagccuggccaacauggcgaaaccccgucucuacuaaaaauaccaaaaauuagccggucauaguggugggcgccuguaauuccagcuacucggggggcugagacgagaauugcuugaacccgggaggcggagguuucagugagccgugaucgcgccacugcacuccauccuggggaagaagagcaaaacuccgucuaaaaaaaaauugugcaguuugaaauuguauuucauguuauguuuuaucucaauacaacauuugcaguugugaaaaaaaauugcacauucucaacuccucgggauggagcaguaaagccccucaguaaaucuuuuuuuuuuuuuuuuuuugagaccgaguuucgcucuugucacccaggcuggagcgcaggggcgcgaucucggcucacugcaaucuccgccuccuggguucaagggauucuccugccucacucucccgaguagcugggauuauagacgcccaccaccacgcccagcaaauuuuuuguauuuuuaguagagacaggguuucaucauguugggcaggcuggucucaaacuccugaccucuggugauccaccugccuuggccccccaaagugcagggauuacaggccugagccaccgcggcucgucaagugaaucuugauuccagaaagaucuguuuuaagucucuagucuggaaaaugcagugggagucuuuaggugguuugugacuugcaguuaaggagaccguggccugagcacuggccccuuuuucuucuuucaucucucuccaggaacugagcauggaauguggccucaacaaucgcauccggaugauagggcagauuugugaagucgcaaaaaccaagaaauuugaagagguagguuuauccaguugagcuacuagagagaggcacguagacuauucagagccugaguuugcuuuuuuuaggaacaugguugacagcugacugccgaugaucugguuugcacuuuuuuuuuuuuuuuuuuuuugagauggagucuugcucugucgcccaggcuggcacaaucuuggcucacugcagccucugccuccuggguucaagcaguucuccugccucagccuccugaguagcugggauuacaggcacgcgccaccacacccggcuuuuuguauuuuuaguagagacgggguuucgccauguuggccaggcuggucuugaacuccugaccucgugaaccauaugccucagccucccaaagugcugggauuacaggcgugagccacugcgcccagccaguuugcacuguuuuaggggaauuuagcuuucaucguagugauggggaagcuacuggaaaugccccgaauacaaccuugagggaccaaucaagcguggaaauggggagcaaagggauuaggcuuuucuagcaacaccagaaaggauuucuaugccgagcgggggugcgggggcuuaugccuguaauccuaggacuuugggaggccgagguggguggaucacgaggucaggaguucaagaccacucuggccaacauggcgaaaccccgucuguacuaaaagaugaugagccgggcaugguggcacaugccuguaaucccagcuacuugggaggcugaggcaggagaaucgcuugaacccgggaggcacagguugcagugagccgagaucgccccacugcacuccagucugggugacggagcaagacucugucucaaaaaaaaaaaaaaggaagaguuuguaguggcugauagaaacgcaugcucacucgcucucuccuguuacaaguucaggccaagaaaaaucaagaaaggguuuguuccacagagaacaauccuaggcacgcuggucuuggugccauuuugggagggugacuggucggugguauugggcgaccucacggacauagaaauauuuauuuugggcaaacauugccagacuuuccugaugacuuguggacaggacaggaaguggucauuuugggagugcagguugcugguagagcaccugagggcucugcccuugccuugcccagcauuugugugugggagagcagugagaccuggaccucucaugcucagaucugcuaagaggagagugauugcuaccucugcagcagcucaucugaaacgugcuggccguacgcuaccaaagauagguguaaagaacagguguccuuagccgggcgcagugguucacgccuguaaucccagcacuuugggaggccaagguggauggaucaccugaggugaggaguucgagacccgccuggccaauguggcaaaacccuguuucuacuaaagauacaaaaauuagcugggcauggugucgggcaccuguaaucccagcuacuugggaggcugagggaggagaaucgcuuaaacucaggaggcagagguuguggugagcugagauugugccauugcacugcagccugggcaacagagcaagacugucucagaaaacaaaaaaaagaacaagcguccugcauccuguucugaaaguuguuuguguggguacggggcagccugugaguggauaaauaggccuccgaggcugggauggucccgggcccuguguccacggaucuuugcagcucagguugcaacgguaagaguauugucaaugagacaaaggaggugagagugccaguugucugaauugguugggauguuggucagaugacaucuaaaagaacacggccauuuuguuauuauuugguuagagacaaggucucacucugucacccaggccggggugcagugucacaaucauggcucacuacagccucaaccugccaggcucacgugauccuccuacuuuagccucucaaguagcugggacuacaggcaugcagcaccacgccuggcuaaguuuuguauuuuuugucgugacagggucucacuguguugcccaggcuagucugaaacuccugggcugacgugacccucuccccucugccacccgaagugcugagauuacaggugugagccaccgcacuuggccagaacacggccauuuuaguuccccuccuuagaggaguaaggccaggaaugagccuguggucugaaagccguggcuguugguuaauguggagaagggaagguggugagagccagcccaaaccccugccgagugagacugauucuggcagcuuuagggagcagggaugagccccucacaggcugggugguaguuagaggaggcagauuucagaaggccacgcagcgcucuuucucagcaggucaggcaggcagcagaggucgggcaggggcauggggucgagggcccgaugcugguguguucacuagaggagagccacaagcagggauucugggucaggugcaggccuagggcuuagugugcacuugugguucugagacugucccaugacuuccugccagcauuccggcagcucuagugggacucccuccugguccaggugaggccaccauugcugcccuggcuugcugcuguccucucagcccccagucugucaccuggugggaguuaaagggaccugcugggguuugaggaagcucugagccguucccuguacgaagccuguggucaucucaggcugcaggagacacaggagauacgagcuuuggagguggggcucucagucacaagcccccguuguuccucccuguccuccgcucacggcacugcuccaguugccggggccaggguucuuggagagcacauccucaccgcuguccccucugcuggugacagcacgcaguggaagcacucuggaaggcggucgcggaucuguugcagccggagcggccgcuggaggcccggcacgcggugcuggcucugcugaaggccaucgugcaggggcagguaaggcccagggcgacgcugggaugggugacgucaggcugcccacugacuguccugucccugcugggccguguuuggacuccugccucggugaguugcugggcacagggucuaggggcugaugggcucuggagcuggauggccuguggggucuccuggugucaugaggucugugugaccguaggcacugccuccucgccuguaaacagauggucacugcaccuuccucuuaugggauguucuggggaucauaugaggcaguucucgcagagugcugagaucguaccuggcagcugguguggggcuacgguguuguuuugcccuugcacccuuucggggccacuccccugcucacugcauuccaucugugcuggucuuggcugacccugaacacccaggccucuugguguuccugccuccccuggucggccacuucuacuccuucaugucccagcugcucagaagggccguccacucucacaggcucuccuggguuucccccacucaggccuuguccucagucucugagcacaaggcugucugcccugcaccgagugcaggggucgggcaggagcugugucauccccugcucugcgccacccgcugugccaggucccgacacacagcaguugcuccccauacgccgcucugcggucggccggugcauccggcccccugcccuguacaaugcugaugcugcagaccugucucuugcagggcgccucugugggaaggagagggguccagggcuggaguccgggugccccugcacuucagggacuucuuggcagccgugugggcgacgcuggcaggcucugcugauccuguggcuuuugucuuuagggcgagcguuuggggguccucagagcccucuucuuuaaggucaucaaggauuacccuuccaacgaagaccuucacgaaaggcuggagguuuucaaggcccucacagacaaugggagacacaucaccuacuuggaggaagagcugggugggugccaccuuggguuggagguuucucuggccuugacgaucaaguguaaccuggaugggaaggaccuggggcuggggaggggcugccguucucagggauggccugcagcggguaugcccacccugcuucaugcaccugggcucaccugcguggccggagugccccugaggcacguguuaaaaaugcagaguccuggccuucaccccagaccugcugacugugagucucuggggcuuggggccuccgaacaccucugcaacggcaggagcugggcgaguucugucacugggagguggugcugcugacuuggucucaaccggagcguacuggucccgucuuccuccuccuuucuccacuuuguggaccuuccuccugccauccuguggugggagguuuccauuagucuugggucucugugucaugauucugggaaguagagaaagaggaggaagagaucggucugacucuggcuuugcuguucugucgcccagaaaagggccucaguggcugggcugccugcaggacaggugccggccaggugccuaccgucagguuuccugucugaggugacguggccggcagccaagugugcacacgucuccuccgagccacucucugcuggggguggggaacgcccaggagucuggugaugucggcgucucccagccucggguugggcccugaguguacggcauacacacuucugcugccgccucggcacagacccucugugcagccccaggggcgguagauccuaguguccgugcguagccggccugcccugggcuccccugagccucuucgggcccagugcguggucugucuguugcugccgggggacugaugaugggguuucuggcagugacggguuuggacacacuguccugcggcgggagggggaggugagugggagauguagauucggcguccucgcaaacugccgccgcuucucccccagcugacuuuguccugcaguggauggauguuggcuuguccucggaauuccuucuggugcuggugaacuuggucaaauucaauagcuguuaccucgacgaguacaucgcaaggaugguucaguaagaaaagaauugagauccuguucugauaaugguccuaaguucagcuccgcagugaauaaaguugaaaccaccaaaaaaauagagguugggcugggcacaauggcucacgccuguaaucucagcacuuugggaggccgaggcaggcggaucacgaggucaggaguucgagaccagccuggccaacauggugaaacccugucucuacuaaaaauacaaaaauuagccgggcaugguggugggagccuguaaucccagcuacucaggaggcugaggcaggagaauugcuugaaaccggaaggcagagguugcagugagcggagaucgugccacugcacuccagccugggugaaagagcaaaacuccaucucaaaaaaaaaaaaaaaaaaagagaaguacguagcuaucuucuguuuagcucucaucugaugucuugguuaucuuuuuguuguuuguuuagaauguugcaugagcucugucucacucaugcugaacacccagcaccgagagcaguggcuggcgcacagcaggcaccugagugcuuguugggugggugggacccccagggaggaugagccaugcguguuauugacgucauagagugacuagaccacagcccgugguggcucggccauccaggcagugcugccgggacugagcucggugcucccugcaggaugaucugucugcugugcguccggaccgcguccucuguggacauagaggucagugccuccccuccccagggccggcccauuucacccugguuucugggaggcuggggcuuggggguugagcccugugugccaccugcuggcuguguagcccugggcaagcugcucggucucucugagccucaggagucccccauguaagucaggauagccgggcgccuccauguggagauguagcucaggguggaugacagcaucaaugacccacagugacagggacgucaggugcuucccacaugcccgcuugcccuguggcuuggagagagggugccauggcagcggggagagguggcagcgcaggcugaaggaggugggaaggaagccuggguguccucuccuguggggaggagcugggguaggacgggcgugagccgucucccucuccaccaggucucccugcaggugcuggacgccguggucugcuacaacugccugccggcugagagccucccgcuguucaucguuacccucugucgcaccaucaacgucaaggagcucugcgagccuugcuggaaggugggguuucugaaacugcucuggaagguuccugagagcacauggaugggacaagggccauccugucucccaugaaugguugucugauucuugggguggccagacaauggccuguugagggacggccagugucauuuucccaggcaguugagcugaggucaggguuuugguggcauuuugagaacccugcugccucugucuuugggaggagaugguggcgagcuggccggaccuuggguggcuauagggcagcagccaggcggggccagcagcgggacuggggcugggggcagggcuuaugccugccagccccugacacgcauugugucucgcagcugaugcggaaccuccuuggcacccaccugggccacagcgccaucuacaacaugugccaccucauggaggacaggugagugugguggguggggcgcagggcaguggaggccagcacagcccucggggcagcuccagugucccuugccaagcacacacuggcuuagagaguccuuguccucucgggcagcuguuccagaggcugccacuagagcgaggcccaugacuucuaggauccagccccuguccucuccuuccucugucaguucaacagaauauccacacccagcucagugccugccccaugcucggacguccuccagcggugcuccccaacuacuuagccuguuacaaggcgaggcucggggucuuggcuugacguugcccuugcccucacccccacagccaggcuguggccacuuuuguugcuuuagccauuagagauggcucagcucugcccacacccuggccucccacccaugcugccagcucccccuccugcucuccuguauccauccgcgccuccugaagcccacuccaugcagcacccggguggccuuuuucugacacagauaugucggugucacccuuugcuggaagccaggugguucccagcgcccuugggauguaggcuucuccuauggaaccaggcccuggggccagcccugccucagcccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggccccugcaucucucccagcccugccucggcccugcaucuuuccuucccuccauccuuggaaccaggcccuggggcccagcccugccucagcccugcaucucuccuagcccugccucagccccugcaucucucccucccuccucccguagaaccaggcccugggggccagcccugccucagccugcaucucucccagcccugccccacccccugcaucucuccuuuccuccaucuugccuucuccccuccaccaagggcuugugcaugcccugauuccucuugccagcagguucuuccaccuuugccgaguuacucuguuuacugaggucuuagcguggucacugacucccccaccucccugaguaguuuuugcuguggcuuuccuucuuggcugugauuggaggaagagauuuugcguuuaccugggagauuauguggcuggcgccugucucccccagacugcgaggcugugggccaucccucuugccugcuuccugucccuggcaugaccuguagcucacagcguggucagcagugaugggcugccgccugugcgcaggagugaacaagaguguuacugcuggccucuguucccugcccuuccccagcggugcuccugccccccccaagcacagggaccucuggggcugcugcaggagccucggcaaccucacacauccauggcggacccugggacagggcccugcucacauuccgucucucuggggaacacuuuuagagccuacauggaggacgcgccccugcugagaggagccguguuuuuugugggcauggcucucuggggagcccaccggcucuauucucucaggaacucgccgacaucuguguugccaucauuuuaccagguaaggcgguuucugugugcagugagcuggcaggaacgggagagcuccccucacgccugcccacccaucccacuggggguccugcugcgggggcugcgguggcauuucuaggccuuuccaggcaguugcuuugcagcugggggugagguuuggggcccuuuguaggcuuuagucuuuuuuuuuuuuuugagaaggaguucugcucuuucugcuuggcugacugcaaucuccgccucccggauucaagugauucuauugccucagacuccugaguagcugggauuacaggugccugguaccaugccuggcuaauuuuguguuuuuaguagagacgggguuucgccauguuggccaggcuggucucgaauuccugaccugaagugauccacccaucucagacucccaaagugcuaggauuacaggcgugagccaccaugccuggccaaaggcuuuuuucucucucucuuuuuuuuuuuuuuuuuuuuugagacagaguuuuacucuuguugcccaggguggagugcaauggugcgaucucggcucacugcaaccucugccuccccaguucaagccauucugccucagccuccugaguagcugggauuacaggugccugccacagugccuggcuaaugguuuuuuuuuuuuuuuuuuuuuuuuaaugggacagaguuucgcucuuauugcccaggcuggagugcaauggcgcgaucuuggcucagcgcaaccuccgccucccagguucaagccauucuccugccucagccuccugaguagcugggauuauaggcaugggccacuacacacagcuaauuuuuuauuuuuaguagagacuggguuucuccacauuggucaggcuggucucaaacucccgaccucaggugauccgccagccucagccucccaaagugcuggaauuauagguaugagucaccgugcccggccaaggcuaauguuuuguauuuuuauuagagaugggguuucaccauguuggucaggcuggucuugaacuccugaccucaggugauccacccgccuuggucucccaaagugcugagauuauaggcaugagccacugcgcgcagcccaaaggcuuuauucucaagcaaaccuuacaucuugcgaguuucaccuucuggaguuggcaguggaggggugaacgcugccucggggguagccguucucuugcuguuggcggcucuguuuugucaagugcuggucuuguccugucucugcaaugacgccguggcacagacgcuggugguacagcuucaguuuccgcagugccccgugaugacagcgcuuuuuguguccguccucguucugugcucacagcucccuggaggguggggcgaucacgucguccugguuuuauagugaugagcugcggugugggucacagggcucuccugauccucugcucuuccugcuaccccccuccccguaggggcgguggggggauguugucuuugugcacagcuugcagccgaacucagggcagcuuucaguugcugcugggcuggcccaccgggugcccaggauucaguugcuggucuguccgagucagggacuuugcaggcaggcauggggguggggcccgucuggguccugacugugcuggagcauguagaaaccccuccugggcgccccaccugcuguuucugcggccccugauaaacguguggugggcacugcgcgcucaggcgugcuacucucggucccaagggugacugggagggcgucccacagcaagcaagcagcucugacccugugugcuggccgggcucguguuccaggccauggcauguccgaacgaggugguguccuaugagaucguccuguccaucaccaggcucaucaagaaguauaggaaggagcuccaggugguggcgugggacauucugcugaacaucaucgaacggcuccuucagcagcuccagguggggugggggcaggagcuccggggagcaccgggaacccagacaggcaggcucggcccacucagaagaugguaccuugggccccaucucugggggucccgcagagacugccagaaccguguucucuggugauucgcaguggcgcucauccaccuuccaccggagacaggucugauuuuuccagacguggugcaucguuuaggccccagacaggaauaugcaguaggugagccggggcugggccagugcuguccacaguccgcagagugaccugcaggccgccuucguggccugagugggccccggcacaguucccagagggaugccaguguggcuuccgcaugacuuuggaggaccgcauuagucgagucuguuaaccacagcuuuaaggaggacuccacggccacacgggcucaucagcauaggggcccuggggaggcgaggcuaguauccagcagccucagggcugugccuuuuccuggagccuggggcgggugauguacaggaggccaggcagcagaagggaggccgggacuucgccgggacuuagcagggacugaaguccucucagagccugucgcugggccagagcauugcccccgaccgcugguggcaguggcagaggucauagccuggggcuucuaaaagaggcuggaccugggagaggcaagaaaggcuuguaguuguggcuacucuuggcccuccugcccgagcuuccuucuuggcccagcugcaugggcacagccaagauuccuuggggggugggguacgggcaggaacagcagcugccaucacagccacuguggccccuugagaggaucugggggguguccugggccacgugggucaggguggccccuggagaggaucugggggugucucaacccaugaggcccggagcggccucagagggcugggggcgucuguccccaugcggcccagagcggccugagagggcugagggugucuccaugcgguggguguguagcgaggccucuggugccaaguccauguggggaguggaagucagccugugucaucgugccugguacugcagaccuuggacagcccggagcucaggaccaucguccaugaccuguugaccacgguggaggagcugugugaccagaacgaguuccacgggucucaggagagauacuuugaacugguggagagaugugcggaccagaggccugugagacccccuccuggguggggccuuugggcuuuggcugguggggaggggccgggugcugggugaagugcagcuuucugagccucagaagccaagggccaggugggcgccugcuuuccagguuucugcacucggcagggaaggcuggcaggcacagcacguguuugguaacaagcucggggcuagcccacccaucaguuuccucccaccuguguggagcaagcuuccauccggcucuguagaguccuguggcucccaggcggccgcagucauuuugccaggaacacucagcuuagggcccaggcuuuuccauggguuuggacacaagucuuccccgcugccaggagugccuuugugucugggcugugggcugcaggcugugaggcggcugggcucugacagcaaaccagccucucgaccagcagcccaguguggagaaggagagcgccggaggggcagaggggcaacaccggcucuucuuuugacaggaguccucccuccugaaccugaucuccuauagagcgcaguccauccacccggccaaggacggcuggauucagaaccugcaggcgcugauggagagauucuucagguaggggguccucuguagccuugccuggcaccuggagccuggcccugucucugucuggggcccacccgggcugggucucaggaugcccgaugagcagggcccuccccucugccucuggagagcccuggcucugggugagcaggugcuagcuugcuuuccaguccagcaggacagguccucucaugacgccacugggcucccucuuuucgggggucgucuggagagaugcucccugggaagcagagcucugugcccugugugccuggccgcgggaggacccagagucgggcuggccugcgccaggcagacgggcugguguggggcuguggccgggcacuccccacccgccccagcaggcugccgucccgcaggagcgagucccgaggcgccgugcgcaucaaggugcuggacgugcuguccuuugugcugcucaucaacaggcaguucuaugaggugcguguccaggcggccgcagcugggggcucagggcuauuucuccgugggcgggcugucucuguugugcacgugcucccgcagagccgggcucugccugggacuucgguccugccggacccucugcagcccccagcguggucuguuuaccccuguucauucacuggcuugcucguccugggugccucugccaggccuugacacguggccaaguagcaaggaaggcacagugccugcccucagggagcuccggccgguuuucacccaacacaggagccucuuaaaaauucugugugaguucguuucagccagucuugcauggggacauugucuuccguuucaguccugacguucacccugugcaccugcgugaucgccagcccugccuggucucuccucugcgggcucucccucuccacucccuccucugggagcucuguggccccaggcccaccuuccuugagagacauuugugugccugccagucauaccccuuucccaggaggcgcagcuuaggcucugaggcugucccuucccaccgaacuccucccugcagccucgcaguccugcccuccugagagcugcccacucugcuccucuccccagcguccacuguccuugaauugcccuuugcugggcauugcgaucccgcauucugucugagggagcuaagggccuccuggaaguuccucuggguccucuggcuucucccaucagggcuggucuuguccuggucucuguuccuguggaacuuuuuaccugcuucugugaaaacucacgcuguccucagcacagcacgcacacacacgcauauucacgcaugcacaggcacacacgugcacaugcccacgcgugcacacagccacacacacccucacgcacacacgcacagcaccaugugggagggguucucggcugugacagugaagggcagggccucaccucggcugcuccuugugaguugugggccccgugucugugcccggccgcccugcggugcucaccagccuucugaacgaggagcuggacaggaucccuggaaggggccccggggucucugagucgcgcucagcgggugcuugugcucucugcccagcugugcugaagucccgagggacauguccgcugcuugcgggucgguuccugaggaauuggaagugucacgagauguggcccucguugggcuggcgcucauuggccucccuugugccugugcaggaggagcugauuaacucaguggucaucucgcagcucucccacauccccgaggauaaagaccaccagguccgaaagcuggccacccaguugcugguggaccuggcagagggcugccacacacaccacuucaacagccugcuggacaucaucgagaaggugagagccguuguacccggggccgggugcuagcgugccagagcuccgugggcagcaauggccucugggcccucuguccuccucuucgagugaccggauggcuguguccguaggugaggcuccccucccugcagggugggugucccgaggccugugcagggccugccacugcuggauuuguguccugacugaaaguccuggacauggguguccugucacacucugggacagcugggcugggccuccuggaccgacgcuggagcccagaccuggggcuggggcuuuggccugccguccucccugcccagccaacagcuuugcucuuugauuuucagaugcauuuugguuucugcacagucacucggguauaaagggcaucuuugcuuuugagcaauaaagaugaaggccgggcacaguggcucacgccuguaaucccagcauuuugggaggcugaggcagguggauugcuugaguucaggaguucaagaccagccuggccaacauggugaaauccugucucuacuaaaaauauaaaaauuagcugcacgugguggcgggcaccugcaaucccagcugcucaggaggcugaggcaggagaaucgcuugaaccuaggaggugaagguugcagugagccaagauucugccacugcacuccagccuggacgacagagcaagacucugucucaaaaagaaaaaaaaaaagggccgggcacgguggcucaugccuguaaucccagcacuuugggaggccaaggcaggcggaucaugaggucaggagaucaagaccauccuggcuaacacggugaaaccccaucucuacuaaaaauacaaaaaauuagcugggcgugguggcgggcgccuguaguccuagcuacuggggaggcugaggcaggagaauggcgugaaccugggaggcggagcuuguagugagcugagauugugccaccgcacuccagccugggcgacagagcaagacucgaucucaaaaaaaaaaaaaaaaaaaaaaaagguguuugugguagaaaguguucucacggcugcugacucagaaccaugagccuguguguaaguccuggccuucucuucaaaggugauggcccgcucccucuccccacccccggagcuggaagaaagggauguggccgcauacucggccuccuuggaggaugugaagacagccguccuggggcuucuggucauccuucagguggguguucugcacgaggccucugcucccggggcgcgcauggcuagcguccaccagcugcaucugcguuguguuggagucuguuccccagcgggacccacacccucccuggauuugcugagggugcgguggucucagcaggcagcagaaccuuccuccugcucuuguggagggauggaugcaagaggccccguuguacgcccugaccagagcuugucucugugcuccugagucagggccggaaccauguaccauccucagcguggcgcuugcccucgucacccagcacagcaccugggaaguaaggguggcccuccauuccugcccugcaguccguuuaauauuugcagcuguuuuguugagauuuaauuuacauaucaugcaauuuacccauucacagugaacaguucagugguuuucaguaaauucacagagcucugcagccaaccccacagucagcuugagaaccuccugagcauaccaguagcacacgcucccaucccccguugcucccguacccccggguaccaucaagcugcuuccugucucuguggauuuaccuacucucaacauuucauggaaguggaaucacacaaaauucauccauaagauguuggaugguagaacaguuuccugucugcugacuggauuguuccacccagcgccauguguccaggcccguccaggcuguggcagcuguuggugcuccccuccuuuucauggcugaguaguauuccaucaucuggaaggagcacauuuugucuguccguuccuccauugguggacauuuggccuguguccgccuugcagcugcggugaguggugcugcugugaaccuucuccuacgagggcuccgccgggccugcauuuucacuuuugggucugcaccuaggagugaauuguugggcccuagguuuagucugcauuugguguuucaaggcgauaccaggcuguuuuccacuggugcugugccauuuuccauccacucgagcagcauguaaggguucugauuuaucuuuuuuuuuuuuuuuuuuuuuuuugauacagucucacucugucgcccaggcuggaguggagugcaguggcgcgaucuuggcucacugcaaccuucgccucuuggguucaggcgauucuccuaccucagccuccugagcaucucguauuacaggcaccugccaacauacucggcuaauuuuuuguauuauuaguagaaacuggguuucaccauguuggccaggcuggucuugaacuccugaccucaggugauccucccgccuuggccucccaaagugcugggauuacaggugugagccaccacgcccggccugccucuacuuuucaaagccucacagcaucacuuacgugugacugucagugucaguaucguguaaaauauaauguaugaaucaguuugcucaaaagcucauccuuaagauguuggaugguagaacaauuuccugucauguuuauaugucauggguuuuuauuucuugccauggaaguugaaaguggugaugauuuuuuuuuuuaauuaauuuuuugagacaagaucucacucugucgcccaggcuggggugcagugcugugaccauagcucagugcagccuugaacuccugugaccaagugaucguccugccucggaggccucccaaguagcugggaccauaggcacacgucaccacaccuggcuaauuuuuucauuuuuuguagagauggggucuuuauauguugcccagccuggcaucaaccuccuggccucaagcaguucucccaccauagccucccaaagugcugggauuacaggcaugagccaccacaccuggccgugguguuugauuaaaaaccaggcaucagccgggugugguggcucaugcccguaaucccagcacuuugggaggcugagguggguggaucaccugagguugggaguucaagaccagccugaccaacauggagaaaccccgucucuacuaaaaauacaaaauuagccgggcgugguggcgcaugccuguagucccagcuacucgggaggcugaggcaggagaaucacuugaacccaugaggcagaggguacaguaagcccagaucacgccauugcacuccagccuaggcaacaagaaugaaacaacgucucaaaaacaaaacaaagcaaaaacaggcaucaccuccuuggugucucauccacaugagcaccaugcucuuuacugacugguugggaaggggugugcugggcugugggggccuauggccugggagaacugagaaccuuucugcuucugcagagggaaggaaagagguucuguugcccuuacuuggaacuccagcccuggaggccugagggucugggcugcagaacugagauauuuccuaguugaggcagaguccugguucuggcugcuuucauuucuuuauuuuuuugagauagagucucaccacuaugucacccaggcuggagugcagcggcacgaucucaccucacugcaaccuccgccucccagguucaagcaauucucuugccucagccuccugaguagcugagaugacaggugcgcaccaccacaccuggcuaauuuuuguauuuuuaguagugacaugguuucaccauguuggccaggcuggucucaaucuccugaccucaagugauccacccaccccagacccccaaaguguugggauuacaggcgugagccaucgugccuggccuguuuucauuucuuuuguuauaauugaaaaguaacacaguugacucuugaacaguauggggcugggagugccagccccugugcaggugaaaauccccaucuaacuuuuaacuccccagaaacuuuaccaacagcccucuguugacuagaagccuugcugauagcagacagucuauuaauguacagcucguguguuuuauguauucuguguuuuuacagugaaguaagcuagagaaaagcaaaugcuguuaagaugcuaggcauggugacucacgccuguaauccuggcaguuugggaggccgaggcgggcagaucaugaggccaggaguucgagaccagccugaccaacauggugaaaccccgucucuacuaaaaauacaaaaauuagcuggaugcgguggugcgcaccuguaaucccagcuacucgggaggcugagguaggagaaucacuugaaccugggagguggagguugcagugaccugagaucgugccauagcacuccagccugggcgacagagaaagacuccgucucaaaaaaaaaaaaaaaaaaaaaucauaaggaagcgaaaauacauuuccuguuccuuaaguggaaguggcucaucaccaaggucuucauuguugucauccucauguugaggggacugaggaggaaggagaggagacacauggucuugcucucucgggugggagaggcggaagaaaauuggcauguaagugacccaugaaggccagccucgugcuguucgagggucagagaguuugcacaauggacacggugacaaguuugauuccccuuuuccugccugccuagugggcccggcagggcggcagcugcuguugguuccauguggccuucccagaauggggggugccaggcacugugugaacccccaccuccaccucuuuuuuguccgaggaagggauguugcuuuuaugucauaauauuuugagaugaggagaaacuguuaaucauuuaaucaucuuuuuuuuugagauggagucucgcucugucgccccagcuggagugcaguggcgcaaucuugguucacugcaaccuccgccuccuggguucaagcgauucuccugccucagucuccugaguagcugggauuuacaggcaugcaccaccacaccuggcuaauuuuuuuuuuuuuuugagacagucuugcucugucgcccaggcuggagugcaguggcacgaucucggcucacugcaagcucugccuccuggguucacgccauucuccugccucagccucccaaguagcugggacuacaggugcccaccaccacgcccggcuaauuuuuuuguguuuuuaguagagacaggguuucaccauguuagccaggauggucuugaucuccugaccucaugauccacccgccucggcuucccaaagugcugggauuacaggcgugagccacugugcccggccuaauuuuguauuuuuaguagagaugggcuuucuccauguaggucaggcuggucuugaacuccuaacuucgugauccacccacuucagccucccaaagugcugggauuacaggcgugagccaccacaccuggccucagucauuucuuucaaugauuuuuuaaucauuuaaagguguuaaucauuucuuuaaaagaauaacaguguaaccacuuaccuccagagugcugcaaagggucccucaggccagauuuccccuggcuccugcuggccucggccccaggguugcuggaggcaacagaugcucuucacaccuugccacacgugucugggaggugcccuugaccuuuugggaggggcugccuacaccugggaucgcccugcagcacacacuccccgccccauucugcccugucugccacgcagcuggagcuucuccauugaauggacucuuccucaccuguugaugacugcccugaugaugagaugggcacgagguuggguuuuacuuuuugcugcuguggagagagaguccuggugguccuggguuugaaggucguguguuuugaagcacgcacucuagagcagccgccccggccccugcuccgggacaagggugcugucuuaggacugcguuuucaccuccugcgccguggugagcugcguccucucucugcagaccaagcuguacacccugccugcaagccacgccacgcguguguaugagaugcuggucagccacauucagcuccacuacaagcacagcuacacccugccaaucgcgagcagcauccggcugcagguaugguggcugggguugcgcagccaguuccugggggcccagccagguauccccgucucggcaggugugguuccuggaagcugcagagacggccccaggauggggccucagcugaccgucccuccucugcacccacuguggccgcagccuccccaguccugguguccuucccucugccugcaguccacacaucuguggcuugucgcucuaagccgcacggugacauggguuggggcagagaaaaggacgcacggcgacuuccggggcagugcauggcccugacgcuccuggugcugcagaaucugugaaggaccugcagcagagggcugggcaggugggcggcacagggcagagcugagagggcagagcugagacggcagggcagggcuggagagggcagagcugagagggcagggcagggaugggcagaacagggcuggaggaguuucgcugaguuugcgcuauagauguuggcaccaggcugagcagaggugacugggaugggagcccucccuccuagagcaggugcucucuggggccaccccuguggccucagaguccuguucagccugucgauggaagaaguggcagggcugggagcugagcuccgcuuucuggcaguugggggcguguggugcugccagaggagcgaggcgcccaucccuuccaucccaggcgggcccagcuguggugguggggacaccaggcucugugagcuccgaggcaagggagggaggaggcugugggugcugggccuccggugucaccaggacagagccugugucuguguugggaugugggugugugcacaucagcagguggccuuuucugagugccuguggugcuggacgugggucugagcaggugggacgccgccuguccugggccugcacgagcuuggcucuggcuuucaccauccucuuccugacaggccuuugacuuccuguugcugcugcgggccgacucacugcaccgccugggccugcccaacaaggauggagucgugcgguucagccccuacugcgucugcgacuacauguacgcgggaccucgcccacggcccaugaggcucagggcgucagaggcgcuggggcugugguggcgcuguuugcaugucugagggaugucccaggguugggaagagccaagucuguuccguuccugcugcggggacuuggccucagcugcuucucuugcuucugcagggagccagagagaggcucugagaagaagaccagcggcccccuuucuccucccacagggccuccuggcccggcgccugcaggccccgccgugcggcugggguccgugcccuacucccugcucuuccgcguccugcugcagugcuugaagcaggugaguggggccgggcagggaccauccgucccacguugggccaggaggacagggagcugccaccugccugcugggccucccucccugucuggccuguggagggcagcccucccucagagcugagccuucccccuuccccgagcagcugcagggacagaggccugcgcugggcaggcucccccggcugagaacagggcuccauagcccuugacgcugugcagccacaaagcagagccucagaugcuagcuuccgccucugucucuaggguccagaaggcccuguccugacgccuccucuccucgcaggagucugacuggaaggugcugaagcugguucugggcaggcugccugagucccugcgcuauaaagugcucaucuuuacuuccccuugcaguguggaccagcugugcucugcucucugcuccaugguaccauggccggccugggguuggggugggggacccaguaggguuuuuccccaaaagacugcgagccucugggcagagcgagugagacccuucgggcucgggcuccauuucccucaaacucagcugcacucuggagcgcagauugugccuugggcaggguggagggaccccugccccagcucgcagcuuuugggacugacgucagagguccccagccaagggcaugucacugaauguggaugucucccaucugugcuuuuccuaaguggggcucccgugccguucaccucacauuccugguguguuacuuggcaggcacucccaccacuccgaaagggaggcccuuccugggagggaggcaagaaggcuccccagccccuuugcccccuuuccugggccugcguucccagggccuccccagccccucuggcuaccccgugaccuggccgcuggggagagguuucaugccuggauuuggucaucagcuuucaggcccaaagacacuggagcggcuccgaggcgccccagaaggcuucuccagaacugacuugcaccuggccgugguuccagugcugacagcauuaaucucuuaccauaacuaccuggacaaaaccaaacagguaggaggucagagcaggacaggcgagcuugauggggccugggauucgagggccuggcccagguaggccccacauuuuucucauaaacgaguuucugccaggccagggaugagugaguuggcucugcuucccuggguggcugccagaugcccagaguggggacauccgauucccuggugcuucuagcucucuuuggggccugggagccauccaguguucccuguccaccccggacagcaucucugcucucuguagagcguugccuggcuuguuccugcugucccaagggggagguggccaugccgguugguggagcugggcugguucugaggcgcagggugggcaggccagagagucuggcuucugccucccuccacgccccaucaggugccggaaacugucccuucaccugcgaucugccucgcccccgucccagucgcauucuuccacaccucucuuugacauggcccuccgggacgaggagcugguguccuagagauucuggccuccgcucagggccaugcccgccaggagaugcugacucugaggcuuggcccaucugugccccgggccucagcuucugaugguggcccuguagggagcuguuguuggguucccaucccucaggcucagccccacccuguugggccccuucagccccucugagaggcucacuggguccucaugggucuugccucaaagcauagccagccuugcugggcugcagguucugaggccuuacuggcccacaguguauccgaggggugaggccggcuuugggaaauggaagcuguucccgggacacugccuggcaggccaucuggccccgggcucugccugagcuccgcucaucuucugcuguccucauggaagacacugcccaggguuggugugggaucugguggcuuggccacuucaggcagcacugccccuugcaacagagccagccugugaagggcccagaaccaggggaugagagcccagcaugucuggguucuguuggccugugggaucgugucggaaugcaacugaccggagcagucugcugugcagagucugcucggguagcucagcacugcuggcucugccccacaggcauucagggacuugcuaagccucggcuguucucccgguggagcacucgagguuggcgagggguaggcgaggcugccucugcugcaagcggguggggccugagguguccugucuccugcagcgcgagauggucuacugccuggagcagggccucauccaccgcugugccagccagugcgucguggccuuguccaucugcagcguggagaugccugacaucaucaucaaggcgcugccuguucugguggugaagcucacgcacaucucagccacagccagcauggccgucccacugcuggaguuccuguccagugaguccccgcccugccugcgcaugcacccgagagguucgggcuguguaaccugugcgggcuucucuggugcccucucucaggacuccuuggggaaccugggugucucgccuucugcugccucagggccugggcgucucugcccggcugccaugagugcucuccuuccuggcuuugaggggcggcuccucucaccccucuaguguccaugugaacgcuccuccuugaagaagccucuucccccccgagcaguggcccuccccugguuuugggccuccucucuguccaacagagcacacgccgcuucaggggggcuuuguucgcuucccccagacugugacuucaggagcucaggugccugucccuuccccucaccgccugugcgcaucugggcaggcccucaauguugagauggcagaagggcacugcugggcccgcacuugguguagaggcuggagagaagaucgugugugcuuugugggccacaugcagguccugucggucuuucuguuuuguugauaacccuuuagaaguguagaagccuggccaggcgcgguggcucaggccugucaucccagcacugugggaggccgaggcggguggaucaccugaggucaggaguucgagaccagccuggccaaccuggcgaaacccugucucuacuaagaauacaaaaauuagccgggugugguggcgggugccuguagucccagcuacucaggaggcuaaggcaggaggcaggagaaucucaugaacccaggagguggagcuucuagugagcugagaucacgccaccgcacuccagccugggcaacagagcgagacaccgucucaaaaaaaaaaaagagagaagugaggccgggcacgguggcucacgccuguaaucccagcacuuucggaggccgaggcaggcggaucaugaggucaggagaucgagaccaucuggcgaacacggugaaaccccgucucuaauaaaaauacaaaaaaacuagccaggcgugguggcgggcgccuguagucccagcuacuugggaggcugaggcaggagaauggcgugaacccaggggguggagcuugcagugagccgggaucgcgccacugcacuccagccugggcgacagagccagacucaucucaaaaaaaaaaaaaaaaaaaaaaaaagaggugcggaagccuuuccucacggaucacacaaaugguaggcgacagcucgaauuggcccagaagcugugguuggcuggccaugggaccgagaguugaggccagggucgggaaagccacguccguguggccguggccuucucuccucugcagcaccccaucgcugccgugggcagagcagccguguuggccuucagaggcgcugcacgggaccccggcuccccugaccacccucuccauuaccgcagcucuggccaggcugccgcaccucuacaggaacuuugccgcggagcaguaugccaguguguucgccaucucccugccguacaccaaccccuccaagugaguggucgccccaggcccugugccucccagccguggcccccgcuaggccuugcggcagaaagccccggcagccuuuguccccaaggccugagcgccucgguuuuuugcacuucaugcccuggggauguuucccugcugccaggauggagugccagcccccuucucaucucagguuuaaucaguacaucgugugucuggcccaucacgucauagccaugugguucaucaggugccgccugcccuuccggaaggauuuugucccuuucaucacuaaggugggcucagggccggugaaggcugugucucucgguaggccagggcuugcuuugcccuuggcuguccauggucgggcagagugacaggcagguggagggcagugggaggguguuuggggcugugccuguggcgcugggggcucugcugggcagccugcagggcuuugaugcgcggcaggcauugaggggugggagcugggugccgccgccuugccccuagccugcagcuugucccuggccagggggcacccggcaggccuggugagggccuccagcccccauugccaccccucacugucugggugugcucacucugccagggccugcgguccaauguccucuugucuuuugaugacacccccgagaaggacagcuucagggcccggaguacuagucucaacgagagacccaagagguacggccugcgggggugugccuggagucggugugggguggggaaggacauggggcuguggccugccugacggugccuccaagucagugaguggaaauggguccugugugcccuggaguaugugaggcagggcaggaccugcaagggccgcuaacaccccucagccccucagcagguuggccgugguggccuggguccgggcugcgugugccacgggcaccuacuuguggaauuggggguuggggugcaagcuuuaggcgccugagccccucgaaggagccggccuugucuggggcugcccccuccucugcagcccccagccugcugcuagccggggacucugcuucaucaccgccgccuugccggaccgcaaagagcugagccagccucuguguucuuguuugcauuucauuugaacggcuuucuccuccugucccccaccuuccugcccgagcuauuuuggcuuucccuagaugggaauacggcauuuuccagcgugaccucaacucggaagcuguugucuccagccccugggggccgggggccaagcucggccauuacggccagagacuacuuucuggggucuuggucucuuuuccuagugaccuucagggccuggccacugaggccucagugccgccucggucagagcugggcggugccugccuuccgcgggugggugggauugccuggccagcacagccuggaaucugccgugggggugacccacacacguuuaauuugcacugacguuguuuguuuuggugucaugcgugaagccuuacuuguucucagucauguuuaccagacguauuaucaugcauuuuuguuuucugucucuuccccgcuaacugcccuuuggcauggcucuuuuugcucaucucacccgcgggaucucuccauccugacccuguggccugggaccuuuccuccucaccccuccacuggcuuguucuccccuucccgggagcugggcucucuggggcguuggggcuccuuccucacccgauagucugaggauagccagaccccccaaacaaggcuugaauaacucuccacccgugaaagaauucaaggagagcucugcagccgaggccuuccggugccgcagcaucagugugucugaacaugugguccgcagguagcgggacugucggguggggggcacggacccuggagcuuggccccgugagcaccuggguggcagugcauggggcugcuugcaugaccucaucgucugcccguguccucccuggccagcccagggggagccggugacgagggguggaaagguugcauucuguccccaggccccguaugagcacgggcugguugcacgcauccccaggcccccucggggugccgcuccgagagagccaggcgugccgggcagcagccuccccaggcuguccccaagggccgcaguguggguugggggagacaccacuccugguuuuggccuuuucguauucucuagaauggacguuuuucuucgggcuuucuucucaacaagguuuauuuuuuguuguagcugaaagggaacaaggggcauuuguggagggugcugggguggggcagccugggagggccugggugggggcuaggauccugcagggcaugggcaugggccugggccccaggccauggucuuaguucuccccgcagugucugggugcaggugugggcucucgggcucucggcugucaccugccugugggucaucgcugcuggcacuggcagaggggauaccugucuccuccuggaagcccguugcaggccaaggggucccauggcccucaguccauccaccuccucaccucaggccggccucugcugggugggacuuggccagggguuggggugguagaggugcucggugaggcuuaaagccauuuucuagcacauucuguaucaugagcaaaauauugccuaggggcuaugaaauuuguaucagaaugaacucccauaagccucuucccugucacuggguguggagcucaggcagccgcucgccugccugagggugacgguggaaggccacauggggaucccagaccucugugugcuugccggaggcagccugcgggcagaaugcaaucugggccugucuguguggccuccgccucucugcaugacuacaccguuucgccaggaggccguaaccuagugcucccgugggcuucggugagggggaugucggucucuagccuccugagucugcuccgaccaguaggccuggucuuccccacccagcgucuccccguucucugggacaaugugguccacgugauucucaagcugaggcucgcugggccgcccacgcccuguuggggucuuuccgagcgagguccucagccgugcaugcguugagcuuuggcccuuggugauagguggcucggcccgcccuaccuggcacccugacccuggucacggccucucccuccagcaggauacagacgucccucaccagugccagcuuggggucugcagaugagaacuccguggcccaggcugacgauagccugaaaaaccuccaccuggagcucacggaaaccugucuggacaugauggcucgauacgucuucuccaacuucacggcugucccgaagagguccaggcggcacuacagggcugggcgggccugcgggagcuccacgggcaagcuggguuucacgcucccugucuucuaggucuccugugggcgaguuccuccuagcggguggcaggaccaaaaccuggcugguugggaacaagcuugucacugugacgacaagcgugggaaccgggacccggucguuacuaggccuggacucgggggagcugcaguccggcccggagucgaggugacugcaccuuccuuuccuccgcgccugccagccucgacaccggcugucccgagcccaggcccacguggcacccucguaccagccuggggacuaaguccacccugugcgugggauucucuucucagcuccagccccggggugcaugugagacagaccaaggaggcgccggccaagcuggagucccaggcugggcagcaggugucccguggggcccgggaucggguccguuccaugucgggugagccuuggccccagccaccuccacacaggcaccggggcucccucaguugcugcuggucccaguguucaggaaggccccgagcccaggggccgggguggcuggcuucaggcccggcccacguccugacucuggggugagccuuccacagcucaccccagagccguggagugguggaguguggcccgcuugcugcagaggggccugcucugggugcugguguuuccugcggguuuucagcucggcucaguccuggagcccuucucugcuccagcgagccguggucugacugcaggacagguucugggucccucccuguggcccuggguucacugaggccagcacuguggugggccgugccccaagggcagagcugccaccgucucuggcugccuguggcacuagcuugccaggcucggggggagcauucagcuugaggcuggugguuuugcaucagguaagugguggucaccaguccucugcccucuucuucagggggccauggucuucgaguuggcgcccuggacgugccggccucccaguuccugggcagugccacuucuccaggaccacggacugcaccagccgcgaaaccugagaaggccucagcuggcacccggguuccugugcaggagaagacgaaccuggcggccuaugugccccugcugacccagggcugggcggagauccugguccggaggcccacagguacugggcggggcuggccugagcgccaucuuucugccagucacccacagagcuguggacacucaggggcgauugcagacuuggcccucuugggauauuuggggguaacuuuuguuuuuuuuuugagacagagucuugcucuguggcccacgcuggaacgcaguggcgcaaucucggcucacugcaagcuccaccucccggguucacgccauucuccugccucagccucccgaguagcugggaccacaggcgcccgccaccacgccuggccaauuuuuuuguauuucuaguagagaugggguuucacuguguuagccaggauggucucaaucuccugaccucgugauccgcccgccuuggccucccaaagugcugggauuacaggcgugagccaccgcgcccagccauuuggggguaacuuguaagucuccagaggugagcugugaggggcgauccagguggcugagguggggcaggggccuguggcgaaccaagugacuuccauggcagagaguugcccuccccgccuggaggcugcaaguccgagaccaaggugcuccucggcaggaggugcuccucagaggccucaauccuuggcaugcaguugguuuuuucccuguguccucacaggcucuuuccuggaugucugcguguuaaucuccucuugggaggaaaccggucauggcuuaggguccgcucuggucccuugcuagccguaauuagcuuucugaaacccagucuccagagacagucccguucugaguuccugggguugggacuaaagcauaccaacaugggggcacagcucagccuguucccaggggcagagggagcccccgcagaggcccagagcccagggacagagggaggccuuugcagaggcccagagcccaggggcgccugggugugccguggcugaggggugcaaagaguagggguuccagcccucguggaggccuuggguccggacugugaggcugugggcuggaggccgcugcucugaggugccuggcggagccuggccucgaggcaggggcugagcggggcagcaggguggguggccgucagagcagcgcuggcuccgacaucgugguccugaggauugugggagggagcaugagggcaaaaccagggcccaggccaggaggccccuggggggccagagauggguaaggggagguacuggccucaggccaaaggugcugccgccuccgcagggaacaccagcuggcugaugagccuggagaacccgcucagcccuuucuccucggacaucaacaacaugccccugcaggagcugucuaacgcccucauggcggcugagcgcuucaaggagcaccgggacacagcccuguacaagucacugucggugccggcagccagcacggccaaacccccuccucugccucgcuccaacacaggugaguggcauggcgggccuuggcacgggcucugcucccacuggccuggugcucccggugacggcaauguggcuccucucugcugagggcgcccacacggcugggaguggucccuggccugccucagcaccauuguucuccgguguuugggaggaggcugacccgugggaggugucugcccugcucaggaagcuggggcuggcagcuucagaagcaguaggggcccuguggagccucugcccagcauccuccguggggaguccagcacugcgggcuccaggaggcucugcggcagccucccucccugccugggcccagguuuggacaccugagcccgccugcgcacucugggcccccaccccacucggcaccgugcuucucgccaggcccucuggcucuucccuguggcugcagauggcacuuagcggccuaggacgucuauucacgggaggagggaggcacugcccuccucaggucugcccaagcagcuuguagcuagcacugggccccgugcgcgccccugccggccgcuggcccugcccucucuccucugcaggcacggggccugugcucucugcucgaccuguguguagccccuccuccugcugacguggccgcacacggccuucccuugcaguggccucuuucuccucccuguaccaguccagcugccaaggacagcugcacaggagcguuuccugggcagguaucgccucucagagggaagcgguuggcugcagagcgccacucugccucauaggugcugugcucgucgccucauccgcccacccccaugguccgucugccuccauugcccuggggagcaggucccgacucgcaugaggacgucugugcagaaugucuuuggcuuggccagcgggauccccuugacuuggucccuuuguggcugagcccuguucccacgcugugcgagcacucccggcccagcuucaggccugagggguggggguggccugagucuccauggugacaucagcugagcugcagacucugauggguggcagcuguuuagggggaagcccaccccugggccugcaccgagcgggccuugcccuggccuuugguggcuccccuggccucuggaacccacagauggggcugccucaagucccagguugaccaggggcccugcagaccgaccucugccuguugcccccaagcccugguggggagugcugugaccugcauggugcuccccugccaggucuccacgugcagacgagcugguuuggaagggcugcgugggacgggcccugggguggcugacugcgcgugugcagggcuguggggcgcccgggggcugugaugguccccucuguugcugcuucuacuuccucucccccuguccugacgcuggcacaggaaaugcugcuuugggaccucccacccucucuccuuagcguccccagcugugggucuggcuuggaguuggagggugagccucugcucuugggagcagucuguuugcaaacagggacuucccccacgucacggagucuccgcagcucuccucgguuacgagggcugguuucaggcucccgcucuuuuagagcugaggcccgucgggcggagagcgucuugccccugccuaccuggaggcacagggguggcugcugguggacacuagggugggcagagccgauugccugcccaacccccgggcacucaugcaggagaggccugugucggggucacgugcaggccuucccagcguccucccugcccgcucgguggauggcagcaguaagcagagcccuggggaggcucgcagggcugcugucccucuggucaggagaaggcugguucucggaggccacgucagggccagggccuggcccagccccacauccagcagccccgucuguguccucccagacuccgccguggucauggaggagggaaguccgggcgagguuccugugcugguggagcccccaggguuggaggacguugaggcagcgcuaggcauggacaggcgcacggaugccuacagcagggugaguguggcucagagccuggacccugcugaccucggggggcuccuuaggggaggcagggcucugcgugggugugccugcacccugggaacuggcucugaacuugggggagauguucuuccacaucccucgugcacagacggucugcacuuugcagccauccaccugggccggcccuggcugcugggcagccuguggucucaggggaugcugauaccucugcucacgcaguguggggcacagcugguggcagugcugcugcgucaacgggcgggggccguagccuggugcucgggcuggucuguggcccugggauggaggacagauagggccucaccaccuccaggucaaccccaggugggcucgagggugccugcugacagggguucucuuugggaugguccuuucuagucguccucagucuccagccaggaggagaagucgcuccacgcggaggagcugguuggcaggggcauccccaucgagcgagucgucuccucggaggguggccggcccucuguggaccucuccuuccagcccucgcagccccugagcaaguccagcuccucucccgagcugcagacucugcaggacauccucggggacccuggggacaaggccgacgugggccggcugagcccugagguuaaggcccggucacagucagggacccuggacggggaaagugcugccuggucggccucgggcgaagacagucggggccagcccgagggucccuugccuuccagcuccccccgcucgcccaguggccuccggccccgagguuacaccaucuccgacucggccccaucacgcaggggcaagagaguagagagggacgccuuaaagagcagagccacagccuccaaugcagagaaagugccaggcaucaaccccaggugggccucuugcuuccgggcggggcuccugacaccucuccugcgggaaccuggugccucacuugccccaggccgagcgggcuggggugggguccucgccugugcccuagggcuggcuggaaccccugggagggcgguggagugggagauggccaggcucuguguuccucccugugggcuguggcugcccuggccaggcccucaccugggugcccaccauccccucccugugcaguuucguguuccugcagcucuaccauucccccuucuuuggcgacgagucaaacaagccaauccugcugcccaaugagguaggcguggccucccucuccugcauccgcuggagcuguguggcucgggugaaugguggggggcccagcucugcugcugggagcucaggcuugcagagggcucuggccuaagcucccuguggcagccugccgugaccggccuggguggggcggccuccuguggacgggcgucuggggcucaggcagggcucugugugccacagucacaguccuuugagcggucggugcagcuccucgaccagaucccaucauacgacacccacaagaucgccguccuguauguuggagaaggccaggugaggcugcggggccggccuaggugccuggacagggccagcugggccucagccugcaguggguagggagucugggcccccaacgccccacagagcucaacacugccggguccccuacagcaugaagugcucauugagcucugugccaggugcugcucugagugcuggggaccccggugcgagugacagguuagcgugggagcacccggcacaccaaggagugggaaggacugggcggguggcaccggucgcagggcuggggagggcgcuguuggucagugagcugacagcugaguggugagggagcgggcagggggagccugcauaaggggugggggcaucccacacaccagcagcgggggccgggcgcacccugcccagcuugagcacuggugcugggcgagcacgggagccgacaggaugggcagccucagcgcccuauaggcugcaccuucaucccaagggaaagggcagggccugggcugcuucugagcagagggcacauggccugacuccgcccagucucagugagucccuccugcuguguggcucgaggagguggguggugaugguucccgugggagugggguaggccccugggggcaggcugcugaggggccagggccccgggugugcuuugaguguggagcucccugauuuugccggccaggcacacacggggcugagggaagagagggagucaaggaugacacccgaugucuggccuggguggcugcuggaauggauggucuugucugccucagggaucagaguggggcucccggcagagccugcugggcacccccacccucugcggggcagggcccggcccgggagugaugccacccugccucuccccucuccccacagagcaacagcgagcucgccauccuguccaaugagcauggcuccuacagguacacggaguuccugacgggccugggccggcucaucgagcugaaggacugccagccggacaagguguaccugggaggccuggacguguguggugaggacggccaguucaccuacugcuggcacgaugacaucaugcaagguacggccuggcgccuacccgcuccugcugccccaggccucagggcacggcucccauccaguccugcuaccccacgcccuggggcauggcccuggcacccccaccugcuccagcuccccacgccucagguuccgagccuaacagcgugggcauggaggcagugauggggcugguggcuuugcgucccaaagcccugccccuggggagagccgaggaccacuggccaggcaccagaggacgugguccccgcaggcccccagagccccuggaguaaucaggaggugccccagugcaaggcacagagggccucagcacuggccccacaaacccauccggcccugcucacccucagccgucuuccacaucgccacccugaugcccaccaaggacguggacaagcaccgcugcgacaagaagcgccaccugggcaacgacuuuguguccauugucuacaaugacuccggugaggacuucaagcuuggcaccaucaaggugagugaggggccgucagugaggcugggccccaggcaggugcccacugcugugucccggguugguggcagguccuccucccugagcuucggucacgaggagcaggaggagaggccgcagugcucagggccccgugggcacgagcuucaccccgagccugcguuguguccucugugcccugaagccuguggcgccugcugcugagugucugucaggaguaacuggcaagugcagacugggugugcugggugggcacaguguaguuggugcuuccugucuguccggcgcggcccuugggcccccaccaucuccccaguggcagcugucaggcugcucaguugguuaucgccacgcaccacuaggcagcaaccagcgucacccucuuccuggaggugggcugggucggccagugucacagcacgguccgggugagccccagcauggcggggagagcuggcauggcccaggcagggcagauaggcuggaggccucacuccaagggccccaggaugcugaggcagccacugaaccaaaaccccggggcugguagucagaguccaggaggggcaggagcauagggaggugggcucugcuagaugccaagacaaccaguugggggggggggggcaccugggcggcugaggagggugugguggugccgagauggggugcacggcucacuucauggcugggcagacggauucggacguguggcugcagacacccugggggccccagugaguggaggugccccagcaauuagaggugucuugccuguggcugcagcauaugugggugcugcgcccagauguggagggggcuuggccugggggaggccagacaaacacagccccgcugccagaggggaaaguucaggggcagaugcugcccauggagcugacaggugucuagcagugcaaccaggcaguagccgagaucagccuucagcacacgcugugugcggggaugacccuuucucuuguccgggcagggccaguucaacuuuguccacgugaucgucaccccgcuggacuacgagugcaaccuggugucccugcagugcaggaaagguagggccggguggggcccugcagugcaggaaagguagggccggguggggcccugcaguguggcgccaagagcccugggccuggcgugaccaccaagucuccccagacauggagggccuuguggacaccagcguggccaagaucgugucugaccgcaaccugcccuucguggcccgccagauggcccugcacgcaaaugugaguggggguggguccaggcgugagcuggugggacaggcccaggugccaccugauagugagcucacccccugccuacguccccagauggccucacaggugcaucauagccgcuccaaccccaccgauaucuaccccuccaaguggauugcccggcuccgccacaucaagcggcuccgccagcggguagggaauauggggcucccucagcggggugugcuggcugcccaagcuguggggcgggugugugggcagagcgguugccacgccucccagacuuacugcccaagccgccucugccuucagaucugcgaggaagccgccuacuccaaccccagccuaccucuggugcacccuccgucccauagcaaagccccugcacagacuccagccgagcccacaccuggcuaugaggugggccagcggaagcgccucaucuccucgguggaggacuucaccgaguuugugugaggccggggcccucccuccugcacuggccuuggacgguauugccugucagugaaauaaauaaaguccugaccccagugcacagacauagaggcacagauugcagucagacagcucuuuuauugacuuugucugcuuggugcggggguugggggggugucgaggcucuagaagcggccaugcccacagaagugguacacagaagcaggcacagccagcuccgagggccuugaggcugccugggccauacagcacacucgcgcgugcgcgcgcgcacacacacacacacacagucaccuuccuccacccugggagccagcccccaggaggagucuuuuccucuaaccacccugggguccucugacaugccuaguccugcuacuugcccagaccugaugccagcaggccugggcgcugcucucuugcuaccuggccuggggcaagggaggaugacaaggccucuggggugaugagagugccuggcagacagcugugcccccagcaccggcccaaggccaagcucgcauccaagcagcagccgggcugccauaacgccaccacaccuaccaagcgcagcagguguugggggaggccagcucugggcgcaggccccucagcccuagugaaaauagugacauacaaaaauauacacauuuuaacaccauauaaauuacugacacgagacacacagugagacggugcagggaguacgguaggaacuggagagguaauaacuuaggggcaggguggcggcggugcaggcuaacccucccugaagccagcagccuuagcagugggggacaucugcccaggggguggggccgggcacagcccgcuguaccugaggacucggggaaauaaauuagcaucucagaggcuagaa

SEQ ID NO: 18229 - RNA, 8110 nt, Homo sapiens
uguaguucugugccgcccucuggcggaaaggccggcgauccuugcaucacgugacggggccgcaugggccgccgggauguguaguccgcaggaguccggcaugaccgccuugagcgcgaggaugcugacccggagccggagccugggacccggggcugggccgcggggguguagggaggagcccgggccucuccggagaagagaggcugcagcagguagcgccgcgccguggcuggagcgugggaggaggcgggauaggggcugcaggcuggagucccgggccgccuccugcggcucccagcugcgcgggcaggggcugcaaacccggcagccgcgaacgguucccacgugcggcccugcguucccaccuugcgccuuuuucccaaagauugcgguccgcaggggcuggguuucgggcgcuccgcuccgcugcccccuuucgccccaagcaagaaaacgcuuccuuucccaccacucuguccgggacucuccacuccaggcucugugggucccauccccgcccuccugcagugaacuugcuguccucggagaggcugggugccaaggacacacgcagccagaagccugcucccccagcucgggggagggugccucugagggaaaacaggaaagggcauggcacuuauuauauuuauccugcagccguugaggaccugcugggggccaagcacugcagugagcagugagggacacggacagggccucugcgcuagucccgcugggacuucugcagaauuggccagagcuggauucccauaggcacccagggaccccagggguaguccagacuaugucaggaggaacuggugcagcugggagcaggcagguggugaugccagccaggguggcaggagcuuugaugccaggauagaguuuggaguuuauuaugacaguaaacggaagucaauuaggagguuuuguuguuuguuuugagaucgggucuugcucugucacccaggcuguaguggaguguugugaucucagcucacugcaaccuccgccccccagguucaagcaguucuccugccucagccucccaaguagcugagacuauaggccccugccaccacacccggcuaacuuuuguauuuuuaguagagaugggguuuugccauauuggccaggcuggucuugaacuccugaccucaagugauccacccaccucggccucccaaagugcugggauuacaggcuugauccaccgcgcccggccggccaggauuuuuuaaaagggagugacacaaccugauguggguguuagcagacugucucuggugcaguauagaagauguauugggggcaccuugguacaggcuguugcuagaguccucaugagcuaacauggaccuugucagggucgcuggcauaaggagggcccacauaccccagacugcagagggcagagcaccccaaguguauuagaugauggacaguuguggcaugaacgagugaggggugagcuagcaggcgggauggcaccccuacccuaccuucaccuguggccccaccagagggacugcguggugcuuuuugcagaagcgaggaaaagccacagccccgugaagcguccgcggaaagcacagagacugcguguggccuaugagggcucggacagugagaaaggugagggggcugagccccucaaggugccagucugggagccccaggacuggcagcaacagcuggucaacauccgugccaugaggaacaaaaaggaugcaccuguggaccaucuggggacugagcacugcuaugacuccagugcccccccaaagguaggcaggggccccaucugcccagaugaccccccaucuuagcaagguccuuguuuucuuucuacccgguggcuuuuggcuggcacccuccccugcagacagcaccuugggaggauggacacccggugccccagagcaucgccugcaucacuguagccacucagcaggucaggacaccagugguuuagggccucgugcucgaacuucugcccagugcaggcgugaccugggcuuugugugauaucaggaaggaagaguuccuuuugcuucacggucccagggccugaaacccuuagaccaagcugaguucuaaucccuauucugcuaccagguggcuuggauacaggccucucugagccucaguuugcuugucuguaaaauggguaguaugggccaggcauggugguucaggccuguaaucccagcacuucgggaggccaaggcggguggaucaccugaggucaggaguucgagaccagccuggccaauguggcgaaaccacgucucuacuaaaaauacaaaaauuagccaggugugguggcaggcaccuguaaccccagcuacuuaggagggcgaggcaggaaaaucgcuugaaccccggaggcggagguugcagugagccaagauggcaccaccacacuucagccugggugaaagagugauacugcaucucaaaaaaaaaaauuuguuuuaaaggguagugugaugauucacgaagcaaucauaauaguaguggccaauggcuguucaguagugaugggccagauacgaucguguuggguuuuuuuuugagaccaagucuugcucuuguugcccaggcuggagugcaguggugaaaucuuagcucacugcaaccuucgccuccgagguucaaauuauucuccugccucggccucccgaguagcugggauuacaggcaugcaccaccgcacccagcuaauguuuguauuuuuaguagagacgggguuucaccacguugaucaggcuggucucaaacuccugacuucaggugauccgccugccuuggccucccgaagugcugggaugacgggugcgagccaccacgcccggccacauacgauucuaagcacugagauaauucauuuaagcuucacauuacuccagugagucagguacuauuauuguccugguguuguagaugaccaaacauacccaaaccagaccuccccaccccacagggggaggcugaugccucaaguguggcccagggcaacaaaccagggugugucgagggcggggggcggagccuggccagggaaucacccaggacccgccgccaccccggucccugucacugcacaagcagguacgcagguaccaggugcugcugucacugaugcucuccagccaaaccaaagaccaggugacggcgggcgccaugcagcgacugcgggcgcggggccugacgguggacagcauccugcagacagaugaugccacgcugggcaagcucaucuaccccgucgguuucuggagggugagcccugccuguggcaacgggggccggguggcaguggccugagagagaccucagaaggcugagggggguggcgacggugcaggaagugagggucaagcaucucaggcucggggggucccccugaagccccccccaggccguggggcccugaggccugacgcccagucccagcagcuccuuggccuuccuguucgcauccucccuuccuuccucugcuuccccgccucgccgccugcccacccuuccucaccgccaaggcugccugcccacccgccuuucccuuuguuuacugcuagccucucccggugugucacccccuccuguccagagccccucacccuccaggagcccuggggaggcugcuccccaaccccgccgagcacuggaugguggugggcggaucuguugaaagcagcuugguggguggggccgcuuccccuuggcacccgcgugggccgcaguuucucagauggguuuuaaauagcccucuccacucaggcacaggaugggaaccacccggcaggccuggcagcugguggggaagccccagcuccagcccuccuuccugaaggcgcaggugcagccaagccccacuccugggagcggcuggccugcuuggccuggccugggugcuggcagggaaugacgggcaggggaaccccagccagagccuacacgugcaucauuggcccacacgggugggaggagggggucaggccuaccuugggccucccugcugcccuccgcuuguucccgccuccuggggggcgggggcugagcuugcacacguccucagcaggugcagguagcucuggccaccugugggucuccugggggcugcauccucccagguugggcugugcccuugccuccaaggcugaacccaccccugucuuucagagcaaggugaaauacaucaagcagaccagcgccauccugcagcagcacuacgguggggacaucccagccucuguggccgagcugguggcgcugccggguguugggcccaagauggcacaccuggcuauggcuguggccuggggcacugugucaggcauuggugaguagaggagggcggggcuggcuccagcccacuggcugcucuugggauuccccacauccuugugaccugugacuccacuuccagcaugcugguccuccacccagcccauagagucagaaaggugcucccaggguggagccaggccagccccacucagagacaggugcuggggcaggaggucacaugggcugagcaccugcuccgugcagggcucugagagaggccccggagcuggacuccaucugcguuguauucgggagaaauguggagcgaggaauuccccacucguggaguggaaacccugaugguugugcagggugcucuuggggccuggcuugggcccagggccucugggaaggcccccaaggucauccuucaccugagagcugcagagcaagguggggugagccaggccaagaggaggaaguguguucccagcagaaggaacagcaucuguaaaaccaugaugcgagagagagggccaggagcaggaaguucuggaaugagaugagggcagaguggggagguaaggacugaggagggaggaggaagaguauccccucagcaggugggguggggagggaggugcuggggggagaaagggggaggguggggagggaggcucugcggggacaggaggggaaugguagggagggaggcgcugggggaaugggggaggaggguggggagggaggcgcugggaggauggggggaggguggagagggaggugcugcggggagaagaggggaggguugagagggagaagaggggaggguggggagggaggcacuggggggagggcccuccuugaauccuuuucccagguccuggugucucuuccuagcaccggaggcuucuuggcaguugggugcagacagaccccuggguuugggguggggcugccuccuccucggcuuuguccagaggauuuggggcuccuaaggccacacgcagccgggcccagccaguccagaaaccagggcuuggcccugcccucugugugcccccaucccaggccccuuugggacuccugcagggggccugugccggaggcggggggcuugcagcacuuucuggugggcaagagggccaccaagggccgggggccucuauucugagccggggccaccuggugaggcugaacagccacagcagccccaaagagccagagccaggccaggugcgccggggcagggccuccucccgacugagacucccagcgucaccaccugccagccucucaguggacacuugagcuuaucugggcggcuguccucagcugcccgugucccuggggugcugcaucgugguugggcagggcugugggggaaggucccugcccgcagccaggcagggaacgggcuuugggagcagcgggcacaagagacagccauguggaaauaccucccucuccaggugucugugggccugaccaccugcaaggagaccccagggcugccuccuagggguuccccgaaagagaaacgcucucaguuaaaaugucagagcuggcuggguacaagggcucaagccuguaaucccagcacuuuggaaggccgagguauguggaucaccugaggucaggaguucaagaucagccuggccaacguggugaaacccgcucucuacuaaaaauacaaaaauuagccggguguggccaggcgugguggcucacgccuguaaucccagcacuuugggaggccgaggcaggcagaucacgaggucaggagaucaagaccauccaggcuaagauggugaaaccccgucucuacuaaaaaacacaaaaaauuagccaggcauugugucaggcgccuguugucccagcuacucgggaggcugaggcaggagaauagugugaaccugggagguggggcuugcagugagcugagaucgcgccaguguacuccagccugggcgacaaagcgugacuccgucucaccaaaaaaaaaaaaauuagccgggcgugguggcaggagccuguaauuccagcuccucgggaggcugaggcaggagaaucgcuugaaacccagaggcgaaaguugcagugaguggagaucgcaccauugucuguauccagccugggugacagagcaagacuccguuuaaaaaaaaaaaaaaaugccacagccauagauugcuggcuccggucccagcucugcaccuccuggcugggugacucugggccaggcccuuggcuucucuaagcucuggccacaaagugggugaggcaguccucgucauucacuguccaggugggcaggaggcucacacaacgugacguggccugacucagccuugaagcauggccacuuccguguuacagaggaggaaacugaggcucagagccccaggggugugaccccucaggccuuguggucuccccacacccucggacaccuuuuucuaggcagcagcgaaggagcuggugcaggccucggcuuucucuuugggaaacacgggaggaggaggcagggcuggggcugcagcuggccggggccaccgggugggagaagggagccccagugagcagacgccugggguggccagcugaggggagcaggagccagaacccagguggacagcagcugcggccggccagggcaugcucccgcugugucccugaccgcugcaguggcaggugcuaggucugcaggcagugaccucaugccggccugccaggcagagcuguugccacccagccuggugcccagagccagugcuuaugccgagaggagccucaggccacaggagacagacagagggaagccuggauggacccuuccggggacagggccacguuccuggggaggcugagggcugagaggugcuucggagucgggauccugccgggccucgguuucagcauccguaggaccucaugaggacucacugagcuggccaaucucucuggcagggucuggcccccagcaagcguuuguccaagcgagcugucgcuguuauuguggggaauagagcuccaagcagagccgagucaucacccccaggcccugcccaaagcagagaccccaccacccacacauccaacuagcaccaguguugggagugggcagcccagaacagagccccccaggcuggcucaggugaugggagagaggccugcaccccaacagagggcucagccccugccccagcaccucaggggcagccaagauggucacauguaggcuugcagccagggcuuugcgguuccaaugucuaacuggagggccacgggggugguggcagacucgccucugggcggggaggggcacgggcuaggcugguggagugugccccuguucaccccgcuuggccucccagcagcaguggacacgcaugugcacagaaucgccaacaggcugagguggaccaagaaggcaaccaaguccccagaggagacccgcgccgcccuggaggaguggcugccuagguaugaguauguggggggcuuccuagggagaagagcucaccccgcccgcccucugucagcacugacccagcccccacccccacagggagcuguggcacgagaucaauggacucuuggugggcuucggccagcagaccugucugccugugcacccucgcugccacgccugccucaaccaagcccucugcccggccgcccagggucucugauggccgcauggcucuggccgaggugccgcuguggccaccgucugugaaguggcuuuacgcuucaggaagccacgccuguugaauaaagcuuugguguguuugcagauggg

SEQ ID NO: 18230 - RNA, 12175 nt, Homo sapiens
gugggucccaggcagggccuguuuauccugagagcgcgcaugcgcuauggcuuacgaggcaacagcggugccggucgaucgguggucgguucgggggugcggggcccgggagggaagugcaaagucaacaggguguccacgggggagcccgccaagcagggcugagccagaggccaggcguccuucccgggugccgcucucacacaccuacguuccccaggccugggagcugccgcgcggaaugaggggccuguccagaggccgcccuccucggggacguggggccuccauccucaggccccucggagagcccaggcccccagcagggcacaggcgcacaggguagcuggguggggagcaggguguggccuagggacccccacaccagggcaggugggcaggggcagcuccuacggccacaucaggccucccuggccuuacccaagguccccacgaagaggcugggcgccccaacuuggccacugggaagucccagggacucccacucaggacggccgcugcugaggggagggggcggggaggaaaugguuugcagagaaagguuuguuuuauugcaauuauuuagagcgcgucccaagggggaggggaagggggaggggaagggggggggucucugguauuaaguggaaacauguguggagcuggagaucuuuuuggaaaaaaagcaaaaacacaaauuccuuucagucagcaggccccggcagagcagcaaaggcccucgccccgcggcugccgcgcgcucgcucgcucucucucugucucucucugugucucucucucucucucucugucucugucucugacucucucucacaucucugggucucucucccccuaucuugcugccacaggcccccaguaccuggugggcaggggcaggaugggggcucaccggggcuggggcugauuucugggcaauggcaggaccacccuccaguccacugaggcugggggagcucggggcaggcugaggcccaagguccgugcgggaggggucccagggucccgagacaggcaggaaggggcucagaaguugcugaagauuucacgcuuccuguuccaguccaucuguggcgcgcgcuuguugacucgcauggcucgagccuucuccuuggccucggccgccguggggcucagguggaggccgcucuccuggaagggaucuugcuuccaggcacugccauccuggggugagcacgguggguggggugucuggagugagcccuagucccacaccccagacgguggccccuccuagggagcaaccaacagaggcugccugcuggggcuggggcucacgaggacuuccugaacagagaccccacugcccgggcugacaucuccacagacgccuaccccaaggccucuagcaaccccacgugugagcucaggaguggagaacauccauaccucaguguccuugucggaaccaggcaggucacuucgggacgagcacgcagagccaccauugagcugggaaaccaagggcagauugugguuucacagacacacacaacaccugcacacgcacacaugugcacagaggcacacccccccccagugugugcuccuccacucggcagggggccucgggccucugguggacuccagaugcggcggggcaggcaccgggcgccuggcagugacaggcagguggccuggccggcucauggugcagaggggguucaggugcaggaauggccggcgugagcaacgccuggggugaggccaccgccagcucccugaggaggcagagacuggagggcaacuccuuaccagguggugcccaggagaggacagaaggcaguggccccgaccccaggggccccacguggcuuguguguggcacgacccaggaugagacccacaggggcauuaaagggaggugacagggcuaaaaucgggugucacuagcacaccucgaggacggaucuccagggagaagggggccucugucgggccuggguacccccagaggcacccugugucucaugggcaccccacccucuuaccugggcagggcugguuccauuggugacgggugacggcagaggaccuguggggacagcgugucaguggcugcucagccaccacaccgcacccacccugugcccugggccguggcccaccuuccacgugcuccucggugggugugacccgaagccgcuugaaguguucaucugucucgggguccacgaccagcagccgggccucguccucccgugccuugaugcuggccaccaccucagcauggcgcagucccuccacauucugcccguucaccugccgccaccagcauguaucagccccgccaugggcccagacagcccccaacgccgcguggccagguguggcaucaaauauucaucacagccaccgcccaccgaggcagcaggaggcgcaccagcucagguucccagcgucucccuccucccugcaaggacccagggccccaguguggacaggugcggggcacucggcaccccgcagcccuggugggccgguaccucaaugagccgguccugggcgcggaggccagagcgggcggcaggugagcccggguccacagagcggauguacuggccgggccgggacuugucacuaugcagguugaacccauagcccugaggucccuuucgcagguggcagagccgagggcgcagcucccucaggggcccacugacauccugcaggcccaacggacagggucagucucuugcuccagccucccgccuccagaggccacuccccgguggugccgccacugcccaaacucgguaccgugccccccacgggcaggcccaggucucaguggcaaacacuccgggcacccaggcugccugugacagagcuuuagcugugggaacuugggcaaagccuguuuucaaacccagaagccuccccgacgggcccagccgccuucccggguugcugggagaauuccuuuggcucgaggccagcguggcgcacaggcagggugggaggaagcaccaggugggaugaacugucgccguuggccuccuggggcgguugucccugagggcucugccugugcgucccccugccccgggcucuccuccagagcguggggcaggcgcuccuaggccagcaguuuuguuuucucuccagaggccuccguggggcuggcugcgguggcggcucuguuugcuuucacauuccaggaaaaugagccgccccacccccgugggcccagcaagcaggggcuggggcaggagcuuaguguggacagggcacagagggccuccuggugcccggaaggaccccccgcuaccaucccaggcccugccccauguuaccucuggcauccugcgguagggcucugggccaggggaccaugcaggcaaggccaggcccaaugaccaccucccagccagggggugggccagggugcggcggcgguggccagcggcugcccgugcucaguuaaacauggcgguggccggagcaggcaggaggcagcucagguuuccagggagcgccaagcuugagggcgugcgcaggggagacugugcaggcgggcugggggcugccagggcccuucccucaccuccuaccucccugugugucccugagggaccacaggccaggccaggccagggcuggggcggcauggcaagggggcgcucagaccucaggagggcaggucuccaggccucagacacccccaaccccuccagccacccaccuucaagcucgcuccaaaccccaauggaccagaaacggccaugucagcgggggggaccgccccgccaagggagcaaggggguccuucuccacacagcuagugcucuguccccugggcucaggaccugcccuuggucuggaacacccuucuccuguccagccugccagaugccucaucugaagccuccugcccacccucugaacccucucugcauggccaccacccagcccgucacaccagaaacuccagggacaagccuguggcucccuggccccacaggggcucagcugggccacaugggcugaauuagagggugcaagacccccaaaaucuccagggccccaccacauagacucacuccucccccagacacaccugguggcacaggcguggggcuucaaggcugacccugacaccugcccaccaaagugccccucagggaugcagucacagcacggcccccaggcuggccugggacgcagggaaggcguggggacaggaguccaguucgggaggggaaguggagcacagcccccaggcuggccugggacggagggaaggcguggggacaggagcccaguucgggaggggagguggagcacggcccccaggcuggccugggacggagggaaggcguggggacaggaguccaguucgggaggggagguggagcacggcccccaggcuggccugggacggagggaaggcguggggacaggagcccaguucgggaggggagguggagcacggcccccaggcuggccugggacggagggaaggcguggggacaggaguccaguucgggaggggagguggagcacggcccccaggcuggccugggacggagggaaggcguggggacaggaguccaguucgggaggggagguggagcacggcccccaggcuggccugggacggagggaaggcguggggacaggaguccaguucgggaggggagguggagcacggcccccaggcuggccugggacgcagggaaggcguggggacaggagcccaauucaguggaggaggugggagcgugauaugggcccaguccgcaaagacacaucacacagccacagacacaagacguccacacacaccugcaaacacgcacagcagcccacacaugcggccagccccacagugcuggcccggcagcccuucccacgccugcacagcggccugcggggcaggguuucucagggcaccagacaggaagcaggaucuggugggugucuggggcccugaggccaggccaaggaccccucaguguucucagggucauucuggccaccccucugccucuguccagaagcagccgucuuucacucuacaaggcaagaaguucugccuaucaaaccuaaaccccuucauugucagcagggucccaguggcgccaggcacagcacuaaaaccucagguggaggggcugcaauggaggggccagggugggcugcuggcagcacaugggcucguggggaaggggggcccagagagccgaggagcucgggcggcguucauagcucacauuccuccucccugcccuggcucagcacacacuuccugccgccucccgccaggcccucgggcucccacgggcuccaggcucccucccugccggcggccagcacagagcuggaccaucccuggucccccagccaugccuguguccggacaaagaggcuggcauggggguacccugggcacccccccagauggugacgcaccagcccuggcagagaaaggccuucauuguugcucagcgaccagccugcuuacaucaaggucccggaguccccuccuuccaccccgggaggcugagcggcugccgguuccuccuagcccucccuuccucccaccccaccugaccuguaccagccucuggggugggcuccguggaggggcucccggagcccgggcagguggcguggcacucccggagcgugccaugacagcggcacagugacagcaaguggcaggcguccggccgggguggccugaacucucuggccgacccaggcugccaccccacuuaucuaccucccucugcggcccuggcuccccggggauggguggggacgugggggcugagucacucuggggagcagggugaugacugagcccgcuccccugcgaaggcuccagccuggcgccccccacccagcuaggcuuccgucccaagaaaggaaggaaggaagcugcuggaaggcccugcccugccccaggacccagggcugaggggacagggaggagucccggccccagaacacaggacgguccuguugaggcuccagaggagcaagagccagggaagcccggaagcccccgcaggcaccgcgccccaaccacacagccgccucccgcagaacugucaccccucacaccugcucuuagcccccaaggcccuccagauggggguggagacaugggcuaggggcagggggcagagggcucagggucugccaccaccuccagggccuggcaccgcuggccaccccgucucuguuugggggcuguccccugucgucacuacuaggaucagcugcacugcagcugcggccacccccagccugguguggcccagggcugagucaucacuaacuaggccuucacggcccccaaaaggaggggccaaccacaucaguguccuccccugcccaccuccccuauccccagccaggacagaggacacugagagccacccuuagcucccagggggcacccaaaguugggcccucuccauccuucaccaaagacaaacuacacacaucccuuccagagcucugccucucugccaccagugcccccacuggagccauccccgcaagguaagcuuugcccuccugggcucccugaccaucugaggcaugcccugaacccaggcugagaagggcaggaucugagccugcucuguggaggucaggugaggcccaccucuuccugcccaugcugggagcucaggugaagaaaccucagguccugagccaggcgcaggggcucacaccuguaaucccagcacuuugggaggcugaggcaggcggaucacuugagcccaagaguuugagaccagccuggccaacacggugaaacccugucucuaccaaaaacacaaaaauuagccagguguggugguacacgccuguaaucccagcuacucagcaggcugagacauaagaauugcuugaacccaggaggcggagcuugcagugagccgagaucgcaccacagcacuccagccugggcgacagagugaaacuccgucucaaaaaaaaaaaaaaagaaagaaagaaaugaaaccucagaccucaggggccggguacaguggcucacaccuguaaucccagaacuuugggaggucgaggagggcagaucaccugagaucaggaguucgagaccagcuugagcaacauggugaaaccccgucucuacuaaaaacacaaaaauuagucaggugugguggugcgcgccuguaaucccagcuacuggggagggugaggcaagagaaucgcuugaacccagacagcggagguuguagugagccaagaaagaaaaagaaaaagaaaccucaggucuugaugccagaagagagaaggggagacccuguuccuugggugcccccugaccuccuggagccccuguccccagccagacucaugcacaaagggaccugccacucaggccacccuuuguuccucuaaaaauacacccagaggaagccccuccuagggcuuccugcagcccccagagccugaaauagcagagggggaaggucccacccaaggcaaggugccugggccacugcacccuccagauaaaguccgagggccggauuuuuccacaggaaggugaaccaugcguuuguguccaaaucaauggacaaacgccugaggcagagggggagcuuccuccugggggagggaagguggcugggaaagagggaggccccaacccucagccuggagacaggggcuuaggaccagccagccccccugcaaggccagcccccccaccagcccugggcugggcaccuuggcccugagcaccacuguggcccgcccucaagccccaggaacaaaacgggucccacaggucccacgggcaggccugcgcccaggcugggcuccccacagggaaugcugucucccugccaagccgcuccccccgggcucagcuccuaggggcagccagcuucagcagugacgucugggaaagggagaaagugaauguguauauccccugcacccucagaacuccagaucccacaccccugccccaagcgcgguucucacaguggggucuggccaaccccuggacucauauccccugaagggauuucuuucuuuuccuuuuuuuguuuuuuuuugagacagucucacucugucgccuaggcuggagugcuauggcgggaucucggcucacugaaaccuccgccugccggguucaagcgacucuccugccucagccucccaaguagcugggacuauaggcgugccccaccaugcccaacugauuuuuguauuuuuaguagagacggggguuucaccacauuagucaagcuggucucaaaauuccugaccucaggugauccacccaucucagccucccgaaguguugggauuacaggcgugagccaccgcacccggccaggguucucuuugaaaaugaaaaaaaaaaaaaaaaaaagguaggagagaacauggagauaaugccaucagggccuccaggaagauaagacagacagcuucaggcuguuccuccugguccccaaggccugccaggccgccccucccagucggccaccuagcaggagguggagcaggccgccccuguacuuuucugggucuccuggcugggagcaagggcaggggaaggaggaaguacuacccagcaggaguccaggaggaacagcagacagggucccagggcccucccuuguaucuagggggaggagugggcucacccuggagccuccuggacccccaacuccacucccaugcucccagccccaccuacgccaggccuggcagaguggccuccuaggcuuccccaaccacggcgcugccuguggagaaggccggcccucucccaggccuucccagcaugcaggcgccuucaacagagacaaagacagagccacggaugacacccagcacaggcacagagcugcgcacacgcagaccuggaaugccucuucccaggguuccucagccacgaggcugggggcuggggaggcggcagcuugucagagugaccccucgauagggcaaguggcucuggagcauccuggagaagaggaacaggccaggcugcccugacccuacccaguuuaaaacacaggcugaggguagaaacaguggcccccaguggccaacaagauggucccuggggcagaaaaggagccccaaaaggcagaagagaccaagacuucuggaggugaccaaaggcaaagaucgucgucaaaagcugagagagccucugggagaggcuaggguggucccugugggccaagcccgccauaccuucuugccagcuucggagcuguggcugccggugugugcccagucuggcuucggcucccaggggucgugggcgggugggagcccucgcugggccaucuccucgguacaggucagcugccgccggcggagcuccucaucugucuccugguccaccaccagcagccgagucugccccuccacagccuugauccuuugcaccaccuggggcgaaugggcgauaggagcgggucaguggcccacauuccgggcagcacaugggcaguggcaccacucugggcuggcccaggcgugcggacaggcggcuggucugcaugggcggguggcugcaccaagaggccugccggccccgccccccacccccggacuccagcggcucccucccucugcacucaggcuccggacacugaggcccaggcugugagggcuucagggugcucccagagccuugcccuuagcccagggucuucuccaggcggggcugggaaggggcugcaggauagggccgcuggguaaguccugucuggaagugacaaaaauggugcacaguggaccuucagguuuucagucugccugucccugugcgcgcaugcauccaucuguuucaaagucugugucuccguccagguuugaaggagaggugugucucccugggccccaguuugagugugucugugcccauucccgucauucucugccgugcagugugggagucuaaacuccugacccuaggccuuauaucuaccuccaggccauggccaugggcccauucccucuggaucugcagagaggggaagggcugggcuccuggcucgggcacccacacacagccagggaagcaggauucaggugcagccggcgagggggagaggcaggugcaccuguggacagcuguggcuugguggccgucggugugugcgugcaggugccugugaagugucuggaccacgcggggggccagcgcacacccgcggagagaaagcagugcccacugggaagugggcaggaagaggggcagcccuacucccaccugcggccugggggaggguggacaaggcuccccaccagcugccgggcucagcagggguggugaacagauaggagggacugagccaggcccaucuucccccagcccuccucucuccccaugacccagagugagacaagaggaacccagugcccagcugcuucuugacuaugugucccagacaaguuacccucaaucucuggcaucaguuuccucaacugucaaauggggcaguaacugccccucuugcccuccuggggcaguggggagaguccaccauggucuguguguccaguccucagagaccagccccacagggccuuggaaaagcagguguucccagggcgaggguggcagugacuauccaacagcagccuggccccagcccuggcagcccuacccucaaucccucagguccaggccccuggccugauccccacauucuucagcaaacaaccuuacacagcagacacucuggguggaaggcauggggccggccgacagagugacagacaaggcaccagguaaacaggagaccagcuccagguccagcugaaccaaccugcuaaucucuagguuccaggaccagccauguagacagguuauggauucaucggugcugugagggacaggggaccuggaggaaaagggguguguggacgcuggaccccaaccagggucuggagggagucccuggccugugggagacagacacaccucaggggucagaacccacagagaaaaggcucuguucuccuuagccaggaggcaggaggcuucggccaguaaccccagccaggcuaggcagccucugaggaggaguagugccuuuguagcuaaggaaugugguugccagcaaugaccaacucagcccggucccagacacaccagcugggacacacuagaguacagacacaaagacucaccggccugcagacagugaugaguacacuagccaggcgugcacacacacagagcccagcucccauacgcccaggaguccagaccugcacacacacaggcacacgugcagaccuguauacucacacacacacuacagcacacacaggugcagacacacugaugccuuuacugcgaccccuccuggguacgcacaggcaggcgcaugcacacauggcugaccccaaagggaccugcauacacacgcccagcuguguucacacgcacacguguacacacacacccaggcaaaagcacccaggucuucaccuuuccggaggggcuccaggcggcccaacacccuccuucacggcacacugaggccaaaacgcgaccaaagggcgaggccagcggccaggagccgcagugcgggccccucccugccaggaugcccccccccacccccgugcaggacugagcuuccugcgccgggacuccgaaggcgccgggccgcugccucccgacaacguccgcguccuccccgcgggagcccccucgggcccccgugcgaccccugcucgccccagggggacgcgcucggggagggggcggcgggccgggggcgagcgcuggcccccaccugguggugcgucucgcccuccacguugacgccguugaccucgaccaggcgguccccagcgcgcagcgcggcggccucggcgggggaaccggguuccacgcgccggaugaacugcccgcggcggcccuucucgccgugcagguggaagccguagcccugcucuccgcgcaccaagcggcacaggcgcggccgcagcggcuccggcgcggccauggcgcccgcugcccaccggccgcccgcgggcaggggcgcgggggagcucgggggcggcggcggcgcugggcacccggcgguggcuucagcggcggcuccuguucggcucccgucgccucgggauccggcucgggcuccggcucgggcug

SEQ ID NO: 18231 - RNA, 867 nt, Homo sapiens
ggcgcaggagucaggcggauuuuauugaccggacggcaggcggggucuaugagcggcuccuggaagcgcgcggccacuccuccugggucaggcgcggaggcgccacgggcgggcgggggacgcugucagaacgguccgggggccaggcagggcaggccaaggcgguuugcugcgggguccaccgcugggcgggagacgucucuccgaagucucuaacgagaacacagcaaggccguggggaggaggcuguggcccuccaaccaccgcccccgggugccagggucgagccugcccagggaaagcucuucugggcgcggagcagggaauggaagggcccgagggugcccccugaacgcgcggcuccgugcuccggcucagaccucccgagacccccuugcccgcggcgguccaggccucuccccucucacguaccuggccagcuccgcugaaguccagggacuccgguuccagcgcaggcucuggggcgcgcgggcuccggggcgcacggacggggaucccugccugggagcuccugcgucgcgucucccacagcuccugaacccacgagggcagcaggagaggagccucgcgggcugcggguucgggggagagggugucccuggccaggggcccggcggccgcgcgcagcgcgcggcgccacagauagggugagcgacgcagccccaugagcaggccagcggcgcggcccaccgugugguagcggggacucgccacgugcuuguaccacgcgccggagggcagcggcagcaggagcagaagcagcagcagugccagccgcggccggcucgcgggagccccccgcuccccugggcgccacgccagggcgcucgcgucgacggccgcccg

SEQ ID NO: 18232 - RNA, 12177 nt, Homo sapiens
cccggaaggggcgggcccgccgggagccaggccgcucggcgccacgaccggccgagaggggggccggaucccggaccauggcggcggccggggggcgccgaggggcggcgcgcggacauggaggcggaggcggcggcagcuccugagcgggaaggcgggagcugcgugcugugcugcggagaccuggaggccacggcgcuggggccgcugcgaccacccggugugcuaccgcugcucuaccaagaugcgggugcucugcgagcagcgcuacugcgccgugugccgcgaggagcugcgccaggugcggggcgccgggggcgcggcccgggggcagcggggcucccggcgaccggauggggacuuugccucacugagguccggccgugggcccggcggcgccggcuuccgagagaggccugguggggccacccagggcggggucccggccgugcggcugacggcggggcguuggggcuuggaggccggaggcggccgagcggguugcaggagggggcaagcccuguggggacagccuggggacuucccccgugucccggggguuccugccgggccucaggaaggguccugaucagauggagaacucggugaccugcucgucuucaggaguuuauuuuccaggguccuccauucgaggaaacaaggcaagggggacucugcggaggccauccguccuggaagcagggcgucaaacucugggcauucucagcccagcuguguuucugggcccccauuggaugacccugagcaaacuccuuccgagacugacguuuuccucuguggaguggaggugacacuagccucggaaggagaccugcccgucggaggggaaggcccccucgcgcuucuuggcgggaagggagaaaaguguuaggaaguuguccuccuccucgccgccgccccccgccuuuggcgcucaucuccgcagugaaugggagacguuuuugacuguacagacuuggaagccguggaggggucagaggguaccaugcagcguuccuccacccucacugcacugccagcugcuggcugugggcaccuggcuggagcccguugguuugcugagcuuagagauuuguuugcuuccagcauugugaaauucccccgguuuguucauagaaggcuucggcuggugacaucugccaggaaucuaacuuucuucuccccagaagugaugcagagcaguauugagguguagguucuuucuuuuuuuccuuuucuuucuuuaaguagacguuuacaucaaaggaguugaagagaugcugcaauucucugagcaauuugugggcuuauagucugugcccuuuuuggaaaaagacauuuggagauucuaucagucugucaugugacaggaggaggccgacccagaccccggggagaucuggggugcaggaacagucacagaggaccuuggcccguggcuuccucagggcgcuuccuggcuuugccagggccugccuugccagccaguccugcauagcaugaccucacucuccaacagcuagguuucccagcacaccuguagcuuccuuccggaaagaagacgcuaaggaguucuuggcacgugaggucccgacccaggcugcaggucugaugcaagacaugagugaacaucugcguaugcuuacuguggcagccucugcccgcucucauuccuuguaggccccacgcccuccaggagcucuguggcugggggcugcggacaugagcugucagccggggugugguuuggcacugggugcccccagccggcuuccucuagggccuaccccgccuuacugggcugaaggaggggcuccuggaaaguuugcuguuugcuggucuccucuccuuugcauucguucuauuuucuucccaucuugagcuugccgccucacucuagucuccuuuuuccuuacugaguucagcaccauccccugaauauauucugugucccaugcgugcucaggaauucccacugcaacccucaacuccugaacccuggcguugccuuggccucccuuaugggacuaagguuuugcgaaaauugugaggaaaguguccaggaugccguguggaaucggcuggcuccaugugcuuguuaguuccacacaccuggacccaggccuucccuguggaggcugcagcugcugcucaggccaggagccagaugggccugaccccuggcaggugcucaggguggaagccgaggcaggcuccccuccgugggaggugggggcgcuggucuuggccauggcugacagagguccuggggugguggagccccacguucugggccucuuuccuggcugcgucuuucucaagggccgguuccugcuguuugcaucuugcucuccagcuugcucuggucccugguguuacugcaggaguccugaugaggcugcaagccccccagggcagcccaccugcaccuuacaggcaggcagugggagggggcgcagagggccagcccacaguuacccaaggucccaggucaggagggugacaugcuggcuugggucaugcuuuccuacuccuacugcucccccuccgcccugcucccgucccccguggcccuggcccuaucuguaaaaugcucccugcuucugcuguccccccaccccgcucccgucccccauggcccuggcccucuguaagaugcucccugcugcugcuguccccaucugggcuccuuggaggucuagacucucuagauggcccugggagccaaccccagggucccccuccccacgugugggcaggcccucaccgcuguccuuuugugugcccaugacaugcuggggaguguagagcagcaaggccccaggcagacaccacaccugucccuguggggggucuugggggccuccuguuccuaagcaggccucaccccauuugccucuugcucuccuuggggccuagcuuggccgucuccagggcucacguagagugcccuuccccucaucauuugcugcauagcccauccccaagccucuccccauggguucuguacuucuguccucagacacgugacccucuccugcuggggcgaccuagaccuguugucucccucuguagccccagccaucuccccccugcccccacgucccaacccagccauuucccuccagccaccaagucccaccccaggcaucucccccaggcccccaaguccccuacccauagccaucuuccccuggccuccauguccccuacguccccuacucccagccuggcugugcuggaaccaucaggcgggggagggucuugcuguuuggcuccuuaguggaccgugccugacuccacccuggccacugugcugcggggcgcagccuuguccagcccccuccucacccucagggagggcgaugcuggccaugccaggcugcacugcugucccacugcccgcuccugaggucugggcagccaguccuggucucccugccugucugaggaugggcagccucaggcccccacuaucaggugguauuucucacuccggccccaaaccugcacgcccuccugcuccagugauuguggccuugggcccaccuugcucacagccauuguucuuucacaagccucuuccuguuccugagcccacccagugucuccuuuccccugucucguugcuccgcuuaggugcccugccuaggugaccccucccagcuguucaggagggacgaauacucugggucuugcuaccccuggugcucggaguaccugccuuagcugcugugcagauggaugcccaucuagacuccauauggggcauguagcccucccgugcuggcccacccuggguccuucaucugggugcugucagugcaccugggauccgcccggccuggcccugccucugcccagcuccccgcagcuccuccacccccagcugcucccuggccucagagaggcugccuugaccgaguccgccagccccaccagugccgucccacauagguuucuugggacuugcgaugugcuagcaucgcauggagcaugggugcccccaggcggcaaggacagaggaguguaugugcuccucagcggggccuggcccugugcccgcacacggguggcacucgggggacgcaccaguggagguuggcugcguguuaggggugccugggaugccccugugcccgcagucugagucgccgccacccacgguggaugagggcgugcggcugaaaggaggggugccaaaguggggagguggggcuggggacgccccuggcacggguuuccucuggggaaggaagucguuucuccucggagucugaugggcuuggaugcuuuuuggcagccuuggggccucccucacaggcugcucgccuggccaccucacaggcagacacuggcuuccucgcccgccugccugcugcuucgggagcugugguggggaaguggcccugucugguucccgggaguccagguacucagcuccccgaggaggcucgcgcucugcgucccagcagcacccugaguggcuccgcucagcuccccgaggaggcucgugcucugggucccagcagcacccugaguggcugcacagauugcgccugugagggucgggcuggagaggcgcccuugggagugaguggaagguagggcugggugccagcugccgcgagggcagcugcugugaaaagaggccgcacaaggcccagggccuuucccuguguuuggggugugcagagaggcugcuccaggggaggggagccaggggacaggucagggugguguggcccgcagugacuggcagccuuuguaauggggcucuggguggggcugcgacucccaucugaagacgucgcgcgugggaggcagcugugaugaagugcccaucugagcccagcaugugacggggacgcagaggcggccgaguucauccugcccagccuugccugaugugaccaggggaggaaaggccugggcugcugcuccugcagcccguaccgcccaccccgccccugguggaagcggcuccugucgguggggugggggcugagcucuccuggcgcuccugacccuccuggggagucagauuuaaccaccugcucugggggacagagacaccccaggacccccugagcacgugugggacuggcucuuccugccaagccucagguuucccagcuucacggccguuccagcccgacauucucuuuggcuaaggggcuaagguaaacuuaacaugaccuuggcaugacccuugcccgggugaggacgucccccugcccuggaugugcgcuugaggccuugagcugcucuaagggcccagagccgaggcgagugaccagugccaggcuugggacagugauggagccagaagggggcuugaccaacccaagggguggguggcaccaaucucugcuggcaugggggcagcgaggguccuccccagcagagcuucguggagagcaggggugcugagcugagcagggaugccggggccgucuguggagggcacagggcagacgggcaaguccucuggcagccagcuuugcaggugccagagaccccugggaaggggcccacgcagaggcucugcagcgccugcugaggaugcacggagcugagguggucggcuugagccucgugccgugaaggcgccauggaaacgugggggcgggggcgccggacaggguagccgggccuugucaccugaugcauccccggcuggcggccauugguauucccuuagcagcugcuuggaacacguuucuucucuguccuggaaagcuccgcagagcgacagcugcucuguuccccgcaggguggagccaccgggugagggccccggccgguggggcguggcugcuuagggacuggccuugccgcccccugguggagaggccuggcguugugucucuguccucugccccugacccuaggcaagcggguuggggugaggaggggaggccuaggccagggugccaggggccgcugccugcuggggccuccuaggaggacccuuuaugccucacuccuucuuagagggucugugagggcucccuugccucugagccuccguugcaucccaggugggggucccaucccaguccugcucaccaccccucugguuuuuggcucuagguggucuuugggaagaagcuuccugccuuugccaccauccccauccaccagcugcagcaugagaagaaauaugauaucuacuuugcagauggaaagguguacgcauuguacaggugagcagggccucucccuggguccuggccucccugugguuguggcccuucacgucccacucuccucacaaccggaggcacuucgggggccaccuggugcaccaaugcuggggccaggcaccuggguuuccauccugugacuggggaggcuuaccaggcccuccuggggguagagcuggugguugugcuggggaaaggcaugcccagguggugcagcaccugccucgggggcaccuugaggggcacacgaggugugugagccaggcccguggccugaaaauccuauaaaggguacagcugucccagggcuggucucucagaggaggggcagcucaugggcucagggcuagagccaggcuucugacccaggccaugugcacagccauggccuugcaucuguccugggucacgggccuggggccuggugaguggcccugcucccggcggugacacugaauguccuggggccgugggcggcucucggugucuuccuaggcagcugcugcagcacgagugcccgcggugccccgagcugccaccuuucagccucuucggggaccuggagcagcacaugcggaggcagcaugagcucuucugcugccgucugugccuccagcaccuccaggugugcccccccagcgaccccggagagagccuaggcgguggguggugcaagggauguggccacacggcugggaggggcuuguccaccugcugcuucuggccccggauggcccccugagggucaggcugcacguggcagggaggccucuggcugcuggcggggcccucucccgccccuugcugcuccgccacuggccugugggaagaggcaggaggcuuggggucccccagccugugcccagccuccugugccuuguagaucuucacauaugagcgcaagugguacucgcgcaaggaccuggcccggcaucgcaugcagggugaccccgaugacacgucgcaccgugggcacccgcucugcaaguucugugacgagcgcuaccuggacaaugaugagcugcuuaagcaccugcgccgcgaccacuacuucugccacuucugcgacucggacggggcccaggacuacuacaggugggccgggcagcagacagacagaugacccucccuccccgagggcguggggcuaaccgggcugcagcccuccuaccgacaccccaucuccugccagcgacuaugccuaccugcgugagcacuuccgggagaagcacuuucugugugaggaaggccgcugcagcacggagcaguucacccacgccuuccgcaccgagaucgaccucaaggcccacaggacggccugccacagucgcagccgcgccgaggcacgccagaaccgccacaucgaccugcaguucagcuacgcgccacggcacucgcgccggaacgagggugagcaggcaccuggccuggaugcccccagguggggccgcaugaccaugcccugcucuggagccugagaugagaccgagcugugggugcaggagcugaccucccacccuccggccaggcuggagcgcccgagcaccccuugugugccaggagcucuugcucccucagggucucgggucugcugcccugggugcccggggcccuucccuggaccaggaggcuuuuacugagcaucugcuguaugcagaucccaccuggggcucggggacccuccuccucucccuucccacugcuccuguggcuuggcacccaggucguagaggcccguggcuggcguggacccugcgaggcuccugugccacucccgggcucaugugcacuguggguaggaaagccucugccauccaggccugagcauuggccggguguggccuugacggcaggccuguuccuccuauugucgucccggggucccgggaagugacgggcugucugcuggccgcaggggucguugguggcgaagacuacgaggagguggacagguacagccgccagggccgaguggcccgggcuggcacucgcggagcccagcagagccgccgaggaagcuggagguacaaaaggugggggaccuugcgugccgcugacauucuccuguggugaccguggccaguggccaagcugggaguggggauggggucagggauuguggccagaguuccugggguccugaguggcaguagggucuguugaggguccuuggugggcacaaguuucucucucuuuucuccaguucuagccacagccacagaucccaggguuggggugggugaaaggggccugugucaauugggcggucaccgcagcuguacgaggaagcaccgccccggcagcccugcagggcagaggcaucagaccccagaugaucgccccacacacugggcccaggcacugcccgccugaggcauuggucucgggccaugcucagccugaaggcuggccuccuugucccagggaagaagaggaccgagaaguagcagcugcuguccgggccuccguggccgcacagcagcaggaggaggcucgcaggagugaggaucaggaggaaggcgguaggcccaagaaggaggaggcagcggcgcggggaccugaggauccccguggcccccggcgcucaccccggacucagggcgaaggcccaggugaguaagcccuaccugguggcagcucugcccgggcuaggaggucaguggcuagcucuuuuuuuuuguuuguuuguuuguuuguuuguuuuuugugagacagacagagucucacucuguugcccaggcuggugcaguggcggaaucuuggcucagugcaacuucugccucccggguucaagugauucuccugccucagccucccgaguagcugggaugacaggugccugcccccacgccuggcuuguuuuucuauuuuuaguagagaugggguuucaccauguuggccaggcuggucucaaacuccugaccucaggugauccgcccaccucagccucccagagugcugggauuauagguguaagccacgauguccagcuuaguggccagcucuugaugggcacggugccugggacgcuccaggccuucaccugggagguugaagagcacccugcacugccaguccccagagggccuguccccacacccugaccugaccugggggccuuguguucuucauaggccccaaggaaaccucgacaaaugguccuguaagccaagaagccuucucggugacaggcccagccgccccagggugugugggggugccagggugagaguaugggcgcccaggggugaauggugcauggugggcgggugcgggcagccacaggugggugccgggagggcagguauggagccacggggccugauagcuguugaccagcugugcuucccugcacccagcgcccucccaccacccagcccgaagcucaaggacgaagacuuccccagccucucugccuccacuuccuccuccugcuccacugcagcaaccccgggcccugugggguuggcgcugccguacgccaucccugccagaggcaggagugccuuccaggaggaggacuuccccgcccugguguccucggugcccaagccuggcaccgcccccaccagccuugucucugccuggaacagcagcaguagcagcaagaagguagcacagcccccacucucggcgcaggcuaccggcagcggccagcccaccaggaaggcugggaaggggagcaggggcggcaggaagggcggcccgcccuucacacaggaggaggaggaggacggcggcccggcccugcaggagcuucugagcacacgccccacgggcuccgucuccuccacacuggggcuggccuccauccaacccucuaaaguugggaagaagaagaaagugggcucggagaagccaggcaccacauugccacagcccccgcccgcuaccugucccccaggggcuuugcaggccccggaagcuccugccagcagagccgaggggccaguugccgucgucguuaauggacacauggagggcccggccccugcucggagugcccccaaggaacccccugggcucccaaggccccugggguccuuccccugccccacgccacaggaggacuucccagcgcucggcggccccugcccaccccggaugccgccgcccccagguacgcgugcuggcucaggccugcucccugggugucgggaggggccggggucaggcuggagccgcaggcacagucugcaucugggugguggggaccccugugugaugccaucggccacccacaugaccuccagccucccguuaaccacccuguguuccuugccucugugagaccggcccucauggcgccucccaggucugagggugcgugagcuugugugggcugggccugccacaccagcagcaguggugugggugcuggcccugcaccugcccugcagggaagggguggcuguagacagaagcuggcccuggaggccaggcagcccgcagucagcgaggguccucucugggucuuguccugccaccccucaggcuucagcgcuguggugcuccugaagggcacgccucccccacccccgccgggccuggugcccccaaucagcaagccgcccccuggcuucucuggccuucugccuagcccccacccggccuguguccccagccccgccaccaccaccaccacaaaagcguaagugugggugagcugccugguguccaccggggguggaggaacgguacccuccccuugggccacugugaaggcugaagccuccaccuccucuuuaccuucugacccccagacccaggcugcugccugccccacgggcguaccuaguccccgagaacuuccgggagaggaaccuucagcucauccaguccaucagggacuuccugcagagcgacgaggcccgcuucagcgaguucaagagccacucaggggaguucagacaggucaggcgggcccggggaguccagaugggucaggcgggcccggggcggggugccagcccgucuucauccagggcccgggccagaggggaugacugaguccggcucuccgguggcagggccugaucuccgcagcccaguauuacaagaguugccgggaccugcugggggagaauuuccagaaggucuuuaaugagcugcugguccugcugcccgacacggccaagcagcaggagcuccugucugcacacacggacuucugcaaccgcgagaagccucugagcaccaaguccaagaagaacaagaagagcgcguggcaggccaccacccagcaggcgggccuggacugccgugugugccccaccugccagcaggugcucgcgcauggcgaugccagcagccaccaggcgcugcaugcugcccgggacgacgacuuccccucccugcaagccaucgccaggaucaucacguagcucccgccagcguggccagagcugucgcaccgugagcguccuuccuccuuccucuccgggcugccaggcagccagguaaggccuggugaggccacuuggccucuugguuggccaggcccaccaggaagucaccaggacaguccacccgcccuguuggcacacucaagcgggaguccaccccugccucaguggugggccagucucgguuugcauucuugugcuuuugggaggugccaggggagggaagggcugggaugcugggaccuguuguugcuggcaaagccagaggucacaguggccugaucugggcccucccaaagcugagggcugcagcccguggggccucagagcugaaagcugcggcgccacuggugccagagucagaugucacagauguguuguguaaacaguuggcuguuucaugcuucaagaauguucaggauuaaaagcagacaagaaauugugcuacuugaaguugaaucuuuuuaugagacaagcugaaucugggaucucaaauugccucugaccuuuuauaagacaguuuaucuucaaauaaauuuauuuugcaauaccacgcauagcug

SEQ ID NO: 18233 - RNA, 12177 nt, Homo sapiens
cagcuaugcgugguauugcaaaauaaauuuauuugaagauaaacugucuuauaaaaggucagaggcaauuugagaucccagauucagcuugucucauaaaaagauucaacuucaaguagcacaauuucuugucugcuuuuaauccugaacauucuugaagcaugaaacagccaacuguuuacacaacacaucugugacaucugacucuggcaccaguggcgccgcagcuuucagcucugaggccccacgggcugcagcccucagcuuugggagggcccagaucaggccacugugaccucuggcuuugccagcaacaacaggucccagcaucccagcccuucccuccccuggcaccucccaaaagcacaagaaugcaaaccgagacuggcccaccacugaggcagggguggacucccgcuugagugugccaacagggcggguggacuguccuggugacuuccuggugggccuggccaaccaagaggccaaguggccucaccaggccuuaccuggcugccuggcagcccggagaggaaggaggaaggacgcucacggugcgacagcucuggccacgcuggcgggagcuacgugaugauccuggcgauggcuugcagggaggggaagucgucgucccgggcagcaugcagcgccugguggcugcuggcaucgccaugcgcgagcaccugcuggcagguggggcacacacggcaguccaggcccgccugcugggugguggccugccacgcgcucuucuuguucuucuuggacuuggugcucagaggcuucucgcgguugcagaaguccgugugugcagacaggagcuccugcugcuuggccgugucgggcagcaggaccagcagcucauuaaagaccuucuggaaauucucccccagcaggucccggcaacucuuguaauacugggcugcggagaucaggcccugccaccggagagccggacucagucauccccucuggcccgggcccuggaugaagacgggcuggcaccccgccccgggcccgccugacccaucuggacuccccgggcccgccugaccugucugaacuccccugaguggcucuugaacucgcugaagcgggccucgucgcucugcaggaagucccugauggacuggaugagcugaagguuccucucccggaaguucucggggacuagguacgcccguggggcaggcagcagccugggucugggggucagaagguaaagaggagguggaggcuucagccuucacaguggcccaaggggaggguaccguuccuccacccccgguggacaccaggcagcucacccacacuuacgcuuuuguggugguggugguggcggggcuggggacacaggccgggugggggcuaggcagaaggccagagaagccagggggcggcuugcugauugggggcaccaggcccggcgggggugggggaggcgugcccuucaggagcaccacagcgcugaagccugagggguggcaggacaagacccagagaggacccucgcugacugcgggcugccuggccuccagggccagcuucugucuacagccaccccuucccugcagggcaggugcagggccagcacccacaccacugcugcugguguggcaggcccagcccacacaagcucacgcacccucagaccugggaggcgccaugagggccggucucacagaggcaaggaacacagggugguuaacgggaggcuggaggucauguggguggccgauggcaucacacagggguccccaccacccagaugcagacugugccugcggcuccagccugaccccggccccucccgacacccagggagcaggccugagccagcacgcguaccugggggcggcggcauccggggugggcaggggccgccgagcgcugggaaguccuccuguggcguggggcaggggaaggaccccaggggccuugggagcccaggggguuccuugggggcacuccgagcaggggccgggcccuccauguguccauuaacgacgacggcaacuggccccucggcucugcuggcaggagcuuccggggccugcaaagccccugggggacagguagcgggcgggggcuguggcaauguggugccuggcuucuccgagcccacuuucuucuucuucccaacuuuagaggguuggauggaggccagccccaguguggaggagacggagcccguggggcgugugcucagaagcuccugcagggccgggccgccguccuccuccuccuccugugugaagggcgggccgcccuuccugccgccccugcuccccuucccagccuuccuggugggcuggccgcugccgguagccugcgccgagagugggggcugugcuaccuucuugcugcuacugcugcuguuccaggcagagacaaggcuggugggggcggugccaggcuugggcaccgaggacaccagggcggggaaguccuccuccuggaaggcacuccugccucuggcagggauggcguacggcagcgccaaccccacagggcccgggguugcugcaguggagcaggaggaggaaguggaggcagagaggcuggggaagucuucguccuugagcuucgggcuggguggugggagggcgcugggugcagggaagcacagcuggucaacagcuaucaggccccguggcuccauaccugcccucccggcacccaccuguggcugcccgcacccgcccaccaugcaccauucaccccugggcgcccauacucucacccuggcacccccacacacccuggggcggcugggccugucaccgagaaggcuucuuggcuuacaggaccauuugucgagguuuccuuggggccuaugaagaacacaaggcccccaggucaggucaggguguggggacaggcccucuggggacuggcagugcagggugcucuucaaccucccaggugaaggccuggagcgucccaggcaccgugcccaucaagagcuggccacuaagcuggacaucguggcuuacaccuauaaucccagcacucugggaggcugaggugggcggaucaccugaggucaggaguuugagaccagccuggccaacauggugaaaccccaucucuacuaaaaauagaaaaacaagccaggcgugggggcaggcaccugucaucccagcuacucgggaggcugaggcaggagaaucacuugaacccgggaggcagaaguugcacugagccaagauuccgccacugcaccagccugggcaacagagugagacucugucugucucacaaaaaacaaacaaacaaacaaacaaacaaaaaaaaagagcuagccacugaccuccuagcccgggcagagcugccaccagguagggcuuacucaccugggccuucgcccugaguccggggugagcgccgggggccacggggauccucagguccccgcgccgcugccuccuccuucuugggccuaccgccuuccuccugauccucacuccugcgagccuccuccugcugcugugcggccacggaggcccggacagcagcugcuacuucucgguccucuucuucccugggacaaggaggccagccuucaggcugagcauggcccgagaccaaugccucaggcgggcagugccugggcccaguguguggggcgaucaucuggggucugaugccucugcccugcagggcugccggggcggugcuuccucguacagcugcggugaccgcccaauugacacaggccccuuucacccaccccaacccugggaucuguggcuguggcuagaacuggagaaaagagagagaaacuugugcccaccaaggacccucaacagacccuacugccacucaggaccccaggaacucuggccacaaucccugaccccauccccacucccagcuuggccacuggccacggucaccacaggagaaugucagcggcacgcaaggucccccaccuuuuguaccuccagcuuccucggcggcucugcugggcuccgcgagugccagcccgggccacucggcccuggcggcuguaccuguccaccuccucguagucuucgccaccaacgaccccugcggccagcagacagcccgucacuucccgggaccccgggacgacaauaggaggaacaggccugccgucaaggccacacccggccaaugcucaggccuggauggcagaggcuuuccuacccacagugcacaugagcccgggaguggcacaggagccucgcaggguccacgccagccacgggccucuacgaccugggugccaagccacaggagcagugggaagggagaggaggaggguccccgagccccaggugggaucugcauacagcagaugcucaguaaaagccuccugguccagggaagggccccgggcacccagggcagcagacccgagacccugagggagcaagagcuccuggcacacaaggggugcucgggcgcuccagccuggccggagggugggaggucagcuccugcacccacagcucggucucaucucaggcuccagagcagggcauggucaugcggccccaccugggggcauccaggccaggugccugcucacccucguuccggcgcgagugccguggcgcguagcugaacugcaggucgauguggcgguucuggcgugccucggcgcggcugcgacuguggcaggccguccugugggccuugaggucgaucucggugcggaaggcgugggugaacugcuccgugcugcagcggccuuccucacacagaaagugcuucucccggaagugcucacgcagguaggcauagucgcuggcaggagauggggugucgguaggagggcugcagcccgguuagccccacgcccucggggagggagggucaucugucugucugcugcccggcccaccuguaguaguccugggccccguccgagucgcagaaguggcagaaguaguggucgcggcgcaggugcuuaagcagcucaucauuguccagguagcgcucgucacagaacuugcagagcgggugcccacggugcgacgugucaucggggucacccugcaugcgaugccgggccagguccuugcgcgaguaccacuugcgcucauaugugaagaucuacaaggcacaggaggcugggcacaggcugggggaccccaagccuccugccucuucccacaggccaguggcggagcagcaaggggcgggagagggccccgccagcagccagaggccucccugccacgugcagccugacccucagggggccauccggggccagaagcagcagguggacaagccccucccagccguguggccacaucccuugcaccacccaccgccuaggcucucuccggggucgcugggggggcacaccuggaggugcuggaggcacagacggcagcagaagagcucaugcugccuccgcaugugcugcuccagguccccgaagaggcugaaagguggcagcucggggcaccgcgggcacucgugcugcagcagcugccuaggaagacaccgagagccgcccacggccccaggacauucagugucaccgccgggagcagggccacucaccaggccccaggcccgugacccaggacagaugcaaggccauggcugugcacauggccugggucagaagccuggcucuagcccugagcccaugagcugccccuccucugagagaccagcccugggacagcuguacccuuuauaggauuuucaggccacgggccuggcucacacaccucgugugccccucaaggugcccccgaggcaggugcugcaccaccugggcaugccuuuccccagcacaaccaccagcucuacccccaggagggccugguaagccuccccagucacaggauggaaacccaggugccuggccccagcauuggugcaccagguggcccccgaagugccuccgguugugaggagagugggacgugaagggccacaaccacagggaggccaggacccagggagaggcccugcucaccuguacaaugcguacaccuuuccaucugcaaaguagauaucauauuucuucucaugcugcagcugguggauggggaugguggcaaaggcaggaagcuucuucccaaagaccaccuagagccaaaaaccagagggguggugagcaggacugggaugggacccccaccugggaugcaacggaggcucagaggcaagggagcccucacagacccucuaagaaggagugaggcauaaaggguccuccuaggaggccccagcaggcagcggccccuggcacccuggccuaggccuccccuccucaccccaacccgcuugccuagggucaggggcagaggacagagacacaacgccaggccucuccaccagggggcggcaaggccagucccuaagcagccacgccccaccggccggggcccucacccgguggcuccacccugcggggaacagagcagcugucgcucugcggagcuuuccaggacagagaagaaacguguuccaagcagcugcuaagggaauaccaauggccgccagccggggaugcaucaggugacaaggcccggcuacccuguccggcgcccccgcccccacguuuccauggcgccuucacggcacgaggcucaagccgaccaccucagcuccgugcauccucagcaggcgcugcagagccucugcgugggccccuucccaggggucucuggcaccugcaaagcuggcugccagaggacuugcccgucugcccugugcccuccacagacggccccggcaucccugcucagcucagcaccccugcucuccacgaagcucugcuggggaggacccucgcugcccccaugccagcagagauuggugccacccaccccuuggguuggucaagcccccuucuggcuccaucacugucccaagccuggcacuggucacucgccucggcucugggcccuuagagcagcucaaggccucaagcgcacauccagggcagggggacguccucacccgggcaagggucaugccaaggucauguuaaguuuaccuuagccccuuagccaaagagaaugucgggcuggaacggccgugaagcugggaaaccugaggcuuggcaggaagagccagucccacacgugcucaggggguccuggggugucucugucccccagagcaggugguuaaaucugacuccccaggagggucaggagcgccaggagagcucagcccccaccccaccgacaggagccgcuuccaccaggggcggggugggcgguacgggcugcaggagcagcagcccaggccuuuccuccccuggucacaucaggcaaggcugggcaggaugaacucggccgccucugcguccccgucacaugcugggcucagaugggcacuucaucacagcugccucccacgcgcgacgucuucagaugggagucgcagccccacccagagccccauuacaaaggcugccagucacugcgggccacaccacccugaccuguccccuggcuccccuccccuggagcagccucucugcacaccccaaacacagggaaaggcccugggccuugugcggccucuuuucacagcagcugcccucgcggcagcuggcacccagcccuaccuuccacucacucccaagggcgccucuccagcccgacccucacaggcgcaaucugugcagccacucagggugcugcugggacccagagcacgagccuccucggggagcugagcggagccacucagggugcugcugggacgcagagcgcgagccuccucggggagcugaguaccuggacucccgggaaccagacagggccacuuccccaccacagcucccgaagcagcaggcaggcgggcgaggaagccagugucugccugugagguggccaggcgagcagccugugagggaggccccaaggcugccaaaaagcauccaagcccaucagacuccgaggagaaacgacuuccuuccccagaggaaacccgugccaggggcguccccagccccaccuccccacuuuggcaccccuccuuucagccgcacgcccucauccaccguggguggcggcgacucagacugcgggcacaggggcaucccaggcaccccuaacacgcagccaaccuccacuggugcgucccccgagugccacccgugugcgggcacagggccaggccccgcugaggagcacauacacuccucuguccuugccgccugggggcacccaugcuccaugcgaugcuagcacaucgcaagucccaagaaaccuaugugggacggcacugguggggcuggcggacucggucaaggcagccucucugaggccagggagcagcuggggguggaggagcugcggggagcugggcagaggcagggccaggccgggcggaucccaggugcacugacagcacccagaugaaggacccagggugggccagcacgggagggcuacaugccccauauggagucuagaugggcauccaucugcacagcagcuaaggcagguacuccgagcaccagggguagcaagacccagaguauucgucccuccugaacagcugggaggggucaccuaggcagggcaccuaagcggagcaacgagacaggggaaaggagacacugggugggcucaggaacaggaagaggcuugugaaagaacaauggcugugagcaaggugggcccaaggccacaaucacuggagcaggagggcgugcagguuuggggccggagugagaaauaccaccugauagugggggccugaggcugcccauccucagacaggcagggagaccaggacuggcugcccagaccucaggagcgggcagugggacagcagugcagccuggcauggccagcaucgcccucccugagggugaggagggggcuggacaaggcugcgccccgcagcacaguggccaggguggagucaggcacgguccacuaaggagccaaacagcaagacccucccccgccugaugguuccagcacagccaggcugggaguaggggacguaggggacauggaggccaggggaagauggcuauggguaggggacuugggggccugggggagaugccuggggugggacuugguggcuggagggaaauggcuggguugggacgugggggcaggggggagauggcuggggcuacagagggagacaacaggucuaggucgccccagcaggagagggucacgugucugaggacagaaguacagaacccauggggagaggcuuggggaugggcuaugcagcaaaugaugaggggaagggcacucuacgugagcccuggagacggccaagcuaggccccaaggagagcaagaggcaaauggggugaggccugcuuaggaacaggaggcccccaagaccccccacagggacagguguggugucugccuggggccuugcugcucuacacuccccagcaugucaugggcacacaaaaggacagcggugagggccugcccacacguggggagggggacccugggguuggcucccagggccaucuagagagucuagaccuccaaggagcccagauggggacagcagcagcagggagcaucuuacagagggccagggccaugggggacgggagcgggguggggggacagcagaagcagggagcauuuuacagauagggccagggccacgggggacgggagcagggcggagggggagcaguaggaguaggaaagcaugacccaagccagcaugucacccuccugaccugggaccuuggguaacugugggcuggcccucugcgcccccucccacugccugccuguaaggugcaggugggcugcccuggggggcuugcagccucaucaggacuccugcaguaacaccagggaccagagcaagcuggagagcaagaugcaaacagcaggaaccggcccuugagaaagacgcagccaggaaagaggcccagaacguggggcuccaccaccccaggaccucugucagccauggccaagaccagcgcccccaccucccacggaggggagccugccucggcuuccacccugagcaccugccaggggucaggcccaucuggcuccuggccugagcagcagcugcagccuccacagggaaggccuggguccagguguguggaacuaacaagcacauggagccagccgauuccacacggcauccuggacacuuuccucacaauuuucgcaaaaccuuagucccauaagggaggccaaggcaacgccaggguucaggaguugaggguugcagugggaauuccugagcacgcaugggacacagaauauauucaggggauggugcugaacucaguaaggaaaaaggagacuagagugaggcggcaagcucaagaugggaagaaaauagaacgaaugcaaaggagaggagaccagcaaacagcaaacuuuccaggagccccuccuucagcccaguaaggcgggguaggcccuagaggaagccggcugggggcacccagugccaaaccacaccccggcugacagcucauguccgcagcccccagccacagagcuccuggagggcguggggccuacaaggaaugagagcgggcagaggcugccacaguaagcauacgcagauguucacucaugucuugcaucagaccugcagccugggucgggaccucacgugccaagaacuccuuagcgucuucuuuccggaaggaagcuacaggugugcugggaaaccuagcuguuggagagugaggucaugcuaugcaggacuggcuggcaaggcaggcccuggcaaagccaggaagcgcccugaggaagccacgggccaagguccucugugacuguuccugcaccccagaucuccccggggucugggucggccuccuccugucacaugacagacugauagaaucuccaaaugucuuuuuccaaaaagggcacagacuauaagcccacaaauugcucagagaauugcagcaucucuucaacuccuuugauguaaacgucuacuuaaagaaagaaaaggaaaaaaagaaagaaccuacaccucaauacugcucugcaucacuucuggggagaagaaaguuagauuccuggcagaugucaccagccgaagccuucuaugaacaaaccgggggaauuucacaaugcuggaagcaaacaaaucucuaagcucagcaaaccaacgggcuccagccaggugcccacagccagcagcuggcagugcagugaggguggaggaacgcugcaugguacccucugaccccuccacggcuuccaagucuguacagucaaaaacgucucccauucacugcggagaugagcgccaaaggcggggggcggcggcgaggaggaggacaacuuccuaacacuuuucucccuucccgccaagaagcgcgagggggccuuccccuccgacgggcaggucuccuuccgaggcuagugucaccuccacuccacagaggaaaacgucagucucggaaggaguuugcucagggucauccaaugggggcccagaaacacagcugggcugagaaugcccagaguuugacgcccugcuuccaggacggauggccuccgcagagucccccuugccuuguuuccucgaauggaggacccuggaaaauaaacuccugaagacgagcaggucaccgaguucuccaucugaucaggacccuuccugaggcccggcaggaacccccgggacacgggggaaguccccaggcuguccccacagggcuugcccccuccugcaacccgcucggccgccuccggccuccaagccccaacgccccgccgucagccgcacggccgggaccccgcccuggguggccccaccaggccucucucggaagccggcgccgccgggcccacggccggaccucagugaggcaaaguccccauccggucgccgggagccccgcugcccccgggccgcgcccccggcgccccgcaccuggcgcagcuccucgcggcacacggcgcaguagcgcugcucgcagagcacccgcaucuugguagagcagcgguagcacaccggguggucgcagcggccccagcgccguggccuccaggucuccgcagcacagcacgcagcucccgccuucccgcucaggagcugccgccgccuccgccuccauguccgcgcgccgccccucggcgccccccggccgccgccaugguccgggauccggccccccucucggccggucguggcgccgagcggccuggcucccggcgggcccgccccuuccggg

SEQ ID NO: 18234 - RNA, 4332 nt, Homo sapiens
cgccgcggccggcgcgcgcucccgggaggcggcagcggcugcagcguugguagcaucagcaucagcaucagcggcagcggcagcggccucgggcggggccggccggacggacaggcggacagaaggcgccaggggcgcgcgucccgcccgggccggccauggagggcgccuccuucggcgcgggccgcgcaggggccgcccuggaccccgugagcuuugcgcggcggccccagacccugcuccgggucgcguccugggugaguggucccugcccgggcccccgcucccgccccugccucgcgaccuucaggccccuaccagcccccugcccccuacccccugcccccugcuucucgccccccgaccucacucacucucauccucgccggccccucccccgccggccucagguuggggugacgucaccgggcagggcgcgcccaccugcgggcggaggaggggccggcggcgccggagagggaccuugagaggucaccgccggucgccucuaccccuaccuccuccccgggucuaauuucagucccuuuccgcagcccuuacuccguuuuuccuguucucgugaccuggaagcagggacgggguggggacggaauucuccgaggggcaggagggggcuacgggaaccgagaagcgccuccccuucccccgcacacacacccucgggucuccuuggcagggagccuguccccuggcccccaguuccagcugugaguugagggaggagaggcucugggcugggagggcuuccuggcggcgguguggaaggcagguuugggagcagccuagcccacuggggcgucccugggagggcccugcugcuccuucccuccggcaggggagguggcaguugggugccgagcucuggguuuuguccagguggcaaccucugggccagccgcaccucggcgccugucuuggaggagggcggugcccacgguggggcaggggcuuuggccuccccugcggaguggcucugaccagaccgggaggcaggacgcugcguuuugguccgagcgcacgucccgacuuguggcccacucuuggggacaagugcaugucccggcuucccccuuggcuccacucucggagcuggagcgggaaaggagcgaagggaugagguugaggcuggaggucguuucuuggaaacacagggcugccccgugcagcgcugguuaaaaugacugcggucccccucaugccugucucccggaacuggugggcaggaggcauugagguuugacggaaccucagaggucaacggugucaucuuuucagcccaaacacuuacaggugauauuaauaaucagucacgugggggcugucaucccucggguacccaccacgugcaggaagcuggguggacaugucugucccagcacugcaugagcugugcccgucacccuauuugcaugcuagaaaacaggccagacaguucccaaccgcgcaggaagcaacagcuccgcugccuccauacccucccucccgccccgcucugccugcugcacucucaccuccccuucgccguuccggcuccagccugggaaucgcgggcccaggugaaggcuccuguucccacacucuugagugggcucugaggggacuccacgggcccacgcggugcagaguaccuggcuugaaucaaccccggcuuuugucagccaugugaucccggacaagucacuucaccuguuggggucccaaugucccccgcauuuauaaagagaauaagaacaauggcgaucccacggggacuuucugaggauuuggugaggggacgcauguaaaguggcuguuuaacacaaugucugggcauaguagaugcucacuaaacggcccguguugucaauaauuacuaaauacgcgaggguucgggaaagaaagaggugacaccgccccccacccagauacgggccugggaacgcagggacaggcccaggggcgugggcgcucgaggcgggcucgcagaggucgggucgccgcagggcccugagcgccgcgccgcacgcagguguucuccaucgccgucuucgggcccaucgucaacgagggcuacgugaacaccgacagcggccccgagcugcgcugcguguucaacgggaacgcgggcgccugccgcuucggcgucgcgcugggccucggagccuuccucgccugcgccgccuuccugcugcucgaugugcgcuuccagcaaaucagcagcguccgcgaccgccggcgcgcgguguugcuggaccugggcuucucaggugggcggggccggggcggugagcgcggagagccuuccgggugggcggggagggggcggggccugggcggggaacaccgcuggaguuuccagcugggcguggccgugacgaggggcggggacugaggcagggagugucaaugggccucccgggugggcggggagggggcggagccuggacggggagcgccgcgggacuuucuagguaggcggggcccgggucugggcggagccugggcgcggaacgggucuggcgcucccgggugggcggggucagcgcaggagagggaggcgggaccucgcgccacgcggcgagcccaggcgaggcgccccaagccucgggcccaccgaccuuuccuccuccgggcgaggccgccgugggccaccgcguggagcgucgcccugacgcgccgcacuguucgcaggacucugguccuuccugugguucgugggcuucugcuuccucaccaaucaguggcagcgcacggcgccagggccggccacgacgcaggcgggggacgcggcgcgggccgccaucgccuucagcuucuucuccauccucagcugggugagugcggggcccgggagggcggggcgaaggggcgggcgcucggcugaucccggcugaccccgcugaccccgccccgcgcagguggcgcucaccgugaaggcccugcagcgguuccgccugggcaccgacaugucacucuucgccaccgaacagcugagcaccggggcgagccaggccuaccccggcuauccggugggcagcggcguggagggcaccgagaccuaccagagcccgcccuucaccgagacccuggacaccagccccaaaggguaccaggugcccgccuacuagcggcuggcaggcacagaccagggcuccaaggccaccccaccaacgcaggccccagggucuccgggaccucccuuggguccuuccagcucagugccgcggacagaguagguggccgcuuugcgccauccggggccaagaggggguggacccgcgugucugggcugccccugccaaguucccccagucccucagcaccuggccccaggacugagguccugagaaggggauagcacugcccaggacgugugucccuagccuggaauggacuggccuggggaaggcuuuccccucuugggccacaccugcucacucugggguuggggguccagcugcccucuacgaucaggugcaggggcugcccaggacaaagcgggggcaggggaaagacaccacccucgccccaagacuggggauccuggccacuguucccaucccaugucccuguggguagugacugucucguuucugucaugguggugcgucccguccggagccacucuccacuuucucucacaggcugcuagaacagcccagcccugucaguguugugaucaugguccagucuucggguuucaccuccuaguacuccacaagcugcuccucucucuguggccccggccccugcccaggugugggugguucuggccaggaaggcacaagguagcugugggccaagacaccagcccuguccuagcccuucaguaagaccuugccaggagaggagaaggaugccugggugccaggcaagacaagccccucagcaggagagaggcccagaggcuccagcuggccaccgugccccacaagauggccccugugugguucccuuuaccuuggcuuccuggcccagucccugccucuccaccugcacccugcuuccuggcccagucccagguuggagucccucugcauagcugacuacucaugcauugcucaaagcuggcuuuucacauuaagucaacaccaaacgugguugccacauuucaucagacagacaccucccucuggagaugcaguugagugacaaccuuguuacauuguagccuagaccaauucuguguggauauuuaagugaacauguuuacaauuuuuguauauaucacucucucccucuccugaaagaccagagauuguguauuuucagugucccauguuccgacugcaccuucuuuacaauaaagacuguaacugagcugacugugac

SEQ ID NO: 18235 - RNA, 1968 nt, Homo sapiens
agccccgacugccacgggccgggagacgggccugggagcggcggcggcggcccgagagcugcgccgggagagcugugccgcgagccuccgccucuuuuuuggcaccgcacaguggaucccuggaggccgagcgccacgccgcccggguacccggcagaucgcgagguggaacgggccgucgcugcgggggacagcguuccgaggcaguugguccucuccgggaugccguaggcaucagcugaccggcccagcccacgugacuacaggggcacuugaugggaaucauggcagcauccaggccauugucccgcuucugggaguggggaaagaacaucgucugcguggggaggaacuacgcggaccacgucagggagaugcgcagcgcgguguugagcgagcccgugcuguuccugaagccguccacggccuacgcgcccgagggcucgcccauccucaugcccgcguacacucgcaaccugcaccacgagcuggagcugggcguggugaugggcaagcgcugccgcgcaguccccgaggcugcggccauggacuacgugggcggcuaugcccugugccuggauaugaccgcccgggacgugcaggacgagugcaagaagaaggggcugcccuggacucuggcgaagagcuucacggcguccugcccggucagcgcguucgugcccaaggagaagaucccugacccucacaagcugaagcucuggcucaaggucaacggcgaacucagacaggagggugagacauccuccaugauuuuuuccauccccuacaucaucagcuauguuucuaagaucauaaccuuggaagaaggagauauuaucuugacugggacgccaaagggaguuggaccgguuaaagaaaacgaugagaucgaggcuggcauacacgggcuggucaguaugacauuuaaaguggaaaagccagaauauugaguuauuucuuaacaaguuucgagagagaagggagcaagacaagagcaagcaacggcuauuaaaugucacaauccuuuaauuagaaaccauuuauuggccggacgcgguggcucacgccuguaaucgcagcacuuugggaggccgaggcgggcggcucacgacgucaggagauccagaccaucuuggcuaacagggugaaaccccgucucuacuaaaaauacaaaaaauuagccgggcgugguggcgggcgccuguagucccagcuacucuggaggcugaggcaggagaaucaauugaacccgggaggcggagcuuacagugagcugagauugcgccacuguacuccugggcaacagcgagacuccgucucaaaaaaaaaaaaaaaaaaagaaaccauuuauuuuaaaaaugauuagauugcuaugccucaacucauagaagaugaacccuucaagaaaacgugaaguagaacgggugggccagaaaugaaaacaggcaaguaaaguauuucuucggaaaacauuuuaucaaaccaaauguuaaaaagacuuuccuuuuguaaaacuggauuagagaagacuuuucaguggguuaucucuaggaugaucaguaguucagcacuuaaaaacugcagagaaaacugaaaguuauguuccagauaacuuuccguuguuuaccaaauuuucuuagauuuggucaucaucaggaagcauuuguaaaaauaaaaaucuccacaaauuacuggcccaucucggacuugcugaaucaauuugauaggauuaaucuccagugaagcuguguuuacagggcauuccaagugauucuuaucaggaaaugugaaaaacacuccuguacauaaucgguuaauuuaaaauuuuacuuaauaagugaacaaguaaugaagauuucaccuguuuacuuaggguaucuacccagacccaucgauucugaguucgggagaugauuuugaaauuacuguuuuccaaauaaaggugcucccuucuaaguggcuuacaag

SEQ ID NO: 18236 - RNA, 5977 nt, Homo sapiens
cccgaagcuccgagacaggugugcccgccccucgccgccggagccaaugggcgcagggggcggggauuguuuacgucucgcuccggggcggaaagugggucagggccgggccggcggagcgcgcagcgggggcugcaggugaguggcggggcacgggccgacgucucgggcucugggcgggcgcgcugaccuugcgggcgcggcgguagcagcgcggccagggcgccgccuuuguuccucuccggagggccgcgcccgagagaggcuuccccggugccgccgacuccggaacccgcgcgcccgcgggagggaacagccaggccgggcugccgccggggagggcggcucccgcugcacacgcgcucgccuggggcugggcaggguucggcgguccgggcgccgcgauccgccccggccucccuggaaccccacccggggcccagcgggcguugccagccgcgagcccggcgcaggggucggcccuggaaggcuaggcgggaaccccggagcuggcgagggaggugccaggcagguggccugggaagcgcagaccuggcccucgcagccuuuugcauuuuauaccauaacagcggccagcgcugagcagguuuuaagauuuguguuucacgaggagcccuggcgguagcgagcggaggggaaggcgagcugcgcggcccaggagacgguggcgggaggaggaugcaggcgggugcggcggucgggccgggcgugaggggaaggugucggggagcggucacggugcuucuggcaugaggaacugggaggccggagaugccauuugucaaaccggacgacagaggaggagcgaguggagguuuuagaugccugcgggacaggcgggcggggcagccagguucgugagguggaaccggagagaggggcugggauucgcauuccggagucaugggugucuggguggcguuucacaggaucuaccuggguuuuauugagcugcucagauccuggagugagguacgggcuccugaagcguucuggagcccuggcugggcaccggugcggccccugcaguccccacuuugaguggguccguggcccagccuggaagcucagggcugggagugcugugagucuuccuuugcccagagccuguguuuucuucuagauucuuuccaccauggccagacgcccccggaacagcagggccuggcacuucguccugagugcagcccgccgagacgcagaugcccgggccguggcucuagcaggcuccacuaacuggggcuacgacucugaugggcagguagguuccagcgggcgaggcggacguggcuggccuaagguguggagaugcccuaggcaggcaggcagacauuaccugaacacggaaucagucggagaaaaagaugcuucugaggcuagaggaccaguccaaaccugggccugucuccuggaugcaccgcauucaguaagacucuuuaauuuggcaaaggacacacacagccucaggggugacaggaccucagaacacacugcauucuucacugugcuuucuccucugaaacacauggugcauggagagguuggcaguugcuuuugguucauucaacagaaauucuccacuacggggcugggcacuguggcucacaccuauaauccuagcacuuugggaggcugaagcuggaggaccacuugagcccaggaguuugagaccugccugggcaacauggugaaacacugucucuacaaaaauuuaaaaaaugugucaggcgugguggcacgugccuguagucccaacgacucaggaggcugagcugggaggauugcuugagccagggaggucaaggcugcagugagccgugaucacaccagugcguuccagccugggugacagagcuagacccugacucaaaaaaaacaaaaacaaaaaaauucuuugguuuacccagcccauuucuggaggugaccauuguuaacuugcugguugucuuaccagacgcuucuucugccaguacaaacgcauacucuuuguucacauauauguguguuaaaaaacaaacaaacagaaaaacccugauccuugaagguaaaaauuucugcacuugcucagggaggccaggaaccugaagguauucagaacagcucagguguuugucugucugcagcccaggugaucugacaugcuugugggcuuugcaggcagagcuaccugcccccauggccccugacccccaccuuggcagacccugagggcagcugccuggccugacgggcgcagugaggcugggaggggugggggucccuguggggggugauuucccagucgguuuccugagaucucccucggaccagagcaggaguguggcugcgccucccugccccacuuccagcuaccacaggucaugugcccuggagcagucucuccuggccucgcagggucauggcugugggacgcgggcguguccacaggccaggccagugucugacacacgcaugcugcuuguccucugucaccaugggccguguccuuccggggcggcugcuugugugaccuggugcugcucucugcugucacagcuccccugcgcugcuguuccggcucagccagguguccugggaggggugggcuccucuccucugagugaggacucccuaagcccgguggguccauuaggccuugggggcaaauugggaaacaggguccuuacccaccgggugggggccguccugaggucuccuggagcucccugcuccagccagggagaggcccccaccugccuucccgcccgccuccagcuccugcaggucacaugccugagccucacaggcucguggcugugggaugcaggcgugccugcgggcucggcaguguucgacacaugugcugcuuguccugugucaccaaaugggccugcagucuguugugggcaggagguaggcaguggcuucagucuuucuccuucuccagggaacccggcccugggccugcagugcaggugcucaguucugugcccgggcuccugacucagggggucuacccuggcucuggggacccgcacuucuaggcagugggguagaguugucugggccugccuugucugugggguggggccauccccuccagaaaggacaguguccugcccugaagcuggcuuucgauagguccacguucaccuggaagcugguggcgcccaugucaugguccccuguggcuucuccuggggaucacaucaucucucuggaccagcccucaacccucacugucacaaggccucugccacaggccccccgccaccacuuagcacucucccugcugacccccugguccauucagccccuggguggcccccacacagucugugacagggaggaggcugggaggggcacugccucccacaaggagcucacguucuggugggaggaggccaagaaucaggaccaaggagaacuucagugaagcaaaagaagaaaaauggaacaggggugaaggggcuggagaagccucagggaggugacagcugaaaccugcaccaggaggggcggggccuguagugggcacugggcaguaggacccuguggugagccaggucugcucagguaacaggaaggucguugggccacagugugguggggacugcccugaggccggguggcugcagcugggccuggugugggggugguggccuugccugggggccccugcagggcuggccuagcagggaagguguccacaccaucucagcucugggcaggugggguggaccuggggcuuauccaccgucuagaaaccacuuggaggccaggcagccuuggcuacugcucuguggcugggccuccagggcccuccuggucaugcagaauggggcagagccggagcccguugggagggagccugggcugugcgcucgggguacugugaagucccuggaggccuggacccccauccuuuccugggugggucagggacagggugggacagggacagagggcaagggugagaggguagagagcgggcaacagguaguaacagccggcccuucucucccagcacagcgacucggacuccgaccccgaguacuccacgcugccgccauccauccccagugcggugcccgugaccggcgaguccuucugugacugugcugggcagagcgaggccuccuucuguagcagccugcacucggcccaccggggcagggacugccgcugcggagaggaagacgagugugagcguggggcccagccccugcugggacugcacugcgggcgggccugggggugggcagggcagagccccauggagcucucagggcugccccagccugggccucucuugcagauuucgacugggucugggaugacuuaaauaagucaucagccacccugcugagcugugacaaccguaaggucagcuuccacauggaguacagcugcggcacagcggccauccggggcaccaaggagcugggggagggccagcacuucugggagaucaagaugaccucucccgucuacggcaccgacaugguaaguugcuucggcccagggugcuucuggggaaccuggcuccggcagcccagccccgcgcccucugccuggccccuguuccuagauggugggcaucgggacgucggauguggaccuggacaaauaccgccacacguucugcagccugcugggcagggaugaggacagcuggggccucuccuacacgggugcgugaggcccaggguggggcggggccgagccuggagcucccgggcucacugcgacccuggcugcccccaggccuccuccaccacaagggcgacaagaccagcuucucaucgcgguucggccagggcuccaucauuggcgugcaccuggacaccuggcacggcacacucaccuuuuucaagaacaggaaguguauaggugaggccgucacaggacuugagcuccucucagcugucaccccgagggaggcagccaccccgccccagcccaggggacacugagguuuucugaaaggguuccucccagaagccugaggccccagggucccagggggugggacagugaggccaggcuggaguggcagggccagcgcgugcacccugccuugccucagcugugccagcugcccacccgggugacuguagcgugaggucugaggggcugcgcccaguagcuggccccuucccugccugggguucaggcugggccccucccuuccagguguggcagccaccaagcugcagaacaagagauucuacccgauggugugcuccacggcggcccggagcagcaugaaggucacccgcuccugugccagcgccacuucccuccaguaccugugcugccaccgccugcgccagcugcggccagacucgggagacacgcuggagggucugccgcugccgccgggccucaagcaggugcuacacaacaagcugggcuggguccugagcaugaguugcagccgccgcaaggcuccaguguccgauccccaggcagcgaccuccgcccaccccagcagucgcgagccucggcccugccagaggaagcgcugccgccggaccugacugacuucccaguggaacugccuucuugggcugggacagccccuuuccucugucccuucuuucucugucccuuccuuccagccacacuccagggcggaguuggaugaggcccguccggagggagccaucucuugcucccgaggcugggacaguccuuucugugggggcucuagggccccucugcugcugugcuggguggggaagcggcugcccugagccccaggucuugugggaggcugcgaggacgagagccuggcuggagcccgcguugcuguucccacagggccucgguuuuuccuaacuugcucugcaugcugucagcggcugccccgccgucauagacuuaaaggacugcaauaaauguagaguugaugucuaacacccacauggcgugagcugaaacguauccgugcagaggccgggcuugcgagcag

SEQ ID NO: 18237 - RNA, 3051 nt, Homo sapiens
cggccgcagcagccgcaacgccucggcagccgcccugcgcucacccgcugggucccgggcucucgcggcggccuccgagccggcggaguccucagcgucggagucugagaucucccagguuggaggucgccgcugaccgcucccgccccguccccggccccggcccuggcaagagacccccgcccucccggguccaacccgcgccauggccggaccgaccucuuccucgcuuccggccgcgaccgaacacuuuagccugggacaccggccucuuccggugacuuccggccggaccgcugaggacgcggacccgccauggcgcggaagaaggugcguccgcggcugaucgcggagcuggcccgccgcgugcgcgcccugcgggagcaacugaacaggccgcgcgacucccagcucuacgcgguggacuacgagaccuugacgcggccguucucuggacgccggcugccgguccgggccugggccgacgugcgccgcgagagccgccucuugcagcugcucggccgccucccgcucuucggccugggccgccuggucacgcgcaaguccuggcuguggcagcacgacgagccgugcuacuggcgccucacgcgggugcggcccgacuacacggcgcaggugcgugcaccccguccgcaccccgccccugcagccgccuggucuccccgccuccccuccucccugcagguuugcguggcugaggcucccaccuccugaccucgggggccgagagcuuugcgagcugaccccgcuuccuucuggcuuugcagaacuuggaccacgggaaggccuggggcauccugaccuucaaagguaaggcucgggagagcgggugcccggcaguucgaugccgaccgccgacggcacagcaagugugugcagacgccucuuuuucuucaucagggaagacugagagcgaggcgcgggagaucgaacacgucauguaccaugacuggcggcuggugcccaagcacgaggaggaggccuucaccgcguucacgccggcgccggaagacagccuggccuccgugccguacccgccucuccuccgggccaugauuaucgcagaacgacagaaaaauggagacacaagcaccgaggagcccaugcugaaugugcagaggauacgcauggaacccugggauuacccugcaaaacaggaagacaaaggaagggccaagggcacccccgucuagaaugccagaaccagcggguggccuuaggggcugugaggcaguggggaccuuauugaugaaagaaaccgucuuugcguuacacccgagucugccucucggagcagggagcucaccuuccgcgacguguucugagggucugcaucuuaggggggagggcuggggcaaaucgccaccugugccuuuccucuggcccugcugcccccacacccaacuccgagggcccacgcuggggaaagcgggaagcgcucgcucccuuucccccauuagugcucucucugccuggaucccggcagaagcuaugaaagggaauaaagagaaaagaaguacccagggucguggugucuuugcgcucugucuuuaggaccggggagagaagggcugacgcuguggucguggcccuggccgggggggcgcggggggggcgggguucgggcggugcggagcagggcgccgcguggguggaaccaccugggcggguugugggggauacaguuaguguccgagcugcuggaggagacuuggccuccgcagcugcccuccggccccccacggcugccggguuccggggugcaagugaagcagccuccccgcggaggccgcagcgccccgaccaggccucuuuaagcgcaggccccgccccgggcgccaccgccccgccccgcggaucccgcucccgcaccgccaucaugaucugccuggugcugaccaucuucgcuaaccucuuccccgcgggugagccgcgcggcgcgggccgggggcggguggccggugcugggccggccugacggcccguccccgccugccccgcagccugcaccggcgcacacgaacgcaccuuccuggccgugaagccggacggcgugcagcggcggcuggugggcgagauugugcggcgcuucgagaggaagggcuucaaguugguggcgcugaagcuggugcaggugggggcgcggugagcgagcgggggcgcgguguggggggaaggggagcggggaccuggggacgccuaggugccgggugcgggcgcaggcggccugacccuuccgcaggccuccgaggagcugcugcgugagcacuacgccgagcugcgugaacgcccguucuacggccgccuugucaaguauauggccuccgggccggugguggccauggugaguauccgggaagcgggcgggcggcuccgggacccccacccccgcgugauaccgcgcccguuccuccgcacagguauggcaggggcuggacguggugcgcaccucgcgggcgcucaucggagccacgaacccggccgacgccccgcccggcaccauccgcggggauuucugcaucgagguuggcaaguaaggcccgccccggggacggucccagccccguccggccucccccuguucagccugcgugguacccgugccggaggucucuuucccacgcucacacgcgccucuuccgcgcaggaaccugauucacggcagcgacucgguggagagugcccgccgcgagaucgcucucugguuccgcgcagacgagcuccucugcugggaggacagcgcugggcacuggcuguaugaguagcccggcagaugcgcgucacagaggcucucacacuccagccuccuccagggcccaggugggcgggcuucuggccccaccccacagcgcuuggagcaucccuuuggacgggcugcugaacauccaccugucuggacguugcauggaggguggcgcaggccucuccaaucccuggcguacaggguuuccugcccgaggagcugcuccaggagccugcgcggcucgccuggaaacgugccaggacacuguccuggugcccagcccaacg

SEQ ID NO: 18238 - RNA, 1621 nt, Homo sapiens
ccaggcaggcgacaggccaaggucacagaggcaaagcagggaugggaaccagccucccugaaccuguuucugacaaagggcgagguucugggcccacacacaggcaggccgagcucaguaucugacggugaaugaaugaagcuaaguggugcuccccacagggcccggcucuuguaacugcuucacagacaagcgauuuccagguuauggagacauccuagcacagaauuaaacgcuucaaacucagacuguuaacuccucagaagccagaguggaguuucucagcccuggcuacaucagcuaacaaucucgccaagcaaggaaccaagggggcaaagacaucaccuccagaaacucgaguguuccuucugcugacagaggagcagcccgccugcggccuuguucuguguuuacaucaaccacccaauucacccgugucacagaccuucaaaauacgggauuagggacaagggaaaggucuccaacaucauccacagacggcugcagcccccuaagaacaccaaaagauuccuuuucuagauggguuuagaauggcagccaacagagguagcacuuggggucgggaaacgguuuugacugaacacacgcacgaaagcaaaggcaauugucaugcagagguggguggggaggggagagugaggccuggcuuugaagcugagcuccccggggaugacgccaggcacaucggguuuggggcugaagauucagggcugggggcacggaggagggggccagggcccaggccugggcggaaaaggggguccccgggagucgggguggggucccggggcaggcgggggagugcucuagggaggugucucacggcgggcagaggggguggggaagucccggggcgggggauaugggguccaggcgggucucggggcggggucuggggguccaggggucccgcgguccggggugccggagcggggucuggggucgggacggguguuggguccggggcccggggcuggcuggggguccgggacggggaugcgggcgggucccgcggcccacgcaccuccuccgccugccugcgcagcgccuucucacgcucguacugggugagcagcugcucguuguccucgcgcagcagcuccagcuccaccucgugcuccugguucucgcugagcaccgagucuagguucuccagcacguucaccaccagcggcaugagcuccuugaccaccuccucgucguagcaguggaugaggcgcucgaacucgcgguagauggagcccgccaggcccgacacccgcuccgacaucaccgagccggagcaguagucguccugguacaccaccacgccgccgcccucguccaucuggaucuccaucaucgcggccaccgccgccgccagcgcggcucgcuauccggccggcgcgcccggcccuccccagcugccucagguuccgcaggccgcagcccgucgccucccgcagcugcugucgccucagggcuccgccgccgccgcugccgaggcugcgcccgucacucacucaccggaagucccgcccuccagccggagggggcggugcccgcgcgucccgccgcagccgcgccgccagggggcgcaggggccgugacgucagaggaa

SEQ ID NO: 18239 - RNA, 1405 nt, Homo sapiens
uaccuuuuccgcggggccccgagccaccggcguugccgcuccccacagcgcucggaggauccuuccugggccucuugcucugcggccgcacgcuggaccggaggaaguggugcugguccugggggcugcccugcggcggggacggcgccugcggcgcgccggggggcgcgggggggccgucggcgccggcccggggggucuucucgucccucuuugugccgcugcucuccucggccgcgucugcgccgccggccccuucuccuuccagggacuccucaucggccgcccgcuugcccagcuucuugagcccguccuccccgcugccgccgucgcccaacuucacugucauccugcggccgggagaggggaggcggccggugaggcgggcgcaggccgggaaguuuagcggccccgacgcgcucucaacauggccgccguuguuuguuccaaauccccucucggcggcucggcccggcccgcccgagcccgcccgagcccgccgcggccccugccgcccccacgccgccgcccccggcccugcccaccagcccgggacccucccgggccuccccggacgcccccuggccgaggcucgcguccagacgcccgggccggcggcgggagggcgcgacagcucggcggacccugcccggccccggccccggccccggccccggggucuaugggagccccggcgcgggcgcgggucugggcacgguugcggguccgggccgcugccccgcccacagccaccuacccggcggggccgcggcucauggccuggcccugcgcgccggccucgcucccugcgccgccucggccggccgggccgcagccccagcccuagccccucgucccacccccuccccgccccccgaaaggcgcggggcucccgggccccgcgcaccugccccacgcgccggcccccagagcuggcccuggaggaggacagaggaggccggauccaccccgggacgggagaagcgcgggcucgccugcccgcacggggaacuccaugguggcccaaugccgccggcccgccugcuuauuuuaaaacacacauaaagaauaaucagcuccgggucucugggaaucuucuucccagggugggaaaugugagcugcugcggggauuuacuaguuaaaaaugcuuuugcaacaaaggagccuguugcauggaacagguuggaaccacccgggaaagugacagcccaguuauguccggguccaggugcaagaagcgguagaagacaaugguguuaaaacucuuggcaacaauuaauaaaauuauugcaucaacuuugcuacccaccgcccuguaaaaugucaacaacaaagugcagugacuaaaaaugcugcagcccagaaagcagagccacucaaaaauaaacucagacaaucaggua

SEQ ID NO: 18240 - RNA, 3115 nt, Homo sapiens
cacucaacaggagagcuggggggacgagacacaagacagacccacggagccaccuucacccucuccugcggcuggagggagacugcuggggccuugccgucucuccggauggguugcucguggaggaagaccuugucuuucuuccuuguuuuugugccuauauaucuacauggggcuucaucgcaggaagccgccccaguggggcccaggaaaccguuuuucgagaggcuccguaggcuggaggaacaggcaaguuauaccccugacauggcgcagucggguuuuuaaauuggcagcagauggaagacggauguuacagaagcagauugguaaacaucagggcuuggcggacacgaacaccgcgugugacgcucuuuccauccaugaagauuauuucaccugcaguuggacaccagggaagagcugagcugggcuccacucacacaggacacaagccucauaacaugugggggucagguggggccagaggcuagaagggggucuggaagggagucaggggaacugggggccaugggggccggguagugucauggggaguggaaacugggaggucacagguccaccuuguggcagucggugugaacggccucccggacucccacgcgggguccacggacaguuccggagugcugugggccugucgggccugcgcugggugcuuccuguuugggccucguaaagcacucaugaggccacccugccguccccugcucacaggcaggagcuggaaucacgagggaaagugacuugccggugguuauggggugagcgguggggaucagagccccagcugugggccuggaguccacaccccacguggugcagcugcauggccuggggucagucccuggcacccaccacaucucacggcaucgcaguggggaucaaaucggugggcagauagccagugcuggccguggcccgggcacgcggccgcugcucccaacuugagagggcaaagccuuucccgucccgcccagccggcccggcccggcccgccccaucaucaccguguccuccuuacaguuccggagauuccaggaggugaccuggacacaccugcagaacaucgccagcaacuacaacguguccuacaacguugacguccgguuccggagccuggcggaagagagccaggcuguggcucaggcagucaaccggucacaggccucggugcagggggagcuggcgcagcucaaggccugggugaggaagcugcagcgccgaggccggaaaguagacacgcggcugcgggccuuggaccucacccugggcgagaggagccagcagcgggcccgggaaaggaaggcacacaaggcccagagggacgcccugcaggacucacuggcacgccuggagggccucguccacagccagggcgccaggcuggcugcucuggaggggcggcugcccguggcccacccuggcacugcagcccucgggccggcccuggucccaaccccaacccagccugaggagcugggcccgaccucccugaagcuucagagggacaggcaggagcuccgagcugccucugagcacaggggccccccacaggacuccucggccccucuccaagggaggcgggagccuccagccucaggcagccaucggguacucagugggacugccccaaaagacccucggcagcaggcaugguccccccaggugccaggagagaguaaguaccacaggcucccagcucacggccaggcuucccuccagcuccuccuuagaccaggcccccuggaaaaggcuucucaaaagagguucaguuaggggccgggagauggggagagggucucggaucaucgggggggguggcccaccgucaucacagaggcuuucuaaggggaggcaggaggaacacagucagaggagggcgugagggcagaagcagagguggcgggaugcacagacgaggaggccccacgccgaagggugcaggcgccucuggaagcuggaaagggcgggagaugguuucuccuggagccuccagaggaaccagcccuguccacaccugauuugagcccugggagaccguguuggccuugugaccgccagaaaugugaaacacuaaaccugcgcuguugugagucaugaaauuugcagagacucccuggcagugaggggcgcuggcucagcugggugggccgacagcuagggcuccuagcaggaccccgccacucccgaguacggcccucauguucagucuucccgccuguggaacuggggugaucccaucaagagagugaaggagacgcugcaggggagccaucggcagggccagcgcagagucagugcuccgugaaggguggcagccgggagugggaggccaggcacccacagcacgugugcuucuggaugcuucugcucggccuccugcaagggguugacccucccuccucuguuucuaguuugcggcgugggccccacccucguuuucccaaacgccuccaccaggaacguggucuuccucagcccugguuucgucacugcccugcgagcccuguccuucugcagcuggguccgcacggccuccggccgccugggcacccuccuguccuacgccaccgaggacaaugacaacaagcuggugcugcacggccgagacucccugcugcccggauccauccacuucgugaucggggacccggccuucagggagcugcccuugcagcugcugcuggacggccaguggcaccacaucugugucaucuggacguccacccagggcagguacuggcuccacguggaucgcaggcugguggccaccggcucccgcuucagggagggcuaugagaucccccccggagggucccucgugcugggccaggaacaagacagcguggggggcggauucgacagcuccgaggccuucguggggagcaugucuggcuuggcuaucugggaucgggcgcugguucccggggaaguugcaaaccuugccaucgggaaagaguucccgacaggugccauccugacgcuggccaaugcugcacuagcaggcggauuugugcagggggccaacugcaccugccuggaacgcugucccugaggccgagccgcacgggggcugaggccagcaagggca

SEQ ID NO: 18241 - RNA, 2677 nt, Homo sapiens
cggaaguggcguccggcgcaagcgcuggcagccgcacagcccauugggaggccgaggggcgcggccgugggguggggaguccccggcaccccagguccgcgccaugggccgcaggagggcagcgcgcgggccgggggcggaaggcggccgcccucggcaccucccgacgcgcucccuggaggccuucgccgaggaggucggcgccgcgcugcagggugagcgaggcgugauggggagagcgggucaggguuugagggccugcccgggggucccacgcugaggccgagugcccuucucucucucgugcagcuuccguggagccaggggcggcugacggcgagggcggcccgggcccggcggcgcugcccugcacgcuggccaugugggaguugggccacugcgacccccggcgcugcacgggccgcaagcuggcccgccuggggcuggugcgcugccugcgccugggccacagauucggcggucuggugcugagccccgugggcaagcaguacgcgucccccgcagacagguaggcgcgggaggccugcccgaggucgucuucauuuccagcgcgugguucccuucagggaugguuuaguggcacuuguaugucgcacccacauccacacccacgugggcagggaacgucugucuaguuugccuccguugcguagcgcagagccugggauaaaggagguuuugggguaauaaacguuuguugagugaauaaacacaugcuccaggugccccaagcagcugccucaaaagcuugcucgugaaguccguuugaggguguuuggggauggcggaaugaugucccugaaucccuuagcuaggccauucuccggggcaugcuccaccuuggguagugcuggcuccugaacuuaucccaugcugucccuggcagacagcugguggcgcagucuggggucgccgucaucgacugcuccugggccaggcuggacgagacaccguuugggaagaugcgagggagccacuugcgccuguugcccuaccugguggccgccaaccccgugaacuauggccggcccuacagacuuuccugcguggaagcguuugcugccaccuucugcaucguaggugaguccaggggccccacagcagugugacccggcggccugcuguuccugcuaugcucccagcaucauguuuccugccgacagaccccaggaggagcauaagggacggacaggggaacaguucagacagaccacgguuccagccccaacugucacuucagguuuucggccuguggaguugcaguagaggcagaaugggaucgcuguucuaucagggccgguguguggggugccauucauuaucagggcaccacugcccagagaauccuccuuauccuccacguccuccuuacugaauugcugaucuaaagaggcccugaugaggcguggggcagucuuggugggaauguuuguuucgcagcaaaggagggggacuuggucgguugcagagguguggacuguagcaagggaggugcaggcugggggcagcacggguucucaggacugugagcugauguuugcuggggacccugcgguuacuugggagagcgccgccauccggcagcagggugaucaggaggcacuugaggggaccgucgacuucuuuggguuuccuguuucucacaccgucaggcuuuccagaccuugcugucauuuugcugcggaaguuuaaauggggcaagggcuucuuggaccugaaccgccagcuccuggacaaguacgcggccugcggcagcccggaggaggugcugcaggcggagcaggaguucuuggccaaugccaaggagagcccccaggaggaggagaucggugagccuuggcggggugggaaccaaggcccuccaaagccuggggggugggaggccugguccugcucugagcucacuuagaggccacuuuccucucucggcucagaucccuucgauguggauucagggagagaguuuggaaaccccaacaggccuguggccagcacccgguagguccuugggcuuaauuucaugaucacucagacccagggcucucuucuaccucuggccugagcccuuccugcugccugggggugguguuguaaacaacaccccgauggucuucugacuagaaaaccugcagugcaugucccacuggagagguuuggguguggagagcacagggaggaagaggaaucuguccucggcugggggcuuuuuguggaugacguugacuccagcuagccagggaggacgucauuugggaacgugcucccccuccucucccaggcugcccucggacacugaugacagugaugcgucugaggacccagggccuggcgccgagcgcggaggagccagcagcagcugcugugaagaggagcagacgcagggacggggggcugaggccagggccccggcugagguuuggaaaggaaucaagaaacggcagagagacugaggguugcagacacauauauuuuugaggcugggugacgagaaaaucuagagacaugagggacauaaaugggccuggcagccucggcucuuugcggcugcuggcaggacugagcuguccggguucuccccacacuuccagcacagcugugcucuguguccugccucggcgcucucgcaaaugaagcugcaggccaagaagccccuugu

SEQ ID NO: 18242 - RNA, 6356 nt, Homo sapiens
auacuugggagacagcagagacauuuucacaggguguguuuucauuugccuuuggcacuaaugggucucuggaacguuccauccuggccggggaggucagggccugggcggccagggcccauuucgagaaagcagguuuuccuuuguggcaugcuuauuucaagcaccauuuucccuccugguuauacuugaaauggggcucgguguugggagguuucaaauguggacauuccgggcaaggggccucaugaacucuguggacauucugggcaaggggccucaugaacucugaagguugagcuuggaaggacggacacaggucuuggcagccugaguggguacaaacgcugauuuuucuggagucaguccucuccugcugaugggcugagagagccccccaggcccugugucccuucucagaggaccucagccccccagugccugggccacggaugggcugggggcuggggcccagggccucgcauccuacaagggcccaagggcugaaauggggcuggggucccuggaucuaggggaugagggcccagaacgaggcuggggucugggguucaguggagcaaugaccaggaaucaggcugcgaucuguaguccaggugucuggcgucagacagcacccuccuguacacggcacagcuguacugcaggguuagggacaggauuuacugccaccaacggaagcguugauuccaagucucagacaccgcccccaggcugggccucccucgacggaaggugacgcucucugggagguccuuggugcucaccucccuggcugcuuggggccccagggcuccugccuagggauguuuuggggcugcagaaggacccucugcccauuaucagacgagaagugcagagagcaaaugcgugcuguuggcgccccccacccccacacugagaguggagacggauaggcccagccagaagcuuggggacccgcucccagccuggagugacggacgcugagcagcaggagcacagcuguucccgacacauccgugaucugggcgugcaccugucacuggggagagagcagugcuggucuccacgcuuugggcaucgccugcucccugaauccuuuccacaugcgaacagccugggcagggguccccagcggucaguagcuacucccgccagcgcggguucauggaucaggaggcucccagugugucaggggagugcgaggugaagauggggagggcugggcuggaaaugcucguccuccguggaggucgggggcaucaggaggaccaggaggacgucugggcugcaggcagacguaagcugcagcagggccagcucuggcuacagaggcccagaaagcacugcuccugcaaggugccaagaaagacucacugagugguuuuccacugcccugugagcgccaggaagcuuaaggcacagacaaggccaguucucaggcagacgccaccccagccaacaggccagccuugacccaaaccggaacucgugccccagcuggcacugccagcacccgagacagugaaguacagggagcugcaacccagcccagagcuccaagugugcguggccaagaagcugacucccgaagggggucuugagagggguccugcgaaccccuccucuccccuggagacccguccgggggcggggccuuucccagccucugcucacagccugcgccggcccagccuguagucacucugucucugccagaccagccgucauuaaaagcaccaauuaaucucccaggccgugccaggacgcugccaacugccccacgggugcucgggaugcaggggcugggaggcccgggccaaggcugugcacacaccggcugccagcggguucacgcccgccgggcccucccugugcuucucagaggccgcacaaaagaugggcugccugccgcaggaggagggccggguuggggguggauggagggggacggggaggacgggcagggagggacggaggggcacagggaaggacggagagggagggacaggggccucuccaggguggcauuucccugggcagcccugcuuccuccucgugcccugggcccaacacacaccacacacacacacacaccauacacaugcacaccacacaucacaaacacacccacacccugcacacauacaccacacacuaaacacacacaccacacacauaccacacacauacaucauacacacgcacacacaccacacaccauacacacaccccaccacacacauacacgcacacacacacaccacacacacacaucauacacacgcacaccacacaucacacacacacaaacacacccacacccugcacacauacaccacaccaaacacacacggacacacacacaccacacaccauacacacaccacaccacacacauacaucauacacacacacacacaccacacaccauacacgcaccccacacacauacaucacacacaucauacacauacacaccacacaccauacacaccauacgcacuauacacgcaccauacacacuauacacgcaccacacacaccauaaacacaccccauacauacaucccauacacauaucacacauuacauaccauacaaacacacaccacacacacacaugaacacacgcgccuccggggucgccaucccuaggagccacggguagggugggguggucucucaucuggaagcaucccccaggccaucccugcaccaucucaugggcagcagagccuguccacccacauucuucucugcggcuguccuuggcgcccaggccagggcauguggagcuacaaaugucaucuacaccagcucuccacgcccggcacucacggcccaggggacagcccugguccagauucccccaucaggguauacuugaaacguacacucccccugaaacugcaaggcccacuagcagguggugaggucaggguggguggggccaugcagacacggcggagcaggccccagcugaagggguggggcagggaugggagacaggggaggagggugugugugcagcuccccccuggaugaagacaugggcccaucagguggacucagagguggcucugauggcugccccuccacucuccacccccggguccaucucuugucaucagacacucugcucuagcuuccccagggaacacgcuggccucucccugcaggagaucagaagcuucagggcucagcuuaaaugacaccaaagaugcuuucccagaccauccuuccugaaguccccgccucugagaggugcuuuuggaguuaccugcugccugccucccuccacaaggccagcgucugcagggcaggagcugugaggguggcccggcuccauccugugugggaaagugccuggcacacagcaagugcuuaauuaauaccuggugacccucaagccaucccgacaccucccucucugaaagcuccgucccggcguccucucaggccuaguggcucacacccgcggaggacgaggucauuuuccuggggacuucaagguggaccagagaugacucuggaagggggguuugugggcaccacucugcauggggauccucacccacauaccgcccucccgggagugcaccaacacguccucagcugacuggccuaggcccccaccaccccgccacagagacuccccaccuccccaccccuccuguggcagccugcacgcccagcaccuccccuggugaucacugcaaccuggggaaaggagcaggcgcuguuggagccugaggcagggucucaguugcacagaccaccgugccccagagucagggccuggaugccacuccccaaccucagucucccuuccuccaggggugcuggaguuccccaccugugucccagggacuugaagcuuccuugguggauggggagccaggaagaggccacccugccugcucgcagaccuaaugcaacugcuuuucuuuggcaaagagagcucuccacggagguccucacccggauggcacugugagcccgagugggcgaugucugcucucccaggggcaggggguggaagguggcacaguuuggaccggacccccacccucacugcuuccacuuaaacccccacuucugccugccugcaucccaggccuaacagaugaguuccgcgggcgccccaggcgaugcucugagggccacggaaggaugcggggaccccgagcggagggcagggccuccagggggaagaggcacugcagacggaggugugggucuucccaggcaggugccggagccaagcgagauggugggacggggaagagagggcaggccaggcuggcagccagcucuccaccuacgaugcguggagccucccaacucgcgcacuccgucuccccaccgcugcuuccucugaccuggcugcagagaugagaccgcccuccgggcaggugacacggcccuugcucuucagccuggaggccaaugcuuccuccaaaggcccuggcccccucagcuccgggccuggcuccgguuguucccaaugcaaagcagcaagggccccggggucugcggacgggggcgggcggccgcugggggcaccagcucucggccgggccagaacaggggguaggaggcgcguccugugcggucgguggcggccccaggugggugcggugcgcuggcaggaagcggcagcacgacccccgacuuugcaucuggacuuuucuaguaacggaccagcuccuucugccgaccgggccggggagaccgcguggcucaguggcugcagcggccaccggcccgggcgugggggcuuugagggcaccggcgcgguaggucacccggguuucgcgggccgcaagcucggagacgcgcgugucccgcguuggcugccugacccggaauggcgcagccccuucgccuccagcgcgcugguugaaaggauccgagccacccucggggacggccgggccgaggccaccucgcggggcggccuugggcggggacccggacccgcgguuggacguucgccucggggggggcaauguccccucuccgaccccgcgguccccaccagggcggcacaccccgcccucuccccgccuccgcaggcgcccagggcucacaggcucggagcggccuccgccucugccggaccacccagggccgccccgccggaggggccuccccgcccccgagcccuaggucacgcccggaaggcccggggcccccgcguccggccacgccauccgcccggcggccccagggacucagcgccggggucagcgcaggccccgcccagcgcucccgcccccuccagcuggccggcccccgggaccgcgcccccgcccgcgcucuccacgcucgcacucguaugggcagggcggcccggggucccccagcuccgagccgcggccccuugaagcgcguuaccuggacgugcgcuguccgcagacucuggacgagcugggccugggcgcugcgcggcggaaccgacccuguccuggaccgcaggcagcagcugaccccgcgccaccggccugcgggcgagaccucaggcgcgagacgggcugugugugugugugugugugugagagagagagagagagagagagagagagagagagagagagagagugugugugugugugugugugugugugugugugugugugugugucgggggaggggcccgaggacccgcuuccuagcugagcgucaggacggggggcggacucucaggagccgcgcggcgcccgcagaggagaggaagcgccggagaccccccugcucccacccggccucccugccccgcuuccuuucccggggcuccagagaggggagcuccaggcguggggcgccuggcccacguggugcggcgccgggcggggcaggcgggggcgcggcgagagccgcggagcuuucuuuaugggugggggggcgggggcggccgggcuccgccuccgggggaucggggcgcgcuccgccaauggguagccgggcgcggggcggggccgcggggccgccgcuuaaagaaacuuguugcgggucccgcagcgggacccgagccucggcggcggcggcggcggcggcaggggcgagggucggggccaccgcgcggcgaccucgggucccggagcgaccgcagggcagccccgggcgccggccccggugcgcgucuccugugcgcgccccuccgcgcgcggccccgaugcuggacaugagcgaggcccgcucccagccgcccugcagcccguccggcaccgccagcuccaugucgcacguggaggacucggacucggacgcgccgccgucucccgccggcuccgagggccugggccgcgcgggggucgcgguggggggcgcccggggcgacccggcggagg

SEQ ID NO: 18243 - RNA, 3870 nt, Homo sapiens
cgggaggggcggggcacagccagggcucugccuggcggacucccggaacaucacuuggcccucgcucucacucgcggucgccuggccguugucauugucccuccgcugucaccuuuucaagguagguccgaugaacaggcgcccggggcuagggagggcccggaggccccucgacucucagcuggcccaggucaguccccugggcucacccuaacucccggggcgagggcagcugccccgcaggcagcaaaacccaacccgagccggugcugcaggcagggaggcggcucucgcggugcgggggagcuguguccaucugagcgccgugcgccgccugcagugcccaccgagucccguggcugggggcguccacggggugcacgggguggguggccaggcuuggcggcagcugcgcgaagguagggcugggcagcaaggacugggcugugggcggggcgccaacaccccgggccugggaggacccgcacgcagcuaguccugcgcccacggggcugaguguagggucuccgagaaaaggccugcaccggggaugggggcggguaggggugcuggaacuccagagucuccgggagggaauccucugcaugacccugaucacucccccagaaaccugcccccgcucgcuccccggccucccaccccacuacgggcagacccucugcuggcugcugggagucugcccaauucaccaccgggaccccaccagccucaggcccugggccccucccuagguggccggugcagcugcacgaccaaaggauggggagacuguugggccaggagcccccuucacagccagaggcaggcuccccgaaacuugacgccaacccccacccacccucccaagguucagcccugucucccaaccuuggggacgggggccagaguugggacggagugagggacucccugggccccuggaguggguagggggagaggcagggggcaacccacccccacuugccucgaacuuguggcaguucugaggggugucaaccuguggcuuucccaggcuggccacaagcagaaagcacgcagguaacgugugugguucccagacacacuggggacccaggggccacccacagcccauaucccagacucggguaguauagccugagcccccaagauccugagcacacaccccaccugccagagaagcaaacugcagcagaacauuccuguccaggaguccuggcucuggacugggcucugccaugcaaagcaaaggggcacacagcggggcggggcaggggccaccuccugaggaccucgccccacaccucacaccguggucugggucagccugcgugggccucagugggaggguaggagcugggggccugccgugcugagcacccuuucuccugccugcaagggaucuucguaaggugugggggccuaugggggaguagcugaggauguaaaguuucuugcaguuaauuagucccagugcaggaggcgggagcuggggccuugugggaacucgcucugugcccugcacccuagcaacgccuaggggacuggcccaggcagugguguggacucuccccgcuucauccugcgggguucagcucaggccugcggggagcagcggggguggggacuacaggcugguggccucggcccuguggcuuccuccugugcccuccagccccaggcuggcugcuucagaagccccugaccccauggaggagugggacgugccacagaugaagaaagagguggagagccucaaguaccagcuggccuuccagcgggagauggcguccaagaccauccccgagugagugccccaccugccugauuugccucucauuugucugcccugcgcuggcugcucauuuccauagccacgaccaccgccgccgacaggcaggugcagcaggaggcccucgggggucaggugccaccacucaccugccacccgcccacccgcaggcugcugaaguggaucgaggacgggauccccaaggaccccuuccugaaccccgaccugaugaagaacaacccauggguggaaaagggcaaaugcaccauccugugagccccgcacccggccccucucacaccauccugugagaccacgcccggccccacucccaccaucuuguaagacugugcccagccccacucacuccauccugugagucccacucccagccccacucccaccauccugugagcccaugcccggccccacucacaccaaccugugagccccacucccggccccacucacuccaucuuguaagacuaugcccagccccauucacuccauccugugagucccacucccagccccacucccaccauccugugagccccacuuccagccccacucccaccauccugugagccccacucccagccccacucccaccauccugugagccccacucccggccccacucacuccauccugugagccccacucccagccccacucacaccaaccugugagccccacucccggccccacucacaacaucuuguaagacugugcccggccccauucacuccauccugugagaccacgcccggccccacucacucuauccugugagaccacgccuggccccacucccaccauccugugagccccacuccuggccccacucacaccauccuaugagcccacgcccggccccacucccaccauccugugaaccccacuccacucgcacgugauuacagucuguaaaggugugacuuuauaaagacaucuccagcuuccugucucugcacucugcgggaagcaaugcgagggcauguccgcggcucagagaacuagagcaagucccugauguacaggcugcgccgcacggcguuggagacacccucguugaagcggaaccagaccucgcuccugcccaccgcugugcccaugcgccgcuccacugaguccugcuccggggccguguccccugcggggccacaggguugcuccucagcuguaaggcccccccacaacccccaggccccccacaaccccacaacacccccacacacaccugcacucgggacugcugugcuccugacgaccacacguccaaagaaguccuucucaggcugaugggaggaaggacuagucagucguauaggacagaugccccauccagccccuacccaagacaggaggaccgagagccuucccagggaggagggaccagaacaccucugagacaccuuucggaaccuggcccaggccagcugccccucaccccucacugccaucugcuccccaccaggugccaaucaagaagagccaauacagccacucuucugcccagaugggaaacugaggccuggguagaacccuggucaugcugaggguaaggagcugguccuucagagccccccuuagggcacugagccagccccacccucagccagacuccuccuguggcucagccccacccccaaagguacccuggccccaccccaugggugccuuggccccaccccuaaagauacccuggccccgccucaugacugcccuagccacagcccugaagguacccuggcccugccucaugaggggcccuagccacacccacaaagguacccuggccccaccccaugggugccuuggccccgccucaugacugcccuagccacacccccaaagguauguacccuggucccacccccacagcugcccauuccacaccuguuccucccgggccgcucgccucaugaugugcuccagccgcugcucaugguugcguggggcaggucggugcaccccuuucuccccaaugccccccagcagacccucgagcccuggggggcucccauccaccuguagggagcaggcauugugagaucuggccacacagggauaca

SEQ ID NO: 18244 - RNA, 3870 nt, Homo sapiens
uguaucccuguguggccagaucucacaaugccugcucccuacagguggaugggagccccccagggcucgagggucugcuggggggcauuggggagaaaggggugcaccgaccugccccacgcaaccaugagcagcggcuggagcacaucaugaggcgagcggcccgggaggaacagguguggaaugggcagcugugggggugggaccaggguacauaccuuuggggguguggcuagggcagucaugaggcggggccaaggcacccaugggguggggccaggguaccuuuguggguguggcuagggccccucaugaggcagggccaggguaccuucagggcuguggcuagggcagucaugaggcggggccaggguaucuuuagggguggggccaaggcacccaugggguggggccaggguaccuuuggggguggggcugagccacaggaggagucuggcugaggguggggcuggcucagugcccuaaggggggcucugaaggaccagcuccuuacccucagcaugaccaggguucuacccaggccucaguuucccaucugggcagaagaguggcuguauuggcucuucuugauuggcaccugguggggagcagauggcagugaggggugaggggcagcuggccugggccagguuccgaaaggugucucagagguguucuggucccuccucccugggaaggcucucgguccuccugucuuggguaggggcuggauggggcaucuguccuauacgacugacuaguccuuccucccaucagccugagaaggacuucuuuggacguguggucgucaggagcacagcagucccgagugcagguguguguggggguguugugggguuguggggggccuggggguugugggggggccuuacagcugaggagcaacccuguggccccgcaggggacacggccccggagcaggacucaguggagcggcgcaugggcacagcggugggcaggagcgaggucugguuccgcuucaacgagggugucuccaacgccgugcggcgcagccuguacaucagggacuugcucuaguucucugagccgcggacaugcccucgcauugcuucccgcagagugcagagacaggaagcuggagaugucuuuauaaagucacaccuuuacagacuguaaucacgugcgaguggagugggguucacaggauggugggaguggggccgggcgugggcucauaggauggugugaguggggccaggaguggggcucacaggauggugggaguggggccaggcguggucucacaggauagagugaguggggccgggcguggucucacaggauggagugaauggggccgggcacagucuuacaagauguugugaguggggccgggaguggggcucacagguuggugugaguggggcugggaguggggcucacaggauggagugaguggggccgggaguggggcucacaggauggugggaguggggcugggaguggggcucacaggauggugggaguggggcuggaaguggggcucacaggauggugggaguggggcugggagugggacucacaggauggagugaauggggcugggcauagucuuacaagauggagugaguggggccgggaguggggcucacagguuggugugaguggggccgggcaugggcucacaggauggugggaguggggcugggagugggacucacaggauggagugaguggggcugggcacagucuuacaagauggugggaguggggccgggcguggucucacaggauggugugagaggggccgggugcggggcucacaggauggugcauuugcccuuuuccacccauggguuguucuucaucaggucgggguucaggaagggguccuuggggaucccguccucgauccacuucagcagccugcgggugggcggguggcaggugagugguggcaccugacccccgagggccuccugcugcaccugccugucggcggcgguggucguggcuauggaaaugagcagccagcgcagggcagacaaaugagaggcaaaucaggcagguggggcacucacucggggauggucuuggacgccaucucccgcuggaaggccagcugguacuugaggcucuccaccucuuucuucaucuguggcacgucccacuccuccauggggucaggggcuucugaagcagccagccuggggcuggagggcacaggaggaagccacagggccgaggccaccagccuguaguccccacccccgcugcuccccgcaggccugagcugaaccccgcaggaugaagcggggagaguccacaccacugccugggccaguccccuaggcguugcuagggugcagggcacagagcgaguucccacaaggccccagcucccgccuccugcacugggacuaauuaacugcaagaaacuuuacauccucagcuacucccccauaggcccccacaccuuacgaagaucccuugcaggcaggagaaagggugcucagcacggcaggcccccagcuccuacccucccacugaggcccacgcaggcugacccagaccacggugugagguguggggcgagguccucaggagguggccccugccccgccccgcugugugccccuuugcuuugcauggcagagcccaguccagagccaggacuccuggacaggaauguucugcugcaguuugcuucucuggcagguggggugugugcucaggaucuugggggcucaggcuauacuacccgagucugggauaugggcuguggguggccccuggguccccagugugucugggaaccacacacguuaccugcgugcuuucugcuuguggccagccugggaaagccacagguugacaccccucagaacugccacaaguucgaggcaaguggggguggguugcccccugccucucccccuacccacuccaggggcccagggagucccucacuccgucccaacucuggcccccguccccaagguugggagacagggcugaaccuugggaggguggguggggguuggcgucaaguuucggggagccugccucuggcugugaagggggcuccuggcccaacagucuccccauccuuuggucgugcagcugcaccggccaccuagggaggggcccagggccugaggcugguggggucccgguggugaauugggcagacucccagcagccagcagagggucugcccguaguggggugggaggccggggagcgagcgggggcagguuucugggggagugaucagggucaugcagaggauucccucccggagacucuggaguuccagcaccccuacccgcccccauccccggugcaggccuuuucucggagacccuacacucagccccgugggcgcaggacuagcugcgugcggguccucccaggcccgggguguuggcgccccgcccacagcccaguccuugcugcccagcccuaccuucgcgcagcugccgccaagccuggccacccaccccgugcaccccguggacgcccccagccacgggacucggugggcacugcaggcggcgcacggcgcucagauggacacagcucccccgcaccgcgagagccgccucccugccugcagcaccggcucggguuggguuuugcugccugcggggcagcugcccucgccccgggaguuagggugagcccaggggacugaccugggccagcugagagucgaggggccuccgggcccucccuagccccgggcgccuguucaucggaccuaccuugaaaaggugacagcggagggacaaugacaacggccaggcgaccgcgagugagagcgagggccaagugauguuccgggaguccgccaggcagagcccuggcugugccccgccccucccg

SEQ ID NO: 18245 - RNA, 10217 nt, Homo sapiens
aggcugcugaaguggaucgaggacgggauccccaaggaccccuuccugaaccccgaccugaugaagaacaacccauggguggaaaagggcaaaugcaccauccugugagccccgcacccggccccucucacaccauccugugagaccacgcccggccccacucccaccaucuuguaagacugugcccagccccacucacuccauccugugagucccacucccagccccacucccaccauccugugagcccaugcccggccccacucacaccaaccugugagccccacucccggccccacucacuccaucuuguaagacuaugcccagccccauucacuccauccugugagucccacucccagccccacucccaccauccugugagccccacuuccagccccacucccaccauccugugagccccacucccagccccacucccaccauccugugagccccacucccggccccacucacuccauccugugagccccacucccagccccacucacaccaaccugugagccccacucccggccccacucacaacaucuuguaagacugugcccggccccauucacuccauccugugagaccacgcccggccccacucacucuauccugugagaccacgccuggccccacucccaccauccugugagccccacuccuggccccacucacaccauccuaugagcccacgcccggccccacucccaccauccugugaaccccacuccacucgcacgugauuacagucuguaaaggugugacuuuauaaagacaucuccagcuuccugucucugcacucugcgggaagcaaugcgagggcauguccgcggcucagagaacuagagcaagucccugauguacaggcugcgccgcacggcguuggagacacccucguugaagcggaaccagaccucgcuccugcccaccgcugugcccaugcgccgcuccacugaguccugcuccggggccguguccccugcggggccacaggguugcuccucagcuguaaggcccccccacaacccccaggccccccacaaccccacaacacccccacacacaccugcacucgggacugcugugcuccugacgaccacacguccaaagaaguccuucucaggcugaugggaggaaggacuagucagucguauaggacagaugccccauccagccccuacccaagacaggaggaccgagagccuucccagggaggagggaccagaacaccucugagacaccuuucggaaccuggcccaggccagcugccccucaccccucacugccaucugcuccccaccaggugccaaucaagaagagccaauacagccacucuucugcccagaugggaaacugaggccuggguagaacccuggucaugcugaggguaaggagcugguccuucagagccccccuuagggcacugagccagccccacccucagccagacuccuccuguggcucagccccacccccaaagguacccuggccccaccccaugggugccuuggccccaccccuaaagauacccuggccccgccucaugacugcccuagccacagcccugaagguacccuggcccugccucaugaggggcccuagccacacccacaaagguacccuggccccaccccaugggugccuuggccccgccucaugacugcccuagccacacccccaaagguauguacccuggucccacccccacagcugcccauuccacaccuguuccucccgggccgcucgccucaugaugugcuccagccgcugcucaugguugcguggggcaggucggugcaccccuuucuccccaaugccccccagcagacccucgagcccuggggggcucccauccaccuguagggagcaggcauugugagaucuggccacacagggauacaguggggauggugcacgcccagacugcaaccugcuccagagccugggugggcucaccugggggcuguucucuacccgggcagaagccuccgcccgccgcaucuucuccaccucgaucucgcgggcgaugagcugcuucgucugguaggugaggggcuugcgggcaggcagcucagggaagcggcagaguuccuccacguuccugcucagcacagggggacaccagggcaggucagcggggccaggcucagggccagagagccgccgggcacuccaaccgcaaaccccaaaagccacaaggccagagcaggaauguggggcugaguccuggugccaccgcaccccaacccugcggcagccagguuuaacugccccgagccucaguuuccccaacugcaaguguacgugggaugaugaugaaaccugccgauggcugccacggagagugacucagcguccugcaaguuggugccgucgcuggggcagcaggaccccggggccacugccccaugccucacccccaccacccccauggccaucccacagcgggaaacggaguguuggaaagugcagucacucucggggcccccggcuccaguuccaugugggggugcuaaggcugggagcagcucugcagcaaaacucaggucccagagccaaucucaaguagcuggaagugaccccccuucacgguuacaucugagcaaaagauaagcuggggcccgccacccccagacgccaugaccgugcuuucagacuccuggccccaugcgggcccugaacauggagcacagccggggagcaugacccuggagcacaccccaggcacugggggacucacggcuccagccuguagauguacuggccaucgggcgugcgcuccuggcgguaggucaggcuguaagcgagcaucgugcccaccaggcuggccagcuguugcuuuucacgggugcuguacagcugugugcucaccuaggggaugggaggcagcagacagggagcugagcaggcuguacaaaugugugcucaccuaggacaggagggcagcaggcggggaaucccccaccccggggacggcacucacggggcggagcuugggugcaagaauguccaggagcaggcagagggcaucgaggagcagggccuggggcguggcccggcugcgcguggcuggcgcgaugccggacaccagcgucuggaucagguuccucaucuggcucauccgguucugggccuggggcagggggugagccaaggccuggucaccugggccucccgggcgaggggggaaugguggguggggccagggcagccacacgggcagcacaggggggcgggcacggggccgggggcagccacacgggcaguguguuugggggggcgggcacggggccgggggcagccacacgggcaguguguuugggggggcgggcacggggccgggggcagccacacgggcaguguguuugggggggcgggcacggggccgggggcagccacacgggcagcacaggggggcgggcacggggccgggggcaggcguggugcagggacgagcacaccuccugcuggcugcuggggaaggugauccuggguguguggcuggaagcaaacagcacauggaaggccacgggcaggaaggguggguagcgcagcagcuggaagcucuggcugugaugagcagcccccgccagcaggucaucgaaggccagccagucgagggccacacacacagcacccaggcuggagucucgcagccgcagacgcaggaaguugucaaacaagcccugcaggcggccggcaaccccugagcuccugcccaccccagggaaggugcaccaccacggacccuccaccucccgccacagacccuccacuccugccugccgccugccccacgaggcuucgcagacccuccacaaggguccccacgacgcugggcgucugaggcagcagcacacaccagcaaggggucacugggcccaaggggucgggggaggguccacccugagcauccucgcuacagcuugacagagacugacuugacagagacugacacgagggggugacccaccaggaggccuccaggaaccaaagggauccagccucacucagccccuccuuagacugccugaggaaguuccgcccaccagaguccaggccguggcguccccaccccuguuccgugggggagucuauccccgccgcugcuccacgcugccccuccacaucgcggcuuuugggauuuggggauugguuguggauccccagcugcuaauccaaagccgcuuagagucagcagacagcuuaggcggggacucccgcgggcagggcggcaggaagcccucaccgcacugcucuccaccccaugugcaucuuaaguccagaauccagccccucgcagccccaggccaggcuguccggcaggggcuccaccccaacccgcugagagucccaagcagccaccagagcgaccucccccgucagacggccgccccuaccuccuugccugccggcccgugcccugcagccccucccacccuccuggcuccugcuccccaccucagagacuuccuggcaccccauuucccgaaccugccucucucagcacccccaaagcgccuccccguccauacgggaggaccggcaggggcaggggcacagcccagguccuagccaggcggccccaggcaggcauuuugguggaagacagguaccuggaccaccuucucgugcucgcccgcagaggcagcggcaugcaggacacgguagaaucgcugugaggcggaggugagggagcccgcguccccgucacccagcaggagugugucagcaggcagggcgggguccuggcccacacggcgccugcagguggggugcugaagcuagauggacccguguuaaaagcacaggcagccccacccgucuccccgggacacucagaggccccaucagagcugccacccacuucauucuucucagcagggcccuugcugccucgcucagguggagacagccaaagacacgcccggaccucaacccccugaaacauucccuuaagccgaggagccccacucugagaggagcccugcccugacccucugggguuaggggaccccagggaaagucccccuccggguccaggccaggagcagcacaucccacaggcccaggccagcgucucccauauccugcagcacgaccaggccagcauccccuggggucccauggcacgucaggacagagacaugcuggcugcuccugcccacgggaggccaagcagugugggcaggcaggggcucagagaccacagcccaggccaaauguggcaaaaaugagggugcaacugggacagcagcugagucaaggggcgcccuggagagggacgcccuggaggccccaccacacuggggguguccuucccacagggggcccuggaggcuucucuagcugaccccccaaggcuguaggggcgagaacaagccaggaaaaggcugaggagggcccuggaggcuggaccaggcaaccgcgggcucaggacacugaguccccgccucgaagguagugcuggccugcacacagggcuagcguccugagguccgggcaccgugagcaucugggccgaggcuguggccaccgccuaccucugggcucgaggcagcuggaagaccuccugccacaccgagaagagcccucugcgcugguccuugaggcccacgcguguggccugcacgucccgcacgcucagcucccgcuggccccggcuguacaggaacuagacauagggcgggggcaugagaagcggccaacuccugaccccaccccaccccacccggugccugccggccgcccaccugcaggguguugaugcaggcccggaugucauugucaguuuucucacagagggcggccagcaccccugggucggcccucaugcccugccgcagggagaccugguggagaagggcugcuggagggcccgaugguaugccccauccuuucagggguuaccaggguuccauggggaggggcagggaaacaggggccagaacgaggccacgcccccaaccccgccaucagccacacggcuccuggggcuccaccgaccuccuggagccgcugcaccagccucgagggcagagucggcgggaaguggagcaggaaggccugcugcuucagcugccgcagggacggugcgaaccugaggagaggcggcagggccagggaccccaggguuggcaccacagcccaggacacagggacgggccggaacccucccuccaggcaccagagccucuccugacuguggcgcccgcccaugcacucacuggucauugcaaaugcagauaaugggccucaugaggagcccccccucugcccggcgccgucggccgccucccgaaggcacagccgggcccuguggccccaccuccuguggccccuugcgguucaggaugcucaggaggacguugauggcggccuugggggaggucagaggacacggugaguccaggcccugcugcccgccugccugcccgcccacccaccuacccaggcaucaaggagcccaccacgggggccccgucgaucucaucgaugaccaggcaguugggcuucccgccagcacccagcaccgacuccaucuggguggccgccucgaugcgugugcggaagaccuccgggcuacggucgucacugcaauggggaggucaggggucgucagggcagugggcgucccuggcagggcagccucccaaggccggggcugccgcauuugcguggagaccgucacaugacgcggcugcugccgaucccgugaaccccgaggaaggacacguuuucccggcccacacacccaggcccccaccacccucaagacgggaacauccacacccgguuucagguccgccaccagaacucaaacacgucaggacagaaggcgagccagagacggaccucacaucacucaccuggcguucaucuccaccacagaguaccccgcgugacgcgcaaucacgugugccaggguggucuuccccagccccgggggcccacagagcagugccaccugcagcccagguagaugaaggcguagugugcaccgcaccuacaggacgcucccggccuagcagccagggacugccacaugugucccacaggcugggcgcucccuccaccccacuccagccaucaaauaagaacaaaauugagcacuuucacacaccaagauggcaacggaaaaaaaaaccuacacaaagcaaaguucgugcagacaaaacacagcugauaccagugugacuggcccccagaaaccacccaccguccacccagaucauccuggccagccgcagagcccuucagggacaacgacuucccccgaguuguuacugcaacgcuccaguucuaacucacgcuaauggcgcuucacgccaagacccacacgucaccacacccacggcuccuggagaaagucaacaggcugcaagggugccggcgccgagugcaaagccucaggcuuguucccggcggcacagccagcggggcucaccuucugcuucggucgcuggcucggguccagcccagccuccagcaucuccuccagcaccuguucguggcucuuccacuugccuggggcuguggccuccuugcugacccgggccggcucaacacugggccugggcuuccgggaaggccucucguggccaaacaccaccaggucccacaacuucagccacuugagcaggcagcgguuggugaacugcgggaaggacgggaagggaagcacagccugagggcaccgccuccaggcacggacaguccaccugccaccaugagccccaugccccaugggaugccaagccacaggaugaauggccacccccgucuuccugccagcgagugaccgcaaggcucacaccaggggcuccacccccacggcucuggccacaacccaucugggaggccccugcccuccccaggggcacuccagugucagcugcugugaagguaggaaagggaacagagacuuggaucaggugacacccuggaccccuagccugccucacaggucacaggggaccaguagcacacagcccugugcucaguucaccaccuacaacucaaaagggcaaaccagagcccacuccgucuccgaggcccaguggauuggcugugcaaaaaucacugggcccagguucuuccaucuugggaacagaggaagccagccacacuugagugagaacaagaccucacgucaucacugagcagcuccguguaguggcggggugcaaacucauccacccagaggcagugacuggaggcgucuugaccgucagucggcuccuccucaggggcccccaagggcugggcugccuccuccucccccgaccugagacuggagaggaccacguccugagccacaaacaacucgcagggaccaugccaacccacacgcuaggagcuaggaguuggugcaagagccaacaaggguccccagggcggaagggccaaccaagucaccugugcagggugucugaaagcuucugggccuccugaagcagccgcucccgccgcugugcaaacaacaggcuggaaucaggagggcucaggcggccccgccaccgccccccagcaaacccgcagccccuaccucgccgucgaccugcuucuucagggaggcuaaggacacacccagcagguccagcuggccaccgccucgccaugggacguggaggagagagcccuguggggaagggaggacaauugccucugggccccuccuaggucacaggauucacgucagcccccaucagugcucagggacccgggugggacaaccccaguaagcuggccagugaggggugggagacuggacaggggugccaaaggaaugaagccauccagaugggucagcugcaaagggaaauugggggcagcuuuaggagaaaggaggaaagggcaaaagcaggaggggaagcaaggaggcccucuccacccgaggccauacaaacaggcuggacagcaaccugcuguggggaggcuguguccucuaagucuacgccccaugacgcagccucccccucugcaccccuggggcucugcacaggacccgcuuuaagcaaauggcaggggugaggggcuccaaggacccuuuccugagcagcacuggcccacccaccgugcaggaaggccacagccacgcaccugcacccccggggccauggggucagcacgcagcaccagauaagcccggacgcccuccguggaugucacguggacguaguccuccaagauggggggccgccucaggacgggauugcgggcagcuggugaggcccgugugagacccacgucggcagcagcuucugagacucuggagagagaccggggcucaguggcagaaacucaagcguggggucacccuuggauauggguguccgagacugcucucagccauggaacccuccccaccccccaggccucauccagggcacgggaugggcuccaucugagucccacuggacagaugggaugggacgcccauguccaagccacacacccguggccccaaagcucugcgagguccucagggcucggcggcggggugauguccgucggcgaggagucgggagggggcggcuccuccaucuccuccgaucugaaguucagccucuugaccaccugcagccuaggccguuugauccugggggcugggggagacacaugcagggaaccagaggccuccucagccucgcgcccacuccggaggcccuggggcaaugccgccaaccuaccguggggcagggacccggccggcugcaggucggcguccaccugccucuuccuggcgccgcccuggcugcugcccacagaugcggcuggggcgggacuggaggccgcguccccucuggcaagggccuccucgaacguccgcgggggucggcccgcggugaacagggggaccccggagggcgacggagucgacgccccugcugggagaggagauugucagcggccgccccgagacagcagaucccgccagcggcgacguggaggccccuucggcccccggcacgcccuccccgaggucgccacugucccggcuuucgcagcuccuccccaacggccgggggccgcgccccaccuuccagcucugccagcaccuccagcucggccgcgaacugguuguggaaaucauccucgacgccgcacagcuccugcucguaguccuccauaccguccgcgagcccgagcucccgcuccgaaccucccgcgccgccgccgccgucgcgcacugcccgccccgagcg

SEQ ID NO: 18246 - RNA, 10217 nt, Homo sapiens
cgcucggggcgggcagugcgcgacggcggcggcggcgcgggagguucggagcgggagcucgggcucgcggacgguauggaggacuacgagcaggagcugugcggcgucgaggaugauuuccacaaccaguucgcggccgagcuggaggugcuggcagagcuggaagguggggcgcggcccccggccguuggggaggagcugcgaaagccgggacaguggcgaccucggggagggcgugccgggggccgaaggggccuccacgucgccgcuggcgggaucugcugucucggggcggccgcugacaaucuccucucccagcaggggcgucgacuccgucgcccuccggggucccccuguucaccgcgggccgacccccgcggacguucgaggaggcccuugccagaggggacgcggccuccagucccgccccagccgcaucugugggcagcagccagggcggcgccaggaagaggcagguggacgccgaccugcagccggccgggucccugccccacgguagguuggcggcauugccccagggccuccggagugggcgcgaggcugaggaggccucugguucccugcaugugucucccccagcccccaggaucaaacggccuaggcugcagguggucaagaggcugaacuucagaucggaggagauggaggagccgcccccucccgacuccucgccgacggacaucaccccgccgccgagcccugaggaccucgcagagcuuuggggccacggguguguggcuuggacaugggcgucccaucccaucuguccagugggacucagauggagcccaucccgugcccuggaugaggccugggggguggggaggguuccauggcugagagcagucucggacacccauauccaagggugaccccacgcuugaguuucugccacugagccccggucucucuccagagucucagaagcugcugccgacgugggucucacacgggccucaccagcugcccgcaaucccguccugaggcggccccccaucuuggaggacuacguccacgugacauccacggagggcguccgggcuuaucuggugcugcgugcugaccccauggccccgggggugcaggugcguggcuguggccuuccugcacggugggugggccagugcugcucaggaaaggguccuuggagccccucaccccugccauuugcuuaaagcggguccugugcagagccccaggggugcagagggggaggcugcgucauggggcguagacuuagaggacacagccuccccacagcagguugcuguccagccuguuuguauggccucggguggagagggccuccuugcuuccccuccugcuuuugcccuuuccuccuuucuccuaaagcugcccccaauuucccuuugcagcugacccaucuggauggcuucauuccuuuggcaccccuguccagucucccaccccucacuggccagcuuacugggguugucccacccgggucccugagcacugaugggggcugacgugaauccugugaccuaggaggggcccagaggcaauuguccucccuuccccacagggcucucuccuccacgucccauggcgaggcgguggccagcuggaccugcuggguguguccuuagccucccugaagaagcaggucgacggcgagguaggggcugcggguuugcuggggggcgguggcggggccgccugagcccuccugauuccagccuguuguuugcacagcggcgggagcggcugcuucaggaggcccagaagcuuucagacacccugcacaggugacuugguuggcccuuccgcccuggggacccuuguuggcucuugcaccaacuccuagcuccuagcguguggguuggcauggucccugcgaguuguuuguggcucaggacgugguccucuccagucucaggucgggggaggaggaggcagcccagcccuugggggccccugaggaggagccgacugacggucaagacgccuccagucacugccucuggguggaugaguuugcaccccgccacuacacggagcugcucagugaugacgugaggucuuguucucacucaaguguggcuggcuuccucuguucccaagauggaagaaccugggcccagugauuuuugcacagccaauccacugggccucggagacggagugggcucugguuugcccuuuugaguuguagguggugaacugagcacagggcugugugcuacugguccccugugaccugugaggcaggcuagggguccagggugucaccugauccaagucucuguucccuuuccuaccuucacagcagcugacacuggagugccccuggggagggcaggggccucccagauggguuguggccagagccguggggguggagccccuggugugagccuugcggucacucgcuggcaggaagacggggguggccauucauccuguggcuuggcaucccauggggcauggggcucaugguggcagguggacuguccgugccuggaggcggugcccucaggcugugcuucccuucccguccuucccgcaguucaccaaccgcugccugcucaaguggcugaaguugugggaccuggugguguuuggccacgagaggccuucccggaagcccaggcccaguguugagccggcccgggucagcaaggaggccacagccccaggcaaguggaagagccacgaacaggugcuggaggagaugcuggaggcugggcuggacccgagccagcgaccgaagcagaaggugagccccgcuggcugugccgccgggaacaagccugaggcuuugcacucggcgccggcacccuugcagccuguugacuuucuccaggagccguggguguggugacgugugggucuuggcgugaagcgccauuagcgugaguuagaacuggagcguugcaguaacaacucgggggaagucguugucccugaagggcucugcggcuggccaggaugaucuggguggacggugggugguuucugggggccagucacacugguaucagcuguguuuugucugcacgaacuuugcuuuguguagguuuuuuuuuccguugccaucuuggugugugaaagugcucaauuuuguucuuauuugauggcuggagugggguggagggagcgcccagccugugggacacauguggcagucccuggcugcuaggccgggagcguccuguaggugcggugcacacuacgccuucaucuaccugggcugcagguggcacugcucugugggcccccggggcuggggaagaccacccuggcacacgugauugcgcgucacgcgggguacucugugguggagaugaacgccaggugagugaugugagguccgucucuggcucgccuucuguccugacguguuugaguucugguggcggaccugaaaccggguguggauguucccgucuugaggguggugggggccugggugugugggccgggaaaacguguccuuccucgggguucacgggaucggcagcagccgcgucaugugacggucuccacgcaaaugcggcagccccggccuugggaggcugcccugccagggacgcccacugcccugacgaccccugaccuccccauugcagugacgaccguagcccggaggucuuccgcacacgcaucgaggcggccacccagauggagucggugcugggugcuggcgggaagcccaacugccuggucaucgaugagaucgacggggcccccguggugggcuccuugaugccuggguaggugggugggcgggcaggcaggcgggcagcagggccuggacucaccguguccucugaccucccccaaggccgccaucaacguccuccugagcauccugaaccgcaaggggccacaggagguggggccacagggcccggcugugccuucgggaggcggccgacggcgccgggcagagggggggcuccucaugaggcccauuaucugcauuugcaaugaccagugagugcaugggcgggcgccacagucaggagaggcucuggugccuggagggaggguuccggcccgucccuguguccugggcuguggugccaacccuggggucccuggcccugccgccucuccucagguucgcaccgucccugcggcagcugaagcagcaggccuuccugcuccacuucccgccgacucugcccucgaggcuggugcagcggcuccaggaggucgguggagccccaggagccguguggcugauggcgggguugggggcguggccucguucuggccccuguuucccugccccuccccauggaacccugguaaccccugaaaggauggggcauaccaucgggcccuccagcagcccuucuccaccaggucucccugcggcagggcaugagggccgacccaggggugcuggccgcccucugugagaaaacugacaaugacauccgggccugcaucaacacccugcaggugggcggccggcaggcaccggguggggugggguggggucaggaguuggccgcuucucaugcccccgcccuaugucuaguuccuguacagccggggccagcgggagcugagcgugcgggacgugcaggccacacgcgugggccucaaggaccagcgcagagggcucuucucgguguggcaggaggucuuccagcugccucgagcccagagguaggcgguggccacagccucggcccagaugcucacggugcccggaccucaggacgcuagcccugugugcaggccagcacuaccuucgaggcggggacucaguguccugagcccgcgguugccugguccagccuccagggcccuccucagccuuuuccuggcuuguucucgccccuacagccuuggggggucagcuagagaagccuccagggcccccugugggaaggacacccccagugugguggggccuccagggcgucccucuccagggcgccccuugacucagcugcugucccaguugcacccucauuuuugccacauuuggccugggcuguggucucugagccccugccugcccacacugcuuggccucccgugggcaggagcagccagcaugucucuguccugacgugccaugggaccccaggggaugcuggccuggucgugcugcaggauaugggagacgcuggccugggccugugggaugugcugcuccuggccuggacccggagggggacuuucccugggguccccuaaccccagagggucagggcagggcuccucucagaguggggcuccucggcuuaagggaauguuucaggggguugagguccgggcgugucuuuggcugucuccaccugagcgaggcagcaagggcccugcugagaagaaugaaguggguggcagcucugauggggccucugagugucccggggagacggguggggcugccugugcuuuuaacacggguccaucuagcuucagcaccccaccugcaggcgccgugugggccaggaccccgcccugccugcugacacacuccugcugggugacggggacgcgggcucccucaccuccgccucacagcgauucuaccguguccugcaugccgcugccucugcgggcgagcacgagaaggugguccagguaccugucuuccaccaaaaugccugccuggggccgccuggcuaggaccugggcugugccccugccccugccgguccucccguauggacggggaggcgcuuugggggugcugagagaggcagguucgggaaauggggugccaggaagucucugagguggggagcaggagccaggagggugggaggggcugcagggcacgggccggcaggcaaggagguaggggcggccgucugacgggggaggucgcucugguggcugcuugggacucucagcggguugggguggagccccugccggacagccuggccuggggcugcgaggggcuggauucuggacuuaagaugcacaugggguggagagcagugcggugagggcuuccugccgcccugcccgcgggaguccccgccuaagcugucugcugacucuaagcggcuuuggauuagcagcuggggauccacaaccaauccccaaaucccaaaagccgcgauguggaggggcagcguggagcagcggcggggauagacucccccacggaacagggguggggacgccacggccuggacucuggugggcggaacuuccucaggcagucuaaggaggggcugagugaggcuggaucccuuugguuccuggaggccuccuggugggucacccccucgugucagucucugucaagucagucucugucaagcuguagcgaggaugcucaggguggacccucccccgaccccuugggcccagugaccccuugcuggugugugcugcugccucagacgcccagcgucguggggacccuuguggagggucugcgaagccucguggggcaggcggcaggcaggaguggagggucuguggcgggagguggaggguccgugguggugcaccuucccuggggugggcaggagcucagggguugccggccgccugcagggcuuguuugacaacuuccugcgucugcggcugcgagacuccagccugggugcuguguguguggcccucgacuggcuggccuucgaugaccugcuggcgggggcugcucaucacagccagagcuuccagcugcugcgcuacccacccuuccugcccguggccuuccaugugcuguuugcuuccagccacacacccaggaucaccuuccccagcagccagcaggaggugugcucgucccugcaccacgccugcccccggccccgugcccgccccccugugcugcccguguggcugcccccggccccgugcccgcccccccaaacacacugcccguguggcugcccccggccccgugcccgcccccccaaacacacugcccguguggcugcccccggccccgugcccgcccccccaaacacacugcccguguggcugcccccggccccgugcccgccccccugugcugcccguguggcugcccuggccccacccaccauuccccccucgcccgggaggcccaggugaccaggccuuggcucacccccugccccaggcccagaaccggaugagccagaugaggaaccugauccagacgcugguguccggcaucgcgccagccacgcgcagccgggccacgccccaggcccugcuccucgaugcccucugccugcuccuggacauucuugcacccaagcuccgccccgugagugccguccccggggugggggauuccccgccugcugcccuccuguccuaggugagcacacauuuguacagccugcucagcucccugucugcugccucccauccccuaggugagcacacagcuguacagcacccgugaaaagcaacagcuggccagccuggugggcacgaugcucgcuuacagccugaccuaccgccaggagcgcacgcccgauggccaguacaucuacaggcuggagccgugagucccccagugccuggggugugcuccagggucaugcuccccggcugugcuccauguucagggcccgcauggggccaggagucugaaagcacggucauggcgucuggggguggcgggccccagcuuaucuuuugcucagauguaaccgugaaggggggucacuuccagcuacuugagauuggcucugggaccugaguuuugcugcagagcugcucccagccuuagcacccccacauggaacuggagccgggggccccgagagugacugcacuuuccaacacuccguuucccgcugugggauggccauggggguggugggggugaggcauggggcaguggccccgggguccugcugccccagcgacggcaccaacuugcaggacgcugagucacucuccguggcagccaucggcagguuucaucaucaucccacguacacuugcaguuggggaaacugaggcucggggcaguuaaaccuggcugccgcaggguuggggugcgguggcaccaggacucagccccacauuccugcucuggccuuguggcuuuugggguuugcgguuggagugcccggcggcucucuggcccugagccuggccccgcugaccugcccuggugucccccugugcugagcaggaacguggaggaacucugccgcuucccugagcugccugcccgcaagccccucaccuaccagacgaagcagcucaucgcccgcgagaucgagguggagaagaugcggcgggcggaggcuucugcccggguagagaacagcccccaggugagcccacccaggcucuggagcagguugcagucugggcgugcaccauccccacuguaucccuguguggccagaucucacaaugccugcucccuacagguggaugggagccccccagggcucgagggucugcuggggggcauuggggagaaaggggugcaccgaccugccccacgcaaccaugagcagcggcuggagcacaucaugaggcgagcggcccgggaggaacagguguggaaugggcagcugugggggugggaccaggguacauaccuuuggggguguggcuagggcagucaugaggcggggccaaggcacccaugggguggggccaggguaccuuuguggguguggcuagggccccucaugaggcagggccaggguaccuucagggcuguggcuagggcagucaugaggcggggccaggguaucuuuagggguggggccaaggcacccaugggguggggccaggguaccuuuggggguggggcugagccacaggaggagucuggcugaggguggggcuggcucagugcccuaaggggggcucugaaggaccagcuccuuacccucagcaugaccaggguucuacccaggccucaguuucccaucugggcagaagaguggcuguauuggcucuucuugauuggcaccugguggggagcagauggcagugaggggugaggggcagcuggccugggccagguuccgaaaggugucucagagguguucuggucccuccucccugggaaggcucucgguccuccugucuuggguaggggcuggauggggcaucuguccuauacgacugacuaguccuuccucccaucagccugagaaggacuucuuuggacguguggucgucaggagcacagcagucccgagugcagguguguguggggguguugugggguuguggggggccuggggguugugggggggccuuacagcugaggagcaacccuguggccccgcaggggacacggccccggagcaggacucaguggagcggcgcaugggcacagcggugggcaggagcgaggucugguuccgcuucaacgagggugucuccaacgccgugcggcgcagccuguacaucagggacuugcucuaguucucugagccgcggacaugcccucgcauugcuucccgcagagugcagagacaggaagcuggagaugucuuuauaaagucacaccuuuacagacuguaaucacgugcgaguggagugggguucacaggauggugggaguggggccgggcgugggcucauaggauggugugaguggggccaggaguggggcucacaggauggugggaguggggccaggcguggucucacaggauagagugaguggggccgggcguggucucacaggauggagugaauggggccgggcacagucuuacaagauguugugaguggggccgggaguggggcucacagguuggugugaguggggcugggaguggggcucacaggauggagugaguggggccgggaguggggcucacaggauggugggaguggggcugggaguggggcucacaggauggugggaguggggcuggaaguggggcucacaggauggugggaguggggcugggagugggacucacaggauggagugaauggggcugggcauagucuuacaagauggagugaguggggccgggaguggggcucacagguuggugugaguggggccgggcaugggcucacaggauggugggaguggggcugggagugggacucacaggauggagugaguggggcugggcacagucuuacaagauggugggaguggggccgggcguggucucacaggauggugugagaggggccgggugcggggcucacaggauggugcauuugcccuuuuccacccauggguuguucuucaucaggucgggguucaggaagggguccuuggggaucccguccucgauccacuucagcagccu

SEQ ID NO: 18247 - RNA, 3287 nt, Homo sapiens
gucauccuuggagccagucacugaacauuuauuuggagucccuggagcccugcuguagccaggagcccagguuguggcaugggggacagaggaggugggaccuggcagacccacagcucccaagcuggggucccggaggcagagugacaaugcauggcugugugggagccaggcaggcggugacguggcagagcugccagcaggggcccaagagacugcagcagguuggugcucacaguggaucugagggaugggcgugcguggcagggccuuggccauggccccugaccaaccccugugcaccaaacaccacacugagcucagaauccgggcagagagggaaccacugguacagugaggccaaggcacacgcagccgggccugcagacucgagcccagcagggaccauuaggucucgggaggaggcagcugagggcgacaggaucugcacagagcagugaggggcagaggacgcagggaccagaugggucucccaggccaggugagcccagaacggcccuucccagccccucuagaggguagguugggggcaguagcucaccaggcccaggagcagcccauccuggaggcaaagccuaucccaaaaccuggcccugccucuuccugaggugaccuugaguccguaaaacugacgccccuggggugacgcuugagagccggaagcuguuccaggaggagggaggggccucgguuucucccggggcaugugggcaggaaggcccucgggaucccgcaucagucccacggccgcggugcggucgucaccugugaucacggcugccuggcgcccccugccggccccaccucagcccuuccucgcaggccuggccggggcaacccagugggccugaugcugccuggcaccucgaggccccagagccagugagcagacgcucgcucgcccaucucccuagagucccgcugugcagcugacacccccugccccagccccacggcucucagcuguccgguuccagcguccacuccgacagccacugcaggcaggggccccgcugugccucagucucagggggcuugguuggggguggaggaggccggccgggcccaggcaggagugcggaggggcugccuggccuggggccccuauccucggggucagggucggggguggcccguaaggccugcacgagcugguccagcgacugcagcagugugugggggcuccagcaggcauccagggagggcaggaaggggucaggcgugcagaccuccacacacucgguguccguggggaugcgcagguagaaagcgugcagcaucauucugaacggccgguccucccggcccgagacuucuccguaggucaggucgcccaccacgggguggcccagggcacugcagugcacgcgcagcugguguguccggccugcgggaugagggcggugccggaucaagcugggagcggggccgauccacaccuaucucccugaccaggacccaccucccgucaugaccccgcugcagucuugaagcagccucuugggguggaacucucccuguccccugccaugagugaggaugacaguauuuaggacagaagauuguguucaggucaccacuggugaggacagggccaggguggugcucgguccuggagaaucuaggccagccagacccccaaggaaucagucaggagccagcagggacccugugucaggugagaagcugagaggcugcagggcguggaguuaagaacgcaggagugcuuguugccagcucugcccugaugcucaggguggcccaacauaagcuucguggcccugugccucaguuucccuucugucaccaccaggacaccgcccaccccagacacacccgugagcggcuucagcagcacuuuggagacaggaucgccugcguacagcccguguuccagaaccacgagaucugugaggcuuggcuuuggguucucacaaccuggggcgcagaaggcaggugugagguuagugggacugacccggggcccaggcccaccccaacgcacgaugcccgcccggugggucccugccugcccaggcccaccccaacccacgaugcccgcccggugggucccugccugccacacccugcgagcccucgaugcacauggugugggcccggcccuccgugcuguuccugccaauggcauggcugaugguuacccggcucuccuggaugugcccccgcagcugcaggagagggagaaucgcacgcaguucacggggcagcccagugcugccggggagcccaccuaacaccaagcaaccacguagagcguggugggaggcucugagccagggcugcccaaguggggugggaauccugaguccccacgccccaccccaggacugaccaggucuuaccaaugccagguaagccuuggucacgcgccgcuccuugaagcaccuguacgcgcugccggcggcugccuuguuuagggccacgcacagcgccccgcugguggagaaauccagcugguggcagaaccuggagugggacagaguccagagucugagccacuuuccuccacagacgccaccguggggcuccggccgcccccccuaccugaacccguagcaggugucagggucggccagcucgggaaagcgguaccgcagcugcuucugcagggucagagucucccgccacgccuugcugucaaugcgaacgucccagugcuuguugaccaccaggaagucgcggcuccgguacacgauggacagguucuccacgcugccuggcuccauggccggccugccgagccacgcgugggugcgugugcugugagcacguggugcgcccccagcccagcauacagagguacccgcaccgccccacccgggcuccggugcgaagccaccgagccggguccgcagcccuacugugcaccugcauccucaguccccgagaucaguccccagggcgucagcuggggagucaaggagucagccugcuccgggcugaccugaagggcccugccugaccuaagccuggagaaagagcccguuccaaaccugccccacagauccuccccacagacccuccccuccaggggaugcacgugaaugccucugcccgacggugggggcggggaggggcugcagcacuaccaggcccggcagccaggucugcccgcagcgcggguuagggcuggggccuccucgcuccccgcaguccgcgcagacccgcgccccgcacaggcccggugggcaggccgacccuggcuccgagccccucccgcgcccacgcccacgccaagaccaacc

SEQ ID NO: 18248 - RNA, 13316 nt, Homo sapiens
gcgaggggaggaggaggcgcccgccugguucccugcaaagcggccuuauuuaucugggcacagccucagccuccccggugggaggcuuggggcggccgauccucucccaccggggagcuccuuuccgugcgcugccgagggggcccggccaggacgggacgcggggcgcagggcgcggccgggcccugccggccaguccagcaccccggcggcccccgcgcgccgacgcccaugccgggcuccccaugacgggaggucgcccggcggacagcguggcaugagccaggagcccgggccgagguaaggugcgcgugcggccgggcugcggggccgggagggggccaggccgcaccuccgcggcggccacaaugaggagggggcggggugggggugggggccgcgccgccgccgcccgggaagggcuuacguaacggcagccccuuccccaccucccccgcggccgcugggccucggucccugccuggccuucccgcagccccgcgccccggccccuggcccggaagagggccgcuccccacuggccacucggccggggcuggggguccgugccuccugggacgccgaaaggaggaauuguaggcccccggccuccaccccgggcgccuggucggcucagagggcgcccccggaccgaagugacaggccagagaccguuaaacugcaugggggucgcguggaugugcggccugaggggcggcccuccccgggcgggcggcuucuggacccggggccugcgcugagcuacugcccgcgggaggaggaggguggggggaggcuggcaccuuccugguucuggaggcgggaccgggccuuggccaagguuggagggccucagaagggaaacggcaccuucagaccugcucgggagggguccgguguccuccuggggauuagguggguggagagcguuccccacccaucaccucaggagagagggcugcgguggcagcuucaggaacugacggcccagcggccacuccaggcccuucccaggcuccaggcucuguucgggcagccugcccuccgcaggaggagcagauggcggaggccaccucaccugccucuuccuucaggcccuucccccacacccgugcauccgagggcccaauggccaggggcagcucaggccucccuggacacagggccgucucccagcccacccccucuguggggugcuggacagcagccuuggagcagauaggccugggucaggccaggagacugaaggguuuucugucucccggaccagggcagaggccuaguggaaccuggcuggucuggccagagguggacacagggcuggaccuggagccgccuggaggggagggaaauucaaggcccagcugcaaacaucgcugugugggggaacccuaggacucacuugccccacucccugcccccugccaccccaacugccccucaucuggggccagacccuugaguucagccccuccaucgacagacucacugccuccagcucacacccacuuccggggcggcuggacgaguccuaccucccacugaugagaaggacacaaacagcuuccugugugggaggcacggggcccuugaaccagcuggacauggacccaggaagccuuguguugcugagaguuagggaucucccacccagguggcacuguucagccacccgaagaccccaucuccuugcaugugggcacccacugcugugccucccaugacuggauuggcagugaagggagcucugugggugagcaggugacugagccuuccccaccaguggugcaggaggagucaacggccaaacuggcugcaauguguggguucaggccucauuccuucacugggcaggaaagaggggugaugguuaguggcagcugccuggagcaguaggcacuaggggcccaggccucgccucugagggugcucaugcucuuccgagcaggggcugagaugaggccuggaucccagcacccacuccccaggguguccagcuuucaaggcugagcugcccugggcuugaccaugggcccucagucugcuggggcagcaacacggguuucucuugaggccacgugccugcugcgccauggugccccuccucagagccccuggugcacccccagaagcaucucaaacugggggcgggagaggagcucugccgcugugccacgugccaaguggcagggacgcgggugugccugcgucacggggcugccacggaaugugucagucugcacccuguccccaauccccagccaccccagcugucagccaggcucuggggcugccacugcagauggagcccgaugugcauuucucuggccaccagggcccugcccagcucuaaggcccucugcaggcagggcucaauggucccugagguucuaugagggcugagugguugguuaggcugugccccagucuggugcugacagagaugggggcaccagagaugggggaagagaccuucaaacugggggcgcugaggggugaggagguuucccaggcauguguccaaaaggaugucccaggggugggcacgcggugugcagccucugcaaggaaugcagcgccguggcagggacccugcaggaugagggcaguacuuggagagaccacuagcccagggcccagcaggaaggcaucgagaccccaugaggcagaacagggcagagcgaggacccugugagguacaccuggcaggacccagguagagggaaucagccagccccggggcuuuuggagccaauccuagcucuauguaacuucuggaaaauccgucugcaagcucugcuuccccacuccuaguuaggcagugugugaaggaaggacucuggccggucagaggaggggugcguguggugccagggagagcggggcaggaggacccccuucccucucuuggcucaggccagaugguggaggacgggcagccacuuccucagcccugcagcuccugaagagagagccagcugaaaaggagaugggcccuccucauccgaaggcucuguguauugcaaggcccaccccagcccuggggucuugggagcccucucagugacucagguaccaaccuagucccaaccccagaggccacucuccccgcggacacuggccauggcacgauccggguuaauuucccgagcugugccuuccccgcugaccggccucuuccuaaauuugaccaauccuccaucagcccuccgggggccuuggcagcugcaccccuuucugcgugacugagcuagcggagccacauuccgcauucauucauucguucccuaauucauucauuccgcgaacaugcagaggccaugcacguuggugcugucuguccucaagaguccucaggccaggaggagagacaccagguggacagugaugauaacccaugugauugcaagacccuggagacgcuuucucaagagcugggggucccggagcaggaggcaggggcgaccucgcaccaggaacugagggauggaggagaagagcuugcagggcuaaggcagggaaacccugccaggcaagcagggggaacggcgugugcccaggcagaggagcaggggaggaggaauggcauggcugggcuguggcaucagggcugggaaggggccggagcugaggucuccgggcucagugacuugauucgcagaagaggcagcuccugcggggcccccacauggccgucugggaauggucagccuggaugcuguacauguacauguggggacccccaggagcacccaggccccaccgugcucccuaggcucacucuggccacacgcuucacacugcguccccuggggaggacacagaggccacggccaccucuccccagcagcucccaggccaggcucaggcugcugaggacaagacagcugagguggggccaccucucucucuuuccccuggggugagccccggagccuugacaggauuccacuucaagcugagccagcaccacaggggcugaggcugaggauggugcaggcauggccaccuuuuuaacaagucucuuccccguauuagcacccgggcugcuugucccuaaagggagaggcagucccuagcagcccacgcaggucguccgagccccucuggguggaacgagggcucucacagucgccaagcaggaaagggggcucugugagccaugggaaccggcuccuuggugaccgucuggcuggguggguggggccgggcccagggccaagcagaggggcccuugugugagcccccagggacuucucgcugaacgggcagagagaccccagucuccaguugagcucagcuuucucccgcagcgcccaugccugggccaaaguguguggcuguuugcauuuuugagcuacggggugggggauauucgggcugagucagucaagccgggagugugaggagcagcgggggccggcaggaacguggacgcgagauuggggagcaguggggcugccugugcggggaugcagcucccaccaagcacacgggucgagggcugaccacaggcagagcagcgccuucuggcagcgcugcggguguggaugagggaagccaggccccggacccauacccagacggccgcuccucagccuguccccucccuccugugggcucucaaagugcggcuugguuucuccaucucgacccugaggccuggagguggggacgggacugugggcgccggcaaacgugagcucccgagcggggcgggaaaggagccccgcgaaugccucccccagccccggcgcuccacgugcaggcccaugacugggagcguuuucaaccuaaaucggcacugcgccgggauuauuccuccccuggcgccgcccccgccgccuccuccggauccuucccggcuucucccccacucuucgcccccggggccccucccugcugagcgggggcugccgggauuugggauugcggggcugccccgaccccgcagccguccgcgguggaagccagcccgggccuggcccugagcgcgcggcuggggcggccgcuguccauggugcuggcgcggguggcgcgccggccggcggggucugcggaggcccaggcgucccuggcggggaaggcggcgcuuccgggucuggggagcgaggguccccgcucuaggggcacggaggauauuuagacuggggcgcccgugggccuggugcugccgccucgggcgccggcauccugcgauauccccucuccccggcucugggagggaaccgaggcagccccgcgccaggccuccccggacaccuggggcaaauucgcuccucagagccucguguuccuuccccaaaccugagguagcgaccccuccaccccuaagggcggccgugaggucgaaucaugugccgaccccagccggcccuugcaaacguugugaugucggccuccggaggccgcgccuucugaucaugggcacaugaugggggucaccggcugugggugccuccucuguggagggcccggccucaccuuccaggacccgaaugauacucuggggagggggagaugguacagaggguggagcuggggcuccugccauuagggcaggaaggacuuuaaacccaaagcuggguucucagccacgagggccacguguucuggcgagaccccuggucccggcuccggucuacacccccuccccagauguggaccgguggcaaggcuggcccugucuggggcuuggaagccaguguggggaccugcugcugggaagagcggggcaggaccucccacugccucccugccucccugccuccccuccccccugaccagauuauggggaaugggcugcgggccuugggguugcagugccguccgagaccccgccacucucugugguggagcaggccaggcccuguagccccagaagggacacucagccaaaaagaugugagccauccucuuccugagagucugcauauugcagggcccaccccaagcguuggaaucuucgugggagacucucagacacccccuugguggcuccaagagaccuuccagugaggcuguggcaggagggggcagggugggcugggagaggcuuuggccccuccucugagauuuuggggcaggaaggcaggaccugcaugaggcuccaggcuuaguccuggagucaccuaagaccggggaagaugcaucuugcuuugcccuggaguguggccguggggcucagacaucacucucccagaccuugcuaugagccacgcacugagcucguucacuuugcaaugccccaagggagcagguaccgucaccuccccaggcuucaaggugaggaaauugaggcucagagaagggaaguggcuugccaagaccacagagccaggguggggcccauuucaaguccagggcgugugaccccaggggcucuaccuccuccccggaugucggggugggggcggcaggagauccgaacuguggagcagaugguggcacagugagggucccaccucugcuucuuuccguggcugugcccagugcccccugccacccacuuacagacuggaggccugaggagggugcccgggacugcucccacuccacccugugcguggaugucgcuggccugaagauaaccuccgcauggccuuccucagccagcucugcccgaacuuuggcuucaccacuuaucuggccaugaccucgggcaggcaguuugcccagccuuggccucaguuuccucaucugugcaguggguacagcuaucacagcaucguucucauugggcagaagauuaaagcgacagcuuguguccagggcuaaccaugcuggcaccacagcacacccugggaagaugcccgcccuuucuuugcauggauucuuuuuucuuuuucuuuucuuuuuuucuuuuucuuucuuucuuucuuuuuuuuuuuuuuuuuuugagacaaagucucacucuguuccccaggcuggaguacaguggugugaucucggcucgcugcaaccuccgccuccuggauucaagugauucuccugccucagccucccaaguagcugggauuacaggagccugccaccaagcccggcuaauuuuuguauuuuuaguagagaagggguuucaccauguuggccagguggucucaaaccccugaccuuguaauccacccaccucagccucccaaagugcuagaauuacaggcaucagccacugcacccagccccuuggguagauucugagccagggaagcuccugugcauguggaggguggcugcagagucagcaccagagccccuccugagcgcugugcagucacccugcaggggaggggccagaggccaccccagacccuucccuucaguuccccuggccugcccagaggggugggccugguggguaccuacaguggacggcacagcagagaggucaagagagcaguccuggccucaccagguccaccuccauuuucuucucuguaaaauggccaucaugguaccuaagugcuaaaaagugucggcguuucuucgccucacugggcaaacaaaaagguuuccggucaggcacgguggcucauucccauaaucccaggacuuugggaggcugaggcggguggaucacuugaggucaggaguuugagaccagccugaccaacauggagaaaccccaucucuacuaaaaauacaaaauuagccgggugugguggugggcgcccgaauucccagcuacacgggaggcugaggcaggagaaucacuugaaccuacgaggcagagagguugcggggagccaagauccugucucugcacuccagucugcgcuccaggcaacaagagugaaacuguuucuuuuuuuuuuuuuugagacagagucuugcucaguugcccaggcuggagugcaguggcgcaaucucggcucacugcaagcuccgccucccggguucacgucauucuccugcugcagccucccaaguagcugguacuacaggcgccugccaccaugcccagcuaauuuuuuguauuuuuagaagagaugguguuucacuguguuagccaggauggucucgaucuccugaccucaugauccacccgccucggccucccaaagugcugggauuacaggcaugagccaccgcgcccggccggaacucuguuucaaaaagaaaaaaaacaaaagaaaaagaggguguccaugggcaaugaagguugggcucagugcauaccguaggugcccagugagugcugccaguggccaugguuggcuuccuguugcugcucacagucugggagggagaagcaggcacucccauccucucugucuggugguucugggagcaccauagggacgcccaaggagggaaggagccccacugcacccgcccccaaccccggccuuccagacucagcaacagacucacucccccucccggcccucauccacagagcgugccaggaagaugucgagcccgggcaucgacggcgaccccaagccuccaugcuugccucgaaacggucuggugaagcugccgggccagcccaacggccugggugcggccagcaucaccaagggcacgccagccaccaagaaccgccccugccagccaccacccccacccacccucccaccacccagccuggcugcuccacugucccgggcugcccuggcugggggcccgugcaccccggcagguggaccagccucagccuuggcaccugggcacccagcggagcggccgccgcuggccacggacgagaagauccucaaugggcucuucugguauuucucggccugcgagaagugugugcuggcccaggugugcaaggccuggcggcgcgugcuguaccagcccaaguucugggcaggccucacgccggugcugcaugccaaggagcucuacaacgugcugccugguggcgagaaggaguucgugaaccugcaggguuuugccgccagaggcuucgagggcuucugccugguuggcgucuccgaccuggacaucugugaguucauugacaacuaugcgcucuccaagaagggugucaaagccaugagccucaagcgcuccaccaucacggacgcaggccucgaggugugcaccaggcucgggggggacagggcuggggggcaggggcgggcagcagcaacccuauggaggugggagcggaugguggcuuuggggugggaggaaagaaggacugacuacaggggaccucgcgcaaagcgaaaaugugggucccuuguucaaagacacucaagauuuucaagauggcagcagcagggcaguggauuaaaugcagggcccaggcccgguggcucaagccugucaucccggcacuaugggaggccgaggcaggccacucacuugagguuaggcguucaugaccagccuggucaacauggugaaacucuauuucuauuaaaaaugcagaaauuagccaggccugguggugggcaccuguagucccagcuacuugggaggacacugaggcaggagaaucgcuugaacccgggaggcgggggguacagugagcugagaucaugccacugcacuccagccugggaccugggcaacagaguaaggcucugucucaaaaugauugaaugaaugaaugaauaaauaaauaaauaaauaaauacaaaugcaguguggggaggaugcgagggggagcugaggggcagcugggaaaggaucccccaggaguagaggucagaggagccgccuggcagccgggucuggagucuaauuguaacgcuggugccaacgcccccagcaccugcccuggccaggcccugggcucucgucccgaugccccgccuccucacacacugccaaauguuuucaggguucagcucccugcauguuuacacccuacugcuuccucccugcgggcuccaccccuucuccugcaauccugacccggcgcccgcccgccugcagguuaugcuugaacagaugcagggcguggugcgucuggagcugucgggcugcaacgacuucaccgaggccgggcugugguccagccugagcgcgcgcaucaccucgcugagcgugagugacugcaucaacguggccgacgacgccaucgcggccaucucgcagcugcugcccaaccuggcggagcugagccugcaggccuaccacgugacggacacggcgcuggccuacuucacggcgcgccagggccacagcacgcacacgcugcgccugcucuccugcugggagaucaccaaccacggcguggucaacguggugcacagccugcccaaccucaccgcgcucagccucucgggcugcuccaaggucaccgacgacggcguggagcucguggccgagaaccugcgcaagcugcgcagccuugaccucucguggugcccacgcaucaccgacauggcgcuggaguacguggccugcgaccugcaccgccuagaggagcucgugcucgacaggugcgcgcccccgggccgcgccgggcggggcugggccgggcggggcugcacggggcggggcggggcggggcugcacggggccgggggcgggggcuuccggcggggcuggggcuguggcgcggcgggcagagcccucggagccuggggagugggaaccgcagaaccgcagcacggguuggcuggacccccguccuucccggugggugggagcgaggaggggccagcggcugcuccggguggggcaggaagggauucacgccaggggcacucccaggaagacgagggauggccggggccaggugauuugaagguggggguccccucuggugcaaccacagguguguacgcaucacggacacuggccucagcuaucuguccaccaugucgucccuccgcagccucuaccugcgauggugcugccagguaccggcucucacgccccgggauugggggaucggcggggaggugggggcgcggggagagcucccggccccacucagauccugggagagucuggggccccucccuauccagcagccgaccuaagcggaacgcaggggucccggcggcccccacgagcacuucccagccgccucccggcuccgggggggacggaggaaccccgggcuugaacccgccuagcccuccauggaccccagggugcccuccgccucggugcgagcggaaaucguuaagucgcuccuccacucccgacaggugcaagacuucgggcugaagcaccuccuggcccuggggaguuugcgccuccugucucuggcaggugagacccccguuucugcucugacgcuggcagugaccacccacccccacuuaguccacccgcccaaccugcccgguccuugugcaaacucacacccggcgcggacacacagucccggguccgaggcggaggaggagggaggcgcggcccggccguccccgcccgagcccugggccgcgcgcacugagccgcccucugaccccgccgcaggcugcccgcugcucaccaccaccgggcugucgggccuggugcagcugcaggagcuggaggagcuggagcugaccaacugccccggggccacccccgagcucuucaaguauuucucgcagcaccugccccgcugccucgucauugaguagcgcgaggcccccgccccggucgcgggaacccggccaugaccugggcgggggcgcggggcgccgccgagcccccucuucccgccuugcgcucgggggagcccccgcgcccccggcccagcgcgggaggcggggcgagccgagggaaagccccuccccgaccuucggucccuccgcccucccagccccgccccgggcaggggggcggcgggugggcccgccccacgcacgcacgcacacucggggacuuugugcaugccccucgugcccgcacugcacgccgcccuccgccacgccacagccacagccgccgccaucacucgcucgcccucccgcuuggggggcggggcucgguccuugggggggcuuugagcucuccagacugugcccuuaccgccuuccccgccacacccgcucugucuucccacugucccccccaucccgggcagggcccagugggauugagggggcugggucccccaggacacgggcccagaagagccccacgggcuuccugcaucuuccaccgcaccauaccuggagcccuccgaggggugucaggggaaacaggccaccgccaaagccauggcccgccgccgagagcccaggccccacccgcaccuccucacccauccagccugacccacgcggccucuccuccuccuugccgcuguguggggcaguccccuguccgccccaaaacccggccuuggucccuggccaggcugagagaauugggcagggagagggcggaagggcuggcgaucgcuuggagucauuaacgugaucccagcugacuccggucggccucaacccagggguggcgcaggcaccuugcaagccucgagcuguagccacccucaggccugggaagaggccugggccgaccucacaccucagcccuugcacccggccgggcucaguucaggccugggcaccgagcuucacccugggugggucuccucagguggagucugcagaguggacccagccaagggucagggucagcacugggucagcgacuccaaucuuccaguggccagcacacccuagacaccccgaggagggagggcuccuuucuagccugcccccccacccccacuucaccccuccccagcuucccaaacuucugucugcccaaaugggcucugaccgugcucugucggcccgagacauuuggaaguccugggggaugcuggcaaaucucagcuguugcugaggagggggcugggaccccuucccaucccaaccuugagccccaggagauaccgcgcccacacccaaucuugggacacucccuaucugguuggaagagaguaaccaguuuccagagagccagagagugagagagagaaagagagugagagagagagagaaagagagagagagaugcuguugaaucagaaacagaucaacagcccaaagauuuuccugucccuggagugccagccccaggaagcuccagggcugaguggucaggagccaguuucuccagccccuccuccccacaaccccuaguggggaggggcagcuguccauuugcccaaaguauuaaugcaacugaagcugugauauuuccaacgacuguaggaggaaaaauuaaggggagagaggaaaacaaaaccaaccaaccccuaaaaucauuuucuuauuguacauaacgaccucauucuccuguauaugcggaagauauaaccuuauauuugguaaguguuucuugugcuauuuuaucacgugaccuguuuauaaaaauauauauuaaaaaaguuguaaaaacaugug

SEQ ID NO: 18249 - RNA, 2826 nt, Homo sapiens
uagaggccucuuccggggcgggccaaaggaggucacuuccgggguccgucccgguucccggccguugccacgacgacgaagcugccggccaauggcuggcggaugggcccaagguucccggcgugcagcgcggcugccugagggcggcaggcucauggcgccggcgucgcgguugcucgcgcucugggcgcuggcggcuguggcucuacccggcuccggggcggagggcgacggcggguggugagcggcccgggaggggccgggcgguggggucacgugcggcgggcggggcgcgggcugacccagcugugcccgcaggcgcccgggcgggccgggggccguggcggaggaggagcgcugcacgguggagcgucgggccgaccucaccuacgcggaguucgugcagcaguacgugcgccccugaucgcggaggucgcguccuguucaccggcccgucugccccgaccgcccaaggccgccuuccccugaccucgcgcgcacgcguggggcuggggcggcgaggcuggcgguccggccuggccgcgacucugcccuucuuuccagguacgccuucgucaggcccgucauccugcagggacucacggacaacucggugagcgcgugcccguccguccccggccacucucgcccgugcugggcccggccacuaaguccccuccccgcccccgcagagguuccgggcccugugcucccgcgacagguugcuggcuucguuuggggacagagugguccggcugagcaccgccaacaccuacuccuaccacaaagguacgcggccucaccccuggggcccgcccauuugccaacaccggggcggcuggaccagacgguccugacccgucucuuuccugcaguggacuugcccuuccaggaguauguggagcagcugcugcacccccaggaccccaccucccugggcaauggugaggcagcccuaggcggcgguaggggguggggacgcuuggagucuccaggugccaggaucccuguccccgccgucucuguuggcagacacccuguacuucuucggggacaacaacuucaccgagugggccucucucuuucggcacuacuccccacccccauuuggccugcugggaaccgcuccagcuuacagcuuuggaaucgcaggugggugcuucuugggacugggaaggacugaggcuucugucggugaguacaaaauggguuggucaccaggugcucauaaccccacaggagcuggcucgggggugcccuuccacuggcauggacccggguacucagaagugaucuacggucguaaggucagcacgggguggggguugaggcuugggacucgcugaccaaaacgggcaagggugacacugcugcucaugcccccagcgcugguuccuuuacccaccugagaagacgccagaguuccaccccaacaagaccacgcuggccuggcuccgggacacauacccagcccugccaccgucugcacggccccuggaguguaccauccgggcuggugaggucaguggcuggcaggagagggccaggccaggcuagaggcccgcagcuaaucucugcugcacccccuuccuccaccaggugcuguacuuccccgaccgcugguggcaugcuacgcucaaccuugacaccagcgucuucaucuccaccuuccucggcuagccaaaacagcuggcaggacugccggucacacaccagcacgucccaccucgugcucacggauuuuauuacacagauaguggcggcaauggccucagcccagcccacccucaccugcuuuuccagcccacaaagggggacgaucacggcccagcaaaagcgaugcugagaggggaaacaguccagaguccaacagcagaacuugggggaagcggucgggguggccaggaacauaaacuauguauaggggccgggggcuucugcccagggcuccccuggaccaggacgccagguagggcagggaaccucaguaguccuccacccagccauucucagagaugaaugcgucaauaaccuccuucauagccaaguuggggaugagcuguuccugggucagggggcuccgggucacggggucaaaaugacccacacgcugcagugacaagaagggcagagggcagucauggggcccaggaccaugccacuggcccugcucccccagccgcaggccucaccugcaggugcuccucgauguccuugcggucguaggugaugccacugggcgugaugcacggcucccgcaucagcucaaagcugaucuugccacacagguagucggggaugucucgcuucuguggcacaggggcacacggucagaggcugaaaaggggcacugcacgagcaccugccagccaucggcagcaagcgacacacacucaccuuccucuucucauccaccugagaaaaaagcucguccauguccgccauguacuuguccugugaagaguugagugcugugcuugggggagacaccccaccucccuccuccauggggcacagacccaacacaaggcggggaugcucccacgccacgugcacacacacagacccacauguggguggggggcacccucacgugcuuggccucaaugcaggccugcugggcccggacguggcugucguccucaucacccucgugguuucgcuggcacucuuccagcucccuggggguugaccaggagccggucagagauggaccuggccagaugucugaccacaccccaaucucagagcuaacauccacacuuccccacauuuccugcuugccaguaaagccuucgauaaacgcuugugucgggagucggugau

SEQ ID NO: 18250 - RNA, 6557 nt, Homo sapiens
guuaagugcgagccccggcgcaggggccggaucuggccgggggccggcggcggugugggagcggcgcgucauguacaccaucaccaaggggcccagcaagcuggucgcgcagcgccgcacaggugcgcacgggccggggaacgggaacggggacggggcggggcgcggcggcggcugaccgccccccggugcccgcaggucccacgcagcagcagguggagggccggcucggcgagcuccugaaaugccggcagcccgcgccgccgaccucgcagcccccgcgggcgcagcccuuugcgcagccgccgggacccuggccccugucgaggugagacgcgcgcggccccggcccggcccggcccggcuuccccucccccgccggccgcccuagagcggagggugaccuuggggaaauguuagugagguccggccacgugcugcaggcggggcgggcgcuccgggcgcggggggugcgcggguccugcccacuacgcgcccgcgggccugcgccucgcacuuccgccucaccuggccgggcccgggcccccagcggggagaaagccggccaguuccugggucgcaggggccuccagcguccgaggucggugcuucgggcgaccuuggguugcugcuggaacccugacgugcagcaggcccaggccacgguucgcggagagcgucgggcgcugguccucaagaucucccggcucugcccuugcagagcucagugggggagacgugcgugcgcuucccucgggcagggccgcugcccuccuccgcccuucaccccagacacccuggggcaguggggccuccccccauccgguugcuucugcuuuuccuaacccaguuaggaaacuccgagaccacaggagccucaguccggccacuguggccuccccgugaccaugacccagagguuggacagccccgcagggcuggacguuugacuuuggcucaguuccuccaccguucccuucauuuauccugugccucucccaggccuguggauuuugcuguggccccaagccggcccgaaggcuccuggaggugguagggucauggccugaggcggugcuggggaggagagcucgggccaggaguucagggcagcuacaggugggggggugccgagccacccucagccugcccccugccuaccucucagaaagguguggagguuccagcggggcgggggcucucuggggcuccauccuagugagguaagugcccucuaccagaggcgccuucuggcgggaggugagugggccccuaggugcuuccagcaucccagcucugcugggacgcuccgcggacaucacccuugguccucguggccgcucuacuucccaggggaggaaaccgaggcacaccuguagccaccaccugguccccaggcagggagcaugaggcuggaguggcccagggugacgccgucucucuuaaccuggggaaaccaccuuucuucucucuccaagaccccacugcuagggagggcagggguaaggcuguggcacaguuaggaggaguuagggaagaagauggaaaugcuucccagaguucuccaugggaccccaagggucccagugggcaacaccaggcccacuggcuguugucucuuuuuuuuuuuuuuuuuuuuuggagacagagucuccaucugucgcccaggcuggagugcaguggcgcaaucucagcucacugcaaccucugccucccggguucaagcgauucuccugccucagucucuucaguagcugggacuacaggugcgugccaccaugcccggcuaauuuuauauuuuuguauuucaccauguuggccaggaugggcucgaucuccugaccucaugauccacccgccucagccccccaaagugcugggauuacaagugugagcuaccgcgcccggccuguuuucuuaaaguccccaugugagguccucugucagccagugggaccugugggaguugagugggcuucaccccgugugcaguggggcuagaggagcccugggcagggcaggaugugugcugcccucuccucccuggggucacccaccuucccacccccaggccccagcgcugggagcuucuggcagcagugggaucucugcaugaagcccccauccugcuccugcaccuucuuggggcaaccaccuucccucuguuucuuuuuuuuugaaauggaguuuugcucuguugcccaggcuggagugcaauggcaggaucuccgcucaccgcaaccucugccuccuggguucaagcgauccuccugccucagccucccgaauagcugggauuacaggcgugcacugccacacccagcuaaucuuguauuuuuaguagagucaggguuucuccauguuggucaggcuggucucaaacucccuaccuccggugaugcgcccaccucggccucccagagugcugggauuacaggcgugaaccaccgugcuuggccaaccaccuucccucugaaccaccccaccccaugcugccacccaccucgcuguuuuuuacuucauuuaauuuuuuucuuuuugagacaaggucuugcucugucacccaggccggggugcaguggugcaaucauggcucacugcagccucaaccucccagguucaagugauccucccaccucucgacuuccugaguagcugggaugacaggcgagcaccacaccuggcucauuuuuaacuuuuauguagacaggucucacuauguggcccaggguaguauucaauuccugggcucgagcaauucucccgccuuggccuguggaagcguugggguuauaggugugggccaccgcgcccggcccugcccugccuuuucuucuccuuggugcuuuuugcuacuccucaucucucacugacugggcgcgggaggggggugucggggucccugcacaucuccuggugcacccagagggucaaggcuugucacccaugauguaugcuggcucugguuccugccaggcaugggucugggcacugcccacgacagugacagaccagauaaaccuugguuuguuuuuuuaauuuuuauuuuuauucugagauggagucucgcucuguagcccaggcuggagugcaguggugugaucucagcucacuacaagcuucaccuuccggguucaggccauucuccugccucagccucccgagcagcugggacuacaggcgcccuccaccacacccggcuaauuuuuuuguguuuauaguagagacgggguuucaccguguuagccaggauggucucgaucuccugaccucgugauccacccaccucggccucccaaagugcugggauuacaggugugagucaccgcgcccggccaccuuuguuuguuuuugagacagagucuugcucuguugccaggcuggaguacaguggcgugaucuuggcucacugcaaccuccgccucccagguucaagugagucucccaccccagccuccggaguagcugguauuacaggugcccgccaccaugcccggcuaauuuuuaguauuuuuaguagagacagaguuucaccacguaugcuaggcugaucuugaacuccugaccucaggcgacccacccgccucggccucccaaagugcugggauuacaggcaugagccaccacgcccagcccagauacaccuuugacaaguucuuccuccuggugggagauggauaggggaggcaguaagauaaacugaggcgauauaaguaauaagaugaaacggggccaugugaucacccgaccccagggcagauggaggguguggggaccgccacaggaagggacaauggaaugaaccccacagggcgagaaggggcagccugcaagagacggggguggggaggcccagugagggcaggcugaggggcuggcuugggggcuguacugggucagggccauggacucuguuguuggauuugcuaugauauccuggugcugcccccacccagcauguaauaugcucagguggauucucucccaagcccagcuucaugggcugaaaaagggaugggcuguggaggggagaggagaggaugcacuccacagccuucaccucccugggcugaaguuugcccggagcagugucccuggaagugggagagguuggcggugauccauaggugcucgccgggccggugcccuuucccccagagagcagcagccuuacguaaccagagccccuggggcggugccugccuccuggggcccaucucugcccgagagccgccaccuccgcccuucgauucacagccccuggcaauguucuugucuucuuagacauugauaauccaaccuccaagcuuucuuggaguuucuggcuuuccgaggugggaguggguugcaggcaagggggcuuuccaaguggacaaacuuuauucccugugguuugugcagaaacucaggcagcgggcaggccugggaggugccccugccccugucccaucuccaccugcacguuuuaagauccucuguggccaccagacccugccagcccuggggccggcaggacccugcgccccucaagacacuccucuuuauuuuagugccccucucagcugaggaggaaccgagagcggcgcuggggcaccugagcccaggaaggcaacaggccggccgggaccgcgagugccuggcggagcaggcgcagcccaggacucccggcucccaccuccggcuguaggugcggccccauucccuccacggcccugucccgggcuuugugugcucagggcucggccagcuggggccgcucaucccugcccugggcccggcuggccgggacgggcccaggggcccaccagacguugcgugcggcacugcgggagccaucuccuuuggcaucgccccuugucucgggccgguggggagugggcgaggguuauagucacucucccgacucagggacugcccaucccggcacccaguccucaucccaugggacgugggggcagccagggagagggcaaaggcccccguucccguccagguccauccguccauggagggaaacaucguggagauggaggugcuucuguggggcgagaauguggccuagaacuacacccagaguggggggguuggggcagagagacauggucauggacugggucguggcucaggucagaaucugggcugcugaugggaugcagguggcagcaugggcaccugcaagacccucggggagggguacugaguggggcccgaccaaagguuugggacacucuaagacugaggcccccacccuacagucacucacuucccucaggacacagggcugcaggugugagcugagcugccgauggcuuggggacugcaagagaggccugggccaccggcugcuguggguggcugcucucucugguucaggaagugccuaggcuggccaagucuggggaaagugggcuggcccggggcugcuccugaguucugccaggcagcaccgcaccugggaugggcaccaaccauguccgucuccucccuuccugcaguccagggccaaggcuuguguucaaucgugugaauggccggcgggcccccuccacguccccauccuucgaggggacccaggagaccuacacaguggcccacgaggagaauguccgcuuuguguccgaagguagcgagcggggccagagggugcggcauaggcugcugggucgcaaaaccauggacccgggauggccccacuucaagcugacccacagccgcugcauggcugugcuuuuccuuggcacucugcccuuguguccugugaccagcccuguguggggcuggaguccagggugaccaucaggcccugggugggcgauggggugccugggaccuggcucagcccgacugcccuccucccacagccuggcagcaggugcaacagcagcuggaugguggcccagccggugagggcgggccaaggccugugcaguacguggagaggacccccaauccccggcugcagagugagccccccaacccuguccccccaggagagaccccccagccccucugauccugacccaggcccugccagguucccaccccaggggaugagggaggggacucuugugcagaaaccccuucuucccagcgccugccgcacucggaguccgggugagcggcuugugguuagcuccaggggagacuugccggcuggccugggaggcagcaucacugcccagccuucucugcccacagacuuugugcccauugaccuagacgaguggugggcgcagcaguuccuggcgagaaucaccagcuguuccuaguggcugcugggagggggcgcugcuacacggccgaccugucgccaggagagaagcauggcgcccugcccacccacugcgccuggcugggugccggccacaccugaagugccagcauuuggacuuuugcaccuuuuuuucccuuggcccggcugucccaaccaagcugccauggccaagggccgaacccgucugaccucagcccugcucacugugcccagggaccagcgaccagccccuggggcuggcagggaggagcuccaggcuaauaaaguggagaaacugucuuuu

SEQ ID NO: 18251 - RNA, 2364 nt, Homo sapiens
ucuugcgacccggguucgauucccgggcggcgcacuuaguuuuuuuucccauuugaacaucgaacucucgcuaacgccagaaauuuaaaaguagagaaaacccgaaaccaagggaaggcgcccagucuggcgcagcgcugacacaaauuucggagagugacacaggugcccugaaaacccuggacggccaugggcgacagggugccugagcugaggcgccuguaaaccagcaagccaagcucgccguucaguccccugccugggaccgccacacaccgcugagccgcuccccaccgugccucuggcgacugcugguccuuuaacaggaggcgcgcgugcuccugggaguuguaguuuaucagcuuccgacgugccccgcgguaucuggacuacagcucccgacgugccccgcggaagcccggccaccgcccccgacgcgacccgcgccgcguccgcggcggggaguuguugcugccgcgaugcugguggcggcggccgcggagcggaacaaggaucccaucuugcacgugcugcggcaguaccuggauccggcccagcguggcguccgcguccucgagguggccucgggcuccggccagcacgcagcgcacuucgcgcgggccuucccccuggccgaguggcagccgucggacguggaccagcgcugccuggacaggugcggcccccggggcggccacuucuaucggugcggcgguccggggccucaagagcccacggcccgcagccccggaggaaaaggaugcggcucgggcucugagggugcggggugggagccugggggugcccccggggcaggcccuagcugugcggcccccgcggcugcggaaguggguggaccucggggucccccuucccagccgcuuuggucuccgcuccucaacgugccccccagccuccccuaagaaauucugugggggcgucggaaaggcgggugcacaggacucggcccccacccaagcguucgccuccugcagcaucgcggccaccacgcaagcccagggccugaccaacgugaaggccccgcuacaccuggacgugacguggggcugggagcacuggggcgggauccugccacagucgcuggaccuguugcucugcaucaacauggcccaugucagcccccugcgcugcacggaggucuguggggagcccagcaugggugucugccguggcaccacucacccugcaugggggcagcugggaugccagauuugcccccaucacagucggggugagggucuccagccucccccaucacagucggggugagggucuccagccucccccaucacagucggggugagggucuccagccucccccaucacagucggggugagggucuccagccucagggccuggcuucuguugggggcagcaccucacugccguccuguuccuacucaccaggggcucuucagagcagcaggacaccugcucaaacccagggcccugcucaucaccuacggggugagugggccuguccacggcgggccucccgcucccaguccuagcugcugucuccugcccugcugagaguccucccuccugggcucccugccccccgcccagccaccagcacggccuccccuccacuuccagucuguaccccucccugggucaucugccagccucccuacccccuugcccaccaggcuggccuuggcugacucccucuuggggacagggagggggugcccuuucauucuccaaaccccagccugcaagucugucccaggcucucugggaaauaccccgaccuugguccagugggcuguguccccaugcccacagcccuaugccaucaaugggaagaucuccccccagagcaacguggacuuugaccugaugcucagaugcaggucagagcuagaggcggggggucuggcucagguggcagguggcuuggguggcaccccccaggccaugacuccaucuccccacccucugcaggaacccagaaugggggcuucgggacacagcccuccuggaggaccugggaaaggccaguggccugcuccuggagaggaugguaggugggggagcgggggcccaggcaaccucucuagggguugagggccguccuccagcaaaguguuucuccagguggacaugccagccaacaacaaaugccugaucuuccggaaaaacuaagccccuccuucacccccgcacaccugcaucccugccggaggcucugugaggcacgaacccugccucccuaggccggaccuuguggacgacagccccacccagucugugcucucagccgcuggccgaagggcccagccugcucagaauaaagcauguccugcugccggcuugcuggugucugccccaccucc

SEQ ID NO: 18252 - RNA, 3445 nt, Homo sapiens
cggggagggcccgugccugccacccccauggcauaggagccugggguccagagggcgccagggacaaaagcugggaucugcuggcccugcccccacccuacugagggucgucaaggagauugaucucagcccagggguggacgaagggguucagguuacaggguccccuccccucccccucuccagccagagccagcccuuccccgccccggugacccucauggccaguggcucugugcucaugggccucuggccccuccccaaccuccuccccucugcccugugcugaccagggccugggagcccccgcacgguucagacagaggggccaggcugaagcuggagaggaaccagcgucacacagacggccucugagaacuuggagaccccguuacccacccagcaggggugucaggacaagcaucugcugcaggcuucagccucaggggcaaaagggagccccgggguccuggugggggcaccgaccacaggcccggaggguggaugccugcaggaagcugggcucuguggagcccgaggaggggcugguggccacaccccccggcccccuggcucggcggcccucaugcccgcccuacguccacuccugccgcuccugcuccuccuccggcugaccucgggggcuggcuugcugccagggcuggggagccacccgggcgugugccccaaccagcucagccccaaccuguggguggacgcccagagcaccugugagcgcgaguguagcagggaccaggugaguguggucgggccgggguccuggggcucagagcagccagccugggcaagacccugcuggaggugccaccuucugccugggcuccccagacuucuggggggucugggucugggccccuuaaggggcccagagacacccccaucguugcccucauuugucuuaagaauaagagcccuccccacuccagcuuucaugcuccccaugugccuccacccuggggcaccaucauccucggcgaccacccccaccccgucacugccucuccucccacccucuccucccacccucuccucccauccacuucucccaccccuucacugccucuccuuccauccucuccucccacccucuccucccauccacuccucccauccacuucuuccauccucuucucccaccccgucacugccucuccuuccauccucuccuauccacuccucccauccacuucuuccauccucuucucccaccccaucacugccucuccuuccauccucuccuauccacuccucccauccacuuuuuccauccucuucucucaccccgucauugccucuccuuccauccucuccucccauccacuucucccaccccuucacugccucuccucccacccucuccucccauccacuccucccauccacuccucccauccacuucuuccauccucuucucccaccccgucacugccucuccuuccauccucuccucccacccucuccuuccauccucuccucccacccucuccuuccauccacuguccucccuguccucccacccuccuuccauccgggaccagugcagaugguggugggggugcugcagccgauguccagccuuuguccuggcccgcaccaccugcugggugguccugagcacuguacgcccuccuugggccucaguuuccucgucuguacaacguaaagaauaacggaacuugcuugugggugugaggauucuggaagguaagccagguggcaccucuggcgagguggcuccucacacaggauggaaaggacacugaguccccggggaggcagccacagagcggggggcucccugcuaccccaccugggccuccccuugcaggggccaggccagagccccggggcggggggcauuggggcucccaccuaagugucccccauccccaggacugugcggcugcugagaagugcugcaucaacguguguggacugcacagcugcguggcagcacgcuuccccggcagcccagcugcgccgacgacagcggccuccugcgagggcuuugugugcccacagcagggcucggacugcgacaucugggacgggcagcccgugugccgcugccgcgaccgcugugagaaggagcccagcuucaccugcgccucggacggccucaccuacuacaaccgcugcuauauggacgccgaggccugccugcggggccugcaccuccacaucgugcccugcaagcacgugcucagcuggccgcccagcagcccggggccgccggagaccacugcccgccccacaccuggggccgcgcccgugccuccugcccuguacagcagccccuccccacaggcggugcagguuggggguacggccagccuccacugcgacgucagcggccgcccgccgccugcugugaccugggagaagcagagucaccagcgagagaaccugaucaugcgcccugaucagauguauggcaacgugguggucaccagcaucgggcagcuggugcucuacaacgcgcggcccgaagacgccggccuguacaccugcaccgcgcgcaacgcugcugggcugcugcgggcugacuucccacucucugugguccagcgagagccggccagggacgcagcccccagcaucccagccccggccgagugccugccggaugugcaggccugcacgggccccacuuccccacaccuuguccucuggcacuacgacccgcagcggggcggcugcaugaccuucccggcccguggcugugauggggcggcccgcggcuuugagaccuacgaggcaugccagcaggccugugcccgcggccccggcgacgccugcgugcugccugccgugcagggccccugccggggcugggagccgcgcugggccuacagcccgcugcugcagcagugccaucccuucguguacgguggcugcgagggcaacggcaacaacuuccacagccgcgagagcugcgaggaugccugccccgugccgcgcacaccgcccugccgcgccugccgccuccggagcaagcuggcgcugagccugugccgcagcgacuucgccaucguggggcggcucacggaggugcuggaggagcccgaggccgccggcggcaucgcccgcguggcgcucgaggacgugcucaaggaugacaagaugggccucaaguucuugggcaccaaguaccuggaggugacgcugaguggcauggacugggccugccccugccccaacaugacggcgggcgacgggccgcuggucaucaugggugaggugcgcgauggcguggccgugcuggacgccggcagcuacguccgcgccgccagcgagaagcgcgucaagaagaucuuggagcugcuggagaagcaggccugcgagcugcucaaccgcuuccaggacuagcccccgcaggggccugcgccaccccguccuggugaauaaacgcacucccugugcc

SEQ ID NO: 18253 - RNA, 398 nt, Homo sapiens
gagcccgcggaguauacaccaugagcaaagcucacccucccgagcugaaaaaauuuauggacaagaaguuaucauugaaauuaaaugguggcagacauguccaaggaauauugcggggauuugaucccuuuaugaaccuugugauagaugaauguguggaaauggcgacuaguggacaacagaacaauauuggaauggugguaauaugaggaaauaguaucaucauguuagaagccuuggaaugaguauaaauaauggcuggucagcagagaaacccaugcucucucuccauagguccuguuuuacuaugauguaaaaauuaggucauguacauuuucauauuagacuuuuuguuaaauaaacuucuguaauagucaaaaaaaaaaaaaaaaaaaaga

SEQ ID NO: 18254 - RNA, 11425 nt, Homo sapiens
cgcgaccucuccguccugggacccccgcgaucccuccaucccgcgcccucccuccagcguccccccggaccgcgcgcgccccgguccgucccccgcgcgccccacgugaccccuccccccuaccggcgccccacgugaccccuccccccggcguccgcgccccccccggucccgccccccgaccccgcccucgccuucccggcucggccugcggggcggggccugcgggcggaagugcccggggcgacggcggcggggaccggccgggccaugggcgccgggggcagaggcggaggcggcagaggcggaggcggcagaggcugcccgggcggcggcgggggccggcggcgcgggacgcgggccggguagcgccgggccgagcgcggagccaugggccgggcuggcaccgggaccgggggcgaggcgguggccgcggugguggcggggccgcugcugcugcugcugcuugcccggcccccgccugccuccgccggcuacagcgggaagagcggugagcgggaggcgcgggcgccaucgggggcguggggccggggcugcgggcggggcgggauugugacaccccgggcgcaccugugcgcucaucuggcgccggcgcgggguuggggguccccgccgcggguugggggugcacaguggcccuuuggggcgcuucguguccuaggggucgaggcggacgggaccccgcgcuuccuccucggucccccgaucgggguugggccacaucggccccuggagcgcccccuccccucccuccuccucccagagcgcccagguccggcgcgcccggcgcggggaaguggaggggcccaggggacucugcccgggacuccagcugggaggaguggcugggccgugagcucaccggccggguccggccugagagaggggcagagccgggagaaaguuguuagacccuguagcgggggcccgugggcgucauggcuccagcccuuccgcagugacccccagcccugguacggccgcuuccugccgccggcccggcuucugggaggagggacucccagcuggcggaagaggggcugaggaaagggcgccccucuccccucuuguugggaaacucgccgggcucccuuugcauuucuguucccugaggguccccgucccugacugagguccaaggaggcggcuggaccagggagaaggcguagcccuuccacgggguagggacguggguguggagaccgucaggccuuggccacccugagauggugaggacuugccccggccucuguggccugggacucuggaggggccguguccuuucuggccggcuggaaguucccacacguccccagccacgcgggugcccaggugcccggcagcugaugcggugcuguuccccgacuucccggcccccagccccuccccuccccugccccugaaauaaugcuccuuugagcuccuguuucuuucgggggcugugccuccugcuuucugagcuuggcacagguagagaugaaaggcaguuuuccccgaggaccgugccccggauuaaauugcuccauggccaggcgcgaagcucacgccugcaaucccgcacuuugggaggcugaggcggguggaucaccugaggucaggaguucgagaccagccugaccaacauggagaaacccccuucucuacuaagaauacaaaauuagccggcagugguggcgcaugccuguaaucccagccacucgggaggcugaggcaggagaaucgcuugaacccgggaggcagagguugcggugagccgaagucgcuccauugcacuccagccuggacaacagagcgagacuccaucucaaaaaaaaaaaagaaagacagaaagaaaaaaaaauaaccugggugugguaauguaagccugcgguuccaguuacauaggaagcugaggcugcggugagccguguucauggcacugcacucuagccugggugacagagugagacccucagaaauaccaaaaccuuacuccguuggaaacuggcaaaggaaauucuccugucccagaacucaggccuggugagggguuccugggagauggaaccccuguguguggacaguggagaggccuggugugcuggcucagccccucacuccucccagccugccgaggaguaagugcucuguggcguuguggguggucagggucucccaugggugccugucccgguuuggaggacgugggucuggggucuucacucagguucccaggacagggccagggacuugcauuaccaccuuccccacccagcccuguguccguggaggggcuguggggcaggcagggggcuguguagcuggcccuccucacccuguggucaccucggcucagagcaccccuaacagccugguaugugugggcaacuugggcagggagcuugggcugcagagcccugggagaggccuggaggggcugugagcccugggagucggggacuggguguuaggacaaccuugaacagaucucuuaucucuguguaccugcugaaacuucacagccaccagcuggguucuaggugcccucaggcuggcgcuccagggccagaggggcugagggcuuugccccagcagcccaggggcugugugugcugcagguggccuccccugccugcccccgcagaggccggcuuucuccgggacaccgugguccuggggggcuguccugcuucagcucccagcacuugagcuuucucugcccacauuaucaggccacagccuggugggugggaccugguggccagcagacaccuggaaagccuggagugcgucguggguggagccuggccagccccugcccagucgccacgccagguuccccuggagcuuggccuggauuugccgacaggcugcuauuggcagguguaucguuucuucuggugccucuaugggagggucacgaggcuggcaggagagccugcugcucaccugucucccuccucaggaggggccugggccugagccagccacucuccagugagaccuaggcagcgcuccugaguguguggggagggggagcugcagcagaggggagggucccgcccccugcuguguccacugugcuuuuccuucugaagccuuugucguuaauuaaccucggagggaggggcccccaaagggaugugcccuccgcccugaccuacccaggagaaggcugggacccagggagggaaggaugcccaaggucgcaagggcacgaggcuggagcuggcacggggggcugggggugagagccugaguccucgccuggggccaugagcaggaugucucccacgggcccuucuccauccccgcaccaggcgugggugcguucccugaggacaguuaggagccuugcccgcuuggaacgcagagggcagcuguccccuuguucucaugacuggccaggcuucuggccugggucccucccacaugcaguaucucccucuggguaaggggaauuugggcuccggucucgccguguccaaagucaucauagcccaagcaggcagccaacccauccagggauggagaugugggaggcugagaggaggugggaggaccgugccuugauauccagggcaucugugaugaggggcgggggcuccuuccugacaccugcuggguccuucggcuucgaccuggguuggccauggggaguguagucuucuaagguuggaggggguccggguggcagugcggguggggauggcagucagaguggcgauggcagugcggguggcgauggcaguguggguggcgauggcagugcggguggggauggcaguguggguggcgauggcagugcggguggcgauggcagucaggguggcgauggcagugcggguggggauggcagucagaguggcgauggcagugcggguggcgauggcagugcggguggcgauggcagugcggguggcgauggcaguguggguggggauggcagugcggguggggauggcagugcggguggcgauggcagucaggguggcgauggcagucaggguggcgauggcagugcggguggggauggcagugcggguggcgauggcagucaggguggcgauggcugcugagguacccugcggcuuguuuggaagcugcugcagugaggcggcagcugugaaaagacccagaugccaggagggugggauguaggccaucuggggagggacagcagaggaucuggcugaggggccagagggugucggugaccuuugccaaggucagaguuggugugccaagaucuccagguggguccccgggggcuuccagcccuuuccaucugggggacucguccuccccaucugcggcccuggaggagggucccggccuggcugacaccuccuucuccucacagagguggggcugguguccgagcacuucucgcaggccccgcagaggcuguccuucuacagcugguacggcagugccaggcucuuccgcuuccgcgugcccccagaugcugugcuucuacgcuggcuccugcaggucucccgggagagcggcgcugccugcaccgacgcggagaucaccguguagguggcugcccgcccgccugcccacccucccgcgccuggccaagcccugugccugaacccggugcugcucucccgucuccaggcacuuccguuccggcgccccuccggucaucaacccgcugggcaccagcuucccggacgacaccgcgguacagcccuccuuccaggucggggugccgcugagcaccacaccgagaagcaaugccuccgucaacguuucccacccggcccccggggacugguucguggccgcccaccugccccccucaucccagaagaucgaguugaaggugaggggggcugcccuccgggauggaggcagagaaccuugcggcgauggccugucccugccguucaccucuuuggggugguccucgcucuaggcuccacgcugcacucuggggccagcccugcucccugcaugccgggggcgucuggugagaccaugcccucacaccugcauucucugacaccgcccccgcccacaccuguucuuucccuagggcuuggcucccaccugugccuacgucuuccagccugaacugcuggucacgcggguggucgagauuuccaucauggagccggacgugccccuuccucagacccuccucucccaucccagcuaccucaagugagcgggggccuggggggcagcccggcucugcccuccggccccuucucagauucgguggagugggugcgagagccuggcccugaguccugggguugggcugggaagugguccagaugccuggcccccaccagagugggcugaggaacagcagagccugggcacgcugcgucccugggcugaggaauggcagagccugagccagcuguguccccucgcugcagggucuuuguccccgauuacacgcgggagcuucugcuggagcugcgggacugcguguccaaugggagccugggcugccccgugcgucucaccgugggcccggucacccugccuagcaacuuccagaaggugcucaccugcaccggugcccccuggcccugccgccugcugcugcccucaccgcccugggaccgguggcugcaagugacagcugagagccugguggggccccucgggacaguggcuuucagugcuguagcugcccucacaggugggccgcacaagggcuggagggauggcccugccccuccccagauccccagacuuuccuccagccaaaccccuuguccucucggcagcuugcaggccacggagcgugaccauccagccccuucugcagagcagccaaaaccagagcuucaaugccuccucuggucugcuguccccgagccccgaccaccaggaccugggcaggaguggcaggguggaccgcagccccuucugccucacaaacuacccagucacgcgggaggacauggacguggugucggugcacuuccagccccuggacagggucucggugaggguguguucggacacgcccuccgugaugcggcugcgccugaacaccggcauggacagcggggguucccucaccaucucccugcgggccaacaagguaccugcugucugcaagcggccuguggccugggcucgggcagggcgccgggcaaccccugcagcgccuccucauuuaccuuggcacgggacaggcggcacagugacaccagcaggcacgggccaagacaggggcccauguuggggggccuccccugcugggcagccuuguuccugucaacaggccccggggcugugggguagcucgggucagaggugggguggaggcaggaugucccagggcccggggaggaaggucccggugcaccgugggccugcaggagucucagagaaaggcaccagcaccggccgggcgcgguggcucacgccuguaaucccagcacuuugggaggccgaggaggguggaucacgaggucaggagauugggaccauccuggcuaacacggugaaaccccgucucuacugaaaauacaaaaauuagccgggcgugguggcgggcgccuguagucccagcuacucgggaggcugaggcgggagaauggcaugaacccaggggcggagguugcagugagccgagaucgcggcacugcccuccagccugggcgacagagcaagacuccaucucagaaaaaaaaaaaaaaagaaaggcaccagcaccaggcugagcuggcacguggggcagaugaccccacugcggccaggggcugcuggagcugagccggcaccgccucccuuuccagacagagaugcggaacgagaccgucguaguggccugcgugaaugcugccucgcccuuccuuggcuucaauacuucgcucaacugcaccacagguaugaugggcaggcgucaccgucagcguggccccggccagccccccgccccggccuccucugauggggcccucuggcuccccugcagccuucuuccagggcuacccuuugucucugagcgccuggucucgcagggccaaccucaucauccccuacccagagacagacaacugguaccucucccugcagcucaugugcccugagaaugcugaguaaguaaaccuagggcagagacgggggccaggcacccugucauuucacucaggaccacaggccgggcugccugagguuggcguucggagugacccagcuagaggggugcuuccuccagggcugcugaaagcugggggcccuaaugcugcguucucaugucugucagccuguugggagcgcugguggcagcugggcugucagaucacugcaccagcuuuccuguggccccuuccucaaagggacugugagcaggcugugguccacguggagaccaccuuguaccuggugcccuguuugaacgauuguggacccuauggccagugccuccugcuccgcagacacagcuaccuguaugccagcugcagcugcaaggcaggugagugccagggccccgcccgccccgagacgcugcugcuguuggcuuccagugcugugcugugccuuuccccugggggagcgccgcaaggggcuggagagagacccuugcagagcaaugcaggggcaaagccuccuccccacucccccauuccccaccaacaauccgucugccuggcacaggcaccagguauccccggggggugguacugccuccugaccuuggaccccgcccgccgugccuacccugcuugcuccugggugaggaaggggcuucucugcaggguccugggugaggggugggcccugagguucagcagugcccccagccuccgcgucgggguuuugugaccgcaggcuggcguggguggagcugcacggacaacagcacagcccagacgguggcccagcagagggcggccacacugcugcucacgcucagcaaccucauguuccuggcccccaucgccgucucagugcggcgauucuuccugguggaggccuccgucuacgccuacaccauguucuucuccacgguaggcuggccccuccugcagggauguggggugggagggcaggaccgcgcucauggagccuccccacaguucuaccacgccugcgaccagcccggggaggcggugcugugcauccucagcuacgacacgcugcaguacugcgacuucuugggcuccggggcggccaucugggucaccauccugugcauggcacggcucaagacaguccugaaauacgugaguggcccucgacguggggugugggcuccgggggagcagggcccccaagugcagccugcgaaaggcaguaccgugggagaggccggaccuggcguugggcacggccccuggaaaccucacaucucggccgagcaugguggcucacaccuguaaucccuaggccgagcaugguggcucacaccuguaaugccuuggccgagcaugguggcucacaccuguaaucccaacacuugcaggaggaucccaugaggccagggguucaagagcagccugggcuguacaaaaaaucgaaaaguuagccgagcguagugguacaugccuguggucccagccacucgggagacuaaggugggaggaucgcuugaucccaggcauuggaggcguuggagugagccgaggucacagcacugcacuccagccugggugacaaaagaaaagaaaagaaaccucaugucuucugugaugccacacggagaugcgggucugagaccccgcaggcaguugugagggggcagugccagcuguuuggaggaugccaggaaggaaggugguaggcaggggaggccaggcccccugccuucgagaagcccccacccaugcucccuggguccuuggggccaaugaugcuuuggggacucucuguggcagcuggcccuggcaaggggagacucaugcccugggcuugugagcugcaugcucugcccucccaucugcucugggaacugcaggcuggguacugccccaagggggugcccaugggagccccacagccagggcagaggggaggcugggaagcaccaggguccugcagggcugagugcggggccugaaccugcagauaggcagagaacuguaggcugugggcagaggugucugauggagacuggggggugggagccccuccccauggaacagugggugggagacugaagccacccugaugggggacuucuagaaacccagugguacagggggcuagugagugugugggugcagagcggccauaugcgucuguccaguuugugugagcaucgucuaaucccccagagaugccugccuggccacauucaccuguggaugcaauacagaagcugaaggaggggcaugucccugccggcuggcagagcuagucagaggcuggcagagcuggucugaggguggcagcagcuccgagggggcaggcagaggugcuguggggccgugggguacgcgugcuccugcugggccuugagcccucagagacgucccugcagucaucccugugucuugcgcaggugcuguuucuucuggguacacuggucaucgccauguccuugcagcuggaccgcaggggcauguggaacaugcuggggcccugccucuuugccuucgugaucauggccuccauguggguaaggagccgggcuggcuggcacugcugcccaggugcucggagaagagagccuggccccuugcucuagccacguuccugguccugcuccaaccagugaaugcccauaucugcuggggguugccauggcacccacagaggcccagcauggcugugucccugaggccugggccugaggaccaguggccuugagcccccucgaagcagcccacccuugucguucugcugcccagaccugggcaggcccccaguaaccaccguaucugggcccugggagcugcagccgcggccccaccugcacugauaccugcguggcuguuuucuccaggcuuaccgcugcgggcaccggcgccagugcuaccccaccucguggcagcgcugggccuucuaccuccugcccggcgucucuauggccucugugggcaucgccaucuacaccuccaugaugacuagcgacaacuacuacuacacccacagcaucuggcacauccugcuggccgggagcgcagccuugcugcugccgccaccugaccagcccgccgagcccugggccugcucgcagaaauuccccugccacuaucagaucugcaagaacgaucgggaggaacuguacgcagugacgugacacuggccuggggacagcugcugcucugaugaccucuucagccaggagcuguaucgagggggaggcgccugguccagcccuggacagauugauuuccagcugaauaaauuggccuagauacccucuuacuuccuccuacugaggagagggccaccccucccucacacgcaccucuccucgccagcugccugcucgcugcugagaucccucugcagaucccagcugcugucugcaguggccccuggggccugggcuugguuacuuggagaccacaggugccugugcgaggguggggcugugugcucugcuggccuguggguggcuagagauggggagaaggacucccuaugguccuguucccuggcgaggcuguggugagacccauggcgcccaggagcccugagcccaccacuggggccgggagcuguggacuccgagaccccugcuccuggccccuguguggcccugaugccagccugccuggggcauggaggaucccccucugcugcuguggucaccauagggacgggagacggagguuucccccagagcugaugggcacuggggaugcaggcucccgccccgccccucccuuuuuccuggcucuggagccuugggucccugagaagagcuuccuuggacuggggugcucugcugcucuggggguuuggcccagaaggaaccccuacccagcccuguccacccaccccagcguuccugggccccccucugggagcuuccucuuggucccaggagcugcgguggugucugcccccugcacugggcucugugcccuguggguguucaggagacuggacugucucugcuccucaugcaaaccuugugggggaagcaaugaccaggagcagcaccuggccccucccugaggccugugagugucucggauccgcccuggagaagugaguggcugagacccggguggggcccuccuacccuuggcucugggggcuucccuucugggucuuguccgggauauggccuuccugaaggucuuaccucccccagccgcccugcacuugaccaccaaagcaaucucuaagcuuauaaaggagaaacauauauauaugggguuuuuuggaguaaaggaaaauucuaagauauuaagacauauuuuuauguagaucugaucuaucuguguuuggugaauuuaauauucuacauugauuuuucaaacuaaac

SEQ ID NO: 18255 - RNA, 3172 nt, Homo sapiens
ccucaaagcaaagauacacacacacagccuggcccagacuuuacucgcucccggccccacgggcacaaggaacacugccgcaaacgucggggcccagccugagaggagccucugggcggcccaggccuccuggggaucccugccaagcuggccccgggcuggaaggugcaugggcagcacacgaaaccaggauccacccacugcccaccgguggcccucacagcuccccgggaucuguguccucagugcaaagggccuggcagggaaagcugggccuguuggucaggcauggaggagcuguguggucacuggccacuggcucucuucugcaccaccgccggcucugacagugccugcugcugcagcugcuggaucagcuccgccacauagaucuugaacagggguacaggguccugaaggagagaggggcucauggugaggccagggaagcccagggcagcuggaguuccgacggggaugggaucagcagcugccgcccagaggaaccggggcaugagaggcccuggagggcagaguccugucggugagaugaggaacccccucccuuggggaugccggaggcacacacauaccccugucccaucccuguggucauggauaaacagagggaauaggggcagccagcugccaugccaucaggggcucccuguccugacagcuaccucaggcuccagacccugggaugcugguggccgagcaaacccucagugcaggaacccacuccuccuacugaggguccugggacagaacaggguggggacuuggaggggagggagcgggccaugcuccucugggugggcaaugcagagcagcagcucuuccccaagcccacccagugcaccagccccuugugcaggcucucuccaaggcagcacacucccagacccugaacaccaggcucugggcaggcagcaucggcuggugcucacacacucaccuucuccuccaaaagucucugcuucucaauggccuccuccagcgugaggcccacccacucugccuccuccucugggauggcaaauuccuaggcaggcagagauggaaagggcagugaggcccagggccgggccacgaguccccagguguagggagcgggacggaaacccucaccuuguacuugucguagauggcugcccgccgcucgggguccucggggugcagcuggggguccugccgggcaagccgcagcagcaucccucgcuucagguccaucccaaacuuggagcacagguccuccuucggggucuggcagaaggcucacauggggccaggugcugguggcagggccccaccuacccuuccagccaacccaccuggcuccucucuagccgcugguggucccaggacaggacagagaaggcccggguggggccgccucagcaccccagccuggggggugggaucagcacagaagcaaguccaagugcagggaaaggggcggcugugcucgcucaggccccacgggcaagucagccacccacagagcgacagccucuccugaaggcaggaaaccccacuggugcuggccagaaaggggcauggccccacucacgcuuucccagugacccuccugugcagaugucagcgugccccggugugaugcugaccuggggcucccgugagucugacuggcccaucccagacccugugugcacugacucgccccaccccgcuugccuugaggauguaaaagucgagcccauaagccucaucgaugagguccaggguccgcauggucacagucacugugaacuucuuguccaggaucucacuguagaacucucgcucaaacagcuguggcuuccacacuuucuucagccucuuggagagcugagggugcaacagagccuccaugaguacugcugcuuucucuuacauaccaaggggggcccaggcaacugcccucaccucccccccggaggcuccaucacagaaccacugcugucagacuggggaccuagagcuaacugggccggcccccagcccagugccgccccagcccgacccggguccugacuguguacccagaagucagcugcuccccaacaagcugggcguucccgcccuggucacaugguugcugcauguguuucagaaacaugugcgaccccacaguuuacagguugucacauuccaaccuggaggugacacaagucuccccacaggcuucagcagucccgccaggaaguccaccacaagcagccucgaagcucugcucgccucccccaccugcucugcucgccucucccaccugcucugcucaucacacaggccuccuccccauccuaacuuuaccccgacuccccacggccucugguugcucccccggccugagucaccccaccucaccccuacuuuaucaguccuguuugccagaacugcgguucuucacucagcgugcuccuuugccggagaugugucgccuccaggcuguaauccccagggcccacccaggucucuccagguaccccgggcguccggcacagagccggcacagccaagcccugagaggagccccugaaggccgccugcggacccaccuugucguuguuggcauauauuuggcccaggauccagcccucgccgccccacaacccccgcugggauucggggggaaaguagaugggaaugggcacguccuccacacgcucccgcugcccguucuugggguugaucuugaacuuggccccaugaggccuauagugcacgggagugggcguccgcuccuccuccagggagcgcagguaguggccgggcaggcgggaacagaugcccucccgcagcugcagccgcuuccagagccacacgggauacuuguguagaggcaucgcgagccuggcgggaggugggggcucgcagucagucgcagccuggccaggcccccggcacucacccccuaccccggcccccgacucucacccgcuaccccggcccccggcucucacccgcuaccccggcccccggcucucacccgcuaccccggcccccggcucucacccgcuacccccuaccccggcccccgguucucacuccggccccugucccgcacccaccugccccuccccuucugccccggcgcccccccacaccccaccugcccgcgcccaccuuucaggguucagagcccaccggaaccggaagccgaucugcc

SEQ ID NO: 18256 - RNA, 3142 nt, Homo sapiens
uuucaauagaaaugccauaauuuauuccauuguauaaaaaagucauccuuauguaacaaaaugucuucuuagaagaagaaauauauuauuucaggucauaaauaaucagcaaacauacaacuguuggcaacuaaaaaaaaacccaacacugguauuuuccaucagugcugaaaacaaaccugcuuaagauauauuuacaggauaguacaguacucaaaaacaaaaauugagguauuugguucuucuaggaguagacaaugacauuugugaaggcagacaccuacacaaaaauaaauaagguauauucucauauguauaugugucgucgggaauaauacugguagguaugucaagcaugaagagauucuacaaaaaacaggggcgagcaaaaagaaaccggaucacacacugaguccuuucucuucugccccauuuugucagauggacuugauguacccacuauauauuggucccgaaugugcugaguucagcaaaugucuugacgcuaagucaucaccauaacugcuuagaaacccagaggaacucgggugaaguuaaauaaauaaggaccagcccucucgagccccucccagaguuauugcauuucuccucucaaggagcauggagucccaaugggaugugaagagccucaccucccguggccuuucagcagcugggagaggucguaauggggcucugaagguagcucagcgcacuguucguggaguggacagggauggagacggggaaguugaacacgguggugguggaggugccucggucgagcacagccauggcggggcucccagccucugccgaacagugcggagccagcaccugggacucaaacugcagcagcuggcccaugaagcugaaguugggagagaugaugcuucgccucugcuucacaaacucaaaggccucguccagcuugacucgauuaguccucauaagguaagcaaggcagaugguggcugaccgggaaaugccugccuggcaguggacaaacacccuuccuccagcauucuugauggagucuggaaaaccaaaggagcggcugguuacuugagaguucaggagaaccaccccaagcccagguacaguguaucugagaaaggucaugugugucuugucuagaaauggucaacaucaccacaugccaucacauggauacuguucauggaggcaacgugggcacugugcaaaggauggcacaggauuuaaacucagacuggggauuuccacuuagcagauagaucucagaccagucaauucaacuuugugagccccacuuugcaaaucuguaaagugggacaucgaaucaaauucauauuuuacaggaauguugcccacaccagacugauacugaauguguggaagaaggcucagaaaacuucaagcucuugccacagagguugggcuuaguggcuaaaaugagaagagaaaggcagaaaagccccaggcauccauuccauuuaccuaugaagucaauggccucguugaaccaggagcugaugucugccuugugguuguccuccacagggaugcucuuguacugguagugacccucaaaaugguugggacaauuggcugagacguugaucaaggcagugaugcccaaggcauccagcauguccuugcgggaagcgugauacgcacugcccagguacagaaagggcaggauuuccaccgggccacccugaaauccagaaauauccaacauucaucaagcuugcucaaagccaaggccagugcccauacccacaaaaacuuucugcuggaaaagucaauuucagauaccgagugaacucaguucuguugcuggaggauaaauaaauagggaacuaagcccauuugccugggcaggaccagcaaguucauuuccguagagccuacaauuggagacucggcuccgucagaccacuuaacuguggaauaaaucauaucccuguguccccuccguuauaaauaaugcugcaggucacuuucuauauucucccuggcacuacucuuccaugccuuugccaguucuuacuucuucccuguggcagggacaccuacuaaccugaucguagagugggguacugcaggaacugcacccagauuccgcgcugucagggacgcuaguacucaggggaaggcugagccccaugggggucgacuguuugcugcacagcuccgggcaggaagccgaaaacgcuucguauccuccugggaauacaaagacauuuuuuuuccccauuagugacaccgggacacggcaccuucauacaacucccccacccaccaagggcuggaaguuuacaucggaaaggcccaggcaagucuuuguuuccagagccaaacaaagccaaugacaaguuccagagauaaauguacuccagcgcccacgcgcugcagguggggcgaucccccgggagccgagagccagggguaccgggcaaaaccucaggggugugcggcccgccccgagcuuccccgagggcguaccuuugaggaagaagacuugcgcggcgcgcgccucgcggcagagcgcgccggccgccagggccagggugccgucgcgcuuggcgccguccagggcggcgcugcgcucguccagcaacaccacggcgugguaggcgccggccagcaggcggccgcggagcucggcguugggcacgaugugcuccaggcccauggcgcccuuggcccggcgccgcacgauggugcugaagcgcacguugacagagccggcgauguggccggcguugaaagcgaagaaggagcggcaguccagcagcaggcauugcgccgcucgcucccccagcagcgcccgcaggccuccagcguccagggugcccacuuccaugaccauggccggccucagcgcccccagcgugaucggcccugcggugcucuuugucuguucucggggccaagggcagggcggcgcuuuucgaggaaaagcuagacccccgggucucucugcgccgaaccaaaagccgcuuuuggacugagagaggagcgucacgcggggcuccgggcuccucggcuucuucgcgguucccccgacugccccuccgacccgcgucgcacacacagcccaaauguccuucgcagcgagccuggcccggggagcgcguuuauaugcggccucugg

SEQ ID NO: 18257 - RNA, 118421 nt, Homo sapiens
cgaguggcgaguggcgaguggcgagugucaggggggcggccggcgggggcggggcggccggaggaggcguuggcagcgggcucggacccacgcggcgccgcggcccgccuggccugcagcgcucccacccccggcggcggcacgaugcccuuugacuucaggaggugaguguggcgaccccggccagucgggaguucccucagcgggcagagggagcgccccggcacgccgcggaccccucccgcccugcaugcaaaagcggcuccccgcccugugcaugccuccgcaggccccuagggaccccaggcgagcccccccccugccgcacacgaagccagccagagccgcggaggcccccucgugcagcgggagacaaauccacccaccuucccuccgccgagcccccuccccagccugcccggauaccuugcauuccccucccccacacuaggaaacauuuccucccuccucccagaugggaacagcccauaacaccccagcaucccucuccucccucuacugagccuccuugguggaccccaccucagcugacagguggggcagggcaccuggaaugaguccggaggggccuggggccccaugcagccugccggcagcuggaggguuuuaaguuucuauagccugaggcucccccaggccgggcagaucgggaggccugcccccgccccucccucccucagccccagcccuguccgcuggguaugggggcaccaugggaaggggaggaggcgccuugggcaggacucugcagaagggccaccggggucuggccuuggcuuucugcagucaccacaauggguccuuugugggguccagcugccucauggucuagguugcauggggcauucuggaagccugcgggggaagagaucuccaccagagguucccuugagguguggagccccaggggauguccuggccugaggcagccacacuuggugucuggcugggaaaagagcagggcuuuaaugcagggaggagcuggauuagaauccuggcucugcccuuucuacugaacagcucgguauauucuagaaguuaggggcaaaggcucuggguucagaacucccugucgccgcucggcuggcugaccucagcaagucuccgagcgcccucaguuucaccaccugcaaauuggggcuaaaaauaaggucuccgcuugugacgacugagugcgugaaacacccuuagcagagucuggcaugauuuagagcucagaaauagggcauuaguggaugggggguguucuccaggagggguuuuccacauccacaaaauagugauucagaugccugugccacaggagguauuucuuccccucuucuugcaugugaaggcaguguaaagugacagucuacccagagagaaaggcccuuagccugccaugacccccauagcaugggauauauugggguuuaggcccaaagaggacacuggucuuggaccucuugauugguugacaugguuuuccagccuguccgggucccugauaccagcuagcaaauguuugccggcuucuugccccugccgggcagcccugaggcuagcagaccuaggcaguuuugaacaaggacagccccucugguggaauucaaggucaguccuaauagcaucaguuaagucugggccauaagagcuguggucggcacaucaauuucugguuccacaaagccuccccuuacccaggccaaccauagggauucgugccaccgccgcccccugccccugugugauucaguagguuccggugauuuugagcuugcuggggaaauugcuguuuuugaucuuuuaauccuuucucccugcaccucacccuuccgucuuaccaaggaggaaaugaggcuccagggaugagggccuuaucuuggacuuuaugggugcuaaaugggaaggguagacuuaggucucaggucacacauggcucccaaccuugugcuccuugaauugguggcuugugggggcagguaagggaaguaaggaaaauggguaaggccagcucuagccuuuggccuuggaagggcccugugucaggcauugauauuuaaagagagaaaugcucagcucugagaagcuggcuagucuggggcucccuuggcauacuucaggucccugagugcccaggugucagggggcccagcuuaacuaggaaauacucucagggcuugggcucacugcggaauggugagaauggauucagugcuucacguuugcaccuuggaggaugagccaugugugcccagcaaaccugcacucuuuaagcucugugaacuucaaggcuccaggaccuggguucuacugaggguucgaccauccccaugcaccuuccuccgcuucagugugcauucaucaagcauucaucaaguguccaguccaugcucagcccucugccacaggccccaccgugaggagguggguggcaugugguccggcucucuuugcauuccaagagaagggaggagggcuuauggggucccaggagugggggugugcgugaacuggcacgcaaggagcaucuaccacuguauacacacuuuggggugcagacaucgauucccuugucaccugagagagggaguuuuaaucuucauuuuaaaucaaaggagaggggagcuccacugaguagaagcccuuugcucuggccaugcagugcaugagcugguggaucugggauuugaacuuggggcuguuagcuccaaagccuuagaucugggagaaaagggagagauuggaggggcccaccauccugucagcucuuuuaagaauuguggggaguggagagggguauaccgugauuagaccuccucccccaguucaaggccagggagaaaaccagccguccugcucguguuccccuucuuaaaaucagaagcaggaaaaauagugcacucuugcccuucccuacggauacuucugauuuucuuacugccuguagagccuggugcaacugaguucuguguuuuccugucugugaaaugggaaugaggagaguacucaccgaaguagaacaguugagggaugaggcagugcggaaagcauuuagacacagaguaagcgccucauccauuuuggccgccauauuuauuugugucauuuuauuuaagcacccaucaucuccuaacacauuauauaauucacuuaauuaucaugcugcuucucucucccucccauuaguacaugagcuccugagggcaagaaguuuuuaucaggcuucuucaagguugcaucuccagcaccuagaacugugcuugagccaaacucgauccuuggagaugccucuugaaaucugucaaggaagccauagacaugacgugacuugauaugccagcuucagugggcagauuuucagccauuaguggagaaaucuccccucuccacccuugaaucugccguuccuagguuguuuuugggguuaaggaaggaggcagaacgcaggggagggaggcugagcuuucaaugauuuauuguguuugcuuugcucuuguuaaauuguuucacuaauggcuggcuguugcaguuguggaacuagccuugugacccacauccguguguguuguuucgaguuccggcuggccuggggccaguagcaccugcugccuucugcacaccagcccagggugggugaggagggaagauaacagcauccggaagcccugugcccaggcccaguggugccugagcacugccuuccgggaggugcagguggcugcugucccacagugacagcccccauguugaaaacccaaggccucgggggugccgcugcacuggcacugaccagaugugcucugggaccauugacuuccccucucggagccuccauuucuucauuuuaaggaggggauguaaacuucgcugccucaccugguagaguagauguaggggcaagugugaucaaugcacacuugcaggaucaaugugcaaugcaacuugcaaugcaggaugaggcccauaauuuguggggcccagugcaaaaugaaaauguggagucccuuguugaaaaaguauuaagaauuucaggacggcagcagcagcgcauucagccaagcauggaccccccucugagugugugacccugugugccugcacaggucaugcggcccugauggggcuggcccugcugcagggccuugguuuggccucuaccauuuuucacucuggccuucugaguggucuuucucccuccaggauaccccagaccuccucaggacucccuagugagcuuuccaaaguugaucugauauuuucauguccugauuucaaccuucaaaugggucucauugcucuaaggauccagugugaauuccuuuuuaaaaaaaaauuauauagagauggggucuugcuauguuggccagguuguucuugaacuccuggccucaagucauccuccuuccuuggccucccaaagugcuaagaucacaggcaugagccacugcaccuggcccagucuuaauuccuuaggccccaauagggaaugggacccugguagccccaucaguuccuacaccaagcuaagccucagccaccacagggaccucugagcacagaguuaacauucagcagagaguagcuaacaugaaugccuguauuucuacccugcuguuucuuccagaaagaauuccaaggaagcugacaagaacauauacuuuacagcaaguuuuaaaaaauauaaaaugagcgcuguggcucaugccuguaaucccagcacuuugggaggcugaggugggcggauuaccugaggucaggaguuugagaccagccuggccaacauggugaaaccccgucucuaauaaaaauacaaaaaucagccgggcuugaugguacauaccuguaaucccagcuccucgggaggcugaggcaggagaauugcuugagcccgggagacggagguugcagugaacugagaucuugccacuguacuccagccuggccaacagagcgagacucugucucaaaaaaaaaaaaaaaaaaaaguauauauauaugggccaggugugguagcucacaccuguaaucccaguacuuugggaggccaaagugggaggauugcuugaggauugcaggaguucaagaccaagcuggucaacauagcaagaccccagaccccaucucuauggggaaaaaaaaauggccagguguggugaugugcgucuguggucccagcuucuugggaggcugagguggaaggaucucuugagcccaggagguggaggcuucagugagccauguucaugccauugcauuccacacuggguaacagagcaagacccuaucucaaaacacacacacacauacacacacacacacauacacacacauacacauacacauauagccuuaaaaaucagggcaaaaagaaaauaaaaauuagaccagagagaaaauuaugugaaaaggccaguauuucggguuuauugaacauuugcuagugccaggcacuguuguaaggaucuuacuguaucagccccuuuaauucuccacaguccuacaagggaggugcuguuguuaccccacuuuacaggugagccaguggaggugccacagaguucggaaacacggucguucccguuccuggagcugggauuggaacacugccauuuggcaccagagcuccacuguguccuguaggcucaucucuaaagcuuucucuuuuccauucacuaaauucagagagaacugagaacucuucuaauuggauucauuggguuucucuucacuaauccucacccaacagugcucauuaagaagcuuaaagccaucaacuuuuuucccccuagccucauguagcgugauaccugauucugaaauggucuuuaaagacccucacaccagcuaauggcaucacccucgaggggcucaguuuucccacgcugaccaguggggguuuuccagcuuagagcaucauguuuaccugcucgcggggacauggaaugagauggaauguccucuccucccaaggccguuuggauuccugacuguggugcuguaguagcaggagacagggcuuuagccagcuguguccugguuaaguuacauuccccaucugguaauccuuucguauuuuauuuggaguuacuccuagccaguuuuugucaggcgugggagagacaggcagggugugaagaggguauuuggggugaggcuuacccgguacaucuaaaucagugagccucaacccuggcuguauauuaaagucucucaugugauucuaaugcacagccaagacggaggagaagugcucugaauugggagaagcaauagcaagcagggcugagagcagcaggggagccaggucggguggcgguggagagccuugccucgggaggcuggggcguggaguucccgucccacccaucacuccugcaugaccuucggcaacucuguuaccccaccagugaaguggacaguaaggggccguaacuuucuacuaauaaccuugcucuucaaagugcagucccagaugccagcuucagcagcaccuuggagcuuguuggaaguggagaaucucagugcccaccuggaaucugaauuuguauuuuaacaagauccccaggugauucauguauucauuaaaauguauaaagcccuggucuguaugauugauuugacucaguguccuccagucugugucccuccaugccgcacuggcugccucacugaggacucugaagaguccggcacugagcgaaccagaguuauuugguucagcccaacauuugccacauguauagucucagaugcccuguuguuuauggagcagcuagugccauuucucaaaacacaguuugggaaacacagcccuaauugauccuuuaaggaaguggcaauuagccuaauugucuguugucagcuuuaacuuuuaggucuauuaacuuaauuacauugauuguauaugugggaaaaguacaggacaggaaaaaaaccuccaacgcuggcugucuuuguuuaaaaaaaaucuugacccacgggagaggcagggugaacucaggguucuccauacagccaagagccaggggacaugugggguccuuuacagauaccucuucucccucugagugggcaugauccuuccuguuuuauguccagggaaaccgacccucagaaaugcugggaaacagcuggugccucugacagcguaauccucaugcccuugacaauuagccuuccuccuggcaccugccaggcagcacagcuacacaggaaggcagauccgcuugaaauggacaaaccauucuguuucuccaaaagguggaaacccuauucgagaugagaggccuggcuguaauuacaguuaguaaagucagaggacccggaugucccugauguacuggggacuggcguugugauagccccuccaugcauuagcuuuccuuucucagauucuggucugggucuugaauaucuuuggaggaggagaaguaaugcucaucuuauuagcaauaccucacggcccuucagcuuguaaugucuugagcacugggcuaggcaugucauuggacuuauaaaaucacacuggccuuacagacagauacaaugauucaugauuuauuuucuuuguuuuauuuuuaaaguuagcauaugauaaaauuaauguguguuugugcacucuucuaugaaaguuaaggcuuguuuaucauguaaucaccaccauccagauacaggacagcuccaucucuaucaccccucacaucucaugcugucacuuuauagucauacuauuaauuugguuauuuuuugugugguaagaauaccuaacaucagagcacccucuuuuuugagacggagauuccuucuuguugcucaggcuggagugcaauggcgcaaucucggcucacugcaaccuccacuucccagguucaagcaauucugccucagccucccaaguagcugggauuacaggcaugcaccaucaagcccagcuaauuuuguauuuuuaguggagaugggguuucaccauauuugccuauuuuagauacuucauguaaguggaaucaugcagucuucauucugugucugccuuauuucacauaacguaauguccaccaguuucaucaauggugucacaaaugacagaauuuccuuuuuuaaggcugaguaauauuucaagguguauauauaccaauauuuacccauuaauagacauuuagguuguuuccacaucuuggcaguuaugaauaaugcugcagugagcaugggagugcagaugucucugagauccugauuucaauucuuuuggauaaauaccccaaagugggaccgcuggauccuaugguagcucuauuuuuaauuuguugagaaaucuuccuccuguuuuccauaguggcugcacuaucuuuccuccccaccaacgguguacaagcauucccucuccccacaucuugccaacaugucuuuuguuuuucugguaauagccauccuaacagguaugaggugccauuucauugugauuuuuauuugcauuucccugaugaauagagauuuugagcaucuuuucaagaucuuggccauuuguaugucuuguuuggagaaauauccauucacauuuuuugugcuuuuuaaaauuggaggguuuuuggccaggcauggugacucacaccuguaaucccagcacuuugggaggccaagguggguggaucaccugaggucaggaguucgagaccaaccuggccaacauggagaaaccccaucucuacuaaaaauacaaaaauuagcugggcauggugguaugcgccuguagucccagcuaguugggaggcugaggcaggagaauugcuugaaccuccgggaggcggagguugcagugagccgagauugugccacugcacuccagccugggugacagagugaaacuccgucucaaaaauuaaauaaaauaaaauagaaguuuauuuuugccacugaguuuaaggaguugcuuauauauucuggauauuagccccuuaucagguguaugguuugcaaauguuuucuuccauucuguaguugcguuuucacuccguuaauguuuucuuuauucaguuuuaaaaugguaagccaaggcacagagcuggaaugggaguggcccaggacacagcuggugaggugcagagcuggggucccagagccuggcaccucacauggugcuauccugcuuugcugauuuuucuugcugauuuuuauuauucuucacuagaucuucucuccccucccacuuucacaccaacauauagaauuaccuaaaguauccuuuaagaacuuugggaaacccuggugauauuuggcguguuuugaugucuugcuggguccaagaguauguucauggugugcagaaagagucuccaagucuucaggggaaagugguauguagcgguccaacccuggccacccuuucugaauggucuucgcccuugcaaaccccucuggggacugaccacagguccccugcggaacgcugugaagugcccuuggaacugacccucacauugcacucauucggcagaacucucuggauugaaaucccuuccucaguguuuaccagcuguggggcccaggacaagacacuuugccucugcaagccucaguuuuccucaucugcaaauuggggugcucauacuuucuuugcggggauuuugugagggugagaugagcucauguggaaugugagacaaguauacuuggaggcgggaggacauuucccucuccucugccuuuccuggcggcauaguccugugcaccucaccgagccgugauagauggcaguagugggucuucugguagguggacgugguaaaaccagggccuccgggguuugcagggcacagauacaaucacaugggaacaccugagauggucagacccagaguuagaccccucucccuuugugguacccacacagccauagacgucaaacaccagucugugguaagggagaaaguggccagagggucacacacucaggcgccccuaccuaucagcaaguaccucagucggugauugggcaagaugugggccauggccaccuggagcgcgaggcccuguggggaagggacagcugacaugcagcucuguugcuuacugccuacagaugcccugauuuuucaagagacaaugaaaaucugauaaauugcgugaaaaugguuggccacugaucucaauuuuauuucuguuaaacaccaaacaaauccuucugagggcugacgauagccuaugacaggcagggugccgccucugugucgcacauggcagugugaccaggacaagcucggggugggcaggaccuugggcucgugggagguggccuggugggcauggacuugaggcuggaggcagaggagugagggacccacaagucaauuucuuugggcacaggcagccucggggccccaucccaugcuaagcccccucccacccggggccuggccuggcccuaggaccuugauuccuucagguuucagcuggggcuccccuccucugauggugugggaauggcaccacuggccccugccauuggaccugcuguccucuuuggugauccuagggcuggcccagguccuuuuggagugacacacccuuccugcacauccuucaauaccuucguccccggggugucuuucaggugacuucccagggcuaugcugugacaacaguagugcccacaauagucacugcuuaucaagugcuagacuaaaggcuuuucuuggauucccucagugcauccucaagucagguaggagccauuucccauucccaucuucuugaggaggacgcagggguauauaggggggacaggacuuggccgaggucacacaaacagcaggugaugccgcuaagucccaagugccugucucugugccaaagcuggcuuucuuagccaguaucacgccccaggaggggaguguuguuacccugauuuucuugcaaccccuccguggauacccuccaucuacucagcuguguuuacagucuguugccuugggggcaacagacuguagaaguggaagccuuggggggcccugguugcuggagaggaggccgggccuggugaccauuuccuaccagccugugcaucugugggcgagagauuaugcugagccccugccgggggagccaggaaggcgugcagcacuuccugugggcagcgggcagggcugguccucuugccggaggaugcucuggccaguccccagggccccuguccacagaccaggagcagcugggccauagagucaucuguugguugaacacauugauugagggccugugugccagguaucauucuagaagcuggggacauagugcugagccaaacagacaaccccugcccugcaacucaugauuuaaaauucauguuuuaauucugguauuuugcuucucucucucuuuuaacuaaauacacuuuuuauuuuggaauagcugagauuuacagaaaagcugcaaagcuaguacagacacccuacauccauuccgcgaggguccccaccuuccauuaccacauucucaccacuaggaaacugaccuuugcucaugacuauucucuaaacucugggcucuauuuggauuuugcccauuuuccacugauguccucauggcaccccaggaucccaucgaaggucccacauuugcauucagaaccuguguguccccaggcuccucugggugggggcaguuucucggucggucccuguuuucuaugaccucagcagccuugaggaagacaggccaggcauccuguagaauguccccagccuggguuugucugauguuucuuccuaaguggacaggguuaugguuuuggggaagcauccccagaggugaagcgcccuucucagcacaucccauggggguccauggcauccauuugaccucucuggcgaugucggccuucaguaccugguuaaguccucauuuggguugguggucuuucucccccucccccaauccccugcacccaucauuccuguaaagugacccuccuggagggaaguggacugacucccagcaucuagaaucccuugugugaugcuacgugacuuaacagcgccucuuucugcgcugucugugcaggacgcccagcacugggcacuuugagucacuucugagcccagcagcguaagauggggcaggagaaggagcuuguaagaacccauuguccucccuggccugccccuugugccaggcugaugucaggugguuuauagucaugaucucauuucaccaucauuacacaccugcaugguaggaggaacugucuuggcucugaguugggagacagcagagcuaggauugcagcugaucuggguccccacuccacagucuuuggauuaugcccugugcccuuuguaagaagagccaauaagaagggcuauaggaaccaugucauaagaguaaccuucaaaggaauaggaagguuucuccuggcgcaggaaaguguuuuaagaggugagcaugagacuugacccagagucuuuuaagucccuuacaguagacaguggugggccugucuggagcucauugcuguggauucaggaugugacucuugacugccgugaggacuaaauaaguuugccucuguaaagcccuuagaacugugccuggcaucuguuaggugcuugauaucuauucguuacagaaaaaagcaccaggauauccaggcugucagagaagauuuauggaugggcaggaaauuggacuagagaugccuccuuuguguuagccuaagucagcuaauuccuauaaacaaccugcagaucucagugcuguaaugcaacacacguuuauuuuuugcucaguguaacuuaugcugggacuugaugacugcucaugaagucccagcagaagauggggugcuccgcucccccuggguacucagaggccuugacuccuugcgucuucuggcucuguccuccucuggggugugcuggauccucuccuuggccuggcagugguggggagagaaaggaggauggggacaauuggguggcaggucaagauguggggccaucacuucugcucacacuccuuuguccagaacucagagaccuggucacaccuaacugcaggagaggucagcaaauacagucuagcagugugcccagaggaagaggaaagaaagugcuuucaugagcauguuaauaagcaugucucuaccauggcaacugaaaucagugguuuuuacccuuccacuauucugcuacuaucaucauaauuuuuggcagauuccuaaacagcaugugauauauauauauauuuuuuguuguuguuguuguugagagggagucuugcucugucgccaggcuggagugcaguggcaugaucucggcucacugcaaccucugccucccggguucaagugauucuucugccucagccucccaaguuagcugggacuacaggugcgcgccaccacacccagcuaauuuuuguauuuuuaguagagacgggguuucgccguguugaccaggauggucucgauccguugaccucgugguccacccgccuuggccucccaaagugcugggauuacaggcaugugccaccacgcccggccacauguguuauuuacuuaauauuuuuucuuugaauuaaucagguuuugaacuuaacacuuuuacugaugaaaggugaccuuauaacaucuuuggaaauggaaaagcaauagcuccugcuguaaauugauacaaauaauugcaauguguuugguucucacgagcaucuggugccuggugaaguugcuggguuuguuaaaaaagagauauuagcaagugcuagagagaggagauguugaagacauaguagugccacccugaggcuuucucguugauauucugagcauacucaaaagagagcugaacagggaauaacuuuuuucaugguggggucugaugucauuuaaccaccagggaaguaggguucauuccuuuuuucccuccaucaaaaauuuauuggagggauucugggggaaaacaagacagacacuguuuccaccuucaugaugguuccaggcuauuggggaagaugggcagaacagcagggaacaaaucauugcacaagugguuauuuuccauugugaugagugcugagaaggaaggcaaaguagauggggcgauagagaguuuauagagaaggagcucacuggauuagcuuggcuaacuaguacucuuccucaaaaaagaucuucccagacugccucuucaaccuaacuugggucaucugccaccccuuuucuggccgcaccuuuuuaugacaccuagacagguccuucagaucccuuggcacaauuagcacaguugcagugauuuguuugugcaguuugucaucuugugucugucuuccuuauggagucugaguccucgagagcaggggccauaucuauguguucaucacuggauccuggugcugagccagcaucugcacacuguggguggucaguaaauauugacugaaugaaggaaguagagagacagggaggaaggguccagcugagacccuccugcaauguggcagagggguucaccuccgcaagaauggaggacuucauugcuauaucccuuuguguuuggaaaauguuucuaguuuucuccuaagugcaucugaaagaauuuauuuugaccgaguccugaggaauugggaagucagacauuacugaggcccugccugaaggagggguggguggcccacuaccuauccugaugggaggccaccacgugccagcuccccuugcuugaagccauguuaguccccagaacaggaguaaggcagccgggagaagacaccugacauuccaccuucacuccugccugggcauuaggauucauuguaauuauucccauuuugaggaaauggagaccgagagaaguugaagaccuggcucagggucauaccucuggcaaaguaacaaacccaagcccuagcucuacuuuccgacccccagaaaguaaugcuuucaguuagaucaccuaacccuggaaaucuuaguugcuuguuuuugaguugagcaacugugcucucucuagcaaacuggccaguuucccuaaucaccuggggcccugugcggauccgggagagucagauucagguggccugggaaucugcauuuucaccagugucuucagugauucuuagggucaggcaagcuggggagacccugaauaaggguucccccauuauguucccagcguaacucuggaacuggguaccacaaaucuuuguuaaccuaguaaugaccaucacaaaagcgagugaugggacuaagacuucagaaagcccuugaagaugugugugcucuagggaucauuguuuucucugcagaugaggaagcugaggcuuugggggguugagaguugggggucacaccugcaggaaugcagcucuucugaauuugaaucccuuacguuuuccaguugauggcaggagucauaugugucuuggugaauguuagguccucacauacccccaaugacagcagcugugggucuccucucuguccuggugcauagcacaagaccucacccacgcugucugcacucaacuuguuucuggaaggcagggaggaaggaagcugucagugcuagacauuugcaggggaacagggguggguagguggugauaguagaaguaaaaacauucacucagcaucucugggguaucaggagcagugcuacaaacuauaaauaucaucuucuucuguucuuacccaucaaguuggggcuuuuauuugccucauuuuacaggugagagaaccgagguggcgugaucugaucuaguguugggugugucaacgucgugugcugauuagaauuaguaaacacggaagcuggaagggucccaggauggguucagugucgcccugauguacccaacaagccagguggcaggagcugguuccaccuuucgggccugccugacuuuccccaauuuggcuuccguuggccaagcugcaaaacugggucacacuugaagccaggugauuggucagagcugaguuaacccugagucaaaggagggcaugagaagguucgccuacccgcccccucccugccccaccccaccccacccugggccaggccccucacaguggagccacacaggcacgucauccugcuugggccuccgccugccccacacucaccagagcaugacaagucagccacccgggauuuggcuguucuagaggcacuguuccaugcugccaggcagaccugggacagcugggcugagggcucgggggaguagagggaggugggcaccguguagugcggagaggccuagggcuuuggagucugguggaccugggugcugauccuagugcucccacccacucgcuguguguccuugggcagcucacuucaccucucugagucuguuuucugcuacaaauggggauacaacccugaccccaagcagcugcuguguagaguuaacaagagccucauauagcccuaggucuuauuucagugucgaaccccucuuuucuuccugcauuuaugaaauuuccugacacauuuggucuucuaaagcggagguugcaaacugguggcaucagagguugaguuuugcccacaaaugugauuauuuggcccucacauuuuuaaaaaauugaauuuuaugucagcauuuuugaaugaaaauauuucacauaaaaauuuggauuuccagccgggcacgguggcucacacuuguaaucccagcacuuugggaggcugaggugagcggaucacuugaggccaggaguucgagaccagccuggccaacauggugaaacuccaucucuacuaaaaauacaaaaaauuagccgggcaugauggcaugugcauguaaucccagcuacucaggaggcuuaggcaggagaaucccuugaacccgggagguggagcuugcagugagccgagauugcacaacugcacuccagccugggcaacagagcaagacucugucucaaaaaaaaaaaaaaaaaaaauuaaaaauucaggcacaguggcucacaucuguaaagccagcacuuugggaggccgaggcagccggaucaccugaggucaggaguucaagaccagccugaccaauauggugagcucccguuucuacuaaaaauacaaaaauuagccgggcaugguggcaugcaccaguagucccagcuacucaggaggcugagacaggagauucgcuucaaccccggaggcagagguugcagugagcugagauugcgccacugcacuccagccugggugacagagcaagacuccguuucaauaaaaaauaaaaaaauuggauuuccaaugcaucuggaaaaauggaccucaguggccacauggcagcccagggcuguugcugggcagaccucugggaccuuaaagcgggagaugugagagccaggaucagguugcaggccuagacagggagguggggggguauggucaccucaggggcuucaggugcccgaggaccccucugagacaugaggacagucuuccagugugacugacuuaauuccaucuagugaggagguggcuuuuagagucuggaugccccuggguaaaagggcuccacuuaccagcuccuugggccagucacugacuugucugugccacuuucucauuugcaaaacaagaguaaugcguuguuaguaagcaccaugguaagcacuccacucaugucagcagcucauaugaguccaucccaaguaggagauuugcccgagaucgucuuugagagaugucuuucuaaagguuccuggagagacaggccugugucuggaaaucccaggcagggacucugacggugaucaggccucuaccugucaaugggugaaccagccaaaaggagaccgccaaagcaucaggugcauugccaggggcauugccaugauuugauugggagggagugucaguguugcauuuuuuguacccccacuuugagcccugugcuuaaagacaccaucaaggccauccccugauggucuugggaauggauagagcugaaaagagugaggcccagaggcagcuuuucguuuuccaaaacgcaggcagggucugcccaggugcccucugugggcuuguuagccugcaggagcugguuucugcuggcugauguuaagucaaagaggucuccuggcucuaacucagacacuuccucauacagucuucuuagugggcuuccugcugacaguggaugccagggacccaggcagggaggucucccuuuugaaaggggccacuggccuuugggaaauaguagagaccagugauuaagagcuugaucuccagagccccucauaggccgucagugacaugagagcagagaccggcucagccuuguucucuaccagguccccagggccaaggacacugaaagcccuuuuuaaaaaaaguguugaauaguaaaugagcagggucuuccucuugggucugaaccucagcucuccuacuugaagccucucuugacuugccaacaacuuaccgugucaucagcggggaugguaaugguaccuuccuccugggggacaguagaguuucagugagauaacguguacaucacucagcauggcacgcagccaugcgacgugcucagcacauguggcugugaugacuguuugguuugcacaggcauuucuauguguggaccuugacgcagguucccacaaaggacucuggccccaugggugacggugucacagcuguccuuuuggaaucuucaccucaccuaaacucccuggcaguaauagcccaggggagagagggcauguggguuuggccaagggaggggaucucuggggaaagucacccuguuuguccaagaagcgccuguguguauguguagauaugagugugcaaaugugugaaacuguguguucaugccuuugcugcaggcccacaaggugguuuaccacgugcuguuguugccuggaaagguauugcgcaggaugccaugugguaugaugucccuggccccagcagccccagugacuggugagcggcuccuaggucugcuccugccuccaguagaagcagccacaggaguccuggccacagcccccauugcggcccccaucgugcugggugcuggcuuuuggaaaucccugcauacccgcaacggcucccgugguggggguggagguggaggagcuggucaggccacccagaggcaucuuccucaguggagccuucugccagguaccucucagcuguuuuccaaaugacuacuuagcauuucccugccucgauccccacagcagcccuguagggaaggaguggcccauuucacagaugagaaacucgaggcuuacagagucagucugcgcaacuggggcugggggcaaugugcugguuaaaaugcagauucccaucuccccccgccccggaggaugggaugugggaaucaggguccaggccuugguguucuaagcagccucuccaaggagcugcguugucaggagagugggaagcagaagcaggagccuugggccuuacaguucugggagugugcucuggcccugcuguuugcucaguuggggcaauugcaucagcuuccugggcuuccuucagcuuucucagcugugagcuggagagaguggugcccaccuccaaggggccuggugaaaauuccaugaucaguucguuuaucucacuugggauaguggaauuccuggagaguucaauaaaaugguuuguugcuauuguuccacaugggauuuacuacaaaagcaauuucagaaacauccaaaaagauauccaugugcauaauugacaguaguguaucugcucaucuccuucgaagugggaguuucacaggauggugaaucaggguugcucuacccccauuuuagagauuaaacuacagcaggcagggcaagguggcucacgccuauaaucccagcacuuugggagaccaagacaggaggaucaccugaguccaggaguucgagaccagccugggcaacauagugagacuccaucucuacaaaaaaaaaaaaaaauuagcugggcaugguggccugcaccuguggucucagcuacucaggaggcugaggcgggaggaucacuugagcccgggagguugaggcugcagugagcuguguucacgccacuuccacuucagccuggacaacagagugagacugucucaaacaacaaaaaaagaaacuacagcagacccuugaauaauguuuuguuauaaaacauugaugagaaaaaaaaguauuuccuggcuggggccacugucuguuggguuugcacguucuacccacgucugcguggcucuucugcaggcacccccacccaccuacccacaucccaaaccugugccugucagguucaucagcacguccgcauggucccggugugggugagugugggugugugggcgugugugcccugcgaugggagggcgugcuggccagggccgguucccgccuuguucccugagcagcugggaugggcucuggccacccgugacuuggaacuggaauaagugaguaaacagugaucuuacuuguuuugacaaaucuuucuuaaguguauguacagcucacauguauuuuaaugucuaauaguagaaguguuuugaucuuuauuuggaaguuugguguuguuuuugugaccagaaauaugccuuaggaacuuaagucuuguuuauauccauuagccuguggggaaauuguuuuucaucuucugcuguuucccucaaagucaugguuuccaagaaccuaccaacaaccuuaagugaggccuugcuguacugaggggccaccugggacucacacagguuuuuagcuaccaggguucuggggcuccugaaauggacucagcucuccuucagacaccuaccugggcuguguucccccaacggacagugguggauguggguugggaugucacaggucacugcaccaccuaccaccucccuggaguggcauuucccagaacaccaggacacacugccgggugggaacaaugacgcugguuuccaggagagcagugggggugggagaggaagcaugccuaccugucuuccauaccugaucuggacccagcaaacauggcccugaggugcuccacgccccauaccucucugcugggggcuccacccacagcccuucugcugagauggucucgggccuaaccaggaccucgcuggcccauuugcucacucagucauguaagagaugucuguugcauguuuacuaugugcugcgcccugugcugaggcuggaguaccuggcugaccccacagacaugguccccacugucauggggcuuacacuuaaacagggaagauggacaguuggaggaucaagaguuuucccagcgagaauauccagggaacucuggggauguucugauccagccuugcguggggugcgaggagguccuccccacgauguucaacucaaggccuuagugaggagcagagcugguuuggugcuggggcagggagccaggcccguccagcacgugguacacugaugagggaaugcaccaggcaggcagagccuucgggcacggugaggagugugcccuguccucagcauagagaggccacgccuuguguuggggagccagguuccaugugggcugugagcggcccacucagccugugcuucagaggcuggccugggugcagcccggcgggggccaggccagcgacugucagcuccuguggcguccagucuuuuugccaagaggccucuuuaauucacauuuuccacaucgacuugauguuuugaaaaugucgaccuuuaguucaucaaaugucacuuauuaaaucauaagucacaucccauucaauuaaaaaaagacaauggacuggugacucaguguauggucucuuggcaggagagacccugaagcacuugaggccagaggaagacaugcgccuugucagugaucccugcaucccuaggggugggcagcacgucauuccugugagaggcuggacuggagagagagacuggguuggcagccaggcuggagaagcugugaccagccuggaacgccaggcccaggcagguggacuugaaacuuacucacaagaagcaaagagcccuguuggaaaggugagguuuggucagucaggccagagaggagucaaggccaugcauggaacagugcuugacuggaagagaagcaaauggcaaaauguguacaggcagggagugaaucagggugcuuccuggaggagggacacuugagagaugaguuggagugaagucaguagaggugaagggauucuagccaagggcucugcggccugaugagaggcuaggaggugggaaagagcgggggauacaaugggcaggugagauggggcugccugugcugccucaggcacuggggagcccuagcagguucuugagcaugcguguugcucaggaagaaaaauaagaucaagugaauguaaaagcucccuacagcuuagaggagggagcaccgaaagucuuuugguauggguuagaaugguucccaaaggcugugaggggaggguucucccugcugagaugacugcgccuuaucagaccuucauggagacggaagacagacuguggagaccaaccugagaauggauuguagccuugcccuccuacccuugcaccucaguaucccuauuuaugaggugggagaagcaguaaucugccucacgguugugugaaacguaauuaagccgugcauacaaaaugccugaagcauacugcaggccuguagacagcacugggguagccaaggguuggggccccuggaaaccccacaacaagaaauucacagcuggggaauucaagagcuuuuugaaaaacaguguuggggccccaaggccaccaguagaccuuaggaacaugauguacgcugaaguucauucaaauaacacgguaaagagacuggccaccauguuuuauguaucuuaaauuaggaauaaggggaacuucuugaagccucaguuuccucauuuguaaaauggggcuagugacugcuucacagggcuguugugaggaugaaaugaauggggcugagacgcuuggcauuggacguagcugagguagggucucaggugauaucccuggaaugguucgauucauugccaugcaccauccuuccucaguagaggaguacacauuucugcuccaguaguuucaaggagaugcuuauaaauaugcguuccuuccuugcagacaugccugcgggaggagacuucucuugagccugggacucacugccuugugugcagcaaugaacagucacagcucuggccccacccuuugcuggcuuugggaccuugggcagguccuucaccgcccugggacucaguuuccucaccuguaacaaugggcuaauaauggugccccccccacccacccuuaagcauugugugaggccaaaaugagaauagugcaccugccaauaagggcucagccauggccacguggucauggaaccccuccuccuggggucucacguggccccaggaccccaggcaccccucuuccauggaacuuggcuucuuccccggguucuugucuuacagcuuacguuaugguuccuggagugagaggaguaaaaucggucuccccaucugcucucugcuuugccuuccuuuucacuuuucaucuccccaggcuguucauucgcucauucauucauacauucacucacugacacauuuacaaauauuuauacuggucacugugccaggcacugcgagacucgguggugaacggcagggauauagccccugcccucauggagucuugggcuucagcaauuaaacauccaauuaaauguauaauucucaguugacaugugacuauaaaggagaaaagcagggggcugugaggccugcgucuucuaggggaucgggggaaccugacugcagugguauuugacggcugucugaaaggugcuuaggguucacugggccacugagaggcagggaggcccagguggagggagagcaugggcaaaggcccugaggugggaggucacaggucggccggcugaagcggcugcuggacagagagcuggggagugccagggcuggaggacucagcuggccagaccaugaaagcugcauaaaacaccguaaggaguuuauccuaagaagcuucagcccuuacaggguggugagcagauccucacgaacucuugaugcgaagggaagagcggacccauuccgggucucgggcagugucugagcaaggggccgguggucugcgcaucugcacacuaggcccuuccucgucagucacacgcuagaggaacaacucacaauuugcacuuaguccugaauccgggcggugacacagaagaaagucauagacacucgggguggggcagaggggcccucacugaguccucugccggcauccagcccugaugauugauucuaauccaggccgcuucugaggacacgaggaaaaggcuguuagcauaggcccuacugcguaccuggcagacccaaguucaucaucucggcugaccuuaccagccccccgcuggcauggguggggguccgcuguuguccacagaaagaaaacagggcugggagcuugugagggcccugcccaagauuccaaggccccugccagccagauguuuggggccaaaguccaugcuucccugcccuguggguaacacgggggagauuacuguuugaaguacuuuggacagucacaccaggucaaaaggucuguguggucaaaagcuacaaggccuguggcugggggagcugugcugaggacgugauuuugaggcuuucuuagcccagacuuaccuucauagcuuccugggaucucccaggucugggucgucaucggcgcccuuaccggggagggcucugcuccccuaaaugccccugugcaccugccccagccccuucccuccuccuggugcuugggucaugucguucccugugcaugccaguccccuuacgugcacauuuuuccucuaugauuuuuccuguuuugaugagacacugcucuuggccgugcugguucccaagaggggaccaggccccggccuggccagcuggucauucaggaacuuugcuucuaggcccagccccacacccagccacauuccacuagggccagaaccuuugagcuccgugugaauggggcaugucccacccacccccaacucccauggccgccuccuuaucacccuucccagcugacggaaaaggccauauuccauccuggaauuagcuuucccccauuucuguuugcuuccagacugaagggugggaaaaaaaaauguccugaaggucacagugccgucccaagccuuugaaguguggcugcucucauuggcuccacuuagcaggaugaaacuggggcucagagagcugccgcaggugccuggugcugcuggucacuucuuugccaccucugagggaaucaccuuaaaggggccccuggagcccuccguagcccucacaccucaugugcugggccugggcuggauugcagcccuugcugcuauccuccgcaggugcccuuggacaggggacagccugcccagcuguacacaguggccuuggcaagaccacagcauggcccauaggugguggcuucaggauuuggaagcccgguuucucuaacuccaaacuccacagucaguacuuugggguucuggauuguuugucggcuggguuagcucuguucuauuuuuccaacuguuucuugccuuuaagcugugcuuugccuacaggccuuuucuuaauuauucagcucugccagaggugcuucuguagaaaguacuuguccugaguaauuucaagcuuuuaaucuuaccuuugaagaaauauuuaaccaucccaugcuccuauauguuuguucauuucuuauucauucuuucaccgaacagcauugauucagugccagggaggggcagggacagaggugaacaagacaugucuccagccucagguagcucaggugugugaggcagugcgcucaagugggcucaucaguucccugacggggaacuagcagaggagggcaggagggcguggagagguauggcaaccuugaaggacuuuggugauggugaugaucauagccagcccugaauaggguucucuuuaugccugcaccauucugcccccucacaucuguuaacaugcuucauccccacaaccagucauuaggaacaacuuacacauugggaagccaaggcacagagaaguuauuuaaccugcccagcguugccugagccagggcagagcugggguuugaacccaggccuccuggcuccugcaucugccccccucaccacugcaccucacugcaugcacgggagcucuuuggaugcagggaugggagcggugugugcaagccucagagcugugaccgugaaagaaacagacuucucugaggcuuugcugcagaaucugggccagcaggugucugggaggaagccacccuugggcuggggccaagcauggguccuggggucaggacaaggagagggacuggugcuugaguccuuuuggagcugcagauccaugguggggcuucugaaugaucuugugugaggaaggaguccaggguguuagccacgccuguguuucuuugugagcacaaaaacauauuccauagccagaguuccacaguguuuggagcucugccugagaaccuaggcugggacuguguggggaggaagggccggcgagagcggauguaggcugagccagccucggcuggagaccggcccuggcacugacugccuggggucacucugggugaaacucauccacccuccugggcacucugcgcucugcuucaaauccaccgccgaaaacaagcugaguccugccccagccugcagggccugugggauguguccuccauccgccucgcugaccucgucccaugccaccugccccucccugcgugccagccgcaguggccaccgcugcugcugacacaggccagccacacacccaccucagagucuuggccaagcacuggccauucccucugcucagaaugcucuucccaggcacuuggcguaguggcucccucccuucccucgggucucugcccugaccucacccagccugcagugcccucuguccggcucugucagacccacguguucucuuucauagcuccucccacccucuggaacagucccaucucccuuuggcuuguuuauuaucuguccccuccaugggaaccucgguuccucagaggcgcaggcuuugccugucuuguucaugccuguugccccagugccaucaauggagccuggcacuuguggaugcugacuacucguuggcugaaugaaugaaccucaguugccuuauuuguaaaaugggaagcaucacacugaucuacuaacguugcuguaaagacgaaaggcauguuauuugggucaagacacccagcacugugccugacacauaguagguacuuaggaagugguaaauaaugcgugugucagcccaagugugaauuacuggccuuguuuagacaaaguguacacggcauagcucuauuuuuugacauugccaggauagccuggugcuccccagcucuaaaacucagggugauugguggggcagaauaagguaagggcagaaaagaaaagaggaggaagugaaaaggaagaagcccuuugcaguguggacuacuuuucaguagaaacguagaaagacauaguuuaccucaaggccucgcuuuguccacuggaaaguuuagaaauuccugccaagaacuuuuauuuauuuauuuauuuuuuaauuuuauuauuauuauuuuuagaugaaguuuugcucuugucacccaggcuagagugcaauggcaugaucucggcucgcugcaaccuccgccucccggguucaagcgauucuccugccucagccucccgaguagcugggauuacaggugcaugccacugcaccugcucauuuuuauauuuuuaguagagacaggguuucaccauguuggccaggcuggugaccuccugaccucaaaugaucugcccaccgcagccuuccaaagugcuggauuacaggcgugagccaccuugccugggcaacugagugagacuacaucucaaaaaaaaaaaaaaaaaaaaaaaaagauggcacaagauaaggggggagauaaggaagugcaguagaggaaaauguagguggagacuuccuuacaccaucgagaccacacaaaugggcauguguuuauagaaaggcccaguggugaggauggcaaugguggugagcacucccgagcacaaagguggaugcccuucagcuguaagaucccuuuuccuugaagaauucuccacagcaagcuggcuggccagccuugacuuuucucuuccugaagggagccugguucucuacugacucagcagggaauguguccuuuagugcuacuuauugaugucaggauaugaaaaacuuccccaaccucaaauuugggacguccuuaccaguguuucucaaauuucaaucacucuagggcuacugucacaguuugugccacaccuacaucuacuccuacuguuauaugcuuuguauuuuauuuaaauggacucacuuuuuaaaaagcuugcauagaugaguuuuaaaaggcaaacaauuuaccuucucucuaaaauggaagaccaggaucaccugccaugaguccaagguaccugugaaagucaaagcagugagaugaaaguucuagcacagagcuauugcugguagacaguucugugccugaagccgagccuucuauuuauuuauacgcacauauauacauacauacgaacucucccucugucacccaggcuggagugcaguggugcaaucccagcucacugcaaccucagccuccccauuagcagggacuacagguagcacaccaucacaccuggcuaauuuuuguauuuuuaguagaggcaggguuucgucauauuggccaggcugcugucgaacuccugaccucaagugauccgcccaccucggccucccauagugcugggauuacaggcgugagccaucgugccuggccuagucuucuuuuuacuaaaaagugagauuauuaaguguaaaaagaccuacuaguaccaaaugagauuuuuuucuaaacucgauuaugagaauugaaagaaaaguggaaaaauaaucacuucuucugugggugauuuguguuauuugcugcccaaucuggguuccaccuaaaaccgucucagguacaccacugcgcagccucccagaaccacccaccuccuuccugacggccaggagacaaaggacccuugggcgcgaucagccgcaccuucaggcugaguggccaggaguccucccguggcccagcccaccucucucuuucaggaauucaagucagcauuuuuguugguccggaucugaagccacuucuuccaggcagcugccccugaucucucaacuucauagcauuuuggcucuuuaaaaaaaaagaaagaaaaaaaccaaacgugugacuuucuuugagguguuagaauuauccuccugguauguuguuauucugacuuaauuccgagagcagggcuuugucacacggagcugguaccuacugugucacagcacugcauguggcucaacaggccagggcuuuuaaucgcuuuugacaucuacucucugaagaaauacauuuauaucacaacccaguguacaauacaugaaaacucaacauggccgggcgcgguggcucacgccuguaaucccagcacuuugggaggcagaggcgggcggaucacuugcggucaggagguugagacuagcgugaccaacaugcugaaacuucucucuacuagaaauacaaaaaaauuagcugggcaugguggugcauacuuguaguccuagcuacucgagaggcugaggcaggagaaucgcuugaacccgggagguggagguuguagugagcugagaucacgccacugcacucuagcuugggccacagagggaaacuccaucucaaaacacaaacaaacaaacaccucaacgguucuucucuuacuacacacaaugacaauaaauauuuuguagucuuuuuuuuuuuuuuuuuuuuuuggagucuugcucugucacccagcccagagugcaauggcaugaucucagcucacugcaaccuccaccugccuccaggguucaaacgauucucaugccucagacucaguagcugggauuacaggcacguaccaccacaccuggcugauuuuuguauuuucaguagagacgggguuucacccuguuggccaggcugggucucaaacucuuggccucaagugauuacaggcaagagaaggauaaauaccacauuuaggagaguauuucuccugggaugggauggagaugggucaaaauggaaagugcagacagaagaggaauauaggggcugucuuuuuuuuuuuaaaugcugguugcaaucuacuacuuugauuuuuuaacucacuagucaucgucaucugcaguugguaaaaacauuguuguagaggguuaaagcaugaaccauauuaacaugucccccccccuuuuuuuuugagcaccuauuauaugcugggcacagugcugaacacugucucauuuuguccuaaccacguuuugcguaucaggccacugagucucagagagggacaucacuuaagcccggcucacacagcaaguaagagcaaauuaagauuccagccugggucagccugacuuauuuucauguccuugaggccuuggagcaguucccuuguguaucugcugcaaagccuugcucaacgcucuucccagaggaagugaucaaaugaaggaaucaaauaucaaauugcuauagaaagaaauucuuuuuuuuuuuuuuuuuuuuuuugagacagucucacucugucacccaggcuggagugcaauggcacgaucucggcucacggcacccucuacuuucuggguucaagcaauucucuugccucaguuucccaaguagcugggauuacaggcgcccgccacuaugccuggcuaauauuuuguauuuuuaguagagacuggguuucaccauguuggccaggcuggucucgaacucuugaccucaggugauccacccgccuuggccucccaaagugcugggauuauaggcgugagccaccgcaccuggccuauagaaagaaauucuaaaacagucucuuuaauauuaacauaagccagugcaaaggguucccaaauguggcugaugacuugguuuucuuucuuucuaaauguuuaaggaauuuuuaaauugagguauugcagauuguaaaguguucuuaucuuaaguauacagcucaauggcuuuuuuaccugauacccccauguggccacccccagaucaaggugcacaccacuuucaguaccccagaaagcuccugcauaugccucuucccagccagcacccccaccacggggugaccuaucuccugacuucccuccccuugcuuuagucuugccuguucuucaggucacacacguggaaucauaugaucugaucuguguguguuggacuucuuucaucccaugucccaucugugggauucauucauguggucggaucagugcuucauucuuuuuuauuguuauaguaccugauugggguacuuuugagcuuauuuuuuauuucauagacuauuuuggacauauagaaucauauagaaucacacccaccucccauccugagaagcaaaccuuaagccccuauauuccucuucugucugcacuuuccauuuugacccaucuccaucccaucccaggagaaauacucuccuaaaugugguauuuauccuucccaugcaaguugguaaauuuguacuaccuauguacaauuucuuaacagauccuuugagugaguauaaacucucuuuuucuuauuugguauugccgaguccaauuaaauuuuaauuuaaauguuccaaguguuucugggauucagaaccucagcuccaugcucuagaggucaagacaguuggagcaaaguccagaaggaaaggccaacuggggagaggcaggaggagagcagaguggggagagaagcggagggaggugggugugggagggagaugcucacagcccucagcagccaugaucuggugggggccccugccgcugcccugguuuuucucucaucuuggaccuauggggaaugcaccgugccccucuuucuggccuaauuuccuguguccacuggugccaccucuuugcagaggcagccuucagagggauuugugggggagaaggagcuucuccuuugggaagaaaaugcuugugguccuccauguacccuacacccugcagcugcgucacaggggaagcacucccccaugggggccaggcgcugugcuaagccuuuucccuguacuaacaugugaacccccucugagcaagccagcgaagugagcacuauuugacagccugagaaacugaagcacagggcagugaagugaauuccccgaggccacagcuagcaaguggcagagcugggacuugaacccagaaagggcagcuccaggcucaccaccuguauacucuccagucuauugucuaguggaggcacgggcggcccaggggccuuccccgaugcuuaucucauucuguaacucugcauucucaguggagguuuucuugacucuagcuccaggcaggcagagacugccuuuguuuggcucccauuuuuaucauuagcagagcaggugcuagugauauuugcagaacaggugcugaaugaaugcaugaaaaaaugcaugaauguggaaaugaaaggggaugcagauggagaugaugcagauggagaugaugaugcagauggagaugaugcagauggagaugaugcagauggagagcaguggccaugcagagucuuugcagaccuuggcuuggcuucaggcugugggggcucugcaagccaaggguuugaguuccaccuccagugcuugccagcaaugccaccuugggugaccuuuaucgugcuaccuggaaaguggggaugcuggcagccccucccuccuggcaucacugacacugcauggucagggugugaucccuuuggguacaggcgggggugguggaccucccaggugggcagguccaguuuggaugaaaggccaaggacgauucauaggagagcacaggaguccuugcuuagccccagcaauuccacagaaccugcugugaacugcuggcugcugcccguaacuuuucccugucccuauuuccacuccuuggaggccgcaagaacaacugcuggcuggccuuggccacugccucaguguuccagccucugccgucauuugacaccaagaagacagccaggcaggccuuggcucacugcagagguguuacuccacccccgaguccuagccgcccccuguccucuggguccuggcugggcugggcaggagggcacucaccucucccuucucucucugcccuagcaugaaccagcagaggggcucucaauccuggugcugggcagugggucuagauuucccuuuccaucugcaaauauacccaccauuucccuucccugcauucugcgcucagcagggcuauucacaggaagcacagaggaccucuccuucacagugagcaguugaccuuuuuugagcaccuacugaaugccaaggguuuuuucuacauuucaauuugugaucucauuuguuucucaaaaucucccuaggagggagacguaaugccccuccccauuuuacugaugaguaaacugaggcuccaagagauucagccaguugcuuagcagagucaggauuugagccgaaagcuggguugucucuacuccccuccaugcugcucugcagaagagagaagccauagaaagcucaggaauguagugacagucgcagcgcuagcgaugaugauaaucacagcucacauccaccaugcgcuugcuacgugcugggagcugccauucaagccuuacaugcguuucugcauuuaauccuuacuccugugagguaagcaguauuuuaaccccauuuuacagauguaaaacacuggcgguucagagaaaaaucuguccaaagucaugcagcuaaugcaugagacagcagagccccuggcucugaaaauccguggggauugaaauaccaagcacacugguucauccagacagugggauauuguucaggauugaaagguaaugagcuagaaaaaugugaaaagacauggaggaaccuuacaugccucuuacuaaaugaaagaagccaaucugaaaagguucuauaccauaugauuuucacucugugacauucuggaaaaggcaaaacuauggagacgguaaaagaucagcgguugccagggguugcgggagggagggaugaauaggcggagcacggaggauuuuuagggcagugaaacugugugugaugcugcagugauugauacgugucauuagacauuugucuaaaccgaaggaauguacaacaccaagagugaccccugaugucaaguauggacuuugggagacaaugaugagucaguguucauucaucaaucauaacaaaugaacccugugguacaggauguugauagugagggaggcugugcauguguggggacaggcaggauaugggaaaucgcuaucuucugcucaauuuugcuguaaaccuaaaacugcucuaaaaauauagccuauguuuuaaaagagggaaaaaagaaaaacagguucacgaugcacuuggugcuugagccaccacaacccccagcagugaugugcagcagggcguggcucugcacucugcgggggcuucccgggcuggcuuagcugugggaucaucuucuccagugguucuuccaggccugcugucaggugcaguuugaaauccaguucaggagugcaccuugcguggggagcuggagggaggcaaugguugcuguugggugacuagcagaggcugagggaauggcaggcaugccagggcucugccaguguauagacagaucuuccccccuggggaggaggaaggaggaggugaggggggugacaacaacauucuuugguccccauuccccaggacagcgugugcucaggggaggcuggccucaccccugccagggaauugcaaaauucagcuucaguugaaugaguguccuuuggaaaaguacauuuugcucaggagccaaguaaaacugaggacucugcagccagcacacugaagucgcuagccaugacucacaccgagugggauggggagggccaagcugggaggcaagccauggcucucugguggguccaggcucccucuggcgccagaccccucggcugggcucaggucccucagcugggauauuucgugugccagagguagcagccucagauggcuuugucaggguucagacucuccuugcuauuuagaaaagauguugucucuaagaagucauggagaaaaugaaucacuguaaaaaucaaauuuucuuauccacuugcauuauugguuuagagauggcuucucuccaagauaaguuuuugguagacugcagaucaaaauguuuaggggcaucugggggugucaugagaagagccccagaugggacacccguucuuccuugugacauuagggaauuugguacagcuuucuggaucaguuuuugccuuuaagaugcaucuggacucaucaaacccagaaaguguagagcaaauauuccuauucccauguccuuggcagacauugcuaaucuaucucagggcuccaacagaguugggucucagccuuaccagccuggcagccacuagacuugaucccugagaugaaaccucuugaccacacaggaacuccaugaucuugaagcucccuucuggcucuauaacuuuuaugucucucucucucuucuugcuguaucuuucauucuacugacuauucugauacaaaaauacuucacguucaagauuuaaggccaaguucacaaacugauaauacucaggccaaaucugacccacagaaguguuuccuuugcuuugcguauuauuuuauuuuugaaacacuugccaucauuuuuuaauuggugauuuuaccuaauuccccagauuucugguuucacuuaacgggcugcccucggaccccuugguuccagccaugugccaagcugggaggcuuucuauggacuccacaguuugccacaggccacacccagcccacuucucuaauuuccaguuccugccuauucucaguaggcauuuuucuacuccagacaaguauacuucugucccacauguaaggccuggcugucucucauuugcugaugugagcugcuagaugaccaacgcuccggucuguuaacucacuugggaugcugacguuuccuggaaucucuuucagagggaaagguguuuccucucuaugaaucauaacugccugaugaauuaguuuuacauuuuuauuuucucaugugggcuuuccucaaagcaggggcucaguuaugccaugaacuguugaagaaagcacaaguugaggcagauaugggaaauuuagcagggggagcggggagcagagcccuucccucccucucgcagccacucccuuccuccccgccugccugccuggaucuccucugcaaagccucauugcugguggguggugaggaagccaaguggcuccccgaggguacuugccugcacagcucaggugagcucuuggcucaggaaagacucacagucuucccuggcucagcgggccuuuugcugcuuaaagaugaugcucgccacuucagaucacagugccagccccuggggaaccccaagaugcguaagacaaccuccugcccuugaggaauucacagcuuugaggggaagacaccaauaguauuaaugaggcagugugggccgugcuguuguuugugaaugcaguccacgcaugcucagugacaucaaucaucgcaugugcccgguaguaacagggagaccucaggggcugcagagguccccgugggggcacuucauccggccugaggcugauuggagauggcuucucagagaaagggaugcgugagcugaguuuucaauugcccgagaccucugaccucacuggccacuccagcuguaucagccucgcugcuguuccaggaaccugccagauacgcucccugccucgaggccuuugcacuugcugucccuucugccuggaaugcucuucccuggcuaucccuguggcuguugucucacuuaauuccgaucuccauuugcaugucaugaucuccuugucugaugagccccauccgaagggcccuggcauuacacuauuuccuuaaccuguuuuauuuuucuucauaacgcuuaucagcacugacauauaugaguucauucacuguuggucucucccacuaggagauaaucuaggugaagacugggagauuugugucugaccuccgaugugcucccagcaccuagaucagugugugguccacaguaagcacuagaggaugcaaaguacugugagcugaugaaggagagagagggggugaugcagacagauggcaccaagcuggaauagcaguggucuuuggggaacaaagaauguuggcgggcaguggggugagaaggaggggcagauaacacacagccaaagacagaucugcuaagacaggcccugacugugucuuucuuuucauuuauaaccugcuuauuauagaaaaagugacaacacugagaugugccgaaguggaagugaucaccaacuagccucucagccaggcccacaaggaaaacauucugaccccuuuccuaaagcccuuuugccugggauuguguggagaguuucaccuuuucauuugugagccagaucuugcuuucuaaagugcacagcuagcugccugccccuucaggucucuucgcugugcucccagcccagugcaguaaccuuguguucagaugggcgaggacauguaccccagcuuggccacgagauagaguaaccucgggccucagggggccaugaagcuuugcaggaaccuccacccuuucuccuccagccucguccccaugugucugccuguacucaaggccucagucugagucacugucucuacacagucuuuccugaaccucaguuuuauuuuucuguaaaaauggggaugaagcuaguguuuauaccuugaaugguuuugaggaucagauuugaggaucagaugagacaauaugaguuacuacuuggguucaugggaggugcucaguaaauaucauucuccuuccccucuuaaaaucuuaauccugcacugugcuuuuaccccaggccucaccagaacucagccuugacuuauuucucaaggucacugagaguguugucaaaagguggucucaggccaggcuugguagcucacacccguaaucccagcacuuugggaggccgaggcagguggaucacuugaggccaggaguucgagaccagccuggccaacaugaugaaacccugccucuaguaaaaauuccaaaauuagccuggugugguggcacaugccuguaaucucagcuacucaggaggcugaggcaggagaauugcuugagcccgggauggggagcuugcagugagccaggaucacaccacugcauuccagccuaggcaacaagagcaaaacucuaucucaaaaaaaagaaaaaaagaaaaaagaaaagaaaaaaaagguggucucauagcacaaagcaaagcugaaucaauugggcagguggaggucaagggacacuugggguccccaaaaggggcaccuuucacaggcaucuuggcauggcuccuuccccuaaauacuccccuccuaaacuuaaaaacacugacaccaacaguuuauucuuuuuaaaucucugugaaaggccgugccuggcggggagccacgggcaugagaauccaguccccggaauagcuccugccgcucagcguuuaaaugccgucuguauuuuuauccgaugaugggccacuuuugaaaaaccccgcucaugcucugccccucuaagaauacauuuccauuuauagcaucugcacacaggauguuguucuaucccgguguggggccaggaggccguguccuguuuccagugaguuggaaacacuuggggggcccuugcuccccccagcccagcacucccuguggccuugacaagcgggaagccugacucccggccaagcccuggcugccuuuccucuuccugugcaagccugagcucaucugucuguugcagguuggggaggcaagugggggugaggggccccucuccagccuugcccagccagggccuccaggugacacagcaccacaguuccuuagcuccguggacccugcauccuucacucacucacccagugccacggccugcugucagcaugggcccugcauggcacaggagagcagcgaugaguacagagagccaaggcucccagggcccaguggggagcuuuggggaggccagggaggaucaguguucagucuccaggaugaggcuggccaggguuccaguccugacucugcuucuuguuagcugugugagcuuaggcaaguggcuuggccucucugagccucaguuucugcauuuguugaaggaaccucaggaguaguagggaagauucuguggacagaguaggccaagugucuaagcagugcuuggcccauagggugggaguccaggaaaugccaguccccuuucccgucccucuguugaccugugguaacucaggugggugcaggcuaaaagucuuaggaaaucugcuugaaguuagauauaaacacaugccuuacaccuuaggaauucuagcacgcaugggcaucuccugaacugugcuuuucagcaaagcagauuccugcccugcccaccucaccccucaccaguuuaguucauucuacaguggggcccuggaaucugcaaauuuuuuuuuuuugagauggagccuugcucugucccccgggcuggagugcaguggcgugaucuuggcucacugcaaccucugccucguggguucaagcgauucuccugccucagccucccaaguagcugggauuacaggcacacgccaccacgccuggcuacuuuuuuuguauuuuuaguagagacgggguuuuaccguguuggccaggcuggucuugaacuccugaugucagaugauccacccgccucggccucccaaagugcugggauuacaggcaugagccaccaugccuggcuggaaucuaaguguaaccagcuucccacagauucugaggcagugguccuuggaccacauuuugagaaaugcugccuucuucauccauugcacaagugcuucuccugaaccuacucuaugccggacacuuuucuaggcccuggugauguagacagaugggguuccagcucucuggugacauauucugauggagucaggcagugagcagauacacauaacucaacaucagggagugauuuuaagugcugagaagaaagaagagggcagaggcugggcgugguggcucacaccuguaaucccaacacugggaggcugaggcaggcagauugcuugagcccaggaguuugagacagccagggcaacauggcaaaaccccgucucuacaaaaaaauacaaaaauuagccaggugcaguggugugcgcuuguccuagcuccuugaaaggccaaggugggaggaucaccugagccuagggagguuggggcagcagugagccaugaucgcgccacugcacuccagccugggcaagagugagacccugucuaaaaaaaaaaaaaaaaaaauuaaaagaagagggcagaguaagcacaggcucccccgaggagaugacauuugaaaauagacuuaaguaagggagcaagccauacagagaugcaaaggcagaaccuuccagguagaacgguaauucauucaaguucuccagcuguugaguggcagaaagucaagggcuuuccauaccuccucugcuuuuucuuuuacaugcuaucuauaagggugcuuuuuuagcugaaguagcagaaaaguggacuagaagagguuuaaauaagaguuuuuuuguuuucauuuuuuuucucauguaacaagaagacuggagguagcuugcuucugguguuggcucagcaucucaaggaugccagaguuuuuaucucugcucucaacugcacuuuucccuuauggucucagaggaguucccccagcuccagauguuaugucugcacccaggacaggaagaugggguugggguagaaauguuagugccggugaugugugacccuuugauuauaaaaccaaaagcccccuacccccccagcaggcuucugcuuauuaucaucagucagagcaaugguauauggccaccccaugccacaaaggaggcugggaaagugaaaguaagugguuaggguuaaagggaaucagaauccaacaaggucuaccuauugccugugggcuuucuugagacaggaucucauccuguugcccaggcuggagugcaguggugcagucacggcucacuaaagcucaaacuccugugcucaagugauccucccaccucagccuccuaaguaacagauuacagucaugagcuaccacaccugacuaauuuuuuaauauuuuguggagacgggaucucacuauguugcccagggaacuccugagcucaagagauuuuccugccuugggauaacaggcaugagccaccaugccuggccacguccuuuauuuauugaagaaacuaggucauuuauucuguagaaugcccgcauuauggauugggcuuauugaaucauguaaccuguuccugguauuuucuguaaacuggugguuagaucuggagccuugauuaggcucagggucaguucucugggcaagaagcauuccuggguacugcugugugcuuuguauugugucacauugagagguacagaacaacuggcuuucuucucuuugagaugcucagauggaucacugcguucaggcaggcagauggaucacugcguucaggcaggcagauggaucacugcauucaggcaggggcagccuggucuaucuguuaggaaguuuccugucguugcugauuauugucuagagccaggauuucaucaguggaugcacaaagaggauuuuucuaauucucuuagucuuucugcauacauucuuugaaguuauucuauaaaacagaacguugcccucaucaacuauuuggcuagcuagaaauacauuuuauaccaagaaaaaaagucagaguaagugcauucucuuuauuuaccaauuuucagaauaaugaguuggugguguaggaucuuaaagguguccaacaaggcuuguuacuuguuuuuaggaaguauccuuaugaacucauggaucacuuaauguaugggauguauuucaaucacggcuguuauuaaaauguuuuauucagacagcuuuauugagguauaaucgacuuacaauaaaugucacaugucuaaaguguacaaugugaaaaauuugacauauguauacguccaugaaaccaucaucacagccaagaucauggauaucuacaccacaccccaaagcuugcuccucccuguccuuuccgcucucccugggcagcugaugaucugcugucacucuagauuaguuggcauguucuagcauuuuauauagacagaaccauaccauauggacccuaguuugccugccauucagcauaauuaucuugagaaucauccauguuguugcagugagccgaaaucgcgccauugcacuccagccugggcgacaagagugaaacuccgucucaaaaaaaaaaauuuaaugaagccuaauuuaucauuuuucuuuuauuacuugagcuuuuuggugucucaucuaaaaagauaaucuuugccuaaccuaaacuuacaaagauauucccuuauguuuuccucuagaagguuuauaguaagucuggacaucagauccaaauuuguucuuuuucacaguugcuuuggcuguucuaaguccuuuguauuuccauaugaaucuuagaaccagcuugucaauuucuacaaaaauacuugcugggauuuugauuggaauugaguugaaucuauggauaaauuugggaagaaaugccauccuuacaauguugaaucuucugacccacuaacaugucuauauuuccacauuuacuuuugcuuucaugucuucuuuaauuucccucagcaguauuuucaguauaugggucuuguacuuuuuucucaaauuuaucucuaaauauuauauauauguguguguguguguguguguguguguguguauauauauauauauauauuuuuuuuuuuuuuuuuugagauggaguuuugcucuuguugcccaggcuggaguacaauggcacgaucuuggcucacugcaaccuccaccuccuagguucaagcaccaccccccugacacagggacacacacauaaaauguaacagaaugcagcguucugccuuggccuuuuccucuuacuguauccuggagauuccccugugacagugucauuuucccaucuagcuguaucacccucugcguuaugggugaucuguaguguccccuuuggcuggauguuuggaugaccucccgucauuugcuauuacagcuggugcugugguacauagccuuguguagaugucaauuuauauuuucaccuggaguucacugagugcuauuaaugggccaggcccugcgugacccacaggagauucaaggacaaaucugacccagcccagcaagaguggaagacccugcagccagccuggggcugggccggguauaguccccagagccuguggagacuggggagcugccuugggauggggagugugguuugucuggccuuccggaagucaagcagucagauuuacucuucuuccucuuuguccagacuuggucuuugugggaaggaggggaggggaaaggccaagauuuuguggucagaaaggguuaucacggaugggagaggucacauguggggaugauugggguagaaguggaggcugcuggagcugggaggccaugccaugggcaccaaggucuagggagagagcugcagggagaaaaccuuauaugcguuggugacaucagcauuaugugcuauguagaccaggagucgucacccagauuucucauaaauccaggccuucacuccuucaccugccagccuguuucccucuuccaggcaggcauguggcccaggggugagaagaauuguucuacugccagacugugccaguucaaguccuggcccugcaucuugggcaaguaaaacagaaagaaugcuacugucuaccauacaggguuaugaaagugauccgagauacugaacgcaaaguguaagccgaggcuucgugcgcaguaagcccucgcaagggggguagcagcagucauagcugugauuguuacuauuauauuauuauuauuauuccucccucaaaguugcuccaucugggcuggagacagagauggaccuuuuuuccuuuggacagagggagagagugguaugaacucaucuuaguaguaugaaugucaaggucaggauuugaggggggcgaugagaaugauucuagggcucccucccgccugccuccacuuggcucugguguguucauuugccuucgugccccccaacacacauacacgcaugcacacacauacacuagcacagcccccgggccagugguucucaguaagguggagggaaugaguaggugaacaaacgagugaguuuuucgccucacucccuggcacucggcaccgagggcuccgacaggcugguggccagggcugaccagccagaguuucaucuaaaagccucgauggcuauuuuugggacaaaugacccaccacuuccaaugacuugcuccgaaauggcaucuaauuucauuaagccuuggaaacagugacaucacaagugccugcccgguagccgcccacauauggcgaaccacagagugauccgagauucgucugcaagaacaggggagaacuaaggucccaagcagcaaaaguuaaaauagcaaagcugaggcauucugcuaugaaaagaaauuacagaugaaauccauuagucagacauuuccagcggcaguuuccuugcuugggagcaggggaagacguguuuauucgggguugggcucugcagccauuccucacucuguaggcaagauguggcccggaaaguggguuucuguuaaggaaauccuauguucucauugacuuuuagcaccgaccuuccuguacauucucauggaauuugcuguauccuaaggcgugaggaagcuagagacguggauuuggcaccuuuuugauuaacauagugacacuuguacuuaccacgcccuuacaguaagucacaaaguaaauucagacggacuucaucuuuucccuauggguuccuuugcuuuguuuuuuuuccaagugagcgcugccuucucaggcacagagcaaaaagggagggaaacacugccuaacuccagauucuuggucuccauggaggccaucaaggcgguggcugugacaucacccaucgggggcaggagcagcuggaggccccucagagagagcaugggaucaaugggaaaccuucuaugugggagguuuuauuccgcacacaacagagcuucccagccucaacccuauugacacuuggggcuggucauucuuugucguggggggaccuucuugugugccauggaauguuuagcaguaccccuggccucuaccuaugagaugucaguagcaccccacacccagcgacggcccaaaagacaaauguccacugagaggcaaaaccucuccuuacaugagcacuaacaaggauugauuggaaagcuuuuuaguggcuuguguuuauuuauuuacuuuauuauuuauuuauuuuuuggaggcaaagucuugcucuaucucccaggcuggaguacugcagagccgugaucuuggcucacugcaaccuccaccucccagauucaagcaauuuuccugccucagccuccccaguagcugggauuacaggcaccugccaccaugcuuggcuaauuuuuguauuuuuaguagagacaggguuuugccauguuggcuaggauggucucgaacuccugaucucaggugaucugcccgcucuggggcuuguuuuuauuuuuaaaaauuauuauuauuauuuuauuuacuuauucuugagacagggucuuacucugucucccaggcuggagugcagaggcaugaucucagcucacugcagccuggaccucccugggcucaagcaauccucccaccucagccucccaaguagcugggacuacaggcgaccaccaccacacccaaccaauuuuuguauuuuuuuguagagacaggguuucaccauguugccaggcugaucucaaacuccugaccucaagugacccacccacuucagccucccagagugcugggaugacaggcgugggcaccacaccuggcuuuguuuuuguuuucaauacucugaguuuaauugcaccuucaagugagcaaggcacaccucuucuugaggcuuuggcuuucucuucuguaaagcgaacggguuggacacagugaucucagaaucccugagagagcugaccgugaggagcguugagggcagggggcccuauggggucucuguuuggguucugccccagcaggggauaaaccgcgugcccagcuagccccaguccccacucccauucccuugaccccuggcauccagguuaguuuuucuuaaguccaguugguuccucucuugcuuuaauuuuggcccauuuuccuuuuuaaaaagugaaaauguggcuggacgcgguggcucacgccuguaaucccagcacuuugggaggcugaggcaggcagaucaccugagguugggaguucgagaccagccugaccaacauggagaaaccucaucucuauaaaaauacaaaauuagcugggcaugguggcacaugccuguaaucccagcuacucgggaggcugaggcgggagaauggcuugaaccucggaggcggagguugcgaugagcugagaucacgccauugcacuccagccuggaaaacaagagcgaaacuccaucucaaaaaaagaaaaaaaaaaagugaaacugucuaaguauccacaaaaguagagaaaacgguacagggaccacgguguacucaccgcccagcuucaccacugcccaucuuaucuuagucucauguuuaaggcuauccagugggccuuaugcuugugcagauccauucauggacucaguuccccaagggccuagacuggguagcgaggagggcaguagaggaaaggucugggaccugcccuugagaacucauacuccaguggccggggagggcuaggagggaguguuucuuaaauaauaaauauuuauuauaauccguccuuuagcuuucuguguuugaggcuaagcaguccaaaucuuuaacuuuucuuccaaauauuuuccacccaaaugggccugauuuguccccacacugugggggaaaagcaacaggaccauaaauuagaucuggauucagaucucugccguggcacuucauaggugugugagccuagccaagucuccagccucucugagccucaucuguaaaauggaacaauaaucccuaauuugcaagucagucaagacaauuagaugugaacaugcuggucgaaggccucuguggcccuaguauauagcagguuugcuguaagcaccccuuucccuccuccauucucuucacccuuuccuccacauucucuugacggagagcuggucacaacuggucacaucaccgcagcaagggacugacuaaugucagccagggaggacggcucacuuccuggucugucacaugccugggguucucaccagccuccugauaacccauuuucuuagugacauucaugcugacucacuuggcuuguggucaguucugaaacuagggucuuuuugagcucucccuuuaccccaccacugcugcccagcguggcucuguggcgugggaauggagucaguauuacaguacguaguguugagguggccacucccaaggagccagaagcuuugcuagauuggcagcuucaugggguggugucugccuugaucacuuucauuuccccacugucuagaacacugccugguauauuaggugcuuagcaaauggcuguugaaugaauuaaugaauuuugaacuggucccugucuuccaggugacucucaucugcucuggggcagcauccuuggaaaagcagaugagcaaaaccaugagaccuucaucugauuuaccaaaaaaugagcucuaaacuggugauucccagaguacgggcaguggaaggaccaugcccuguggacucagacuuggguuugaauccuagcucugccacucacuggcuuggugacucugagcuuccauuuucucccuggaaaaaugagauaucaguauuuuccaggguuuugugagaaauacaugcaaauauguaugucaaagugcccagcauagaauggaagugauuaugguuaagcaucauuuacucuuuccuuugauugccuucuguagcuuugguccaaaucucaccucccucuuagagcgucaucaucgcccagccugccucccuaccccuguccccaugcccagcaaagacuuacucugccugacacccaggagucaggguuaaaccagcaccuaaaauucagcaccucaaauucaggugccuacaaggaccagccauaugugaagacaacaggcuaaguggggugguggugaugaugaugaugaugauuacuauuagagaugguggucucacucuuuugcucaggcuggaguacaguggagucgucauagcucacuguagccucaaucuucuggucucaagugauucucccaccucagccuccugaguaacugggauuauaggcaugcucuaagugugauuaaguggcaucucugucuuucauguuuuuuuaaauuuccauuugaaauacuuuuuuaacuuuuuguuuugaaauaauuucagacuuuuccgccaaacugcaaaaauaguacagaguuccuguaugcccuuuacccaagcauccccagauguuaacaucuuacauaaucacaauaccaugauuaagagcaggaaaauccauuagacagugcugccggccaaucugcagaucguacucaacuuucuucagguguccccugauggccuuuuucugauccaggaucucauuggauuuaguugucaugucucuuuagucuccuucaaucugugacaguuuccccaucuuuucuugugcuuuaugaccugagugcucuugacaaaugccagccaguuuuuguuuuguuuuguuuuguuuuuuuguagacugccccucacuuuggauuuguuugauguucucucauuguuagauugaagcuguaccuuuuaggcaggaucccccagaaguggugcugugcccuccucagugcggcauaucaggaggcacagggugccgaugugucuccaugcuuccggugcccacugucuucaccugguuaagaugaugccugggccaggcacaguggcucaugccuguaaucccaauacuuugggaggccgaggcgggcagaucgcuugagcccuguaguugaagaccagccugggcaacauggcaaaaccccaucccuacaaaaaaauuaaaaaauuagccaggcaugauggugcaucccuguagucccagcuacucgggaggcugaggugggaggaucgccugagccuugggagguugaggcugcagugagucaucacaucacugcacuccagccugggucacagugagacccugucccuccagcccccaucaaaaagacgaugucugccaaauuucuccacugcacaguuacucuuuccauuuuguaauuaauaagcguuuucugggggaagugcuuugaagguaugucaauauccugucuuuaucaaaguuuugauuuguucauuucuuuauuucuauguauguuuuauccuuucuguuuuauccaauggcuuauaaucugugaugauuguuauuuauuuugaugcucacauugucuauucuucggccagugggaaccccaaguuuuuuuuuuuuuuuuuuuuuuuuuuaaagacagggccucacccuguagcccaggcuggagugcaaggcucaccauagcauuaaacuccuggauucaaaugauccucccaccucagccucuugaguagcuaggacuauaggcacacaccaccacgcccaacuuuuguuguuguuuuuuguuguuguuguuuguagagaugaggucuuguuauguugcccaggcuuuucuugaacuccuggccucaagcgauccccccaccugggccucccaaacugcuggaauuacaagcaugagccacugacugugucuggccucuucuuguccuuuugacauguccuuuucauucuuugaacacuuucuugguuucugacauaagaaggugcuccaggcccaucuuguauuuuuccugcccagccuagaaucagccauuccaaggagcucugacugcuuuaaguagagaauagugauuagaagccaagguuugggugcucguuacacucacugcuauugggcuguugcuguugcuggaucuucucuauggaaagagcuaggaaauguauguauauaugauacguauauauacaugugcauauuucaguguuuggguauauugaaaaugauuaauucauacugauauuuccauuaccacuauaauaccauguuuucaccucccuucccugacagugaggcaccuggccccacuauccuuguacauguacauguuugaccagucucucuguauguaacaaucuccuaucucucucuuccucacccugacugaacuuagacacucugccccgagccacugcugccuccucacccagagcagccucugacuuccaguuuugaaacaaugguucuuauauuuuuuauuuuuuaauuuuuauuuuauguauauuuuugagauagggucucacugugugacccaggcuggaguacauuggcaccaucuuagcucacugcagccucaaccucccaggcucaagugauccucccaccucagccuccugacuagcugggacuacaggcgcacaccaccaugcccagcuaauuuuguucauuuuuuuuuguggagaugaggucucucuaugcugcccaggcuggucgcaaacuccuauucucaagcaguccucccaccucagccucccaaagugcugggauuacaggcaagagccaucguguacagcaguuucuguauuuuuuuaaacugcgaggcccaguuucugcuugucggucccugauggugaccuggacaaaagcugggcuguuagccaccugggguaucgagccccaggacacggcugucaugcuuuaaucugcaugggaacuuuuagauccccugugcacccccucauuucauacucagagaagcugaggcccagcaagggccagggauuuucugaaggucuaacacgaaguugggguggagugaggacgagaccccucccgcugcagcccuuuccugcugcucauuucuccagucuuaggagaacccacaugcccuccccacuggcccaggcuggccuuccuaugacacgaggcggaccacauccucuuccagcuccgcaaggccucuccgcucaaauggucaccgccuaggccccaggccucaugucaucugcagacgcgucucauuuguccuguagaguguuggcccagcauuugagaauggugaacuuccauguaaaauuccacauuuuuggcuucucuuggacacucagaaggucuggccuccugagcccgcaucucuaccuggcaggugucagcuggggcucggugauggccgccugcugguuuguuuucucuccauucccucuccccaccccuaccucccaaauuugcugaccucucacagucucccacaguagaccgcccgccggcccccaucgacacuuggugugagacucccuagccacagccuggcccucaggacccucuccuccagccccgccccaguuuuccguccuccucucccugcacaucgggcuguacccugugccggagagaggacagcgcccagcuucccagauucgguccuacucugucuuugcuucugcuccucuccuugccugggcugcucuuucccuccacccauccaucuucucccccuccugcucugugcacacaucacccccuguaggaagcuucaccgaggaccccaggccaagucagguacccccuccugaguuaauccagcaccucgugaugaggaugccacuaccuucuccuucccuuucuuugccucuaccgcuaaacuacaaacucacugggccaaggguugauuuuuaucuccuugccuaagggccuaaaagaggggguguguuaguaggcacugcguaaauguuugucaaacaagcguuaauaauaauaguaaccacaaauauccacguggcauuucuggggugccaggcucugccuaaguacuuuauaugugcucagucauuugagccucaccaccaugcugugagauaguuacuguuguugcccccacuuuauagacaaagaaacugaggcacagagagguuaagugacggucccagggugguacaguaguggucauaguugagcccaggcaucugauuccacagcacaugcucuuaccucucacacaccucucaguguuaaagcggcccccacuuucugacuaagggauaugaguaaauauggacaggugaguugcagagacccccaaccucccgaccacaccccagccccagcuucuaguacccucaggggcacaagcacaggugacugggagcuaagcaggcggcagagaaagugguaccuuugaacuuggcagcccgcaggaauuuuucuccccugaggucuuaggaaacugagcauguuucacguguaauuagggugagcacacugauucaagcaucggcccuuacgcaagguuuccaaggcauugcgucggguuuagcugggcauacucuuguuucccaaucaccaaagaggaaccgcacaccagccugucacccccaagggcuggagccgccggccucuccagcaagucaaguucugucugagagcugggaugccguguggacuaaggaggguucugucgaucaaacucugcugugggagaacugucugcuacgcagguucaagugaaggaaacgaagccaaguguguggggagccuccccugcgagcucucugcgucacauccuuuacagacacuucuuucccucacuccuuuccguggccucacagggucuaguacuaauggucccauuuuuacaaaggaggaaacaggcuccgagaggugaagucguuugcugaaggucacauggugaacgagaggaccagccgagauuugaaccaggguagucugauuccagggucuuaacucuuaaauagcugaagcagagccagaauuaaaccugugucugucugauuuccaaaacccugaauucucccacuacaccacacgauuucccugugcucuggugggauccauaggaaagaaagacaucugucugcuucugugagggaaagaaaucacacaagacaggaaccagagccaucaccagcugaugcuaagaccgugggcuccuggcaggacuuucuguuaaccucaugccuuagcauucuuaagaagagucuccaugaggcagacagcaggagcuggggggugcagccggaguggaaacaggaggaggcaggaaagggaagagggggaggagaggugacguggagcaagaaugcagcaucgucacauaacucgagcagggcugugcguuuccuugcuuccucuagcgucagagucacccccgauucagggguuccauacauuccauaauuauccagugccuacucugcaccaggcccaugcuaggguuugggaacguggcagggaacaaaaccuaacuaggccccugcucucgcagaaguuacacucugauggaagacccaccgaugagugggagggucaucuggugguucacgccuguaaucccagcacuuugggaggccaaggugggcagaucgguugagcuuaggaguucgagaccagccugggcaacauggcaaaaccccgucucuaccaaaaauacaaaaauuagccaggcaugguggcacaugcccguagucccagcuacuugggaggcugagacacgagacucacuugaaccugggaggcagagguugcagugagccaagauugcacaacugcacuccagccugggugacagagcgagacccuguuuaaaaaaaaaaaagaaauguuaugaagaagagaugacaaggggaugugaucuaaggguguuguggggagcagggguuccaucagagaagcaucuuggagaaaguguccugaaagagcagaaaaacugugggaagaaccaugguuuguugaaccaugugucacacaagccagcaccacugccugcugccuugagacccacccuuugugcccaccucacuccuguuccauuugcucuccacagguuugacaucuacaggaaggugcccaaggaccuuacgcagccaacguacaccggggccauuagugaguagccaaccucuggccaugcccucugccccaucuccacugccugugccugcucucucugugcagaucaucugggccagggaggaaagaaggaaagacaggagggaggaaagaaaugcugagcaucuugcgggggcccuucaagcauuuccucacuuacucucuauccucacuguaaccccucaaggcacaggcaccaucuggaaggacaugaaagaaauugucaagaguagcugccaggcugggcgcgguggcucacgccuguaaucccaacacuuugggaggccaaggcggguggaucaauugacaucaggaguucgagaccaggcugaccaacaugcugaaaccccgucucuauuaaaaauacaaaauuagccaggcauggugguacaugccuguagucccaucuacucgggaggcugaggcaggagaaucgcuugaaacagggagguggagguugcagugagccgagaucacaccauugcacuucagccugggcaacaagagcgagacuccaucuaaaaaaaaacaguagcugccccugggagaggaauugggcccagggguaggaaggagauuuacuuuucucuuuauaccuuaaaaaugauuugaguuuuccaccaaagcauguuuuuauccauuaaaaaaaaaaaucacaaucucauccagacuuuggguucuaaagaccauucuucaauaaaaggaaccauggcuccuuggagaaauggcugauuucagggcuaggcaggguaaagauagaggagccuggagugccuggugucagcaggaccuaggagccaacuugaaagucagccugcagcaguuugaguaauaaaauaaauaaugacauuauuggcuuagaagccagagaauuaagaaagaguucuguggguccuaauugauaucaauaaaugggggagaagagacaaauccauucagaagaauuccaaauaauauacaggcugaguaucucuuauccaaaaugcuuaggacaagugucucagauuuuggauaucagauuuuagaauauuugcauuauacuuaucaguugagcaucccacauccaaaaaccugaaauccaaaaugcuucagugagcauuuccuuugagcaacauguuggcacugaaaacguuucaaauuuuggagcacuuaggauuuuggguuuucagauuugggauacucaacguguauguagcuauucucccauccaggugguggaguuuaauuccccucucuugaguguggacuuaguaacucuauuucaaagaauagagaaugggaaggaaaaauaaggccuuuacugaggaaauauggcaagugccagugaggaaccaagugagaaagguuggcaugaccagugauaagccacgugcauaucgugagccccugauaggaugcauggaggcaucuugccuccaugggaucguaccaaaaaaccacaguucagucuaaucauaggaaaacucacaaucccaggucaggggacauucuauaggauacuuggccaguacucuucaaacauggcaaggccuugaaaaacacaaaagaccgaggaacugucacugauaagagacuaaggacccaggaugaaaaugcaaaguggacucccagaucaguuccuggaacagaaaucuggaguuugugggaaaacuggugaagcccaaauaaaguccguagccaaguucaugguacuguacuaauguucaauucuucauuuugacaaauguaagaugcuaacauaacgggaagcccagugaagggcguaugggaacugucuguacuaccuuugcaucuaugauuauucuacaguaaaaaguuuuaaaaacaaaccaaagccaccuugcaaacaggggaugcuuucgccucauuuucccaaugagaaaaugagcugagagaggugagcugaaauuucacagcucacagaagauggagccacgacucauacucaggugggccuccuugcaccccacaagccccccuagugccuggugugggagagggaacugccccccugauggucccagcccugcugccugagcaggguccugggccgggcagucggucauauuggaguccacuucucccaggucaggccauucucaguugggggaggaccuuggggauccggcugggcuuguugaagcugcaagaugccuuugagagcccugaggaagggacagcacagccccguggcaggaugcaugucacacaggcucuguguucgggcagagcaagguucauccucccauuuagcagcagugugacugagcaagucacuccccucucugagccucaguuuccugaucuggggauuaaaugugucccgggaugugucuugugcagggcacguacuaaccccucagugcauggaugacucuccuuuucuucucacuguccucccggagccugcaacacaugagggccuguggccugagaagcugugcagcuuugugccuugacucccgaggaaaggauauggaggggaccaugagaggaaagagccuugguaguuuaugaaccugauccaaaaaaaucaaaugaggcuuccugccccauuccuaccguccaccaguggcuccauccucuucccucuucuccaucucugcagucucucccuugucugguauguuuaacagucagguguguauuuuucuagaguuuuaaaaaauauauuuaggcuguuuuuuuuuuuugagauggagucucgcucugucccccaggcuggaguacaguggugggaucucgguucacugcaacuucugccucccggguucaagcaauucuugugccucagccuccccgaguagcugggacuacggaugcccaccaccaugccaagcuaauuuuuguauuuuuaguagagacgaggcuucaccauguuggccaggcuggucucgaacuccugaccucaagugauccgccugccucggccucccaaagugcugggauuccaggcaugagccacugcaccuggccuauuuaggcuuugauauaccuauaucacuguuugaaacacaaaagggagcauacucugcacacuguucuuccccugccuuucuucugcugauacauccugggcaccuuuccugccagcggauaaacagccaccacauucuucuuuccagcugugucacauucuguuaucuggcugaccuacggggccuguggccagccccugaggguagacauuccccauucugguuuguuggagauccuuguccauaucuuuuuguauccuuguacaguuauuucuguaagguaacuucccuagaagaggaauuacuggguuaaagaguauguuuuuuuuuuuuuuuuuuuuuuuugaaacuuacaagguccugccaaagggcccuccagggacauggucugauagacaguuucagccacagcacaggagacagcaaauuuccuuacacaagaggaaaggcgugaggcauaggaagccagcccuuagcuaccauuuagugaauaaauauuuauuaaccagguccuugggccaggcgccaugccaagcccugggacugugcugaugaacggggcuuccaucuuuguccuugaggagcacacgacugggcagggcgggcugacuuggacacacaccauuucauuacuuugugaugggugcuauuaauaacugaaggaaagaucagggcauuggagacuuacagcucaggguuuaaauguugccuccuccacuuacgugacugugugaccuuggacaaauuccuugaccucucggagccuugggucucagguccagugcccccuuuggcuggccguaccagguuuccuaccaucaagccuucuccuggggucacauuccuacuguccgaugccugagucaguuucagaagaagucuggaguuagagagccuuagagucuugcccaaacauggacugaaaaaccuucaucaagccuucaguaucagaaggccuuucugguugaaauaguuuuuaccuccuguuguguuuuuuauucauucauucaauaaauauuuauuuuauaccuucucugagccaggcacugugcuagucucugaggccacaguggcauugugaccuggucucuguccuccuccucuaucugggguaaggguaacacacgccaugaaugcgugugaucgggaccuuuggaccacuugagucucugccgaguagacuuggcacuuauuguguccaccugcugggcugaccaggcuuaguccgagccuugaaaaagcacacagauuucaggaggccuuuccaucccauccccccagcucuggugcucugguguggauagaauuagaacccugggacacacgucuacaagcaugaacacggaaaguagcuaggagaccugaacccauccaaguuagcacugaccuucaugaacacauccuguuuuguuucguuuuuuuugagacagaauuucacucuuguugcccagccugaagugcaauggugugaucucggcucacuacaaccuccgccucucggauucaagugguucuccugucucagccucccaagugguugggauuacaggcgccugccaccgcaccuggcuaauuuuuguauuuuuaguagagauggguuuucaccguguuggccaggcuguucucaaacuccugaccucaagugauccgucugccucggccucccaaagugcugggauuauaggcaugagccaccaugcccggcaacacucccuauuuugugccuguucaucauuacagcauccaauggguugucggggcuugggggaggaggguguaaaagauucugaaauguggguccuauaugauccuggucagaaaguugcaagcuuccaaagcaaggauguuuugccugcucaguuuuccaagagguuuaauagccucaguuugcgggugagaaagggaagaacaggagccaggaaauuuggauugauagcugaucucuuccaguggauuuguucagcagcuggagaaaacaauuugaaauuuaucucucugccguucgaaaaugaaggaaaacacggccacucaguaaacugauguggaaccuguuucgacauagauugcugagugagcaaagcacgguggaaaagagugugcccauuacgcugcuguucacuuagggggauauauauauauauauauauauauauauauauauauauguguguguguguguguguguguguguguguauauauauauauauauauuuaaauguccauggauggacacaugaaacuguaacagggaaucgggggcugcagaucaggagagacagacucacuuuuuuuauacagcuggauuuuuuuuuuuuuauaauacgcauuguuaacuauuuuuuucuuuaaaaaauuuuuuuuucucacugucuuauggugcugaugauacuuuuuuuuuuuuuuuuuuuuuuuuaaguaaaaccuuugaaugcuuccccgguacaacuuuuucuuuuuuuuuuuuuuuuuugagacggagucuugcucuuuuacccaggcuggagugcaguggcacgaucucggcucacugcaaccucugccuccuggguucaagugauucuccugccucagccucuggaguagcugggacuacaggcgccugccacaacaccuggcuaauuuuuguauuuuuaguagggacgggguuucaccguguuggucaggcuggucucgaacucuugacuucgugauccgcccgccucggccucccaaagugcugggguuacaggcaugagccaccgcgccuggccaacuuuuucaaaguuugggagaaauugggaguaauucuaguaucccccaugucucagggugguuggagagacucagugagcagucuggggacauccugcccuucacucggagccuaaguucuugagguuccuuuucucagggcuuugccucuaaaacauauggcuuccaguccugccucuccugccaccacacagugaagccaugggccagccuccuugucucacugugccuccauuuccacacccuuaacaugggcaccgccccccucaagguggugggagugugaagugacaggacaucuguuaaugcagucacaacagggcacauaguaagugcccagcaaacacucucuuucuucucccuucccucggaaugcaucuuuggcuguuuguuuugaagacagauagauggcuauuugcuuugaagauagaucaaucaaucgaucaauguuuggcuguuuguuuuagauagguagauaggcagaucgauauauguaaauagauacagacuaagaaaaauaauagagauaacuggcugucacauccgugacgcuggcucugccaguccaggugcaggcugcggagaaugcagcagaaucagcaagagggauugggaagucuucuuugcaggaaacuaagggucaaucaauguguugaaucacuuuccccagaucaccaaacccuucccacaucucucugauguaaguccuacucaugagcugaugcucagguaauuauuaccugccgggcucuguuucaagcucaauccuuguguugcugagauccucagagaagcccuauaaggcagguacuaccauugcugccauuuacaggugaggaaguggaggcacaaagagguuaaguaacucacuuagggccaugcagcaggugagcaguggggccccagcgcaguccuuagugagcucuugcccacuaagugccucugggauaaacucagguguggcguauucagcccucauuuuguauccugggagcugacucucugccguacacaauaccuguuaggccccagccccaggccaggcacuggaacuccagaguauuugucuuucuggauaucagucuagugggagaaacggccacagauaaccgauaaaaugugggacauguucaagcagaggcugggaacacagacaaaagagugaccagcuccaccucugggaguaggggaagcuucccaucaaaagggacaugugagucgggccugggaggaugaguaggaguucagcaagcagagaggauaaccauggaggaggagggaugaugaguccaggcaaaggaacagaaaugaaaggcauauuuagggaauagcaugcagcucucugugggugggugguuagacauuguggggagugucaggagauggggcuggugaguggaguugagggccggacucuggggcacuuguuauguccugcccccaaggagugacuccaagguccacaaaccccagugucuuuaggugccaggcagaugagagaaagacaacagacauggccgaccccagaacucuguucuacacucugcauuuuaaacauauuggaccggccggguguaguggcucacaccuguaaucccagcacuuugggaggcugaggcgggcgguucacuugagaucaggaguucaagaccagcccggccaacauggugaaaccccgucucuacuaaaaauaaaaaaauuagcugggugucguagcaggcaccuguaaucccagcuacuugggaggcugaggcagaagaaucguuugaacccaggagguggaaguugcagugagccgagauugcgccacugcacuccagccugggcaacagagucucaaaaguaaagaaauaauaagcauauuggaccauucuucacuuccauaaagaauuauuucuucucuugaagcaccgcugucuauagccccuucuaaggacaggggcaccguguggauggcaccacagaggguggugagaaacagccacagacucugccucagccucagaaccagagaggcagaagggagugguggggccuguggcaaacucaugggcuccgacccuccgugggaacaagggugagauguucuggagaagccagaaugcuggccuuuuaugugaaaucugcugacuguucaagguggacuccagauugugaaauauguugucacucgagccaaacagaacacauuugugggccaccgguuugcagccucuacuuuuggcuggccuuugcauuaaagagcucuccuggaaggaagcggggccagccccaggaggauugcucaugucggcagguugauccacaccuggaggccagaccaguaccccaaaggcaggggguggggcugcuucauauugaggcucgagucagaaggggcucuggagggucugugggcacagccccacacccuuguccuggggccucuuuccucuucccucuaggcuggucucccuucgucagugcccaccacccuuaacaguuugcauuucuguuguuucuuccagucuccaucugcugcugccucuucauccucuuccucuuccucucggagcucaccggauuuauaacgacagaaguguaagucauacuuucccgauggggcauuccaggauguucugggaccccagacaagaagagggaggggucuuuggccagguuugguggcuaacaccuguaaucccaacacuuugggaggccgaggcgggcggaucaccugaggucaggaguuggagaccagccuggccaacaugcugauacccugucuacacuaaaaauacaaaaauuagcugggcgugguggcgggcaccuauaaucccagcuacuggggaggcugaggcaggagaauugcuugacccugggaggcagagguugcagugaaccaagagugcgccacugcacuccagccugaaugacaaagcaagacccuguuucaaaaaaaaaaaaaaaagagagagagaggagucuuaaaaaggagagcaaguuccaaaccuuccaacuucugucuccaggccuguggcaucgguugcucuucuguuucuuaaaaggacuuuaaagugagagcaaaagugaauauugccuuguuaaagcugaagggaacauuuugguuccauuccguggggguucuccugggcucaaagaugaacagaaauaauuugcacaucucugccaucccuuuguuuggccagugggcuuuuuuucccucugaaucaucacagggucauuugaugugagagccgaagaguucagugaaacuaauggguacagcuuccuaccggagggggcgagguugcugacaucagcgcccggcccccuggacuaacccccuucccauuucucaggcccacacuuggugaggaaucggugcaggcuuccuggcaguggcugacgcagaguuaaaccauuccugauuccuagaauuaucuguugucuggauaaccuaguaaacgcucugggguguguguaacagaaugccauuaggauuaugcagucacgaccucaucggacgccccucugugauggaauuagacccaggagcuuccugccuuuggcacuggcuugaggcuucaaagccucuucauuucuguguuuacagcccggaaagucaucacggagcucggcccuggccacccacucuccugcucaacacuggaauuuucuuuuucacuaaugggauuucuugguuuccuuugccuccacucagccacaagacaauaggaaacuaaauacauagcugcuuagcccaagaagacucucauuauacaagcauuaccaccuuuaguucucaaacagccucaggagggagcugcccccucuuuacaaagaggaaauugaggcccagggagguggagggaccugcccacagccauacaguuaggagcuggcucccagcccugccuaucucccuagcccacauguguuugaccagcacacugaaaggccuaugagacaggagggcuggucucaccuuguuucuggguauaccuuucagcccuccccuggcaugggagaguuugccuuuccuggucacucugauccuguuuuaacccugauggcgccaaagcccaggggaccuuuuacaguggugggaagaguacaagauaaggcauugggagacccagggccaggucucugcuuaauuacuacuuugcugugugacccuaugcaaguugccgaaccccucugggucucaguauugguagccaaaugaaggagaguagaccagagucagagcucccuuccagcucugggagagguuggucugcuucccaagacaugacccuguggccaugcaggguucgaagaagggguuuuauuccccccaggccucuaaugggagauggccauguccaagucaagcaucuuccccucuguacaacucagucacuggacaucuuaggaucacccuaucaugaaucagagcucgaagcagggagagcggcaagagguugagacuugcuaauguuaugagguaccuguuguaugccaggcacccacuggccucugcaggcuguaccccacccucuaggaggggaccugcuuggcuuggcaggccugucauguucugagcaaggugacagaggcacacaugugucaucugcugagaccaggcaccaggcagguggcuuuaugugcugugggcaggacaccagcaggugcaaagggccucaggcagggaugaccugguguaugugaaggcaggaagaaggccaaucagccaggucaaagugagcaagcggagaggguaggagguagagcaggcaggacggagaggggccaggccuucugagcugccagguagaauugggaguuacuucuuuuuuuuuuuuuuuuuuuuuuuggagacggagucucgcucugucguccaggcuguagugcaguggcgugaucucggcucacugcaagcuccgccucccgaguucaagagauucuugugcuuugccuccugaguaacuggaauuacaggcaagcaccaccauguccagcuaauuuuuguauuuuuaguagagacagccuuucaccauuuuggugaggcuggucucgaacuccugaccucaaaugauccacccgccucagccuguaaucccaggcugggauuacaggcgugagccacugcgccuagccugggacucacuucuugaugaugagcucguggagcccagggcuggaccugcacacucacugcucuguggcuccacacauggaggagcugaaaacgccagugguagacacagucaacaagcaaacaaaacuagacuguaucgaucaggggcaaguacuccaaagacaagaacuaaagcagggcaggagguagaaaaugagauggcugcagguacaugauauuuuaugaggaucaaacaagauuauuuagcugaaagcuaacuuaauauagugcggcuauacuuuaauaucauaagguccauaucucuucgugcauuuauucauuuccuacauagucugcaucuaacucuaaaaagguuuuaaggccgcuccgcaccaggcauauaaguacucagggaaugugaauuccuuguccccucuuccgcuuugaguuaagaagaugccucucuugccugcugcugacagcgugugggguggcauucccagcucaucccacaugagguggggcacugaggcaaugggcugccaacaagugaguuuugacgucacagcuugaggcucgagcagguggggccccacccgcagaaugcccgggagcauuggggaagggcccuuccagcaagcccagacaacucaugcagcuucccaagggcagggcugcuucuuucugaagagcacaguguguucccacugcuccccauucccccgugccaggacuuccucucccucucucccagcggcaucccggacgcucugaucccaccgagucccuggagagguacaaagcuuagggaugaggggaggaagggggccaggugcaguggcucacaccuguaaucccagcacuuugaaaagccaaggccagaggaucacuuagcccaggaguucgagaccagccuggacaacacagugagauccugucucugcaaaaaaauuuuaaaaacauuaguuagccguggacacacacaccuguagucccagcuacuugggaggcugaggugggaggaucacuugagcucaagagauccaggcugcagugagccaugauugcaccacggcacuccagccugggagacagagcgagacccuaucucaaaaaaaaaaaacaaaaaaaaacaugaggacauuuuuugagcauuugccuugaguccaacccugugcuaagucagcggcuggagagagggagggaggcagagaugaauagagagaucuguccggagcugaggccagaugcuccagcuaugaagaugcagugacccuaauguccccuucccuccuuacuaagguauaggaguugcccgaagggccuccgcaggaugagcccuaagacuuacagagcaaucgagaggagaaagcaucacaucuuuggggucuuccaguugucagaagcuuguggcccccaggaagcccuacagguuugggaacaacugaaggucacaguucucgucuucuggguggcuggcccucuguggcagguuuguggccacaguggggucagugcccccucccgccaccaugagauuguaacuuaaggaaaugaggucaccguugguuggaucaacauggcuccagccccagccugugguuaucagugacauaagacgcuuauucuggccugggccugguggggggugagggggaggcacauuuguuugggugguugggcuccaaccuggcuuuggacaggccguuaauuauccuugggaaagaggccccacagaguguucugaaacuccguguuuucagggagcaggccccuccucaggcaaccuggccacagaauguuccagccucugacugcccagucucugacugcucugaauaauuauuaaccucaugaggauuuauacuaauaaaauauaguaacuggaacucuccacugauaguuuauaauguaauauaacucaugguaccuuccauacuauaacucauggauuuauagugugcaugccaacaccuaggucagcacuuuauuuuuauuuuuauuuuuuguuuguuuguuuuuugaaacagggccucauucuguugcccgggcuggagggcaguggcucaauuauggcuuaauguagccucgaccuccagggcgauccuucugccucagccucccgaguggcugggacuacaggcaugagccaccaugccuggcuaauuuuuuaauucuuuguagagacaggggucucccuguauguuacccaggcuggucucaaacuucugggcucaagcaauucucccaccuuggccucccaaagugcugggauuauaggcaugcaggcugcccccggcaggucagcacuucaugauggucaucucauuggucaucgcagaaccccuugaggcaacuacuacuguucaccccauguuacagcuggggaaacugaggcaccaggcggccaaaaccacaugaagcacuaagugguguaacuggagucaaacacgggucugugaugcugaagcccaggcucagcaccuccccucuguuguaccccacuucccuggccccagcauuucagggccccaggcucaugggagccacugcuuuuugaucagaauaguugacuggaggacuuggaugcacccuucuagggugagguggccaaacaggcagauggaagccugggaggugggagcuuggaggucaccuggaggucacgguguucucacaggcuccccguaggaggcccggaguggggagcaguggcuuaaccaggaggaggagcuggaagucuccagguugccugccuugagccuggguugugagccaggcuggguagagggccccaggcaucccauuaaggagcaugaaggacauugcucuuagcaauaggaggccugagggcgucugaguguggagugacggguuuaugucucagacagcucaccccuugugaagauggguuugguguggggccacccagaggccaaagcccuggugggagcugggggaugacccaagucagaggggccgagggugcugggacuuuggcuuuggagcaggggugggcagaacccggugacuggcugucgagggauguauuuuagacauccaccugguugguaauagaugcacauacuuuuaccuggacgacucaggauuugaaacucaaggcuccggagcacgugcuugcagaaucuccaucccucccuccaccccaccccaagcccuugcggcaggccucaccgccgccuaaguuuccauucgaucaaauuuugaagcauagaggucagagacuucaggcaggaaucugaacuauuuaagugcucuucaaaaagcaaauaaaauuguuuuguauagaugucaucgaacucaugccucagacuagaauuucaaggcccuccaccacauuccauuuacacuccccccacccacaccuccccaggcccuugcguaccucucccuacaaggccacuguccacccacacccccacccucccacgcacucgccugacucccugacgccaucuggcgucccccaccuggaaugugcucccgacugcuccaccagcgcgugccuucccugcauccugggaguucugcugaggacucccuccuccacucaggcucauuccacugaaguuugugagcacacgcucugugcugaggcucagggagcccucguccuggggguguugacgggagugggagaggcuugugggacagacgcaacuggaccccuaagcaccccuguacccugcaggcaccugggcccuggugggaggggacacaccugaagauuaugaaaaaggacuaggaugccugcaucacauguccacugagggccaccggccccucagcuuuucaccgauucccaucccauccaggcagugcaaugccuuggaaagagcaugggcucugggcccccugucccugggcucagauccugccucugccuccucuugguccuaugaucuuggccagccagcugugcuccucugagccugguuucaucgacgugaagggagaauaguacccuuauuaaacacuggaucaacuccuugagcaucgauauuaauaauaaugauaaaaaccauggacauuuauugagcacuuacuguuuacuaagaccacacuuagcauugcucuuguucucauuugaucuucucagcaaccccauagcaaccccuaugauuguccccauuuuacaucuggggaaacugauggaugggaagccccuugcccaagucaaucagccaagagguggcagagccaggauucgaacccugguagccuaggcuuugaacccugguagccuaggcuucgaacccugguagccuaggcuuccccugcacugcuguauuuucuuuaccaagaaggguguggaaucggcccucaagagagagaugagucucacacauacacacacacacacacacacauugacucacacuaacauacacacacucacucacucuccugcccuggggcagccaacagcuugaccuggcagucauccagcagcccugugaaguagacggaaucuuuauccuuauuuuccucuuuuucucuccuuuccucucucccuccuuccuuuccuuucuuauuuucuuauuuuagugagguauguguaacuuacauacagcaaagcauacaaauauuaagguagaggccugaugaauuuucaccuguguuuacacacguaaccaucacucugaugaagacauaauacauucugucaccaaagaagggucccuugagccccucccagucaguagcccccaccacuauuauucugacuuccauugccauagauuaauuuugcugauuuucgaaccgauugaaagcuuuuccaguuuuacagaugaggaaacugaggcucagagaggugaagcaguguguccuaggucucccagcuccuaaguggcagagccaggaggugagcccacaccggucugccacugcccccauaggccuucccacugcccacacuggugacaggggagucaggcccauggaaguccucaaaccacaaugaauccacaaaaaacauuuccuuuucuuccagguggguugauuucuggcagcccguuggccuuuuaaaaucaguucagcccuagccaaugaaguuaguuagccuuggcaggccccugccauggggugguugugggugagcucguggcgcuggcugggguggcaggaagccagcagcccuggaacauuugccuuggacacgaaggcgaaggcggcuuuauugaccucaucaggcagcccaggugauugaauuguguuuaucucacagccuggggcccuccaggaaggagccugggagcagccaguucuggccuuacauaaccagccuggccagagcgccucaggccgucccugcccagcaccgcagcccccuuguucuggguggcccucuagcccugcggagccuguucucugcuuauucugguuaggaagacagggacccacgccugggagaggcuucuuggggccuugugggugagcucaccuuggcgccacaccugggauucacuuugcucuuggcugaggucaccuccagaggguugccaguggaugacaucaucccacaaucccucagugcugugcggaggcccagccucgccaggugggaaaggugaguugcuucaaggaagagucucaggcagcuuccuggcugggaagggaagcccaggcucuccuuaguugacuguguguuaaucacccagcaauuucauuacucaacagcucuccagaguugcacauuacagcugggguagaaauugggugcugaaggccaggcagagcauuuggcuguagggaggccgauccuccucgggccuguuaccggcgggucuuuguucuuagaccugggguucuuggccucacggauuccaaggaauggaacguugggccaugcggugaguguuacagcucuauuggaagccgugggucacggaagagaacuguggaacccagcgacuagugugcagcucauuuaggacaaacccgggcacuuagccacgcaggaacaauggccagccucuaguccgaucaggagcggcaaugggagccucgcugaauaagcacagcggacacccugccggauccagagggguggaagucagcggugggucugugacgacugcgaucagcaccacgagcuaaagcucagcucgagccggaacacagaccagaagaguguguaguugcaagacuuaauagagugaaaacagaacucccauacaaaggagggaccaaaaggggguugcccaauccagcucgaaugccuggguuuauauccccaucauugucccucccccugugcucucaggcgauagcugauuugacuguuucuuuaccuccugcuuuuagccuaauugguauuucagugagcucccuuuacuaccugauuggucaggugugagcugaguuagaagcccgguguuuaaaggugggaguggucaccuuccccagcuaggguuaggaauucuuauuuggccuaggaaauccagcuaguccugucugucauaaccuccugggcuccuguuugccucucucccuccagcuccuuugcucuugguggccucugauuggggccaacacuacaagcaaggucaagcgcagguccgugucuccccucucccauccuaaggcuucccaggaccagggcccuccuucauuuucuuccuugacccugaugcugaggagagggcugggaggcagccugagcuguggaaaggcuggguugagauucuagcucggccauuuccuagcaugugacuccggggaugggacacacccucuccgagccuguucccugguuuuaagauggggcucagggcauuucacaggcgcacaugggacagcaugaaugcacguaguaggccucccccagcuuaacgaguggaggcccaucuguugcacucuugucucugggaauauccuugugggccccacagagaagccccaggugucuuuucagagcccaccguuccuugugaacagcaucacaccgggugcuaggggcgcaaagauguggucuuaguaaaaacgaaauuccuuugccuuggucugacucauucuuucccuaagauguggccauuuacaaagcucucuuggagucuucauugcuuagauagggcaguucucuuuuauuuauagccuagggacuggacccaaggggccuaauaaauguuuaaaauaaccacagcccagccaccugaagcacugccccuucagccgcccccuaggccaggccuuuagauuugguucccucuggguggggggcauuaucggggaaucagaugcggccaucagacauccagcagcuacuuggggaugccucaagacaccugggcucagcacagcuucuggcacucagcaccucucccuccugcugguccuguuccucuuccaagggcucucagcccaaagaauggguccaggaagaaacacagcagugugucugcauuccccccucaccucacccuccuccgcccagucccauccaucagcaagucccgccugcucuacguggguuccuacagcccuccuccucuccauucccaucccaccccauccaaggcgccgccauccccugccuggucucccucuugcacagcagccccuccagugggucuuccuugcagcagccagagggagcccgugugagugcgagccugaccccguggcugugcucauaucaagccuaaaggccucggccaggcacgguggcucaugccuguaaucccagcacuuugggaggccgaggcaggcagaucaccugaggucaggaguucaagaccagccuggccaaccuggugaaaccccaccucuacuaaaaauacaaaaauuagccaggcaugguggcgcaugccaguagucccagcuacuugggaggcugagggaggagaaucgcuugaacccgggaggcggagguugcagugagccgagaucgcgccacugcacuccagccugagggacagagcaagacucugucaaaaaaaaaaaaaguauaaaggccucgugcagccuccuuacacugcaaccacggugaccuucauucaguuccccaaagcagccaugcccuccccaaccuccaggccuuugcacaugcugccaggaugaugccuacgcaucccccagaccucaaucacaccucagagaggucuucccagccccuucuccccaaaggucaguggcccuguagucccugucauggcccccugcagcuuucugucaaguacuaaucagcguuggggguggcagcauauuuaggggcugagugaugucugguucuugugucuauaagcuugaagaagguagagacagcaucugucugauucauugcugcuucuggcuccugacagguaguagguacucaaaaaaguauuuguugagcaaauuuggauugcuaacagaugccaacacugugcugcugacagcaaggugacauggcugucuguggagccaccugccccuaaauauggccgaugcggucgacagaauaaugacccccugcccccugugaugucuaggucccugucccugauguguguggccguguuaccuugcauucaaaaggaacuuugcaaaugugauuacauuaaggaucucgagauggggagaggauccuggguuagccagguggacuggaugaaaucacaagaguuccuguaagagagagguggaggccaggcacaguggcucacgccuguaaucccagcacuuugggaggcugaggcgggggcggggggggggggagagaggggagggggggaggggggaggggggggguggaucaugaggucaggaguucgggaccagccuugccaauauggugaaaccccaucucuacuaaaaauacaaaaauuagcuggagugguggcacgcaccuguagucacagcuacucgggaggcugaggcagaauaauugcuuggaccugggagauggagguuggagugagccgagaucgcgccacugcacuccagccuggguaacagagugagacucugucucaaaaaauaaaaaaagagagagguggaggucagagaagggggaagcugcuggcuuuggaacugggagaaggggccacaagccuaggcagcgccuagaagcugaaaaaggcaagaaaaugcauucucccaagaacacagcccguuuuagacuucugaccuccaaaagcauaagacaauaaauguguguugguuuaagccauucccguugugauaauuuguuacagcagccacaggaaauuaauacagccgucaagucguuucucagaaccgguucugccccuacggaugggcaucagggaauuccuggcuucccggcugggggaaggggaccucaagagaggaggcuguaagguccucugugccugcuggcgccaggcccugaucccuuauaagaccccuauuucucauuuuaguguucaaaccaccuuauucguagugggugguguuauccccacuuaacagguguguucacagaggugagcauaggaagugccagaaccagaauuugaacuugaaucugucugaaagauaugcucuuaccaccgugcuaucugaccccaccccuucucuuuccugagccccagcccuccccucuuuuuuuuuuuuuuuuuugagacggaguuucacucuuguugcccaggcuggagugcaguggcgcaaucucggcucacugcaaccucagccuccuggguucgugauuuucagccucccaaguagcugggauuucaggcaugcgccaccacgcccagcuaauuuuguauuuuuaguagagaugagguuucaccauguuggucaggcuagucuugaacuccugaccucaggugacccacccaccuugaccucccaaagugcugggauaacaggcaugagccucugcgcccagcccagcccucccguccugagagguaaggcugcacuugaagagugcagccuagacccgugccugagggcacaggaggugcaggcucugcccagguggagucuggguuaucuaaguuguggucaccaagugaagugauccccggcugucccccgcagcugagaucuuugccgccaucucaacaaagguuccuauacuugucuuuccccuagugugaacgagcucuaugucgaugacccagacaaggacagcgguggcaagaucgacgucagucugaacaucaguuuacccaaucugcacugcgagugugaguacuccacgcagccccucccuccagcaggacaccuccuuagggcaaaugugugugugcagaaauggcaagaucuccaggacaagccaagccaacauaugguucuccccacucuuuuuuggaggagaauauaauugcguaugcaugcacuuggagguuuucuggcauaauaaacacaagacacuacucauagggguuaacccuggagagcagcugauuuggugcagggaggugggaugucucuuagggucauguuacagcuucgcagcagagccugagagucucaugcaagugacuuguugaggggaggaagcuguaagggagaaacgcaggauagggcaguacgacaggauaagcaaagauguguguucagcugaaguccaaacucagccugaucucacaggaugcuguggggugugaaugacaccauagcauuugucacacccaauagcaaugggaccaggcuguuauuauccaugucauuggguaauggcugcagaguggugugcguggcaggggucauaucaccucccaagcaucucaagcgagaagaccuccggucagccaagagcauucaucuggagaagggcgcagcucugagucauuggcagcugacaccuagagaagcuggagcgguccaccauccaugagagagugcaggacagggcucaagagcaucugcaacagugaagggcugggagauucccuuuuugacuucacaccuauuuuguuuuaaccaaaagaaugaauuacuucuuuuuuuuuuuuuuuuuuuuugagacggaguuucacuccugucacccaggccggagugcaauggcacgaucuuggcucacugcaaccucugccuccuggguucaagcgauucuucugccucagccucccgaguagcugggauuacaggugcgcaccaccaugccaagcuaauuuuuguauuuuuaguagagacgggguuucaccauguuggccaggcuggucucgaacuccugaccucaggugauccacccaccucagccucccaaagugcugagauuacaggcaugagccaccgugccuggcccagaaugaauuacuucuacaaaacaaaacucauuugaagucugauuuggagucagauccuggcuccuuugcuggcuaaaacugugaccuuggcuagggugaccucuccgagccucagauuccucaucugcaaaaugggcuuaguaaugucuguugucugagguucuugggagaaucuaaugccauggucccuagacuugucagcgaguggacugggcgcccucuccuggacugggguuccagccgucccucugcccagccuggcacagagccugcugcaggcccuucucuccccacccccucuuccuguuaaaggacacagcugagagaacacugggugcaucuccggccagagauaggaagagucucagcccugucauugcuuuuggugagauuuacgucacaauuuugaauccucgcugggccccaagccagggaaccuguugaaauaggucggucuuauuuuuuguuauuuuuuuucuuucacuuagaaaaauaauucaucuggcagauucucauucaggagugacuguaucucuggaacaaggaaauucuuagucagaccagaggacugggacuagugugguaggaaagggaagagaugugguuccaggaggggccaggcaaccuccaccccauucccugccaugcccugcuggaucuguggggcuauaaccugaacccccaacccccucaccccuguuagagcccagcauucuggcuuuucuuuaaaagaacuucacauuuuuauuauaggaaaaaacgcaugcucaucauuguacuucuggaaaacacagggaagcaaaagagaucacccauaacucugccacccgacagcaguguuggugacauuuugacaucauucuguccagcuggccuuccuuucuguguuucugaacauagcugagaucguacugcauguaugaucucauauccugcuuuuaaaaauaauauucuucauuauacaacuaauagacuauauuucaaucuuaagacauacauucaaaaauacaaaaauaauauguuuuuuaaaaagcaaaaguaccccuccccugucccccuucuugucccagcaugccaucuuccccaaaggacaccucugcuagcagguggggcccccguucccuaccccuacaugugugugcgugucugugaacauauauuggguuugggguuguuuuuguuguuauuguuguuuuuucuuuuuacauaauuaauugggacccuaccauaugggaaccuucuggaguuucuuuuuuuuuuuuuuucuagcuagugucuuggagcuguucucauauuacucauaauaugaguaaaauaauaacagcugccauuuauuccauucuuccaggccaggcccuguccugcguccuuuggcuauauuaaauccacugggauuugagguaucuuagcagaauggcugaagggugggggcucagaagcaaauccaccuggauuucauuccaggcucugcuguuuccuaguggugaggucucugugccucaguugcccuagauguagaaugggacugauaauauuaucuuccccacagggguguuuaaaugguguuuuguuuuguuuugagacagagucucacacugucacccaggcuggagugcgauggcgcgaucuuagcucacugcaaccuccgccucccggguucaagccauucuccugccucagccuccugaguagcugggauuacaggugcccgccaccgugcccggcuaauuuuuuguauucuuaguagagaugggguuucacuacuuuggccagguuggucucaaacuccugaccuugugauccacccgccucagccucccaaaguucugggauuacaggcgugagccaccgcgcccagccaagaagguguguucuuauauaaaaggcacuuagaagagagucuagcacguaguaagugcuauuuuacuuuucuuuucuuucuuucuuucuuuuuuuuuuugagauagaguuuuucucuguugcccaggcuggaguacaguggcaugaucucagcucacugcaaccuccaccucccagguucaagcgauuguccugccucagccucccaaguagcugggauuacaggcaccugccaccaugcccagcuaauguuuugugguuuuaguagagaugggguucgccauauuggccaggcuggucucgaacugcuggccucaaguuauccgcccaccuuggccucccaaagugcugcgauuaccggcgugagccacugugcccagucguuuuacuuuucuuuaacccucacaacaagccugugauagaagaggaaacugaggcacagagauuagguaaccugcucgaggucucagcgcuaguaacucagccacugaucugcucugagccuccuccacgcaccugcauuuagcccauucuuuguaccugccgcacggcacugggaagagggcuguuccacuggcuccagugauaagcaguugaauugcuuccaguugccacuauuucagauaagguugccugagcagcuuugcacacacaucuggacacacauuguggaucuagaggacaggcugccaacauuggaacugcugagugaaaagcggaccugcuuguguuuucucuaaacuucacauuauaccauuggcauuucccauguccuguggacccgugagggucauuucgaauggcuccagcacguucccuucuauggcuggauccucacuuacuucucuguccucaucgaggaacacagaguuguucccaauuuucccuuuuaagguugucccucuuuaaaauugcuuccagcuguucuuccucuguauggcaccuccuuucuagcgcuccugccagggaaauuccuacauuuccauaguucacagggaucaucucaccacuggcuacuuggaccaucucuggggaugcaguuggcauuggccugcccauuuuacagauggggaagccaucugagucccagugaggugacagagggcagggccuaucuuuucccuuugugcauuccuggugcuuaucauagggcugguagcauaggcgauggguaaaggaaggugugaaugaaugaauaagugaaugauggaugaauggauggggggccugagccuauucaccccauaaacccaaaaacucucugaaggccaggaacgguggccuacacuuguaaucccagcacuuugggaggcugaggcagguggaucaccugaggucagaaguucaagaccagccuggccaacauggugaaaccccgucucuacuaaaaauacaaaaaaaauuuuuuuguauaggcgggcaccuauaaucccagcuacuugggaggcugaggcaggagaauugcuugaaugcaggaggcggagguugcagugagucgagagcaugccauugcacaccagccugggcaagagagcaagacucugucucaaaaaaaaaaaaaaaaaaaaaaauacaaagacuaucugagauacaagagcuaacauuuauuaagcacuuuccaccuagcguucaucagacccuaagcauuuucuacaucuaugaacuauuugauccccauaaucuuucaaggaggguucaauuauggucagccccccaucuuacagagaaagaaacugaggcauccagagguuaaguaccugaggcaggacccagauucagaggaccaguauggcagaccccaggguggccccgggaccccuacuaugcacugccccccucgccucacguuuagcggagucauuguccuguccccuguagucuuuggaccccagaccaugagcuccuggagguccccagcccggccugccccugcaauggaugaaugaaggcucccagagagaacaggcuggcccccauccucccgcgucucuggguuugugacuguugucucccuuuggcuccugcagugguugggcuugacauucaggaugagaugggcaggcacgaagugggccacaucgacaacuccaugaagaucccgcugaacaauggggcaggcugccgcuucgaggggcaguucagcaucaacaagguauggaagcccugccucagcccuuucuaccugcuccccuuuccugcugucuccccgcucccuggaaacugguuguggaggcacucacucgaccugacccugacacagcccccagcaagcgaggguucguguccagcugccuggccguuccugcugagaaucuggauggggguccaggcucccugggguuuuaagccccugauggcugguucaggaaggagcuacucuucucuccagugagggggacaaugaugagaagaccugaggauuugcagcccccagcccuggguucaagucccagcucuaccccuucuuggccccuacaagucacuugacccaucuuaggcugagggugugauggcgauaauaguaucacgauaccacccacuucacaaaguuuguguggggauuaaaugagcuaaugcagauucauucauucagaaaaauuuuugaauggcacguucuguguuccagggucggugauaggcucuggggcagcguuccugggcugguggggcucccauucugguagagggagacagucuacaaaccagaaagcaucagggaugcuaagugcagugaugaggaauaaagccaaggggagugagaugaggugggcuugaaaguaccuuguccgcucagaaggaccauucaagguucacuguuguuuuguccucagaaccaggagcuucagauccuaagucaagugggugaacgcagugcccuugggagggccgaggcacccgguggcagcuggcaggguuuugcucagcacgugccggccuuccucgaagcucgguacugucacaguggagccucucaacaacgcugugaggcagcaccauuugacagguuaggaugcuggggcccagagagguuaagugucuugcccgaggucacacagcuaucugcaugucccacaacuccccuucccagccccagccaaacugagccacuggccacuccuggcuucuccuugucccuccugcagccucugcucagaacgcccuuccuccagacccugacaccugagcugggguugcaaagucacuggccacauccagcccaaagauaaauuuuguuuguccaguauagcauuuaacugcaucagaaccaguaugaaaagaccaggaauccagauuucuggcuuuuaaaagucagaggcucucacuacacuggguccguguucccgcuaugacaaugaccuggcaccaaugggcaguguuccccuuuagagagggugugugcugucccuucccacagucccuggcaggcggcuggaaggccaggccuggucaucugucaagcaggguggacuucuuacgugacaguucagggcucccuuaagugcuaaagcagaagcugcaaggcuuucuuaagguuucgaguguugcugggagaaaucugcugcauguuguggguuaaagggagucucucaccagcccaggcccucaggaggaggagauaccaggaggcagggaugcugggggucgugguucacugggggcucucucugcccaugagcugccacacagcaccuuugccaugccccguaauuuggauuuuauggugguugugauggaaagccauuugaggguuuugaacagggaggcaauguaaucagauuuaugccuuagaacuggacuauccaauagguugccaccagccacauaaggcuauuuaaauuaauucaaauuaaauguacaauucagucacucauucucaucaaccacauuucaagugcucaaagccacgugcuggcuaggggccacagcguuagacagugcagagagaaagcacuuccaucgcugaggaaaguucugcuggaccgcacacccuuagaaggauggcucugguggccgggcgcgguggcucaaaccuguaaucccagcacuuugggaggccgagguggguggaucacgaggucaggagaucgagaccaucccggcuaacauggugaaacccugccucuacuaaaaauacaaaaaaaaacaaaauuagccgggcgugguugcgggcaccuguagucccagcuacucaggaggcugaggcgggagaauggcaugaacccgggagguggagcuugcagugagccaagaucguaccacugcacuccagucugggcgacagagugagacuccaucucaaaacaaacaaaaaaaggauggggcugggcuggagaggguggcaggcagugguuguggcaguggagcuggggagauguggucggauuagggagguagaaucaauaagacucagugaagaaucggauguggggguaagggcacauguggaagcaaagaaaccuuugacgucuuugucuugacaaccgggugguccuguuucuagacauggaagcuuagaaaagccuggagucugugggaaguagguagggcugggcacuggucauuccacucugguuuccuuugggguucccauuaggugucuacagggagaggugaaauuggaaguuggagguguggagaguucaggagaggguucuggaccacagauguugaggugggagucauuagugaauagaugauguuggaagucauggguccucagagugggggcuccuuaagccuccaggccagcagcaucagcaucaccugggagauuguuaggaaugcagauucucaggccccccuaagacccaccgacucugugcuagaacaagcgccccucagagauucugaugccacugaaguuugaggagcauugguuuaagcaagauuaccuacggagaggcuguagauccguguucuaaaccugggguccacagacacccccaagaagagcggauugaaugcaagagaucuaugaaguuggaugggggaaaaauugacaucuuuauuuuugcuaaacucgaucuaaaguuuagcauuuccaucugcgaugaauguaggccacaaaccacaguaguauuagcagugccugggaccuccucaacaacagaaauugccgguauuuauagcacguuacaguuguugcagauaauuuccagagacuguuuauaugcaccacuguuuuaaaauuacggugauuggccaggugcaguggcucacaccuguaaucccagcacuuugggaggccaaaguggguggaucacuugaggaguucaagaccagccuggucaacaugucaaaacccuguaccuacaaaaaaauacaaaaguuaaccaagccuaugcuuguagucacagcuacucgggaggccgaggugggagggucuucugagcccagggagguagaggcuucagugagcugagaucgcaccaccacacuccagccugggugacagagugaaacccuuaaucaaucagucaauaaaaauuacaguaauuauuagacccaccacuaggucaucuuauuugaugcaucaguaaagcagcauauucaaauguggauuuuuaaauauuuuaauuacuauuuaaauaucucuuuacuuuguaauccuaugcauuuuacgcauuaaaacauuuuaagcauuuaaaacguagguaucauuagacuggcaaaggaucauccguggcaccaaaagccuuaagaaccuaaggucuggagagaauugcaguuugaggacugaguucuggcgccccgcccagucacuucgagguggggagaugcggggguaacaaaaggugcaagaaggggcagucgaacaggaaggaggaagcaaaggcugggcggaaccugcagccuggaaaagaacauauguauagauaucaaagagcagggcuggcgcuaccaggcucaggaaggcaggcuuggaauggacagugaucuaagugcugcagagagugcuccagaaaacgcugaugaugaggagagaaggggccgcugcaggagccacguccuuacgaagcaaugggagccagacgcaggccacaguuggggguuuaaggccuuggagagguucacagugccggcaggcaggugggggguuggugggggaccucugcugggccuccauacccucccucuguccccaccucauccucuuggggaaccacuacucacccacaggccucagcugaugugggucccucaggggaaguccucccuccccuucccugcccacccacauucacuccccaccacgccccucaucacgcugcggcugcugccugugccuccuccuugacuuggccucucccuuugaccacuccacucaggcuuucgugcuauugagcauccaccucacgccuggcucugugcuuggcgcugggcugcaaugggagagaaacagccaugcuccccgccguugguggcccauguucuauaacggggggacagccagugcucagguaaacaggaaauaugugauuuugauaaagcagccgugaagagaaugacggggugcugugguggagaaugaaggaggagaccccugagguuacaaaggaagcccugucugaagacugaagaugaagaugcacagaugaacagacguacacgcacaccuccucacugugggccccccgcccccggggagaugcaaccaccugggcugaaaaaauauauguaccccagauggugaccaagaagggaucgugcuuauucaagcaccuggagugacaacccacgagacagcccugccaccaagcccucccaccucuuggcaaacacgcccaagacugcagucugcuccccuuagaaugggcugugcuggagcccccagccagcucugggugaacuuguccuuuggggucagacagaccuguggucaaggaucccggcuaccauggucacugguugaaugacucugggcaguuuagcuucucugagccucagguuccucaucuguagaauggggauaauaauaccucacaggcugugaaacaugaacaaacucugcaguagagacuggacaagcauccuggccugccucaucucccgucagugcaaaguuuccaugaccucaucagcuggcacccaccuuacaagugcgccuguggaaggcacauggagggcguccaagaaaugggccuucucuggucaggggagugccagggagucuuugaaaggcucacaccagccuuucuuagacccgcguuauggcugccacguacuagguucuuacccagcccuuuccacauauuagcuccuuuaguccucacaguagccuggaggaaacugaggcacaggagguuaagugaccuggucaaggucacgcagccaggauuuuaacacaggcagccuagcaccagggcccuggcccucugagcucacugccuguggcugcuucucccaacaucuugguuacacaugucaugaccagcugugucugugugccccaggucacagccuagggcacccucugccccauacuccuggagggaguagagaccgucccccaccccagcccagccacuuucccuuugaggaaccgcccaucaagaggugcucaaagaagccaccaggguccaugugcugugauggcaaggucagcagccagcccccgcaccucucucccagcaucaggcugagacuugucccauggccuccuuauccgacccccaggaaguugaccagcagccagaugucagaguuugcguguuuugagcagcagcggcagccucaccagagaccccacggugaccucguuucaucagccagccccgcaggaggaggacaggauggggugagggguauggggccuggcuccagcuauauguuuuuaaaauccaucagagacacugacguagguuccuaagucacaggcucuaaaagcguugcuguuucuuucuucagcccagcaugugcuggcaugagucagccaccugugauggauuugguguggagggggaguggguuccugagucacagccucgcacggcccggcagggguggcaggugcugaggggacagccuucuugacucacuucacucccggagcacgcggcccaggccccaaucccaguucugaacucugccauggcccgaucugcggaaggcccugugucacugcguagaaaaccucugggaggacacacgccuuauggcuguggguuucuuacucccagggguggucagcaacagggucuuuagucugacugugucucaugacuguuuuaucaugaaaauguacccaggcauuauuuuuaucggugaaaaugaggcauaaauguuaaaacccacagugggcuuuuccucacgcccugccugugaguguucccucuuccgggagggcccuucuugguuggcuccgaugacaaacauguucacccuacaaacccgaucugaggccagcugcgggcugcuuuguaugcaucaccucaaugaauccucccaguaaucuucuggcuuuacgcccauuucgcugauggagaaacugaggcauggagugguuacugaccucgccuaaggcuccccagcuaggaaguggggcugggcuuggggccaaguguagaacucagagcaaccgcucuacuauggguuauugggucccugaagcaggcgaugcugucccucgagggagaucuugccacgccuuuguuucugcuccacuccugacccagcaagugucccuucuccacuguagccugcagcucgcuccacugcgaguuugcugaggccgaggcuacaggcugucagcuugaugccuccccugucagccacaagcucgggcccugcugaaguaggaauauuccugcaggaaguccccaacuuuguguuugaaacagacaugcuuacaaaaucagacuuugaugggcugcugcacgauaagcuauauucccuccucggacacagcucgcacagucuucuucauugggcuggaauaagguaacccccgaguuuuucaguguggcaucuggggaccuuugauaaacagccccaacuccucccuugugccucuuuguuuccugcugcugccagcaccgccaccuccgucucauuuggaguucaauaauaccagacucuuaguuccuuagacagcccacaugcugggaaguuucuguccucugcaccuguucaugcuguucccucugcccagaugccuuucgcucucuuccugaguaaugcagacucaucuucagagccuuaacacaggauguccuucccccugggaagcccucccugaauacagccugcacccucaauugagccgggggccuucccuguaacccccauggucugcaaauuccucugggccaggguggaucccacagagucucauugucuguuccaagucugugucacaggggcuuggccaaggccagauucuugucugcucaucuccccaguuccggcaucuccugaaggacuggcgccauguggccaucagcccaggcugcggagguagauggcauccaggcaucagaggagggagcagugcguccaacagacgugagcugagacugcagcucucgacaugugaccuuagcaaguuucuucacugcucugagccuccauuuucuuuucuguaaaaugggaauuaucagaugacaaagucaaaggauucaguguuguuuguuuagucauucauucauucaaaaagugucuauugagcaccugcuaugugucggagucuggggagcacagcagggcguggacaugcuaaugggaggaggcagacgagaacaggauggguaugagauggcaggugaucccagaggcuguagcagguaaggggauggggaaugggggccagggugcucuuuugcacagguggacguggagggccucucuguugggcccugaggguccgagggagggccauguggaagagggucccaggaaggggugcaggcacaaaggccuaaaauggggccacacuggaugcuguucccggcacggcaggagaccagacaggaagcagcagaggacacagcagcaggaggccaagcgguggggacacgaugcuuggccagcggccagauguggccugugggccaccacgaggacauggaccuggacucugagagaauagaagccguggaggguucugggcagaggagugaugagaucugauguaggguuuaaaaagaucuuaacagucauuauugggaaaaggcccaggcuguggggaacauggaagcugggagcccagggaggagccugccauuguuguccaugaagagacgaccuuggaccagggcagcagagaagaggucaggcgccagguguguuuggaagguggagcuaacaggguuucagcugauggaugggacgucgggagugagaaagggggguuccaggaucauaccaaggguucuagucugagcaucuaggaggaggaggaggaggaggguuccaggaucauaccaaggguucuagucugagcaucugggaggaggaggaggaggaggguuccaggaucauaccaaggguucuagucugagcaucugggaggaggaggaggaggaggguuccaggaucauaccaaggguucuagucugagcaucugggaggagggaggaggguuccaggaucauaccaaggguucuagucugagcaucugggaggaggaggaggguuccaggaucauacuaaggguucuagucuaagcaucugggaggaggagggggaggagggggaggaggagggacuucgugcugaaacaaggagaagcugcaguggcuccugccacaugguugucaccagcauccuuuguucuguaaauacucauccagcaccucuugcuggcuuggcucugcgagggcuugagacccagggaagagaugaggcuaccacagucuguccaucagggaucccccgucuagggcacuggggcaaacuuggguaggaaaugauagggguuuggagucugaggaauccccauuagucugcaagcucaaaggucaucccccagcugacuguggggucagccgcccagaauccacagagcuggagggggagcagcugccaugaguccuggcuuugugcccgucgcccagaugggcacuucacaugcacccucucaccagauaguccuggcagcccccucggaagcuaugguagugcccccauucugcagaugaggagccugaggcccagagagauggggugacuccuuugcacaguugaaaaugauacaagcaggauccaaacccagaucugccugauuccaguguccucccuggaucacacagggugaggccccaauguuccgcccccuggagaagucaaccaaacuccugaaacucacauuucucccccagguccccggcaacuuccacguguccacacacagugccacagcccagccacagaacccagacaugacgcaugucauccacaagcucuccuuuggggacacgcuacaggugagcaggggacacucgagauggcauggccgggggugggccuucaggggcucugucacccagugcccucugcccucucugggcacuaggaagaguuaccguuaaggugacaucuaagccaagccuggaaggguaagaaggguuucaccaggaacagaacagggaaauggguccuaggcagggggcgucucaaacaucaccccucuccuagagcgcccagcuggugguuuucaugugaaagacccucaagguuacuuucagaaaaauggaucaguaagcguaugugacacggcauguucugugccgagaugguccagggcacaagggcucgcuuggcagcugagagggcccagagcacuugccugaaaugggagccggcaggugggguguguggggugcgagagacccgugguagacugaggaagguggagacugaaggucugguuggugacucagagcacccaucugcaaugaggaagauggacccaggaggcaagacuauaggcagggaggugagggaagggcccagaccgaggcagguggaggggagaggagcagcggucucgcauugccacgugcaggggcaaaacagaaggacacagaaacuacagucccaaguuuagucauuagugggguggaaaucugauuuuuuuaaaaaaauguacagaacuuagcuuagggcccauccauccauucauuuucuguccauccaucuagucaacaaauauuuacaaaguaccuaccguguccaggccuugcauaccuuggugaggacaaacauggucccugcccaccuggagcuuccagucuaggggggaagacagauguugaucaaauaaugguacaggccaggugcgguggcucacuccuguaaucccagcacuuugggaggcugaagcgggcgaacugcuugaggucagaaguuugagaccagccuugccaacauggugaaacucugucucuacuaaaaauacaaaaauuagccgggcgugguggcaggcaccugugaucccagcuacucaggaggcugaggcaggagaaucacuugaaccugggagguggagauugcagugagcugguaucaugccacugcacuccagccugggagaaagaguaagacuccucccaaaaaaagaaaaaauaaaaauaaaaauaaaugguacaaauaaaugugagauaaagccaugucacaugacaauggaagagaacauucuagccuucuugucucuguaaccaccguucucauggguuagaaaugaagccuucacacggucagucucaagacagcaaauagacaaacuuccuuuuccuuguugagaaauugcaguuccuuccaguuguugaggaauugcuuguugagaacaugcagguguguuaagugcucaguaaacaucagccgccugagaccaggaucagggauuaugccaccccgcugcugcccacugcuccuggaguggccacagaaucauguccccacguaccucuccgaugucuccuccuuccuucuauucaaacaccucacucuccuuccuccugggggccacgugggccugucuccauacuuaagccuuuguacaugcugcuugccaguuuaacuucccacuuuccuccagaucuuggugucaaugucauuuccuccaggaaggccuccagggugucuagcucgauaaccccuguuaaccaugcccaugguagcaugcuccauuuaccagguaugccuuguccuucuuuagauguuccuugaggccaaccugguuucccauuguccucagagaaaaggugagaugugguuuucagcccuacucuacagcagcccaccccacugcccggaggaggguuuucuucacaucugcuauacguucucugcagcagacaugauggggggcccacagcucuggggcaucccugccuggacuccucuaugggccuuucagaggacccugggaucucaggagaaacuuucugggacccagaauccauguucacuugaauuuucugugugacuucauggaaagaguccagcuuagugucagacagaccugauuucagaguuuagcuuagccacuuaccagccgggcaaguuuuggugucuuuccaagccuugauuugcucuucuguaaaaugggcccaauaauacaucauuaggggcaugaaaugaaauuauaugaaggggccaggauggagcagcacauaguaggggcuagagaugggaaacaagcuugugccuacuaugugccaggccccugcugccucuugcuccccacaaauccgcuggagcccccuuuuacacauugguaggguuccuagaccaggugguaccuggccaucccccacaaccagggccaggccuggagguggagguguccuggggaccauccccucacugcauuuuuccacagguccagaacauccacggagcuuucaaugcucucgggggagcagacagacucaccuccaaccguauguaucccugcugggaacagccuucugcuccaagaugcccaguacagcaggcagggagggggagggcagagaggugggggugccuguccagcacccacuccaaggcagggaggcugcugcucacacuccauucccacagcuaaccagugggaagguggacccagccccguccagacccagacccugauggagaaggaagaaggcuugucccggggcacagcagacgcacgcacgcaguggauaccagcuauuaccauuauuguugcucucaucacagccacaucaucauccuuaguugaacuaauuaccuaagaucccacagggagcuauggcagaaccaggaucuguucugccuccaggucgcaccgugagaacaggucuguggguggcccagucagcugugaccacauggcugccucccccacaccucacucuccuccugcucagacuccucccaucgauaguggcuccuccuagaguccucgcccuccuuagcucccuggcaccuuggcccagaucaaagagaaccgcacaucuccacacgcagacaggagagcacgcauaccuuucgugcacaccaacacacaugagcucacauggccccagacacgugcacagaaugggcccgggaggccugugugcucaagcagaccugcagacccacugcugcacaggguaccuggauuuuucuuauuuccucaccugagcucaccuuuuaacccacaucuuuucuuauuauuuccugaaaugcguuugcucucccauugucagggauccaaggcaaagaaaacaucccucugugaccugcccccccgacaaaucgaaccucauuuuucugugucccugugaguccuuguccauaagcagaacucacuuuucuuuuuuuccaaggcauggauugcaguuuaccgucugcuuuuuguacuugaccuuauuacauagccacgauuuucuuacuuuccaguuguaaugggagcacaguuguccaucuugcagcucugcugugcuuuuuuuuuuuuuuuuuugagacggagucuuacugugucacccaggcuggagugcaguggcacagucucggcucacugcaaccucagccucccggguucaagcaauucuccugucucagucucccgagcagcugggauuacaggugccugccacaaugcccagcuaauuuucuguauuuuuaguugagacaggguuucaccacguuggccaggcuggucuugaacuccugaccucaggugaucuguccccacucugcucugcuuuucuaagucauugucuucucaccgaaagugucugucguuuccuguguuucacuguggcaauaaugccucugauauguacaggguuggcgcucuguuacccgauugcuuuccagcugugucugguucccauucaugcugccuccagcaacggauaaguauacggcagcaccuccuuauuugagugcaaaugucugguuguaauagagguagaugauucuugguguggugccguggucauugucguuuugugucaugguaacaugucauccgacgucggccguccacaaaugucugcagcuacgauggacccucagcugcuggacaggaaagaggaucaagcuaagaaggcccagagugugcaagcagagagaggguguggacagaaaaccuugccuucuccagggcuaguggcgaaagcuaucucaggcuggcucaaguggagagaaaaaagcaugagaucaagcaauggacagcuggggaagggcuggcuuuuauuuccucagcucccaagcucagucccuggcacugggccguugccuuuguaggucccucugugcccaggucuugcuauggggguuguuucuuggcauuaaggucucaguucaaacgccaccgucuccaagaagcccucacuggucacccuaucuaaaguaacccucacuccuaaggacaaaccuguuuuuucuuccuagcauagaccacucucugaaaucaccuuguucucccagucaucugcugcccuuggcuguugcgccagcuauaacauggcacucugccuugcccacugcuuuguccccaggacccagcccuguacccaggguauaguagguauaugaucgaugauaagaggccuggaggccacuauggaagagcuccugccagauggugguggagugcggucaugaggaccucggccuccagugucccccuccacucuuucccagcccuguggucuugggaaagucauuuaacucugcuaagccucaguuucugcauguguaaagugggaagaauccucuccaccuuaagccuugcuaugaggauuaaugagaugcguguacagaguuuaguacacggccugccacauugugagugcucaauaaauguuggccguucucuucauuaucgucagcagcuaacuucaggaacgagauccccuagggcagaaucuaaggagaaacuuuccuauaucaaauuguaucuuguauugugguacugaauuguuuaacugguccugaaugauauaacuggaaugaaaccagcuugucauguauauguauacacauaauaugggcugucauauauauauauguguguguguguguguguauauaaguauacacacacauacauauauaugggcugcugguuuuaagaaugcagauucugggccccacuccaguggcgggauagggaugaaacaagauuggccauacgcugguaauugcugaaguugggaaauggguacgugggaguccauuauacaauucccuauguuuuagguuugaauuuuucuguaagaagauuuugcggguaggggaggaggagugagcuugaagggaaugugggcuggccuagaccagguuggagccagcagucucuaggaauggucagcucacaaggaauccacauggguguaauuaacugcagugucuccagugggcauuuggcaaauuguaucaaaggccuuaaaaauggucauugccuuugagucaucaauuguacucauaggagaguaagcuaaggaaauaauuaagagaguguacaaaaaucuaggaaaauaauguucauuaggucauuguuuauaaaauugaaaaugaggaaccacgucaguguccagccauaggggguugacugagcaugguaacugcccaagaugagcgaggugugucaggaccuuacuggcagucaggcagcaaagauuuauugagcaccuacuauaugcugggcauugggcuagguucuggggauagagagaugaauaaaacaaacucugcagagcuuauguucugugucuuagaccugaaaaguugaucaugauguucaguucuuagaaaaagauggcugggcgcgguggcuaacgccuguaaucccagcacuuugggaggccaagucggguggaucacgaggucaggaguucaagaccagccuggccaagauggugaaacccccaucucuacuaaaaauacaaaaaauuagccaggcgugguggcaggcgccuguagucccagcuacucaggaggcugaggaaggagaaucacuugaacccagaggguggagguugcagugagccgagaucgugccacugcacuccagccugggugacagagugaaacuccguuucaaaaaaaaaaaaaaagauacgguaugguccuauuuuaggaaaauacaaauauauguauaaacaugucuggcaguuuauaugugagacugugaaccauaguuuucugaggauggugaauuuauggugauuuuuuguuuuguccuuggugaucaccuguguuuuguacaauuuuuuuuuuuuugagauggagucucgcucuguugcccaggcuggagugcaguggcagcucacugcaaccuccaccucccggguucaagcgauucuccugccucagccucccuaguagccgggacuacaggugugugccaccaggcuuggcuaauuuuuguauuuuuaguagagaugggguuucaccauguuggccagguuggucuugaacuccucaccucaagugauccucccaccucggccucccuaagugcugggauuacaggcgugagccaccacauccggccuuguacaaauuuuaacaagaaauauuacaggggugauuuugauaaggcauucacuuuuucauuccuucaaguuuuuaaccuagggcaaugggcguuuggacaccacuaucaagcguggucuugggcucuuguuuuaaaaaugcaaauucugagcuccacccuugacccauuuggcgggaugcuccuggaaagagguccaggugucuuuuuauuccaaaugauucgacugcuucugacaucugagaaccauuacaggguugaacagagggauguuggagucuucauggacugggcucugcggcugcaggacuuuucucggguuuucagaggaaccuacucaaaacaauucaagaagcacuuccuuugcuuacugagauauggcuuuggcaggaaggggcagggagggagugucagggcagugaaugcugucugcauucccagccuucuuacagaagaggacugacucgacucugcgaccaggcuuagaacccacaggccuaaauuucuguguuauuuuagcucuguaguccgugacccgagauuguggaaggcccaugagcuuccuguaagcaucccagaaggcccaggagaguucauaccuuuccugagugauauuuggcagcucugggccagcauucuaucagcccagcauuggauuccaguuaccucacgcuuaucagcagcugauucaucugugcuuucauucaugccccuguccaaucauccuuccauccguucauucauucaguaagcauuugccacgguccacuugguaccaggcccugcacggggcucuggggacacagaguugaguaaggcuccaucccugccuucagcagcucccccauccaggaagaacugaucugccguugauuucuuuccccauucucaguucaucagugcuucauuggugcaguuuuucugguugauaggcucuuuucuuuuuaauacugaaaccuaguuuguuuuaaaaguaaaacuauucagacaaugucagaggauguacaaugaaaugggaucuuucucaaauccugccuuccuccccagaagcuaaagcugcccgugguuccuugggcaucuuuccagauaauucuccuauauauuuacauggauacagagugucuccuccucccccaauccauggacacauguguauccugucccaugacuugguucuuuucccuguuggagaauagcugcuccuagcacccacacuuuuuuuuuuuuuuuuuuugagacagagucuugcucuaucgcccaggcuggagugcaguggcaugaccuuagcucacugcaaccuccgccucccagguucaagcgauucuccugccucagccuccugaguagcugggauuacaggcaccugccaccacgccuggcuaauuuuugaauuuuuaguagagacgggguuucaccaucuugggcaggcuggucucgaacuccugacugcagaugauccacccaccucggccucccaaagugcugggauuacaggcgugagccaccacgccuggccaacacucacucuuucaugguugcucuauugauggacauuuggguuguuuccagaauuuuaaugaugugcacagugcaggaggaaagauccugauggauagagucucccaauucccgguauccaaggggagaagaugaagagcaguugguuggugguaaaacuggggaaugagcccccugccgugcccagggaauuuaggcuuaggauugaaaugacauagagcugucagcgggcagugcccgucccccugcuucauucugcuguguccuucccgcagcccuggccucccacgacuacauccugaagauugugcccacgguuuaugaggacaagaguggcaagcagcgguacuccuaccaguacacgguggccaacaaggugcgcgggcgguggcugggccgagcugugugcggcggcgcccucugcugacggagagcagagaugacaggcggcugcaccgacgcacuuucuucugauuccuuucuggaggccuuuccuggggguuagcuugggccaggcgcugucccuggguaaaauugaaaagcccagucccugccauguggcagucucagagucaaggagaacagaucuaaccaggagauagggugugaugcguuugacaaagagcagguagucucuguccuacaaagguccugggguugcaggucucaaacagcccugcaucugguccgaguccuucagacacagaccccugggugcucaacacagacagacacuccugcucucagggcacaggcacuuuacccaaacucaugaggcuacugagucacaccaagauggcuguugauuaauuugcuguugauugacagggguguccccaggaccccaacacucaaagucauggagaagacgccaggccuuagugggcagcagagcauggucagagucugcagagugggaugacccagcaauuaguggucucaagacaagacagccuugggcuucccuggggguaucccaccaaugggacaugaauacuugaaaccuguugguugaaaugccccugcuagacccuggcggauggguuuuucccacuuaccaccaggacuguccuuuuucuucuguuccaaggcugcccaaaccccuuauaagugauaccuguuuagcucaguuaauuauaacaacaguaggaggcauagcugucacucauugaguacuuccugggggcuagacaugcuaagcucucuucuuccgucuucucaaucaucaugacagcucugauguugagacuguuauugagcccauuuuguugauuugaccauugaggcacugagaggugguuguagagcuauaaaguggcugaguggggauuagaacagguuuuccuugggcuccagagccuggcuucuugaucaccucacgccucggucugaggaaggggcugugagucugcccaccugcgagcugcucucuguccaaugacuuagucccucuguucugacucacccuaaauugauguucccgggagccccuguuucuuuuauucacuguuucacagggggcaucucauuguaacccucacaugcucauagcagcuaacagauggaaaagcacagaugcaagcucaggaccacgcugcaguucaaauuccagcucagucauucacuagcuauugaccccggacaugucacauagccacugugugccucaguuuacucauucauaaaauggagaugauacuuuauaagagugcugucacaugaggcaauguuuucaaaaaugccuagcccaccaaaaaaaaaaagccuuuagguaagugauacugacugcugcuauuuuucacucuuuuucucugucccucagcucuggguugugacccagacagucauccugccccagcagcucuccuggagaaagcuggucuucccuugcacaaagcuccuuuucccaaugcuuuggcaaggcccagcagccaaauacagcuugcuuagcuucucuauggcugcagccgcacucugcccugggagcaggcagcagcgacccagcgggaggucagggcucaguguuacuuacccccggaguggccugggcuccucaggcucagcaugugggguuggggguaccccagugguucaauuuggccuccaguuguugcagacuuuagcaccuugaagugcccaaacuggagagaucccagggaucaucaucccaggcccauccguguuuagauggggaagccaagucccugagggagggaggggcuggcccaaggaugcacuguuagcucagccucguaguauccuuagucccugcugugugcauucucaggaagguugguggcagggcggggccuucuggcuuugcaguucagucuauuccucugaagaagcuagcccacuccccacguggcauuuacacccaucacacacacacacacacugggacuccugcuuauucaucauguguggcucagaauguccccuccccagucucccagaugccgcccgggagaaugggucauucauucauuccccucaacucuccauguuccuccaucccacaugcaugaugucacaguguuagggauauucuuaugucuuccuccuucugcagacugcgacucccucuggguaaagggcaggacuugcucaccucgggguccccagcagccagccaugggccaccacaguggaggcguucagcaaaccauuguugaauaaaugaauggauuucgcguggcccagagguugaaggaggcaauagccaaaaauugcacuuuuccuuuuacagcucugcuuucuaauuuauuuucugauucuggugcugcuugcagcucacuuggucaauuucuaaacaaccaaggguaucaaaaaugcccagcugugcacggcagaguucagggccuccaggggaagggaugugagagagggagugggggagucuggcuucguggggcagagagggaggaaagcccuuucuggaggguugcuggggggcccucugcaauccaguccccgcccccccugagacacaguuuguacuucugauucuuauauccucuaccccaggaauacgucgccuacagccacacgggccgcaucaucccugcaaucugguuccgcuacgaccucagccccaucacggucaaguacacagagagacggcagccgcuguacagauucaucaccacggugaguggccuggggcaguggguggggcccugagccagccacccugcgccugcucugggccccuuuccuuggcaccccucaccuguucucgcugaaacaggaggcagccugcagggcuaggggcucuggcugggcacaggaggcuucgaccccaaggaugcugagaaauguugucagaaacacaucaguaucgaugacguuuugucuagaaaguauuuuccagaggggaaugcccugaaauccauuuaauuccugaagcaaaucuccauaugguuccacuagauguuuaggauuuucuccagcuuuuuauuguuauggaaauuauucuuagcagaguuuauccuuuaauguguaaauuuugcaccaaagauugaacucauuuuuuuuuccaggucuaauuuccaguuauagcugcugauaggguccgauuuuucccuuuccuuccucucuguucucucuuuuuugccauggucucuaccacauccaguuuucucuagggcagauucaagcugauguuaguuuuccuuuaugcugauuauuucuaucaugucuacuguuuccuggccucccauucagaagguccuuagggucagaacaggagggucagggugcccuucuucacccaagaggcccaggagguacugaagaagccagaguuagcugagguggaagagacaggguggcuaucccuacuucacagauuuggaaacugagaccuaaagauaaauauggcauugggaggcccuuaugcuucuguacuucuucaugcuuguaaugaugguucaagaucaagggccuuggcucuuucauuucccgcaauaacuaggucaguauuagucaggacucuguuaccgaagauccagaaccagaccuugagcuggccugaggaguagaaggccucaggcauggcuggauccagccuccaacauugccaggaguaggucucuaucuucggaucugcuuuccgcuacacuggcuucaucuucaaguagaauuuaccaguagaaauggccucuuucucagucauucuaaccaaguccuagauaggacagagcucucacuggcccagcucaggccucaugccauccuuguggccugggaaaucaaaugcucugguuggccaggcuuaggcccuguacccucucuggugucaaccccauccaaaccgcagggacacagauugugaggaaugagguuucucaagagaaaaggcaggggccagcuacuggaagaggaaagagugggugccaggaggcagaacagugggauguugugacagggucucugccuucucaucugugaaguaagaacgaucaucucuguuccugccaccucccagggccuugugggacucagaggagauugugaaaggagaagcuguuugcagaugugaaaagccaaguaggacggggcacaguggcucacacuuguagucccagcaguuugggaggcugaggcgggaggaucgcuugaggccaggaguuugaaaccagccugggcaacauugugaaggcuugucucuaagaaucuucuuaaauuagcuggauacggugguauaugcaccuguagucccagcuacuuaggaggcugaggugagaggaucacuugagcccaggauuuuaagguuagagugagucaugaucgugccacuucacucuagccugggcaacagagcgagacccuuucucuaaaaaacaaaaauccccagaaaacagacagagagauacaaagggugucauaagucuggugcuuacaugagccucagaacaguuuuuugcuguucucuuugaccacauaaaaguuagaaacuccuguucaacaaacggcacauaacauaaagcaaaaaucucacacgcagccugggaaaagauacuugccauccaaaugggaaagggguagccuucagaauucauauguaaagaacuccuacagaucaguaagaaaaaguuaacaaccaaaaaagcagacaaggccaaggaccagcucuucacagaggaggugauauuggcagugaaaagaugcccaaguucacuagaaauuggagggaugggauuuaaaacaagacucaauucaggccagacgugguagcucacaccuguaaucccagcacucugggagguggaagcaggaggaugacuugaggccaggaguuugaaaccagccuggucaccgcagcaagacccccucccuacaaaagaaaaguuaaaaaauuagcuagacauaguggugcaugccuguaguuucagcuaguugggaggcugaggugggaggauugcuugagcgugggagguugacacugcagugggccaugauggcgccacugcccuccagccugggcaacagugagacccggucucagaaaaauaaaaaaauuaaaagacccaguugaauccuauuggacugacagaaauugaaaacuugcccggcucacaccuguaauuccaggacuuugggaggccgaggcgggcagaucaccugaggucaggaguucaagaccagccuagccaacaugacaaaacacuacuaaaaauacaaaaauuagcggggcaugguggugggcgccuguaaucccagcuacuugggaggcugaggugggagaauuacuugaaccugggagggagagguugcggugagccaggaucacuccagugcacuccagccugggcaacagagugagacuccgucucaaaaaaaaaaaagaaagaaauugaaaaccugcuacuacaaagauugggaagaugugaagcccugggaacccacaugugcuauuggugugcagggacauggguacagcuacccugaggggagaugcacaaaccccaggacccaaaaaaucaggggauuugugagcaaaugauuuaacccaagaccccgcaggguagcacaccccaagugggucuuggugcugauucuuacugcagcucuccuacuccacacccacgauaagccacacacaaagauacaaguagguucccuggugccuccaugaaggucuagaccacuccucagaggcccuagggucuguacauugacuauagcagagaaacccccuccagccaugccucacaguaggguucagaaggcucuuuucuguccccguuucuguuugcuccuguauggaaagcagcugagacucugggcauuacaaucauuuggcaauggccgggcacgguggcuuaugccuguaaucccagcacuuugggaggccgaggcgggggaucacuugaggucaggaguucaagaccagccuggccaacauggcaaaaccucgucucuaguuaaaauacaaaaauuagcugagcaugggggugggcacuuguagucccagcuacucgggaggcugaggccggagaaucccuugaaacccagaaggcggacguugcagugagcugagcugaugccacugcacuccagccuggguaccagagcgagacucuaucucaaaaaaaaaaagaaaaaaaaaaagaaaucggccgggcacgguggcucacgccuguaaucccaacacuuugggaggcugaggcgggcggaucaccaggucgggaguuugagaccagccugaccaacauugugaaaccccaucuccacuaaaaguacaaaaaauuagccgggcaugguggcacaugcuuguagucccagcuacuugggagggugaggcaggagaauugcuugaaccuggcagacagagguugcagugagccgagaucacgccacugcacucgggucugggcgauagagugagacuccaucucaaaaaaaaaaagaaaaaagaaaucacuuggcaaguggcugagaaaugaagcaacuucauuuauucacuuaacauuugcuagaauucacuauguuccggcccccguagcaggcaccagggucagcugaaucauacgcagucccugccuugaaggagcccccugcuggaggggcagaugagugagcacagggagcugugaccggcucuaguggagaugugcgccagacacugcaggcaaacaagagggcgccauccccuuuguuugggaagcucuaagaauagaacccugugaugggccuugagcugaggaggaagggcccgggaaagggaaugcuaugcgcagaggcgcccaguauaacaugucguaugaaguccaugccacccccuuuggcaggugacaaacuccccagugagccgcugaccuucugagagcaggaggcuccaagaagccacggggaagacccuuccuucgucagagacccaaugccucuaugacuccuccuucucuuccuguccuuggccaccagccuguccuccauuucugccccauccaccucugcucaagcgugggcuggcaaagcccugggcuugugggccacacugcugcagggaaccuccugacaucauuagccuggugguucuucugaaggcccugugccaccaccuugguugccaugguaaccguggggucagcucugaaggagccagccggccggcugucccuggcagauggcgucauuguggagcuucaaaggcccuugucacagggcagcagauguggggaugacgccagcacucagacacacacguacacacacggcacaaagaucccugggagcccucggagggcgggguggggccaggauggaaguggaggcaccugcuguggcuucucuuucucucuuuuuaaaaaucaaacacuugcgugcaaagccccuaaacggcaaaugggggccucugcaaauagcuccuuagaggggcugcagaugaagaggggcuuaggucgggaugucgucauguggcggcugcggggcugggaggcagcugugggugggcuggagggagggaggguagaggcagauggggccucccagaugcauugccaaguguuuaguaccuggcugcuuccagguugcccccuccagggucucauugucccaaaagggcuuguuuaucccuagccuacaacaguuuuuccuccuggaagucuuuagccaggcuucuuggagcuucucucucucggcacguggggcaccuugcucagagcgaugcucugugcuauauuagaacauuccagcgccaagggaauaaacagauuguguuugacgacaugcaaguaauccccuccaaagugcuccccucccacacacacauuuguccugugccacuugcuguagcucccuuuuugagauugagauugccuucaaguggguuguggugacagacuggagggcuucagaggugucagaucucuuuccuugcaugguuuauuuuauuuuggaggaacagccagaagucacaaagugccaguugggccaguaugaccgggaugguuuuugcccaccaagaaguaccggauggcgaugacacccucccauugcgugcuacucaaaaccugucauucuuggagaguugcgcagcucccuuaacucaaguggugcucagggcccuuggccagggcuuaaccuggguaugagggagaguugcuacagggagccucacccacagacguuccucucugcugcccucuuucaugcuuucuaaccuggggacuaaucccccagacuuuagauugcccugcaugguugucaggccugaugaugaccuccgcgucugacuuaccuguguccccagcauccagugaagggccugaccuggacacaggugcucagaaauguguaagaggcagcugccuaaagaagugaucauauuuucagcugggcgcgguggcuuacaccuguaauuccagcacuuugggaggccaaggugggcagaucuccugaggcuaagaguucaagaccagccuggccaacauggcgaaacuuugucucuacuaaaaauacaaaaaauagccagguagcacgccuguagucccagcuacuguggaggcugaggcaguuggaggcugagacaggagaucuuggcaguaagccaagaucgugccacugcacuccagcucugucucaaaaaagaaaaaaaaaaaggugaucauauuuucccuagccagacaggaugagggaaaaaagugaucauauagcuacccuuauuaagcaccuacuaugugccaaguaauuacauaguuaccucuuuuagcccccccagcaaccucucaagguagaugauuuuguuccuguuuuauaaauggauuaaacugaggcucagagaggugaaaaaacucauccaagaucucacagccaguaaauggcaaggcucggaccugaccccagugccugccucugcaacauccccuacccccagcacugucucaggagccucuaucuuccaaaacaagggcugucagggguguugcagcaacaaagcccccagaagucauagaacucuugguaggacagacaucaggaucauuugauacagugacuuucauccugagaaucaggaagaacuauuagagcaggaaacaaaguuuuauugugaauaugcauggugaaaucacagcuucacacaaaccauuaaaaaagccgacguccaucuaaggcagauuggcugauaguuugcaaguuuuccugcccauaucuaacaccuuuuguucaccuguuuaggcuucugcaaacauuugccagaaacuaaggcagcaagugcugggggcagggaagagggcaggggcauuaagaagaauugacaaggccgggcgcaguggcucacgccuguaaucccagcacuuugggaggccgaggugggcggaucacaaggucaggaguuugagaccagccuaacauggugaaaccccgucucuacuaaaaauacaaaacuuagccaggcgugguggugcacaccuuuaaucucaacuacgugggacgcugaggcaggagaaucgcuugaaccaggagguugcagugagccgagaucgugccauugcacucuagccugggcgacagagcaagacuccgucucaaaaaauaauaauaauaaaaaauaaaaaaaagaauugacaagagacaaacuucaaacugagaagguucuacccacuaagaugaugugaguuggaaaaaugaccaucuuggcccugggguggcaggagagccuucccagcucccauaugccgccucgguucucuccucucugcccccgcuacccugcucaggguucccucggugucucucuucccuggaccacaagcaccagggaagcuccacgagcuccagguuuagucaucucuggucuccagauccagugcaucaauguggguaauaaauaggugucaaacaaugagcacauagaaggagagguguacaccuugguccacccccaaccaagaagauuucuguuauuggagggacagaacagaacccauauuaggagcuuggugauucaggucuggaaaugugcaaaacgcuucaguucagauccuuccgugguauuccaagcugaacuagaucuucaagaagguguuccagagacagauugcuccaaacugggucuguacagagaggggccuccuggcgcgugcguucccagagcagguucggaggcggaagaggaacgugagaccgagugggcuccauuuugcacaccaggcugguuuuuauaguugcagagcuucugacuuccaacacuuugcugacggggaccccuuaggucaggauauuugcuacguaaaccuuaacagaauugagaagacagauucccugcauggaagcuaucuguacaugaagagaggggcuaggaagagucuuccggcugggaaugagggcaggugggcuaacagaaaaagcaggcccuuugcagccucccaaaccuggcuucuagugauccuugcuuacucgguagcccugugacuguggacaagucauucccucucugacccucuguguccuugucugugaaaugagggucaccuagcaguggcaaggauugaaugagaaaagaggagaaggugccaucucagacccagcacauaauaggugcucaaccaaagugagguucuugcgaggugggguggauggguauuuugcagcccauaggaauuguaaaaaugucagcgggaggccucuccccaggcccccggagcucuggaaggccugauaccacacgcucuccucccccacccccagccuuuccagggcccagucaaccacuucccuuccccgacuacaccccccaccucugccuccuccacgacuuugguguucucauccccggcuccagccugucugccgcugcuggagccugaugagacuccaauucauuauuuauuuccucaugcggcgccuccuccacacgcuuuuaaagcagugcugacugaacggggaaagugacugaacaguuccugggcacuuaggguacagcaggcagcuggacagugucaucccggucccugcagugggccccauucuacagauggggcaacugaggcucagagagguaaacuggcuuucccagccagggccacagagcugggauuggaccgcaggaguguuuacuccaaagcccacaaucucgccucccacggcgguguguauggugcuucuccauugcacgcuaugggagaguaauggggaggggaguaaugaugcacugggaaggcguucgugcugguggaaaaacaggcauuuaguucccgcuccagugcggcuggaacacauccuucucauauuauaaggaauuaagaaccauaaugaaaauguaagggaaacacacacgcaccccuuuuaaagguagacaagcugacuucauucuagucacaguggaaggccaagaagcugacgggaccccugggaggaaguugcuggugggaacagaggggcauuaucggaugacgucugaugaaugccacuuccugcacugcccucagacucacuggggcccagguauugaauuguccuuguuuuuguuucuggagcuguggcugcugcccagagcaguggugcaugcacuggccgagguggcccucccuggcucagugacccugcucccucauccccgacggggaagaucccacccuagguugucucugagccuugaggccugguugggagauacaagagcguggcaguggcaagggaccaagccacucucagucaaugccaccacaguccuagggggugaggauuagucuuccuuuuuuuuuuuuucugagacggaguuucacucuuguugcccaggcuggugugcaguggcacgaucuuggcucacugcaaccuccaccuucugaguucaagcaauucuccugccucagccuccugaguagcuaggauuacaggcaccugccaccacgcucagcuaauuuuuguauuuuuaguagagacaggguuucgccuuguuggccaggcuggucucgaacuccccaccucaggugauccacccaccucggccucccaaagugcugggauuacaggcgugagccgccgcacccggccagucuucccauuuuuaaaagccagaaaacugaggcacugggagcuaggguggcacaagagcacauggaugagaggaguccaagccaauucugccagccuccaaagcccaggcccucuauggcaucgcuuuccaggugcagggucuccaggcacagcaacuuaguggagaggggcaccugcugccugccccauccagggucucccccuccaggcccaccuuuucaucagcacugccuuccccacgcccccggcugacaccccugagcgagucaccuuugccgcugccuuggguguggaacccugugccuuuccugaguagucauucauucccucacucuggaacccacccauuggcuccucauucuuucucucacuccuuuauuuauucaacaaacacgucuugugcaccucccauguggucaguugugucugcuaucuucucucccuugggcauucaggaaaaugagaguuuucccaauaggcuugagguggugagauucagggagcucccucacuggccaaaggauggaacccaccucuggccuaaggugcuuugccccacaaggauguucuucaucacaaacacaucuuggcaacugccugagggaacaggacacccugucugggccucagcuaccuguucuguugaauggguugcuguguaacuucagagggcccuuagagugcgugggcccccagcggccacaaagaaucugccugcggugcugggacacucuugcgguccuguuccuguaugacucgucuugccuucugcuaaaagugccagagagagaauggaaguugagacccaaaggcgugcucuggggaauaaguaauauuuuacugauuuuucugguuaaagugggucucagguugagacaaucccauuucuuggccauaagguuagagccuuccagugaacugaaagauuaagaucagguuucauuuacugagcaucuacuaggugcuaggugcuccagauguauuuucaguagagccgcagggguuuugucguuuuauuuuuauuuuuauguauuuauuuuggcaacagagucuugcucugugaccucgccuggagugcaguggcugaaucucgacucacugcaaccuccacuucccagguucaagcaauucucaugcaucagccucccgaguagcugggauuacaggcaccugccaccaugcccagcuaauuuucguauuuucaguaaaaacaggguuucaccaagugaccagguuggucgcaaucuccugaguucacgugauccuccuaccuuggccucccaaagugcagggguugcaggcaugagccacugcacccggcuggcuuuccuguuuuauagaugaagaaacugaggcccagaaaggcucucccacggcuagaauuaguaagugaugccacgaugcagccuccaaaggcugggugcucucugcugccauggcaggaaagccggguggacuccccagcccucaccucaugccacccucaccauguccagcagggaggugcacaccucccagccccagcuuuguccuggacuccccuggagaggcccagcucuccucgcuccucugugugaacagcaacaggcugugggaacuaagugucacgacugcaauuugcuuucuuuucaguuucauucauuaguguuccucccaggccccauccccacagcccagggaaaugccaaucagcgucuucccuccugccagcggcaccccugcccuccccuccgugaguuccugagaucccgccagcaucuccuccagcuucagaauaucugcuguuggaucccauuguucccacaucaucccaggaauccuaaauggcaaagccugucaucuugcugccgcccauguagggccugaauuccaaggcagacacaccaccuggcacagccuuguggcugcaucuccccauguuccagaagguauggugaccuucuaagacgagggacagccaugaccagccacuucccugagcgaguucaggugugagaacgcccuggcacugggcauuucugaaucuuuccauaugucagaauccaggaagugccaguccugggagcaccagaacccucuccugugacucuacgucaccucaugccagucaccuccuacugacugccagugugucagggaggccugaaggaugagagauaaaauaaugaaagcagggccguggcaaugugggccuggccacuagaguucucucagcauuuuuuuuuuuuuuaagucacggggccaggcaugguggcucacaccuguaaucccaccacuuuggggaggccgaggcaggcagaucacuugaggucagggguucgagacuauccuggccaacaugguaaaacccagucuuuacuaaaaauacaaaaauuagcugggcaugguggugggcaccuguaaucccagcuacuugggaggcugaggcaggagaaucacuugaacucaggaguggagguugcagugagccgaggucaccccauugcacuccaaucugggcgacaagagugagacucaaucucaaaaaaaaaaaaaaaaagaaagacaugaucuugcucugucaccuaggcuggagugcaguggugcaaucauagcucacugcaggcuugaccuccugggcucaaaugauccucagccucagccuccagaguagcugggacuacagccaccacaccuguccaauuuuuuuauuuuuuguagagauggggaucucacuguuuugcccaggaugggcucaagcuccuggacucaagcaacccuuccaucucccgaagugcugagaugacaggcaugagccacugugcccagcugaguuaucucagcuuugaggaaaccccccuggaaugugugaggauuuccccuccccucaccuccucaagugaacagugaccagccccuucaacagaugcggggugaugggggcacguugagcaaaaucaguagauacucauagguagucugccucaggguucccccuuagccuucaggcuugcagucacucacccugugacugagccaguugcauagcaguuuccaugccccagggccucaguuuccccucaggcgaugugcuuuccuguguaccucaauacacacauugucucccucuggucugggccagccccaugaaaggagaguugagacugggugccaggugucugugagucauaagcauuuggguuccaaauuguguguagaugaauacagauguguuuugugugugugugugugugugugugugugugugugugguuauuuuuuauuuuuugcuucauugcacguaagucacauuuuccuaucuucugauccaagcucuaaaagcguuuugugguauaaaaucucccaucaucugauccacucuaccgaaauaaaccagcuccccugccgucaucuucccugaaaagucccccugcgucauguucugaggccggcagggaggggccuugcccacuuaaaacacuucaccauaauccccccagcgcccccaguccucuccacucccuggggggccgcuccgguuuccugggcuguuauuacuggaggaccagcugcuacccugccacccauccauacagaccuggucuguccauccugggccucacaggcccccgcuuagcucaucucauggaaauaucauuuaaaaaaauaaacacugguuugauucgcacuucccucucgccuuugcuaugucucccagccucccaccacugggcaccaguucaucuauuaagguguucuuggcucccagaguuccccacagguugcaggucaguagcuggccguccaccuguggugccucuggggcugcuaauguccucuggggccacacaacuguuuauuucuucugaguccuguggucauuuaaaugccccuuaaauguggcaugggggaaagagugagugccacaugcacugugugaccucggacaaguuacuucccucucuguaccccauggguaccucagugaagaggcaucuccuucaugggcuguagggcuccugcugcuccgaggccuauggcugcuccuaggaugggagguguugguucuuauaaaugacauaaaguagaugcucaagaggaaaauaugcuuaaaguuuucuugcaaggucuggaacagugguucaugccuguaauccuagcacuuuggggggcugagacagauggaucacuugaguccaggaguucgagaccagccugggcaacauagcgagaccucaccucuacaaauuaaaaauuaaaaaaaauuagccaggcaugguggcaucaccuguaauccuggcuaccccggaggcugaggcaggagaaucacuugaaccugggaguuggggucuguggugagcuaugaucacccacuacacugcagccugggugacagagugagacccugucccuacaaauaaguuuccuugcaaaccuucugugaacuucauuugucuuccaucauccaugcuuugauucucugaagucaucagaaggcaauuuguaggccauaacauuuugaguaaaacauaacauuaguuugauuagucccaaaugguguucugacaacugcaaagcuuugugauucaaucagguggguguuuugugccugagaagcaacagggugucacauuaagagcacagacuccaaaguuuugaaccccuauucagccacuugcuguggcauuggacgagggauucagggucucugugccucaguuuccuuggcugugaaauagucuaagaauaguaccuacugccuaggguugagcuggggauucacuggggugguaggcauggagcacuguaacccaccuggcccagggaaggugcuguguaaguacuguguauuuuguugugguuaguauauuaugauguggcagacaguuaugaaguacagacauaacaggugacauucauuauccuccugcuaccgccauucucaaccaggggcaauuuugacaucuggggacauuuggcaauguuuggagacauugugguugucacagcguggcggggggggguaugauuggcaucuccuggguagaggccagggaugcuaaauccuucugcaaaggacagccccuguggcaaaaaauucucuggccccaaaugucaauggugccauuagaaaccuugcccuggccaggcacaguggcucaugcuuguaaucccagcacuuugggaggccgaggcggguggagcacgaggucaggagaucaagaccauccuggcuaacacggugaaacacccccacccugucucuacuaaaaauacaaaaaauuagccaggcgcgguggcaggcagcuguagucccagcuacucgggaggcugaggcaggagaaugccgugaacccgggaggcggagcuugcagugagcugagaucacgccacugcacuccagccuggaagacagaaaaaaaagaaaaagaaaaagaaaccuugcucuaauagaagcuuucugguagcaccaaaggccucucuguccuuuguagcacuugccuuggcuauaauuuugcauuuauugguaugauuauuugcuuacuacccaucaagucccaggaugccauuucuuggcugugugaccuugggccccugggacugccuuucagaaccuccauuuccuucaucugcaaaugggauuguaaauaugugauaaauucagaguugagguuaagaccacaggcuccagaguuaagacguaccuguguucaaguugcaucucugcuaguggugaacuuaggcaagucaccugaugaaccucaguuuccuccgcugugaaaugggucuaauaauucccuuccucauucagagggugaauaugggaauuaaaggagcucauaauggugaaaauuauuuuauuauuauuaaauccaccauccaacaacugguuuucuuugagcccuaaguauguuccggacuuggugacuauguaguggguauuaugggcuuaacgggcaaugucugccuugcagagcccaucaucucaugaugugggaggggucuggccugguucauccuccagcacugacuucugacacucccaccccaccccugcccucuugcagaucugugccaucauuggcgggaccuucaccgucgccggcauccuggacucaugcaucuucacagccucugaggccuggaagaagauccagcugggcaagaugcauugacgccacacccagccuaauggccgaggacccugggcaucgccagccuugccuccagugcccugucuccuuuggcccucaaucuggucccaaaucuggcugugucccaaagggugugugggaaguggggggaaaguagaggauggcucgauguuuugcagcuaccucuuuuccccguguuucuuuuuagacaaauuacacugccugaaguugcaguuccccuuucccuggggagccccaagaacagagucaggcaagggguggggaguccagggaucuuggggaccccuccuaggagagcugcagucucuucccucaggggaacaucccagaaugcauaucgaucagcucucagccaggcuucgacaaucucgcagcccccacuagguggacacauuaaugauuugguuucuccccugggcagccaaccugccccagaggcaccagaccugggcuuucagcuuugggaccaggcugcccaaagguacuccuuuauacacccggcaccuuccacgaaagaugguacuucccaagcaagccccuaugauuugucacuauagauggaacccugacuucugccccaucccuuccugcccaaccuagaacccaggccucaagucuuuaccccaccccuuucuuguucuuccaagaagcagaugcccaguugcucagcagcagcgguagagacuugaaucugcccaccagucacaaggcgggucacagauuccucuuccucucuucuccucguuccucugaacccuccaccaaugugccucagccugugugcuguguggcaacagcauucugguucccacugccaagaucucccaccacucugcugggaucugcaguggcagggaguggggguuguguaaaggggaagucaucuuuugagauccagauagacaugguuugugcacuuacguccagaugggaagcauccuuccugcaacccuaaaauaaucaugcagccucucagacggacgccaucggucccaaggccuuagguggaggaagcaaagcaggccaggccuguccuguccguggaccucuaccuucuggacucccuacgggugcagagcacuuggguuucucuacagccaucguggcccacuugacacugugcuccuccaucagcuggucacaugccaacacguucccagccccugaggcagcuccagggugccccaccugcuccugaggugggucccuacccugcugcuccucuucauccuuucccuuuuguccugaaagggaggagcaaugguccaggcauuaauuccacccagggaauuuuagcuaugcccucaugucccagggagagagccacacgccuguuuuccauuuauagcaagauuguuugcauacuuuuguaaugaaggggaguguccaguggaaggauuuuuaaaauuaucuuauggauagcucaagucucugccauuuguaauuuuuggcucuaagcuccgauuggagacgcuucuccuugugcaugugaguugacugauguugugaguguaaaugcauuugguuauuucugguaucgguggccacuuggauggauuuuuuuacauucuguuccccaguuacaggaaggagucccuuuggugugugaauaugugugccuguagaggguggggcagggugggguggggauggaaauguguggcaugcacaugaguugaaauucuuuuaugcauuuuuuugaagaaaaaaaaaaaaacaacucugaggacauaggggaugucaguuuccuauggaagagacaccucugacccguuauucuuauaaucaaaaucugaagggaaaaaaauguuuuaguucuuuccccacucguuggguucaacuagauuaaaaggcugauuuucagaaauauuaug

SEQ ID NO: 18258 - RNA, 3234 nt, Homo sapiens
gugcggggucaacgcacucucuuuaaugggaaggggaucgucauuucuuacagcaauagguaaaaacauaaauacgggugggugcgugggcgggcgacggcgagauagcaaaggcccgggcgcccggcccuggcucgcggaaugggcggccagaucucaggcccugcgugcccgagcucagucccaguuccaaccgggggugcccauggacucucggagggcacuccuggggggacagcuaagacaccaggcugcaggaucacucauugcacgcugcauaaucgccgccacaaacucucccgugcgcaagaacaaacgcgcgugggacagaaaaaguuccuaggucuccgcaggagugaaugcaaaauccaggggacucagggucauguugggagccccuucuccccccgagagucagggagcuguugaggugggaucggucagggucgcgccacgcgggucccuucccuaccaggcucggauaccaugcagcguggacacucccgaguugcucugcggaaucccggggcucugaaccgcauucaaguccccgacgccgaaguucacgaaguuguuguuggcggcggcaguggccggcugcgcuggggaaggcccggcgggguaagcggcagugcagcuguagccagggcugcaggccgcgccgccguaacccggauaggcgggguaggcguuauaaccguagggauugaggcccacgccguaggcaggcgcguagggcgccgaguccccuaggcauggcuugccaucgcgcaccagcacuggcaccgcgauccugcgggcaggcggcggcggcggcgggggcagccccaccagcuccagagucugguccugccgcugccgcuugcacuuguagcgccgguucuggaaccagaucuugaccugcguggacgugaguuucagcacgcuggccagcuggucgcguucgggggccgacagguaccgcugcugcuugaagcgccgcuccagcucauagaccugcgccugcgagaagagcacgcgcggcuuccuccgccgucgcgcccggggccgcuccgcguuguccgccucugucuucuccagcuccaccgccuucugcagcgcgcacagcucugagggggaacagagaggcagagagacgcuugguaagagcggcuugaccuacggagcgcggccgcacaguaaugguaagggauccucguggaggccacuguguccugccuggagcgcccagcuggcugcggcucacucugccaagugcacugggagccaccgacacgucucacucagcauuuguagaaagucaggcuggcucaaggcgcuggagaacaaaacgggaggucucugcccucggggcaguucacacccuggugagggagacagacggugacuuaaaauuucaggcugcaaaaaaaaaaaaaauaaauaaaaaaauaaaaaaauaaaaauaaaaccaggugaugcucuggggugaacugaauuagggcuaguuugguuugagaaguuaaaugaacagaggccgaggccucacugcuagggacggucuuaucucaaaauuaaggaaucaagaaacagaaggccagggaguguugguuuggugaucggaggcuccagccuggccgcagcaggguuugcgcaguguccaagaagcugcgggugggcaggcggccucggaaccugccuugcuggcuuccucgaauugguagcgaucaguucuagccgccgugcccgcccgaauuuguucccaggccucugcuccucaacaaaccuaugaauucucucccggcuggcagcggcccuucgcccagcgcuucgcccagcgccugcggccucccgggaaucgcccgggcuccugccuugggcuggggggucucccagaaggccccuuucugcagcggggccggccucccuccccgauccugggauggccugcgggaugaucccgcacucaucucguccacucccuugugcccgcgguagcgcagcauuuccuaacuuuuccacgagggaaccucuccgcccuggccgcgccggcaaguugugcugaaaaaauaaagugaagucagauuccugaggguccgcaguaucccauuuuaaaaucaaggcccucgaucccagacuccacuuuccuggcgcaaagaaagaaaggcaccagaaacccgggucgugggugggcugcagaaagaagguccaggacccuccuccgauuguacgcaaaagcugucuggugagcaacauuucaauuucuguuuagcgguucucaucagaucuuuaaaaagauucguaaauccaaaggagauuuaaaaacagagauuaucugcuugucucucuguucugucuaccauaaaccgauuucucaacuuccuaccagacccaggagcagagccgaagccgcccggggcuuuguuaggccggggggaaacguuuuuuggucucuugcuucugauccuuucaauccggcauuuccucugaaccuccgauuggacgcggggcgcgggagccuggcgacaacaccaggcaucuuacauucugaaccccccgccgcagcccagcccucggcccaagggcgcgugucuccuccuccuggcccugaguuucuuggggacgaaagcgacccaggaggggagaagggggccuguguuuccuccucaccuuucuuuucggcucuaggguccuuggcugggucggggucgcuguaggcacguggauagaaggcgggggcggcgggaaaggcagacgcacacuuggccggugaaggcgcgcggcccagcucugcgcgcagcucugggaggcccggcgcagccgccucgggcccagcguaggccucuggcuugaaggcggccagcaugcaggaggagggcgccagggucgccuccaggcgggcagagagcucuccggcggcagccaggcugcgcugcugcuguuccagguuuaggaugucuuugacugagaagggcgugggcgugagagcagggcuggggaacaugguggcagcgccagucucacagcgccaggugggcggcagaaagcggcgcugcccacggccccuggcagcuucccugcauggugccgccgcccgcccgcgcacccgucggccagcucuggauguguccgggcagcagguagcgcugagcacaaggggcaggagaggcgggaccaggccagaggagggggacucagccugccauugggccaggggccucgaugacaggagcgaugagcaguuucgugucaccu

SEQ ID NO: 18259 - RNA, 6683 nt, Homo sapiens
uggggagacagccguuucugcucuggaaaacaucuccagaaaaggucccaaaacacgucucugggcaacaggacacccuaauuaugauaccucuaaacugaguagccuuugcuucuacaaccauaauuucuccuaaaauuucaaggccaguauauaauaucccaggagagcucuggaagcugggaaacuagcaacuagguuuggggucggggggagggcuguuaguuaccgagaggagagccagucacuagaguuggaagaggacucaaaaagcuggugaugggugcccagugguuuccuaucaaggugucucagggauuuggagaugggggcacagauacuucauucuugauggcaaaauaggcaaagaaaauggggaggcuggccgggcccgguggcucacgccuguaaucccagcacuuugggaagcugagguggguggaucaugaggucaggaguucgagaccaguuuggccaacauggccaacaccucaucucuacuaaaaauacaaaaauuagccaggcaugguggcaugcgccuguaaucccaccuacuugggagacugaggcaggagaauugccugaacccgggagguggagguugcagugagccaagauugugccacugcacucuggccugggcgacagagcaaaacuccaucucaggaaaaaaaaaaaaaaaagaaaaagaaaauggggaagguuucucagcauucauaaccuucuccuccccauuucuuuucuggcuaggcccccccaggaugcaauggcgcagcccccccggcugagccgcucuggugccuccucacuuugggacccagcuucuccugcucccaccucuggccccaggccucggcuuugggagggucaagaugugcuggccagauggacugaugggcugcuauacuuggguaccaucaaaaagguaagaccuucuaccucugaccuucuuccuaguucccuuaucuaauucugguucccauuucauccuguuugcucacccauuccagguggacagugcuagggaggugugucugguccaguuugaggaugauucgcaguuucugguucuauggaaagacauuagcccugguaagacucuagagaccugagauugcacaucccauggaaaacaaaccuggccuagaggggcagaaagagacuuaaaggcaggcccugugacacuguguucucucacagcugcccucccuggagaggaacuccucuguugugucugucgcucugagacuguggucccugggaaccggcuggucagcugugagaagugucgccauggugagagggcaggucaccugaaugguccagcuugcucuucccuccaggauggucucuauaucaccuguccuggccuuaguccccaagccacugcucuggccaggcugcuuagccuuaucuuaguccucauccgcuuucagcccagggagaagcagccauggaaaggggugguauaaccuuugcaggcagaagaugguuuaaaugcauccuuuucuaaccauaugaccucggacaagucccuuaaccucuaggagccucaguucccugacuuguaaaauaaggauaaugcacccccucaucaagaccauggucagggauuaaaugagauggguaaagacuauuccugucccaauaccaagcacacacagguaugcaauaaguggucuacuauuaucacugcagcuuaucaccaggacugccauguucccagggcuccagccccuggagagggagagggcacauccuggguaugccgccagugugucuuugcgaucgccaccaagguaaaggcacuucccuguuacccuuccugugggagccucccauccacagccucucccaagccuuuuccucuccccaccccucugaagccacccaccuguccugucucugcagaggggaggugcccugaagaagggccccuaugcccgggccaugcuggguaugaagcuuucucugccauauggacugaaggggcuggacugggaugcuggacaucugagcaaccgacagcagaguuacuguuacugugguggcccuggggagugaguaaugagaggggagcagacuguggaaugaaugauguggugguggaucccaggaaaugaaggaaaaagaacaggaugaggguagcacucagggggauaggagguaaguuuaggguuugggacaguuauggggaaggggguuucuggaggccagaaguccuguguucccccucagguggaaccugaaaaugcugcagugccggagcugccugcagugguuccaugaggccugcacccagugucugagcaagccccuccucuauggggacaggugagaccaaggcagacucucuaggagccaaggaugcccucuuucuucguguuccacccucaguucucccacgcccuucuccacuccagucucuucccaaccucugcagcguuaccucaccuguuugccccguccuugcuugugagucuuccaggggauggcacaguuuuccuguguaaguguguuugcucccucuugcccauguccagguucuaugaauuugaaugcugugugugucgcgggggcccugagaaaguccggagacuacagcuucgcuggugagcuggauugggcaugaccucaguguaacuccacaccacaguauuucacucuauaugccccaaccucccaccucaggacuccccuggcucuuaaaaugccucuguggucuugaaaacuuuguuuuuccaggguggauguggcccaucuuguccuguaucaccucaguguuugcuguaagaagaaauacuuugauuuugaucgugagauccuccccuucacuucugagaauugggacaguuugcuccugggggagguaagggguagugcaguuuuggggguugggaugggacagggagauguagcggaaaggggaagagaagaaaucacugcuccccuggccccauuuuucuucauuucucccagcuuucagacacccccaaaggagaacguucuuccaggcuccucucugcucuuaacagccacaaggaccggugaguuggagggaagaggaggcaaggaugaggcucggaaagagauggagaguggaagccuggaaggggaggggcuugcaacccaccuggaagacugugacugaaaaggauugaggaauggcguaaggaggaaccguuuuuuacagcacugacccuauaucauuucucuucuugccccaguuucauuucagggagagagauuaagaagaggaaauguuuguuuggucuccaugcucggaugccucccccuguggagcccccuacuggagauggagcacucaccaggucacugguccaggggggaugggggaaauucucaggguguuaguccugggggguauauguauagagauggggaggucuuggggguguccgggagggggcuggggggauaaggaggccucuuacagcuucccuucagggcagggcccugggggaggggucucacguccccuggggaagcgccggaggccggagccagagccccugaggaggaggcagaaggggaaaguggaggagcuggggccacccucagcagugcgcaaucagcccgagccccaggagcagagggagcgggcucaucugcagagggcacugcagguacuggagcagggggaacccgauggagcaaaugguggggugugggaaggagucaaggauuaucucucaguccuuugcccccucuucuaggccucagugucuccaccaucccccagcccuaaccagaguuaccagggcagcagcggcuacaacuuccggcccacagaugcccgcugccugcccaggucagugcuccucugccccucccccacaaaauaugcucccaauuauucacaucuucuggacuuuaucacccagaauucuuuucccucucccccuuggcuacccacuucuuggccuagaccgacuucuagaacuagugucugguagccaguauucuggggaagggagucccuuggggguaguguuugagcucugcacuucccagggggagaagguccuguuccccugcuucagguccugacuuuccccacuccaaccccagcagccccauccggauguuugcuuccuuccacccuucugccagcaccgcagggaccucuggggacaguggacccccagacaggugagauucugucuucuauuaccagugaugcucuucuuccccucuaugugcucaaggcucuuagucucuaacacuguuucucugauucacaugugcucuccauuucugcccauuucuuacaauugccuucucucccuaggucaccccuggaacuucacauugguuuccccacagacaucccuaaaagugccccccacucgaugacugccucaucuuccucaguuucauccccauccccaggucuuccuagacgcucagcacccccuucuccccugugccguaguuugucuccugggacugggggaggaguccgaggugggguugguuaccugucccgaggggacccuguccggguccuugcucggagaguacggccugauggcucugugcaguaccugguugaguggggaggagggggcaucuucugaacagccugccucugcccagcuccccauucacacacaccggcacuuucauacccugaccucugaccucaccuacagcugggauguaccuggagagauaggggguaguucucccuacugcccaggcuggaauccaagaguggggaguggggaagaggcccucuucucuacccuccuucaugauuccugaccccucccauccuucccauuuccuuugauguuauuuuguuacagcuuuuuaaauauuuuuuaaaauuauuuaaccccugggggcagagacugaggagggaggaugauaagggaucccggacucuguaugauugaaauaaagagaaauaaacaaaucuagcagcucugagucauucugaaagauguagagaauacagggacuagaagcacuuauauucucccaacaaauuugcauacaugacaaaaaacaggcaaaaggcagagagacccaaagacgggauuuauugggggcccagucaucaccuggaagucagaaggcguugaaguaucgcggggaucuucaugaugagcaggaacagggcucaucauggcaggacugugauagagucagaaacugacucugugaccuggcgcacccacugcagguacggaaaguuccccuguuccacaggcaaugcaauuaccucggccacuucguaagggugcacagaacuacaaaauaggugggugggggaaggggaucacucaaagauuuacccaaaagaacccacucccuuacacgcaagcccuagacugcccagcaagucacacccacacaguacacacccucaccccauccaucucaaaguucucaccgaacaaaaucugucaaagcugggaccaaggaacuuuggguuuuaaucaucuaagggacaaagauaaacaugguugaaucaaggagugggauugaguucaguuucucagaagagggguaagggcuaaaggggucagggauuggggauauuuuguugggugggggaaauguuucucaccaucagcaccucacugucuuccucgaucuucccuuuccacucauagcugaaaggucagagggggagaguuguggggagcaaagaauuucccccaggaaagagguucccagucagcuccuacaguuagguuaaccccccaacuccuaugacucacauggauguaaucugagggaugagguugacgcaggcugcuaggcgcuucuccaccacggcccuggagugaagagacagucccauucagaguaccccauaaccccaguuuuuguacuggcagcccagagacaggcuuccagagcuggagaaaggagaaagcagcacucuucugccccacccccaacugucccuucaugaucauccuuucucgcugcacaucgaggucccuaccuggcgaucuccuuggcgaccuucucguuggggcaaguaacaaaggcugcagagaccgagcccggaacguagccagagccggaauccgaggccggcgagggcugggucggagggcuuccagaggccauggucagcaagacucgggguagcaacaaaaggcgggaggccacaggcagcagcgccggcauccaaacaaaagacaggagcagagaggccugagagcaggaggcgaauucgaucucuccucacaaacagcccaggaaauuacacccggggaagccuucgcuuagauccucaggcucugcccucccucugaugcacccccgaagaaugccccugaaggugagagagaaacuuggaaaauaaagcaaaagcucauuucacucacaccucagggggccaaccucugggauuuagggugcggguagcggucgaggcuucgaggaccggaaggggcggggcggggccggucacucaccacuccgccgagcaggaccgcgggagcccgccccccacucaugcggccuacgcugguacaggagaguugaucucaaaggccacacgucacacggagaaacaaccccaggaagagcggccucuucuuaccuggguggcagccacgugauuagaaaacagcgcgcaccaugugacaguagaagaaggaccaccugcgccuccagagccagccaaucccgacccu

SEQ ID NO: 18260 - RNA, 7951 nt, Homo sapiens
aacuucucacccuggguuuuuuauugguauugauugauguagaggugggggagaagaucaaagacaaggauugagaaucagggaugggaaaagcagugggccacugacagccgcccugccugccugggaggugggguggggaaagugggcgggacaugcuccugggccuggcccacccagaucacccuacaggcugucggccugugcgucugcauccgguggccacagagcaacuuccucuagagggagcugauuggagccgggugccgcuggcaccucuaugaucacuggagucucgcgggucccucgggcugcacagggacaaguaaaggcuacauccagaugccgggaaugcacugacgcccauuccuggaaacugggcucccacucagccccugggagcagcagccgccagccccucgggaccuccaucuccacccugcugagccacccggguugggccaggaucccggcagguaagcuggaagggucuuguccauccucccagaucucagcagccccagccccaggguggggcagggagccugccgggagccggguggggaaggggaagcucaaggcuucccugggcaggucugccgccccggcuggggaccugauccugccaugccugccucuggcugccccucacagcuuccccucuuggcccagcccuggaugccggagaacuguaagaacuggguccuuuaacagucugggagaugggaguggaggucagagccaaggucaagggcagagagagaacuuucucagcgcuugcugcugcccaacaucccuagacuggguccagggccuggccaggcauguaucccugggcaacauucaucggggcccagcaagcccaggaagucggggguggcuccccucaccgggaauuuaggccacuuggaugggggaggcagagcuaggccugagucagcauagguugcuggccuugguggguguucugaggcucuaccugcuccccucggaagccugggguguugguagagggaguuggaggugcagucagcauccuccagcccuacuguccugggggugccggguccuggagacuggggaagaaggaaggccaucuuauguaaggagcuacggggggugggaggcaagcaaaacucuuuuuuuuuguuuuuugaaauggagucucgcucuguugcccaggcuggagugcaguggcgcaaucucggcugaccgcaaccuccgccuccaagguucaagcgauucuccugccucagccucccgaguagcugggacuacaggcgcacgccaccaugcccagcuaauuuuuguauuuuuaguagagaugggguuucauuauguuggccaagcuggucuugaacuucugaccucgugggccacuaugcccggcugcaaaguucuguuuuaacaaggccuugccccuagagguggaggagaggaaggucugccuucacccugucccuguccggcagaucgaggaggaguggggagcugggugagggcacaggugguccagcccuccuccaccccuucuugagagcucuuggggcacuuucgaaaacacucccaggccuagcggaaggagggugggcgaagguccccaggcccugggcgguggggguggggcugugugcuuggcccaggguggggcugcacacccccucccucugggauaggaggagggcgcucuccuucugagggcuggaggcugccuggggaaauggggcucugggaggggugcaaacugaaagugaaacagcugacauccaggaaacacucgcccugaugaggggucacagcagguuggggcugcggucaggaccaggcaaagaggaaaauuggggccggggacagaagaccagguguguggugggaguacgaggcagguuauggggcuucaaagaaggcccugauccugagggcucccuccggucacugcaaggcagcaguggggaaggcacagacaggagguaaauagggaaaguugcccugagaaagaacacacucugagguccacaaacuggaaaagaaaucuugcaugcguguugaguacauggacucacggagauucagacaaacaaccugacuuuccgugacuaacgaugugaccucgggcacucaacucuuugugccucacuuuuccugccuguaaaguggguaugauggcgcucacccugcuggguucaugugaguuuccaguguucaccacccacagagugcuccuaagugggagaguauaucuuaggcucucaggaaauguuugcggcuaacagcccagaguuaaaaaacagguguguucuggccagccagagggaaguagggccucugaggacagccuucaugggccauuggcugggcaguggcucgcuugcaauaagcaugugcugggugggcugcaggaggccccaggaacagcuaaaaaccccccaggcucuugccccaggaguggcaugaacuugagagccagcgggcacugcugcagccacacccuccucgauggugcagauaccucagucugcccuuggcugccucaccuucuuacccugucucccucaaagagggaguguucaguaaguuguuuccucccagcagacuucacugggacccaugcuggaguaagaauaaaaagucccagaggaggccaggcacgguggcucacaccuguaaucccagcacuguggauggccgaggcagacucacgaggucaggaguuugagaccggccuggccaaagucccagaggacuaagggccuuucugggaaugggggauccucucuccuauguggacauggcaaccuguaugggguccccagucacaggucugugcucacccccaucucugcuuuuucucgcccuuccccgcaggcugaucccguccuccacugagaccugaaaaauggcuucggggcaaggcccagguccucccaggcaggagugcggagagccugcccugcccucugcuucugguaagggucuuccugcccccucacccaucccauaaccaugagugcugucgugaggauggaaggagcaggacucaggcaggcuccuucgccucgguucacccacuguggguggggaauacucuuccccacccacgggcucagaggcuggagcugcugucaagguuaagcccaggagggggaggagucuggacuggggagggccuggagguugggagaggccaggaagugaguguaagguaggcacagugccaccggggcagagggcugggucacgggcgagggaggcaggaauuagaguggggccuggcugcuguaucccuccagcgggagaaauaaggaaguaagcuggccaaucacccagucaggucugcucaacagggaacgcaauuauugugacuuggggaggaaguaagauggcugcccuccuucccucuucccaggggauagccagggaagccccagcucacaccucacggcgggcuguucccuggacuugggaaucaggucccaggucugucacuaucucccugugugacuuuucugggccgcagcuacaaauucagauuuuguuucccacauuucccugcacgcaaagggcugcggagcugagauguacuaauguagacucaggaccccaaaugcccgggacugucccgguuccccggcuuguucuggcuguaugaccuugcacacguuacucagacacccugugccauuuucccccugccagcuggggauugccugcucccagggcuacugugaggacucaaugcaagugccggaacaacucuccacacagcauaagcucuaggggcggcuaaggugcugaaguagggauauuucuuuucuuuuuuuuuuuuuuguuuuuuuuguuguuguuguuuuguuuuguuuuguuuuuugagauggagucucgcucuauugcccaggcuggagugcaguggcgugaucuaggcucacugcaagcuccaacucccggguucacgccauucuccugccucagccucccgaguagcugggacuacaggcgccucccaccacgccuggcuaauuuuuuguauuuuguuuaguagagacgggguuucaccauguuagccaggauggucucaaucuccugaccucgugauccgcccgccuuggccucccaaagugcugggauuacaggcaugagccaccacacccggccauuuuuuuuuuuuuuuugagacagaguuucgcucuuguugccuaggcuggagugcaguggcacgaucuccgcucaccgcaaccuccgccucccggggucaaguaauucuccugccucagccucuucuugaguaggugggauuacaggcaugugccaccacacccggcuaauuuuguauuuuuaguagagacagaguuucuccauguuggucaggcuggucuugaacucccgaccucaggugaucugcccaccucggccucccaaagugcugggauuauaggcgugagccaccgcaccugguugggauauuucuuuccaugggugaggacagcuauggccuuaggaagagugaauccccuauaaggcauggggcugccaggguucggcccucucucccugacucccagcuuugauccucagaggagcagguagcccaggacacagaggagguuuuccgcagcuacguuuuuuaccgccaucagcaggaacaggaggcugaagggguggcugccccugccgacccagagauggucaccuuaccucugcaaccuagcaggugagcuacaaccgcugggcccacaaggacaucuucagggaggcaguagcucgcaugggucucugugcagguccugggagcuggggaggccucgggggucuugcccuucucucaugguugcuccucuuuuauguugggcucccacccccauccaggaccuuguauccuuuuuagcccaugccugccccuucuccuggagcccagcacucaugucuuagaacacugucagggaccuccaagaagggaugcacagggccauggacagcucaggcagaaccccucugccaugagccagggccuggucccgacugccugguuacuggcucaccugcaugccuccugcuccuacagcaccauggggcaggugggacggcagcucgccaucaucggggacgacaucaaccgacgcuaugacucagaguuccagaccauguugcagcaccugcagcccacggcagagaaugccuaugaguacuucaccaagauugccaccagguaccccagccaccucccugccagcuccagucacuccucugucaugucacaaccauaccauacccugccugcaugaugcucuccuggcauggggagaagccuucugucaguguccaaugucugcugugaacucacauguggucucggcccccuauuuuucucuuucggggucccagacuuguauuuugggcauuagcucacagcucuuuugagcucugacuccaaggucuugacugguuagaucaggacucuagagggggccugagguggggacgucccccacagcuccccagcccagcugggacauagcuguccuucauaguuccaauuugaaaccacauaucacacugaagauggugagggugcuaaccucugccagguccuagaaauggcuccuacuugcuauaaucuggcauccaagugguuaaagacaccgaauauuugggugcaaauccaagcuuugccacuuacugccuucgugaagcuuccuagcccuuagucuccugguuuguaaaauagggaaaauaugcuuagauuaguguccaccuuacaaaguguuagccauugcuaccaccagaguuagggaagucagugucggaguagauuugaaacuggaggugaagguaggaguaagugauagauuuuagaauuagugcucagagcugaaauauccaguccgugaacuuagaggccagccuucauaccacugugaugacaggaacuacccuaaucuuuucuguccuuuucucucugcugucccucgggcugccaggccagcagcaacacccacagguaaucuccccgcugacuccauccacuugcucugcccucugcccucucugugccccguugcaccugagcguacaccccagcaguggcauccagcucaucugccccugagcuuucuccuuucgcagagacccagguuguucccaaauacaggccagguuggggcagccucugcggccuuaauucacagcuaagcuauuuagcuuccagcugggagaggggugggagaggccaggcaggcugaagggcuuccugggggcucuccaccaaugcuaugggaugcucugcccacagccuguuugagaguggcaucaauuggggccgugugguggcucuucugggcuucggcuaccgucuggcccuacacgucuaccagcauggccugacuggcuuccuaggccaggugacccgcuucguggucgacuucaugcugcaucacugcauugcccgguggauugcacagagggguggcugggugaguauccaaggacugcaauguccucccugcuguuggggcugccccucucccaggccccaccccuuccucggguuccuauaucuucugcuagccucucugugaccaccuuguuucucccggcagguggcagcccugaacuugggcaauggucccauccugaacgugcuggugguucugggugugguucuguugggccaguuugugguacgaagauucuucaaaucaugacucccaagggugcccuuuggggucccgguucagaccccugccuggacuuaagcgaagucuuugccuucucuguucccuugcagggguccccccucaagaguacagaagcuuuagcaagugugcacuccagcuucggagggccccugcgugggggccagucaggcugcagaggcaccucaacauugcauggugcuagugggcccucucucugggcccaggggcuguggccgucuccucccucagcucucugggaccuccuuagcccugucugcuaggcgcuggggagacugauaacuuggggaggcaagagacugggagccacuucuccccagaaaguguuuaacgguuuuagcuuuuuauaauacccuugugagagcccauucccaccauucuaccugaggccaggacgucugggguguggggauuggugggucuauguuccccaggauucagcuauucuggaagaucagcacccuaagagaugggacuaggaccugagccugguccuggccgucccuaagcaugugucccaggagcaggaccuacuaggagaggggggccaagguccugcucaacucuaccccugcucccauuccucccuccggccauacugccuuugcaguuggacucucagggauucugggcuugggguguggggugggguggagucgcagaccagagcugucugaacucacgugucagaagccuccaagccugccucccaagguccucucaguucucucccuuccucucuccuuauagacacuugcucccaacccauucacuacaggugaaggcucucacccccaucccugggggccuugggugaguggccugcuaaggcuccuccuugcccagacuacagggcuuaggacuugguuuguuauaucagggaaaaggaguagggaguucaucuggaggguucuaagugggagaaggacuaucaacaccacuaggaaucccagaggugggauccucccucauggcucuggcacaguguaauccagggguguagaugggggaacugugaauacuugaacucuguucccccacccuccaugcuccucaccugucuaggucuccucaggguggggggugacagugccuucucuauugggcacagccuagggucuugggggucaggggggagaaguucuugauucagccaaaugcagggaggggaggcagauggagcccauaggccacccccuauccucugaguguuuggaaauaaacugugcaauccccucacc

SEQ ID NO: 18261 - RNA, 14163 nt, Homo sapiens
uaaggucaaggggaaacuggggcaguuuuauugacgauggcaauguacaagacuccacaccuagguaugugcacgagguaaggccugagcucaggccuuaugauccuccucaggacccuugggggcaaacuucuccugcaguuucuuccacaugccuuuaucuauuuccuuaagcucuuccaaggugucugcaaaaggggaagacaaaaagagagagggacugaagucuaaaacuugaugacauagauuggacccacugggcuuucccgacacaagcauggcuugcuuuucacacaguguguuccugaaaaagguggagacccagcuccugaagagcagaucaaacagguaacagaagugaccgcuugcggggacugagcacugugugccagacucugugcccagcacgcugucaguggucuccugcccucuccucacccucggcaucaaagcgggaugugcugcucguugcccugcuccguaugagggcaaagaaauggcccugcgcuguccgcugugcaacccacagacccagaugcuucaucgcaaaauuuggccugcuccacacagcccuuccuguccccaguuuucagguguggaaacugaggcaggaggcagugaaguaacuugcucagguugcacagcugggaaguggagcagggauuugaauccugguguguggacucagcacaugcuguggaguugagcaggcacugggagggggauggccuugggccugaauccgagcccaucaucucccacucuggguccccucaagcaaauuacuuaacccucuacgcuucggguuccucaucuguaaaaugaagauaaaaacacacaucugcagacaacuuggggagaggugaaaaaguaagaaaaaaaaaaccacacguaccucaaaaguuguaaggauuaaagaaaagcauggagguaacucgcuuggcacacagcccgcacucaaugaaaaggcagccaucauccaccacaaugcaggcgggaggggcucuuguuuaagaacauacacgucccuacacccaggaaccaaagcaggguuucuuggccuuggcacuaccaacacuuugggccagauaauuuuucgucgugggcuggccugugcaucacugaaggcuguuucaaagcauccuggccucuacccacuaaugccaguagcaccgcugcccgcaccaccaguugugacaacuaaaaaugucuccagacauugccacauguccccuggggggcaaaaccauccccccaguacggaaccauuugucuaaagucucuagggcuaauguuccaugaaaucuaauuuuacgugcauguuaaauuuuagauauucuuauaauauuguuuugcuuuaccagccuaaauuuucacguuaacaaaacuacuggagaaaaaaagaguaucuuuucugaccaaaaaagguaacagaaaaaagccccugcucuggagcuuuuccagaaguccauguuuccaguguccagguggacacugaggccucccuuaggcgcuuuccaugaccccaaucccaggguggacacacacauaacccagaacacagcacauuucagacuugccaggcccucaaagccucucacuacaaggugcugcaggucuuuucuuguccugucagaggaaacauuugguaagcuuacgccacacaauuugcaacaaaaauaugaggcuugcugugaaaacaaauucucagcaaauuuccugaacuaaacucgcugccagaacaagcugcagcgcggaccaauggcgggacuaucucccagccuucguugcugccuguuuuccacuugcagaggcugcccugaggugaacaaaacagagggcagaggcagggccucuggaacuuacuuccgcccucacuucaaguucaaacuuugcucaaacuguccagggcccucacaauaaugugcaucaaugcugcuaauuacacggacccagggauauaggaguaaauuuacacauuaaaaaaaauugccaauaaagugauucugccuggccaaaauaucuucaccacaguuucccagagaguacuggaauaaaaauaggguuagaguugacauguaauagcaggugacaccaccagguuuuaaucucagaagagaguuuucuagaagcccaaauccucaaaacuuaaguugcugaaggcugccagaagaagaggaaagacacauuucuagaauaccagaaggaaaugugucagggccaugcccucccagaaaagguuaaccuauuuuuguauauaauauacuuggcaacaaaaauaguaauuuuccaguaccugccuacuucaucccuggcucuccggccccccuccuuagggacaauggagauagggaaguaaggaaaggacgggcuuggcaggauguuuccuuucuugauaaucagagucuaucaaugacucuaaaacauaccuaguuaaacucauaucuaacccacagaccacguccccugggucacauaacucuuaggcggauauccccaaacacguuuauugaaugguuuuuuguuuuaauuaaaaccuucauuguuuauaaagcccucuuaagaccauaaaaauaaaauuauuuuccuuccauccugauuucaacuacuuccauuuggcaaauagguauuccucuguucccugaugcccagccuugaauuuaaaagcccuaaagauagauuuucuuuuuuaaauaacgccuuugaccuucuccacaguauauggucaaaaugcaugcgcccuguagcuucagaauuuccucugggcuguucuacaagacuuuccaucaagcaaaacugucuucuuagacaauuccccuuggccacucaaacucagaaucauuugcaaaccaaugagaaaaggcagcugugcuuucauuaccuguggacaggaucagcuuguacucuuccaacgacaggccacugaagcuggugucucuggggcgaggguacuggucaccggggcagaaaggaagugaagggaggggagagaucagcacacaagcccugcucucuaacugcauuucaccuaggcccugggcaaccagaggccaggaggccuagcaaggagaagagcagcgccaccucgaggucaagacuuggccucgcaagaaccaguacagucuccaggaggcagcuccaacuauaauguacccgugaguccucccuggaaaacgcagguauggguggggccccugauucugcauuucuaaccaguucccaggugaugcccaugcugcugcucauggaucacauguuagcagggaggauuuagaaaaaaucaauuuuccacauaggcauauggccacaaauguuuguggaguuaaugagcauauuuuucaaguaugggaaaaaccacucuaaauggaauuugacaguaaucauguugggcccagcuccguaaaaggagggcacuuucccaaucaucccaucuuuaucaccagaauguggggaggugucaguuccgucagaguggaugggaaaauagguauaaauccaauggcugucagacauucccaggagcacacacuggcauaucaaauacauggcuucuauucauaauugguuuuguuucuucccuauauucacaauuuuaaauagcuuuuauuuagguggccuaaaagccucuaccaggcaccucuguuggcuugguugaaauuacugguuucauuugaacgcagcaaagccaagucuuuacaaaacauuaccuaaucagauuuucacucauucuuauuaguugucccgucagaaagcuggguauauaaaagacuguggcccacucaccuuguguuuguaguaguuugaauggagucgcgcuaagcucucguacaucugaucacaggccucaggcucugcaaccugaaaagcaaagaaucccaaaggaggugagcaaaggaguccugccucccacagugucuguaccuugaggaaagaccauacuuaauaaagcguucacaugaagcaggccugcagcuagcacuggcuucuccacucugcgggaagcaaaccuggacuacagcucugcuauuagaaacuacuuuuuggaggcauagcucugccucaucaacuccccaaccuacagaaaaaucagaucaauuaaucagcaaacaagcauuuguugagcaucugugacuugugagccacgacaccagcugcagugggagaugccacaauagaaauguaagguuggaaaggcgugccuaacaaagggggugcugggcagagugggcuacagggacucagugggggaguccccgcaugcucaaguggucagugcaugauggaagugagacaaugcuagguucugaaggaagcacagcagaaggucagcaagcagaaggucagcaagcagaagggagaagggcaggccuuccugggggaggagaugccgucagcaaggaagaggaggcaggaauccugugggaugcuucaggccagaccaguagauucuuuuguuuuuuuugagacagucucucacucuauugcccaggcuggagugcaguggcgcaaucuuggcucacugcaaccuccgccuccuggguucaagcaauucuccagccucagccuccugaguaacugggauuaaaggcaugugccaccacacccagcuaauuuuuguauuuuuuaguagagacaggguuucaccaugcuggccaggcugguuucgaacuccugaccucaagcgauccaccugccucagccucccagaguguugggguuacaggcaugagccaccaugcccggccucagaccaacagauucuuuuagcaaaggcaaaaaaaaaaaaaaucaucugaguucucaaucuaugauaaguggggagcugcugaaacucuacaagaaggaaagaaacaugaagaaggcaacauuuaagauaaaauguguaaacugaggagaaccaagccaggaccacaguuagguccugcuagaaaggagauggcccagaacacugaggccuugccauagaaagggugauguaagucaauucucuggugccagagacagcagugccccugcuggaccuucucagggagacaggcagcauacagaggagguguggucuuuucucuugcaccucuucuaacuuucccuuuacucuguccuuccuauuauuuauguauaguucuuuauauuuuucugccaagaauuuugaaaagcuccccagaacaaaacuuucucuuuuauauuuuuucccccagaauucaaaugauggauuuuuuccuaacuuaaauccuuccuuggagaaggcagagcauaaauaaaucaguaguaaagugguuuaauaggcagcuccacugcugccucucugugcaugucaaaugaggucccuacuuuacagcaaacaaaaaagacaauccaucauuuaguucuaccugacccauuccugcguucaggcuacucaucaugagaauguacacccagauacaucagaagaggaaggauuauggccugaggagguggccagcguuugcugaauaauaaagucauuaucugaguggacagaaugaauggaaaauaugaggcuguggucucccugcugcuggucagcuuguccagggaaagucccauuagaauggaauucugcacacaucugggcgaacacaucuggaacauuucuucagcagggcacgcacagccaagagcuaacgcuggagugcaauggcgugaucucggcucacugcaaacuccccuccuggguucaagugauucuccugcuucagccucccaaguagcugggauuacagguacccaccacuacgcccagcuaauuuuguguauuuuuagcagagacaggcuuucaccauguuggccaggcuggucucgaacuccugaccuugugauuugcccaccucggccucccaaagugugcucacuuauaaauuuaacagacauucaucgagacccuauagcaugauuggcccaucuaugagcaggggacgcuugggugaaugaguaucuccaaggcuguagggagcaggggagucaaacugccuggguugacuccuggcaccaucccuuaucagcuaugugaugucaggcaaaccacucacucuuccccaugaaauacacuuaaaaaaaaaaaaaguugccacaguuuaucuuucucuguaucuguacauacauauccuucuucugauccacuugaaaguaggagcauaaugccccuucaccccauaauauuucagugugcauuuccuaagaacaagaacauucucuuauauaaccacaguucaaugaucaaauucaggccacuuaacaccgauacaacacuauuaucuaaugcacaguccauauuccaauucugucaauugucucaauaauaaucuauggaaaaacaggauguccugcugcauuuaacagucauguaucuuuuagucuccuuuaauccgggaccguuccucggccuuugucuuucaugcacugaacauuuuuaaagcauacuggccaacuuaaccuuucuuuuaaaagaaaauauaauaauagccccuacguccccgguggugugaggauaaaugaggugacgcuugggcugcucugaauuccgggccuggaacgccgauaaaugugagcgauuaguuuuucucacaguuauuaguaguaaagaguuguaguaaacacaggccccugucucauaaaauaagaggggaaaggacagaacaguucagaaccacccuggugggaguggaaugaaggggcauguacaaggugcuaugggccuauggggccaggcaggaagugcuggacaaugaguggcugaggaugggcgcauguaccggcaagggaguggggugcuccaggcacaggaccagguggagcccgugcccagggaaugggucagcauguuaccaguggaucagcauggcuggugugcacugccgaggguggcgcuggaaacggaagugaggaaggaugaaaaacugcugaggcuucacuccugacugacccugguggcucucagcagucacugagcucuccauggucugccgagagagcagcuguuugcuguaccuggucuucaccugauggccgcuuaucuggaccuucccguccugccaccauccccaccaccuucccaaccaagcucuuaggaaaggaguccacaagcugaucugccuuccucccauagccucugccucucuccugggcuccuaacacugcuuccugauaaaccugcauucugaccagauccccacccucaaauaccuuucaacucaaguucccuuccugcuccaacuucucuagcagugagaagucaccaguagguugcucagcaaccuuguaucacacccucaagcaggugugguauaaggugcuguccuuccuugccacguagucccaucccugaugagcagcaggacagacaggaggggcauggggggcgggucacccuugcagagugcugcuccuauaagagcaaaauguacaaagucuaagugcaaaaagcaaagugacccucagguacucucacuucuuuuuuuuuuuuuuuuuagauggagucucacucugucgcccaggcuggagugcacuggcacaaucuuggcucacugcaagcuccgccucccggguucaugccauucuccugccucagccucccaaguagcuggaacuauaggcgcccgcuaccacgccuggcuaauuuuuuguauuuuuaguagagaugggguuucaccguguuagccaggauggucucaaucuccugaccuugugauccgcccaccucggccucccaaagugcugggauuacaggcuugagccaccgcacccgaccacucucacuucugaaacuuccugugugaaagagacagucuccuagagaguucccagaauuccuggacucagcuguaaccugagaaagaaaaccaaacaccugaguccuaaaacagacuugccauccaguuucccgucugaggucagaaggugucuaacugaggcuguaaaagcagcucaguggaggugacaggaguuugagacaugcccauuucuagccaaguucuuacugcuugaggagugaugaagccuuggucaaugcuggguuccuagccacagauaacucaagcucagcaauuaaaaaagucaugcuuacuacuuaaaaggaugucaguggagacaucugucgaauuccagaagccucaccacguuccuauagcuuacacuuuauucacagacuccagcacuaacauuccugagcucugaaaugcaguuuuucugaugaaauggacggugcauuuuuagaaauauucuuaauacaugcuuuaaauuaccugauuuugcauucacaccuaaugagaucacagacguuuuaggacuaauagcagugcuggguuugaaaaggcagcaguggggacauuaugaaaaauucagcacugcuccccaaaugugaauaaaauagauguucaucugacgaguguccuuuauagcucuauuuuugcuccuuuugcauuuccccuguucagucgucaguaaauuucucuuuaccauauuaaacuuuuauacauacaaaucuacaucagugcugcaggcacugauuucgauuuugcaaauugaauuuuggguggugacagcaauugguacagcggccccuauucuagucacacaaagggacgcauaagcacuuuugggaaaggguguugcaaauugcuuugcuaauuaagguagagcuggauucgguccaggaggaucuauaaaaaaagguuuucaagacuugguaaugaacuucugaaaugaguucauucuguuaugggagccuauucccuucaauugaguugaaaauguauuucuugagcaccuacuauagaaagagugcuccacuaggggacggugaggggccacaaagacgacgacccaggccagcuguggagaagcuggcaggcacacuacagagacaagauacacaugaauuagaaaccaacccugcccggggcaauguguaagugagagccagaucugcggagcacgggccgcugcacgagacccgaggugggaguugggcaccuggcugugcugauggggagguguggcaggaaagggcugaguuucacugcagcgacagugcagagagugaggagugccaaccugggcaugagugacacagggaccagaaaugacugggaggaugaggcaugaagaggcacaggacaagaguguuuuaggcagacagggcuuuuaaggggaacccagggagggcuccaagagccugggaagccaccaaauucuugacaaacucuguguuuggguuuuuugcgguuguaggggugcagugauccacagcgcacuuaagucucaaaggaucagaauugcuuguaccauggccaguuugggagaccaugagaagacacccuugcugagccuggggcucauguuaggguggugcgaggcaagguuggaaacacaggcugggaccaaggaucagaggcacugcaggucucacaaaguugccugccaccugcccaggaggcaaugggcagaccccaaacaucuuugaauaaaguagugacccaccagaaguggccaagaauuuaucccuucagguggagcacugcagcuuuacauaugcagagauaaacgccaccccuuggugugaauacuacccuagcucacacuggcgccauucagaauugggagagaaaaaaagauggagauguuuguauucccucuuagagaugauucuccuuacaacuccagguuuucgaugggcucaauacauaauuaaaaauaggauaaucuguucuuaggacacucuucaaaagcauaacuucagggggcccacaagugggggugagcaacguugagauggcuucaccguggccagcauaugccagguggcuugggagcuagcucccugccacacugaggaaugccaaggaccaggccucaaauggaugacugagaaaacagaaucaaaaaaaccuuugaauucuccucugagaagguggaaauaccauuuaccuuauuagaaacccaagaaaaaguuuaacuucuuucaaacugggccaauauuauuauacuuaaacuugcauacaauacaguuagaacucccuggugggcgaagagcagcagcucuucuaggacgccccucggaguugcaccuugugcuacauaagugggugcuggugugcaguccgggaucuuuuaggaagcaccuaaugaacucauuagaaagaucugcuccuuucucuguuguuaggucaacaauuacauuuguugugccaccuucccccacguugcaauucuuuuauuaagcucucagcgcuguaggaaacacguguucuuagacaaacuguauucaaaauuggcaaagcccauaaacacugacuuuuuaaaacuacacaauaggauaugggguguaagaggaguuacauguguucccgcucccaccaccaccuccccacuugguggguuuaggguggaccacaagacuccccagagggcaauuugagguggaauaaauggaggcagugguuuuuguacucugguuuuguguaugaauuauugauuugcccuuuaguuaacccagcuuuucuccgccuggugucccacccaggaccaucuuucuucccaucuggacugguaguggcuggggcaaagaauagguggguaaacacagggaguuccauuugcugcccaaacuaucuauggcccaaaaagguuugaacgggcaaccaggggaaggaagugguuugacguucauggaauaagagguuguucuaacaauaacuuggaacagcagcugaggaaaggccaggcacccaggagacgaugcacacuagggccagaggggcugggucuguuucucacuuggcuugucucuuauggcuacggaacccccagugcguugucuuguuuuucugauguuuccucaucuguaaaaugggaacaguaauggcuaccacucagcuguacuaaggauuaaaugagaucacgccggcaaaggugcacugugcaccuuucagggugaucauuaggacgaaggaagccaagaggcugagaggaggacugacugccucucuccucuacggaaauggaaagacggcaugagcagagcuacuuuccccuccaguucugucuucuggcaaccggcuuaaccaaggaggagcuccauacuagucagucaacuggaucuaagccccaccuccugcugccaguuuaaugaagagccuaccagaaucaucuugcuuucucaaggucuuuauaaaugaucugggggugucaguaggagugacucacaauaguguuuucaauuccagcaaggaauugcgcccuucaaaaauuaccacaaagauuuacuaaggccaggugcauucucaggugacauuaggaugagguaccgcaacagugguccugaguaaugcaccugcugccauugugcacugguucacucuaccaggaaugcauucaucagcugcuacagaaucacuaacacagccaugaguugcaucugcagcugggacucaaaccugugugggccuuugacugaucagaaacgauugcccuaggugaugacaacuccgaaagagaaaacucuuuccuccuuugcuggcuccucuuacacuaacaaucaagcaagugaauguuacgcucucucaccuccccaaggauggagccgcugacugcucaacuguaagcuccucaguggugaaggccagguuauggccuuccuccauagauccugcaauuucccaaacaugguaagcucucaaaucaauucucaccacucaggacacacaaauauuccuuucucacucuucacaacuucucuucaucuaguucugcuacaucugaaacuauauucaaauuaucuuugucucaugagccacaaccaauuauuuacuuauccauucagacauuuacugaguguuuuuuuaugggccaagaacuagcuagacacucguaggggagagagggaaagauaaaaauggcaucaucucuauuuucaggaagcucauacuaaaaauaugcagggaguacagcuuuagaaaguucacggguuuguagaauugggacuagauaagauucuugccuuaaagaucuuuacacuuugggccagugaagaccaccaugaauaaugugagggcccuggguaucguauaaccugggccagacacuccccaggcugccagccaaucagcaguacagucacaaugaugccacugggcgugcuccugcuccuuuaggugggcuggcuuggcucuguuucgggcuaagcugaaaaaaaaaaaacccauguuccuucuguaacaagucuuggccaaguuucacaagucauuucuucagacuguguguauaugcaucucauuaucucauuucauuucuggucucuugcccgagccccaggcucaaauauagcacugccuacuugacauugccacuuggaaaucaguguacuuggcaucucagguuuaaccugcuuaacaccgaacucgagauauucuuccuacacuucaccuauuccuaccucaguaaauggcaccaucuuagaccuagaugcccaggccaaaaaauaucuaggugcuaucuuugguuccucucuuuuccuuuaucccacaucccauauaucagcaaguccugcugacucaaccugcgcauaaccugaauccaaccacuuccaucuucugugcugccguccucauccaaccccccaccaucugucgcuuauaguaccauaaucggcuucucuccagccucuuuuuuuguuauugcccccuauagcccacucaccacauacaaccagaauagucuuuuaaaaaguaaauuagggcacaucaguccccucacuaaacauccccagugacuucucacuggccuuauaaugaggucuaaagcuaaucagaacagauaauauccuacugugccuggcuccggaccuucaccuuagcaaacuccaccuuacuuacuacccugcagccauucuggcuuucuuucuguccucaaacaugucaaucugccuccugccucuggacaugugcagugucuggaauguccuucccgccaaguguacauggcuggcucauccucuugccuuaggucucaccuaugugucaucuccucagaaaggccccacuaauaacauuacccuuuuaucacgcuacccuauuuucuaucgaucacaguacuuaucugucuuacguacacuuaccugcuuauuguguccugaacuacaauguaaaacuucaugcgggcaggacuucaccuguuuaacacugcuguuucccuagcaccguuccaggcauaugguaggugcucaauaaauacgagcuauaugaaugaaugaaucccagagcugcagcgccaaccuggaggaaagcaagaacauaggccuacuacucacacacagcugcgugagcugaggacccaaaccugcugcacaggcuuacaggggcucaggaagaacgcaaacgcuuagcggggaccugcagaguuaacuggggauuagcucagucaauacacaacacugcgaaauaaugagguaaugcuaccgugacaaggaagcaaaaagcugaggcugucaccagcugccacugguggugugggucucaacucucucugcaccuugaaucaccuggagagcuuuuaaaacucugaggucaagaccccaccccuagagauucugcauuugaaguuuuuguuuguuuuuugauuuguagagacggagucccacuauguugcccaggaggucauccugggcucaagcgauccucccgccucggccucucaaagagugcuggaauuauaggugugaaccgccgcacccggcccaucuggaguuuaaaaaaagcuucuucggcaauuccaaggugcagccgggggagagcgcugaauacaacgggcgucgcuaucaguagcucccugggggaaaaaggggguccgcgcucacgugcugccuggaaagagggcgcgcgcaugcgcagaucccccugcuagcgcgcucguuggccccgccccugccucguccuuuccuccccucgucccagccgccuccccgccggucaccuggguauucucucccucccgaaaggccugugcuacccgcugucgcagguaagcgcccaagucccggccccguuuggucucguccacuggccauuccucacagagcuuaagaaaacgccgguaccggcuggccgccaucuugggccccgcguguucccgccuuagcgggaggagucg

SEQ ID NO: 18262 - RNA, 14163 nt, Homo sapiens
cgacuccucccgcuaaggcgggaacacgcggggcccaagauggcggccagccgguaccggcguuuucuuaagcucugugaggaauggccaguggacgagaccaaacggggccgggacuugggcgcuuaccugcgacagcggguagcacaggccuuucgggagggagagaauacccaggugaccggcggggaggcggcugggacgaggggaggaaaggacgaggcaggggcggggccaacgagcgcgcuagcagggggaucugcgcaugcgcgcgcccucuuuccaggcagcacgugagcgcggacccccuuuuucccccagggagcuacugauagcgacgcccguuguauucagcgcucucccccggcugcaccuuggaauugccgaagaagcuuuuuuuaaacuccagaugggccgggugcggcgguucacaccuauaauuccagcacucuuugagaggccgaggcgggaggaucgcuugagcccaggaugaccuccugggcaacauagugggacuccgucucuacaaaucaaaaaacaaacaaaaacuucaaaugcagaaucucuagggguggggucuugaccucagaguuuuaaaagcucuccaggugauucaaggugcagagagaguugagacccacaccaccaguggcagcuggugacagccucagcuuuuugcuuccuugucacgguagcauuaccucauuauuucgcaguguuguguauugacugagcuaauccccaguuaacucugcagguccccgcuaagcguuugcguucuuccugagccccuguaagccugugcagcagguuuggguccucagcucacgcagcugugugugaguaguaggccuauguucuugcuuuccuccagguuggcgcugcagcucugggauucauucauucauauagcucguauuuauugagcaccuaccauaugccuggaacggugcuagggaaacagcaguguuaaacaggugaaguccugcccgcaugaaguuuuacauuguaguucaggacacaauaagcagguaaguguacguaagacagauaaguacugugaucgauagaaaauaggguagcgugauaaaaggguaauguuauuaguggggccuuucugaggagaugacacauaggugagaccuaaggcaagaggaugagccagccauguacacuuggcgggaaggacauuccagacacugcacauguccagaggcaggaggcagauugacauguuugaggacagaaagaaagccagaauggcugcaggguaguaaguaagguggaguuugcuaaggugaagguccggagccaggcacaguaggauauuaucuguucugauuagcuuuagaccucauuauaaggccagugagaagucacuggggauguuuagugaggggacugaugugcccuaauuuacuuuuuaaaagacuauucugguuguauguggugagugggcuauagggggcaauaacaaaaaaagaggcuggagagaagccgauuaugguacuauaagcgacagauggugggggguuggaugaggacggcagcacagaagauggaagugguuggauucagguuaugcgcagguugagucagcaggacuugcugauauaugggaugugggauaaaggaaaagagaggaaccaaagauagcaccuagauauuuuuuggccugggcaucuaggucuaagauggugccauuuacugagguaggaauaggugaaguguaggaagaauaucucgaguucgguguuaagcagguuaaaccugagaugccaaguacacugauuuccaaguggcaaugucaaguaggcagugcuauauuugagccuggggcucgggcaagagaccagaaaugaaaugagauaaugagaugcauauacacacagucugaagaaaugacuugugaaacuuggccaagacuuguuacagaaggaacauggguuuuuuuuuuuucagcuuagcccgaaacagagccaagccagcccaccuaaaggagcaggagcacgcccaguggcaucauugugacuguacugcugauuggcuggcagccuggggagugucuggcccagguuauacgauacccagggcccucacauuauucaugguggucuucacuggcccaaaguguaaagaucuuuaaggcaagaaucuuaucuagucccaauucuacaaacccgugaacuuucuaaagcuguacucccugcauauuuuuaguaugagcuuccugaaaauagagaugaugccauuuuuaucuuucccucucuccccuacgagugucuagcuaguucuuggcccauaaaaaaacacucaguaaaugucugaauggauaaguaaauaauugguuguggcucaugagacaaagauaauuugaauauaguuucagauguagcagaacuagaugaagagaaguugugaagagugagaaaggaauauuuguguguccugaguggugagaauugauuugagagcuuaccauguuugggaaauugcaggaucuauggaggaaggccauaaccuggccuucaccacugaggagcuuacaguugagcagucagcggcuccauccuuggggaggugagagagcguaacauucacuugcuugauuguuaguguaagaggagccagcaaaggaggaaagaguuuucucuuucggaguugucaucaccuagggcaaucguuucugaucagucaaaggcccacacagguuugagucccagcugcagaugcaacucauggcuguguuagugauucuguagcagcugaugaaugcauuccugguagagugaaccagugcacaauggcagcaggugcauuacucaggaccacuguugcgguaccucauccuaaugucaccugagaaugcaccuggccuuaguaaaucuuugugguaauuuuugaagggcgcaauuccuugcuggaauugaaaacacuauugugagucacuccuacugacacccccagaucauuuauaaagaccuugagaaagcaagaugauucugguaggcucuucauuaaacuggcagcaggagguggggcuuagauccaguugacugacuaguauggagcuccuccuugguuaagccgguugccagaagacagaacuggaggggaaaguagcucugcucaugccgucuuuccauuuccguagaggagagaggcagucaguccuccucucagccucuuggcuuccuucguccuaaugaucacccugaaaggugcacagugcaccuuugccggcgugaucucauuuaauccuuaguacagcugagugguagccauuacuguucccauuuuacagaugaggaaacaucagaaaaacaagacaacgcacuggggguuccguagccauaagagacaagccaagugagaaacagacccagccccucuggcccuagugugcaucgucuccugggugccuggccuuuccucagcugcuguuccaaguuauuguuagaacaaccucuuauuccaugaacgucaaaccacuuccuuccccugguugcccguucaaaccuuuuugggccauagauaguuugggcagcaaauggaacucccuguguuuacccaccuauucuuugccccagccacuaccaguccagaugggaagaaagaugguccugggugggacaccaggcggagaaaagcuggguuaacuaaagggcaaaucaauaauucauacacaaaaccagaguacaaaaaccacugccuccauuuauuccaccucaaauugcccucuggggagucuugugguccacccuaaacccaccaaguggggaggugguggugggagcgggaacacauguaacuccucuuacaccccauauccuauuguguaguuuuaaaaagucaguguuuaugggcuuugccaauuuugaauacaguuugucuaagaacacguguuuccuacagcgcugagagcuuaauaaaagaauugcaacgugggggaagguggcacaacaaauguaauuguugaccuaacaacagagaaaggagcagaucuuucuaaugaguucauuaggugcuuccuaaaagaucccggacugcacaccagcacccacuuauguagcacaaggugcaacuccgaggggcguccuagaagagcugcugcucuucgcccaccagggaguucuaacuguauuguaugcaaguuuaaguauaauaauauuggcccaguuugaaagaaguuaaacuuuuucuuggguuucuaauaagguaaaugguauuuccaccuucucagaggagaauucaaagguuuuuuugauucuguuuucucagucauccauuugaggccugguccuuggcauuccucaguguggcagggagcuagcucccaagccaccuggcauaugcuggccacggugaagccaucucaacguugcucacccccacuugugggcccccugaaguuaugcuuuugaagaguguccuaagaacagauuauccuauuuuuaauuauguauugagcccaucgaaaaccuggaguuguaaggagaaucaucucuaagagggaauacaaacaucuccaucuuuuuuucucucccaauucugaauggcgccagugugagcuaggguaguauucacaccaagggguggcguuuaucucugcauauguaaagcugcagugcuccaccugaagggauaaauucuuggccacuucuggugggucacuacuuuauucaaagauguuuggggucugcccauugccuccugggcagguggcaggcaacuuugugagaccugcagugccucugauccuuggucccagccuguguuuccaaccuugccucgcaccacccuaacaugagccccaggcucagcaagggugucuucucauggucucccaaacuggccaugguacaagcaauucugauccuuugagacuuaagugcgcuguggaucacugcaccccuacaaccgcaaaaaacccaaacacagaguuugucaagaauuugguggcuucccaggcucuuggagcccucccuggguuccccuuaaaagcccugucugccuaaaacacucuuguccugugccucuucaugccucauccucccagucauuucuggucccugugucacucaugcccagguuggcacuccucacucucugcacugucgcugcagugaaacucagcccuuuccugccacaccuccccaucagcacagccaggugcccaacucccaccucgggucucgugcagcggcccgugcuccgcagaucuggcucucacuuacacauugccccgggcaggguugguuucuaauucauguguaucuugucucuguagugugccugccagcuucuccacagcuggccugggucgucgucuuuguggccccucaccguccccuaguggagcacucuuucuauaguaggugcucaagaaauacauuuucaacucaauugaagggaauaggcucccauaacagaaugaacucauuucagaaguucauuaccaagucuugaaaaccuuuuuuuauagauccuccuggaccgaauccagcucuaccuuaauuagcaaagcaauuugcaacacccuuucccaaaagugcuuaugcgucccuuugugugacuagaauaggggccgcuguaccaauugcugucaccacccaaaauucaauuugcaaaaucgaaaucagugccugcagcacugauguagauuuguauguauaaaaguuuaauaugguaaagagaaauuuacugacgacugaacaggggaaaugcaaaaggagcaaaaauagagcuauaaaggacacucgucagaugaacaucuauuuuauucacauuuggggagcagugcugaauuuuucauaauguccccacugcugccuuuucaaacccagcacugcuauuaguccuaaaacgucugugaucucauuaggugugaaugcaaaaucagguaauuuaaagcauguauuaagaauauuucuaaaaaugcaccguccauuucaucagaaaaacugcauuucagagcucaggaauguuagugcuggagucugugaauaaaguguaagcuauaggaacguggugaggcuucuggaauucgacagaugucuccacugacauccuuuuaaguaguaagcaugacuuuuuuaauugcugagcuugaguuaucuguggcuaggaacccagcauugaccaaggcuucaucacuccucaagcaguaagaacuuggcuagaaaugggcaugucucaaacuccugucaccuccacugagcugcuuuuacagccucaguuagacaccuucugaccucagacgggaaacuggauggcaagucuguuuuaggacucagguguuugguuuucuuucucagguuacagcugaguccaggaauucugggaacucucuaggagacugucucuuucacacaggaaguuucagaagugagaguggucgggugcgguggcucaagccuguaaucccagcacuuugggaggccgaggugggcggaucacaaggucaggagauugagaccauccuggcuaacacggugaaaccccaucucuacuaaaaauacaaaaaauuagccaggcgugguagcgggcgccuauaguuccagcuacuugggaggcugaggcaggagaauggcaugaacccgggaggcggagcuugcagugagccaagauugugccagugcacuccagccugggcgacagagugagacuccaucuaaaaaaaaaaaaaaaaagaagugagaguaccugagggucacuuugcuuuuugcacuuagacuuuguacauuuugcucuuauaggagcagcacucugcaagggugacccgccccccaugccccuccugucuguccugcugcucaucagggaugggacuacguggcaaggaaggacagcaccuuauaccacaccugcuugagggugugauacaagguugcugagcaaccuacuggugacuucucacugcuagagaaguuggagcaggaagggaacuugaguugaaagguauuugaggguggggaucuggucagaaugcagguuuaucaggaagcaguguuaggagcccaggagagaggcagaggcuaugggaggaaggcagaucagcuuguggacuccuuuccuaagagcuugguugggaaggugguggggaugguggcaggacgggaagguccagauaagcggccaucaggugaagaccagguacagcaaacagcugcucucucggcagaccauggagagcucagugacugcugagagccaccagggucagucaggagugaagccucagcaguuuuucauccuuccucacuuccguuuccagcgccacccucggcagugcacaccagccaugcugauccacugguaacaugcugacccauucccugggcacgggcuccaccugguccugugccuggagcaccccacucccuugccgguacaugcgcccauccucagccacucauuguccagcacuuccugccuggccccauaggcccauagcaccuuguacaugccccuucauuccacucccaccagggugguucugaacuguucuguccuuuccccucuuauuuuaugagacaggggccuguguuuacuacaacucuuuacuacuaauaacugugagaaaaacuaaucgcucacauuuaucggcguuccaggcccggaauucagagcagcccaagcgucaccucauuuauccucacaccaccggggacguaggggcuauuauuauauuuucuuuuaaaagaaagguuaaguuggccaguaugcuuuaaaaauguucagugcaugaaagacaaaggccgaggaacggucccggauuaaaggagacuaaaagauacaugacuguuaaaugcagcaggacauccuguuuuuccauagauuauuauugagacaauugacagaauuggaauauggacugugcauuagauaauaguguuguaucgguguuaaguggccugaauuugaucauugaacugugguuauauaagagaauguucuuguucuuaggaaaugcacacugaaauauuauggggugaaggggcauuaugcuccuacuuucaaguggaucagaagaaggauauguauguacagauacagagaaagauaaacuguggcaacuuuuuuuuuuuuuaaguguauuucauggggaagagugagugguuugccugacaucacauagcugauaagggauggugccaggagucaacccaggcaguuugacuccccugcucccuacagccuuggagauacucauucacccaagcguccccugcucauagaugggccaaucaugcuauagggucucgaugaaugucuguuaaauuuauaagugagcacacuuugggaggccgaggugggcaaaucacaaggucaggaguucgagaccagccuggccaacauggugaaagccugucucugcuaaaaauacacaaaauuagcugggcguagugguggguaccuguaaucccagcuacuugggaggcugaagcaggagaaucacuugaacccaggaggggaguuugcagugagccgagaucacgccauugcacuccagcguuagcucuuggcugugcgugcccugcugaagaaauguuccagauguguucgcccagaugugugcagaauuccauucuaaugggacuuucccuggacaagcugaccagcagcagggagaccacagccucauauuuuccauucauucuguccacucagauaaugacuuuauuauucagcaaacgcuggccaccuccucaggccauaauccuuccucuucugauguaucuggguguacauucucaugaugaguagccugaacgcaggaaugggucagguagaacuaaaugauggauugucuuuuuuguuugcuguaaaguagggaccucauuugacaugcacagagaggcagcaguggagcugccuauuaaaccacuuuacuacugauuuauuuaugcucugccuucuccaaggaaggauuuaaguuaggaaaaaauccaucauuugaauucugggggaaaaaauauaaaagagaaaguuuuguucuggggagcuuuucaaaauucuuggcagaaaaauauaaagaacuauacauaaauaauaggaaggacagaguaaagggaaaguuagaagaggugcaagagaaaagaccacaccuccucuguaugcugccugucucccugagaagguccagcaggggcacugcugucucuggcaccagagaauugacuuacaucacccuuucuauggcaaggccucaguguucugggccaucuccuuucuagcaggaccuaacugugguccuggcuugguucuccucaguuuacacauuuuaucuuaaauguugccuucuucauguuucuuuccuucuuguagaguuucagcagcuccccacuuaucauagauugagaacucagaugauuuuuuuuuuuuuugccuuugcuaaaagaaucuguuggucugaggccgggcaugguggcucaugccuguaaccccaacacucugggaggcugaggcagguggaucgcuugaggucaggaguucgaaaccagccuggccagcauggugaaacccugucucuacuaaaaaauacaaaaauuagcugggugugguggcacaugccuuuaaucccaguuacucaggaggcugaggcuggagaauugcuugaacccaggaggcggagguugcagugagccaagauugcgccacugcacuccagccugggcaauagagugagagacugucucaaaaaaaacaaaagaaucuacuggucuggccugaagcaucccacaggauuccugccuccucuuccuugcugacggcaucuccucccccaggaaggccugcccuucucccuucugcuugcugaccuucugcuugcugaccuucugcugugcuuccuucagaaccuagcauugucucacuuccaucaugcacugaccacuugagcaugcggggacucccccacugagucccuguagcccacucugcccagcacccccuuuguuaggcacgccuuuccaaccuuacauuucuauuguggcaucucccacugcagcuggugucguggcucacaagucacagaugcucaacaaaugcuuguuugcugauuaauugaucugauuuuucuguagguuggggaguugaugaggcagagcuaugccuccaaaaaguaguuucuaauagcagagcuguaguccagguuugcuucccgcagaguggagaagccagugcuagcugcaggccugcuucaugugaacgcuuuauuaaguauggucuuuccucaagguacagacacugugggaggcaggacuccuuugcucaccuccuuugggauucuuugcuuuucagguugcagagccugaggccugugaucagauguacgagagcuuagcgcgacuccauucaaacuacuacaaacacaaggugagugggccacagucuuuuauauacccagcuuucugacgggacaacuaauaagaaugagugaaaaucugauuagguaauguuuuguaaagacuuggcuuugcugcguucaaaugaaaccaguaauuucaaccaagccaacagaggugccugguagaggcuuuuaggccaccuaaauaaaagcuauuuaaaauugugaauauagggaagaaacaaaaccaauuaugaauagaagccauguauuugauaugccagugugugcuccugggaaugucugacagccauuggauuuauaccuauuuucccauccacucugacggaacugacaccuccccacauucuggugauaaagaugggaugauugggaaagugcccuccuuuuacggagcugggcccaacaugauuacugucaaauuccauuuagagugguuuuucccauacuugaaaaauaugcucauuaacuccacaaacauuuguggccauaugccuauguggaaaauugauuuuuucuaaauccucccugcuaacaugugauccaugagcagcagcaugggcaucaccugggaacugguuagaaaugcagaaucaggggccccacccauaccugcguuuuccagggaggacucacggguacauuauaguuggagcugccuccuggagacuguacugguucuugcgaggccaagucuugaccucgagguggcgcugcucuucuccuugcuaggccuccuggccucugguugcccagggccuaggugaaaugcaguuagagagcagggcuugugugcugaucucuccccucccuucacuuccuuucugccccggugaccaguacccucgccccagagacaccagcuucaguggccugucguuggaagaguacaagcugauccuguccacagguaaugaaagcacagcugccuuuucucauugguuugcaaaugauucugaguuugaguggccaaggggaauugucuaagaagacaguuuugcuugauggaaagucuuguagaacagcccagaggaaauucugaagcuacagggcgcaugcauuuugaccauauacuguggagaaggucaaaggcguuauuuaaaaaagaaaaucuaucuuuagggcuuuuaaauucaaggcugggcaucagggaacagaggaauaccuauuugccaaauggaaguaguugaaaucaggauggaaggaaaauaauuuuauuuuuauggucuuaagagggcuuuauaaacaaugaagguuuuaauuaaaacaaaaaaccauucaauaaacguguuuggggauauccgccuaagaguuaugugacccaggggacguggucuguggguuagauaugaguuuaacuagguauguuuuagagucauugauagacucugauuaucaagaaaggaaacauccugccaagcccguccuuuccuuacuucccuaucuccauugucccuaaggaggggggccggagagccagggaugaaguaggcagguacuggaaaauuacuauuuuuguugccaaguauauuauauacaaaaauagguuaaccuuuucugggagggcauggcccugacacauuuccuucugguauucuagaaaugugucuuuccucuucuucuggcagccuucagcaacuuaaguuuugaggauuugggcuucuagaaaacucucuucugagauuaaaaccugguggugucaccugcuauuacaugucaacucuaacccuauuuuuauuccaguacucucugggaaacuguggugaagauauuuuggccaggcagaaucacuuuauuggcaauuuuuuuuaauguguaaauuuacuccuauaucccuggguccguguaauuagcagcauugaugcacauuauugugagggcccuggacaguuugagcaaaguuugaacuugaagugagggcggaaguaaguuccagaggcccugccucugcccucuguuuuguucaccucagggcagccucugcaaguggaaaacaggcagcaacgaaggcugggagauagucccgccauugguccgcgcugcagcuuguucuggcagcgaguuuaguucaggaaauuugcugagaauuuguuuucacagcaagccucauauuuuuguugcaaauuguguggcguaagcuuaccaaauguuuccucugacaggacaagaaaagaccugcagcaccuuguagugagaggcuuugagggccuggcaagucugaaaugugcuguguucuggguuauguguguguccacccugggauuggggucauggaaagcgccuaagggaggccucaguguccaccuggacacuggaaacauggacuucuggaaaagcuccagagcaggggcuuuuuucuguuaccuuuuuuggucagaaaagauacucuuuuuuucuccaguaguuuuguuaacgugaaaauuuaggcugguaaagcaaaacaauauuauaagaauaucuaaaauuuaacaugcacguaaaauuagauuucauggaacauuagcccuagagacuuuagacaaaugguuccguacuggggggaugguuuugccccccaggggacauguggcaaugucuggagacauuuuuaguugucacaacugguggugcgggcagcggugcuacuggcauuaguggguagaggccaggaugcuuugaaacagccuucagugaugcacaggccagcccacgacgaaaaauuaucuggcccaaaguguugguagugccaaggccaagaaacccugcuuugguuccuggguguagggacguguauguucuuaaacaagagccccucccgccugcauugugguggaugauggcugccuuuucauugagugcgggcugugugccaagcgaguuaccuccaugcuuuucuuuaauccuuacaacuuuugagguacgugugguuuuuuuuuucuuacuuuuucaccucuccccaaguugucugcagauguguguuuuuaucuucauuuuacagaugaggaacccgaagcguagaggguuaaguaauuugcuugaggggacccagagugggagaugaugggcucggauucaggcccaaggccaucccccucccagugccugcucaacuccacagcaugugcugaguccacacaccaggauucaaaucccugcuccacuucccagcugugcaaccugagcaaguuacuucacugccuccugccucaguuuccacaccugaaaacuggggacaggaagggcuguguggagcaggccaaauuuugcgaugaagcaucugggucuguggguugcacagcggacagcgcagggccauuucuuugcccucauacggagcagggcaacgagcagcacaucccgcuuugaugccgagggugaggagagggcaggagaccacugacagcgugcugggcacagagucuggcacacagugcucaguccccgcaagcggucacuucuguuaccuguuugaucugcucuucaggagcugggucuccaccuuuuucaggaacacacugugugaaaagcaagccaugcuugugucgggaaagcccaguggguccaaucuaugucaucaaguuuuagacuucagucccucucucuuuuugucuuccccuuuugcagacaccuuggaagagcuuaaggaaauagauaaaggcauguggaagaaacugcaggagaaguuugcccccaaggguccugaggaggaucauaaggccugagcucaggccuuaccucgugcacauaccuagguguggagucuuguacauugccaucgucaauaaaacugccccaguuuccccuugaccuua

SEQ ID NO: 18263 - RNA, 1790 nt, Homo sapiens
ccaggucccuccccacacgcccgcuguccacgcgcugcggccuuggaguaacugcuguucuuaaaggcugccuccguccugccgcgcggccuuuagaggguuggagcuggcagaaccguaacucccucucugagggugaauacgggccuugauugccagaagggcccucggccggggacgcgggaugaugcggggccgggagaugcuuuccuggaggcugagaaaccuggagggagacccccaaaacuucucaguucgccgaccccuuggucccagagggagaggaggugggcugugccucagcagggucgcaggcauugcaggggcaucacguuagucagagcauguuggcauggaggccacucagcccagggaggcaggacucacgccccaaauggaaggcacgcagucgugccugccuagaggcguuaauauugugccacacuuugggggugaggaucuggcaacuuuauaccuuuuugaguugucuuuucaagucuguaggaucagcccacagcuugguuccugugaagugagcuugcugugacugcuucuucagggacaacuguggucaucuuggggagaugccuuggggucuguggcaagaggcaaaaaggagaaugugugauacucagaaugcauuaaagcgugcucuuacagagcagaagucaguggcugcucaccagagaggggccuggggguugagaaaagcaaaaaaauggaugggcuucuaucagauuucaacacugaugaacuccaguuggggggcaggugccagccagggcuauuaaauaauaacaggaggggcugccauaggaugacaggaugggggaggguggggaggggaagaggaaggggacgugcuccaagaaggcacccagcaccaguggucucauuagcuuuuugcuaucaguccucaacuacauuugggggacaguuccugaccaggcaaucugucagcaaaggggugcugcaaucugucagcaaagggaagaggggaaguuuggggucuuaacuggcucucuacuaagauacccagaggaaugccuucauuugcauaauaaaccagaggaaaauuugagucugccccugaguuccaaagguucuggguaccagggcuugaauccagcagugugacuauucgugccucaguuuuuucauccugaaauuuggaaagucguucuuuccauugugauauucucuagcuagaacccagagaggauaagaaacugccucaugguagccucccaggggagaagguucuaguaggagauggccucagagcaaggacuuccagccucccauccucugguggucugggaggaucacaggaugucaaggccuugcuccuguggccuugauucagauuagcugugguucaagacugccuguguggcacauguggauacgugcaaggucgcugaggcagugcugugcccuuaaaguuuaucugcuuuuccaacccaaaagcagacucccuaaaggguagggaaugccucauuacucacugggcccuccugcagcuccuggcauggaacugacacauaguuggcacuggcaaugcacauacuuacuagauguuaaagaaguccagaaccagaaccagaggcacauaaauaggaucugcaucagcaguggguuagagaaagggugggaaacuaagugaaaucuuagaaugcauccaaggaaguagaucaauuugagcuuuaacuacuggagaauggccccugagaaggccccauuuguucacacguauagcuaauuguauauaccuuugaggaaugcaagag

SEQ ID NO: 18264 - RNA, 2648 nt, Homo sapiens
cacucaccacugaccaaggccaacgccugaguucuuccacucgccuucaucgauacuccacgccaaccacuccgugucaacacuugcuuuucuagccugguggcacuuguggagagauuauuacauacuugccuuuucugcuacgccccaggccugucaguugucagauuaggcagaucaauuuuguuguugccucccucuuuuugaaugccuuuccaugucuuccugaucacugauugucacaggguugguggccaucagaaucucaugcaguuugaugcugauuuguauuuuuuuccuauuuugguugaaaaacugcccugauucacgcuucacucccagcagcuuagagccauucguccagccuuugcguuuggucucagagccccacugugucuugcagcuugcaauggaacugaggauguacaggagaguaggaugaaaacacuggggcugaaaugcacaucuccaggcauggggugggaggcauagaauggaacugcugugugaccagaaacagccucaggccuguggagagggcggcaguggacgcuugcuaaguguggauugauuuggagcuggagauccuggaauccaggagcaagugaauaaaggggcuaaggagauagcgagggggaggccgagagaagcagccugagaagaugcagaccuccauggcgguucaggccagcucagggaggcugagggacgggcauugggccugggggggcaggggggaaggaugccugggagaugaggcccacuuuuggaccacaugugaccaaaggaucagcaauccaguagaaaccugucuucugcagccacucuuuuguagcucugcaggcugccuacucugggggccuugucucuggcuguggcuccaacuccugcccuccccucccuaccugcugccugccugccugcaccaaccacaguccaugucagcccauucccaggcaggcgguaagcaccucuucccuggaaacuaagguggacacacacugccugucucccucugacuguccccaaauccagugaccugagcuccugcagccagagccucucccgacccguuccuuaucccagcagcucucagcugguguggacucacaggccaaccaccacaggcuuuggaggcacacagaggaccacagaggcagagccucauuucccgcuggaucguccucugcccggugcuagggauuccauggugucauucaagagugcugcgacauuuuuuauucuuugguaucuaggaaucugcgacuucccacuuuucuuucucauucucuguccacucuuuaaggccuggcuggagcccuuccccuucacgaaaccccuuuuguccacuccagcccacacagucuccccaguccacuuuuuuugcagcccagauucauuuagccuuuauuaugcucaguuuaggcgucacucuguuuuacucucuaagaguucccuaggcauucuuuuucuuucuagcaagaugauaaacuucuugaggacaagacguucugccccaccaccccccuccugaccuggggggauaaaugaaggguuuugguagcaaucagggaagcuggccuacaugcuaccugccugcguauguaaugguggcugaugguucaauauuaauggauacugaauaagccuggcaccugcuggagacagcgaugacauuugcucucacagcagaugacagggugauugauggcaggcaucucuggguggaagcgaugaguucuccaggggcgaugaagggguuagacugggugcuuagggcccucaagggaccucaagggaauguagagaagccucaggcaacccagggucaggggugaggggaccaggaagagaaaguccgcucaggaaggguguaggcucggacacuguaggaggcagauccaagaggcuuccuaagucagaccucuugucuaaauuggaugggcugagagcuuuggagucacugcuuugcauacgagaccauggggacauagaauccgucauuaucccugccagcucagcucagaggucagaacugaggagggaaguggucagguuuaggguacagggagagaagguaggacguccccuccagggccuagagcuggggaccacagccaggcucuggcaugccugaaaacagggcacaucgcagguggucgguaaagacacgugggauugaacugaacaaugagggauuaauagauucuucuuaaaauugucuuaugguuuaaggagggaacagaacagaguuggaaguaggggacaggaacucagaugugauuuuagccagggcuugguuuaagcuguugugcuucuucucuugugauacuaguuugagccaagggcagcaggggcugcuccuggugagaggacgugggcagggaucccaucagagacaagccaggcagacacuguccagagaggccucucaggaggccaggacagccagcugcuucuccuuaaggaggaggccucugcuccacccuccauuccuccuccccugggccucucucccuuucucccugugagaucuucugcuacuccagccacaggagguauagauccauucccagaacaaaaacugucuggcugcuccugaaacacuuuuucuccuaugcacuacuggcucauccucaugccuccag

SEQ ID NO: 18265 - RNA, 482 nt, Homo sapiens
ccuuucucgcucccgggccaucuuagcagcagcuccugguugggggccaucccacaccuaaggcagaaagaugguggcugcaaagaagacaaaaaagucgcuggaguugaucaauucuaggcucuaacuuguuauaaaaagugagaagcaugugcugggguacaagcagacucugaagaugaucagacaaggcaaagcaaaauuggucauucucuguaacaacuguccaacuuugaagaaaucagaaauggaguacuaugcaauguuggucaaaacugguguccaucacuacaguggcaauaauauugaacugggcgcagcaugaggaaaauacuacagaguaugcacacuggcuaucauugauccaggugauucugacaccauuagaagcaugccagaacagacuggugaaaaauaaaccaugcaaaauuucccuuuaauaaaauuugccagugcuuguuaaaaaaaaaaaaaaaaaguug

SEQ ID NO: 18266 - RNA, 2938 nt, Homo sapiens
guuggggagggguagccaugauuugucccagccuggggcucccucucugguuuccuauuugcaguuacuugaauaaaaaaaauauccuuuucuggacuggagucuccuguggugugugccccuaaagccuggggcagguaggaugggugacacuuguguucuggcccccauccuucaggcugcaggaagggaggggaaauagcacuggaaucaccuccggggaaggucauuuuaagccucuugaugaaaucaaaaccccuagccacaaaacauuuuauuuacaaaauauauacugaauacuauacaucuggccccaucaccauggaaacaacuccaaagccugccuggggauuugugcccaagcccagcccaggagggcuagagaaagcaaaggugucuaccagccgcccccaucccagaaggaaagccucuucccaugagugccugugggugggcggugagcucaacacccacaaagggcagaaggccugggggcagugaggugauggugagggcaugggaagcagaugcugcugaggguggguggagggagaaauggagacccagcacccagcagggggagccaggugacagcaggggaagcagauggcagggccccaggcaguccaggaccccaggcucugaaggguggggcaagggggucaggucacgucuugacauccagcaguggcauccgcuugugcugguagccacucugccagccauguaccaccugucggggaggagaccacaccacaaggcugggcuguguucccugggagucugcagcacccaguuacagcccaaguaagcagaaccaggcucugguuucaguguggacgaguauggcugggaacagggcugacucccaccuugccucauucucccccuggcccccaagugcucaccuuggggucucccaugucagagagcagcuccugcucagccucaugcaguuccucagcugggucauagcuguacauggggagcaggugauggcgcagccgguccacccuggggagcaggggaggggacucagcuaggagguccccccaacccucaucaaacaccuggcugccucgucuccucccuuucccaggcaggggcaauuccagugggugccuuuugggacacacuauaccuccaagaauacaacccugauucuacaaaggggcuuuccccagugaguaaccugaggcuggggcagggaaaacaaauuucaggcuuguaucaggauggcugagggacaucuuacagaaaagucagagccuaugagcaggaauuucagaacgggugugggguuagggcgggugggggacagggacacucaccgcuuuuucuucuguacauacauuaccugcaacagagacacagcacugugggggcugcugagcccaggaaggcccacaggcagagagaggcccaccuccacacccuucacucccuuaacaggacaguggggacucugugcagacuggaccaggcccacccagccccugccuuagcaaagcugugggugucuguguguauaugagggcuccuuaccacagccaccaccaccccgaccagggugaugaggaagaagggccccaacacauagcccaccauggagucgcuguuggccuggggggcauugggcacagugguguuacucaugacaucagcagccggagggcuggguggucagcaugggcaguggcgcuucgggagggcgccuccacugggcucccugggaaggaggaagggagguuaucaguugcacccaggugacauccagacucuggaucccucccccagagcugaagaucuaugaaaacuggucccaggucaaauccugggaggagggauccuccagguagauguacugggugugacccuccagugagucuuggcaaauccuggcaggaaaggggaucaagggaaggccuggauccagggcugagucuugcccaacuccuaucccuaaaucaggguggggcccagcucagaugcuggccaaacauuuacaagucucagcuucuggggaaagauuaagugcagguuucaggugccugccccagcccuuuuggggcauugggcugccagcaccuguccaguggagcaaaauggauaaaugaggucuaaaggaaggaccugcacugcagccaggggugagaugggagcaucugaaggagcccgcuuccauccugguccaaucccacuucaagcgaugggcuccaugccugaguucuaugcccuugucccuggugucaccucagacauacagcccaaacacccucucccccaucugucucgugugccaggguggacacgaguggguaaagcuggauuguaucuucaagaugaugucaccuuccucuugucuccacccggggcuccgcccaggucccuccccuccuggccugagcugacaggcagagguggagagggucaguccccaucgacagaagcaaagagaucguccuggggcaguuugcacgcugauggcccaagguccgcgacccagguucgcuugagucucuaucagagggcaagguaugagcgaccuacccccguguccguagggcacggggcaucgagcuugcccuuacccagucguaugcucaucgucccaggucaagggggcaugccaggguggggagggcgucaggccgcugcuaggaugcgggccagcaacagcggacaggaggugguucccacggcgcugggaggcucaggccggagguggggguguugggggaugcggaugggccgccccgcgcccgaacauccuggaagcccgucacccgaggcguggacccgugccggcgcucugcagcccagccggccuggccaugccuuaccucccgccgcugcagccccgacaggaacgcccucgguuggcucccgggccccggaaaagccgucaggcgcgugaucaaaggacccggggaaaugg

SEQ ID NO: 18267 - RNA, 12937 nt, Homo sapiens
ccagauugaagcguuuaacaacagaccuuggaaaaguuuacagcauccuucgguuuccuaaacaagucucucugccuuuauuucuagaugaauaagccccuggaugaauccugcauaugccacuuagacuaauccaaugagguucacuacaaggaacuacaauuugaacuucaagcacaagagaggcucaaagacgaacaucuugaaaaugauacauccagaggcaauuuuaauaaaacaaaagcgaggggccaggcgcgguggcucacgccuguaaucccagcacuuugggaagccgaggcgggcgguuccugaggucaagaguucgagaccagccuggccaauauggugaaaccccgucucuacuaaaaauacaaaaauuagccuggugucguggcgggcgccuguaaucccagcuacuugggaggcagaggcaggagaaucgcuugaacccgggaggcggagguugcagugagccgagaucgcgccacugcacuccagccuggcugacagaacaagucuccgucucgagggaaaaaaaaaaauaaagcgagguccuguguagccugguggaagguuccaaguuccucagagaagaaaaucaauagaauuuccuccagaggagccucgagauucuacaaggcguaggaguuucugcaggaggugagggagaucucauauauauauauauaagauauacauauuugcucuuaauuggcuuuugugagcuacgauagcuggcacccuguagcgagcgagagugaacccuggcugugccaugcggcggaggcugccaccugggcacucccaccauucuucgcagccgggucagaacgggagaccaggcgagcccggagcagcguggacucggaccugcgcgcccuccgguacccuggcccgcgggccgccugccucgccccgggcacgccacaagcccaccccgcccgagucucaggacccccgaucucucuggggacccaagagacgggugggggagaaagggucugcaggcagcggcccggcccuggcgcguacccaccugagcagacuggagaggggguggcuggaagagccgaggccgccgccgccgccgccgcugccgccgccgccgcccccagagccaccgccgccgccgcccccaaagccugaggagagccgcuucccggacagcagcuucuccaccgccgggaggugcccggugcgggccgccuccagcagcuccugcuccuuccccauccccagggccgccacccgcuggacccccuccccgaggcugcagccgagccugcucgggcucccaaacuuuccgucuccgggcaacgcaccccccaaaccggcuggggacaccacccccucccugccuuuuccccacgagcgcgucacuuccgggauccggcgucacgcgucaccgcgcccccgcgccccgcccccuagcucaccuagcugggcggggcuccgcggaccagcgcagguggacuuugcugugccgagacacgccucucggggcauggggacagcgccuugugggcccccauuaugcagguggaaagggacaaacaggcccaccuguacgcgccucccgaagugcgcuccuuccccaaagguuuugggagcuccugggacaggaaauacgguaauucguccaggcagcguagaaacaaagagauaaauguaacgcgcaccuacauuuccaaguccauucuuucagcacgcauaaauuaaauauguaauaggugcggggaccuagucauacccaggugaauaaaacgcccucccccucguaucucaaugagggaagagaagaaaauuuuaaaacagaaauauccucaccacuucauccucccaguacgugaacuaguucauuaaagugaaacguucaaaggagacaccuuccucucuuuaggcuuuccucuuaguuuuaaugagauuaaccaaacugauagaaaagugucagacuuguaaaaacaaaccucaaucuucaguacuggcgaacugaaaaaaaucauuuaauuggguagaaacuauguguguuuuguucccugguacuagcacuguuucuaaaucgaaguaggcagucaauaguuguggaugaauaaaugaauuggauaaauucugcucgagcuauaugacuuuuuguuguuaaggugcuugcggaauggaggggaaaugcuagcaauucuauguacacacaggcccgcgguuucgggccaguugaaauauacaagguugaguccuugccugaaaguuuaccagucccggggagccucauuccacgacaccgccauacaacggaacugaguuuucucccagucccccaacuuuacucugagggguuaacgaagggauuaacugacauugcauuuuuagacaggcgaaaaggaaaaaguuauuuaguaaacaaaacugcgcuccuucacaagugcugguuuccuagcgaggaggauccauagucugagcucuuuacguccaauuuucccgcuucccacugucgccaaaccaaaguuaaaaugaguccucuaguccucuacgcgcgccucaaaaugaccccucaggagagcgguaggggugaugucaucgcugcgcgacgacaggaaguaagauccuggccugugcagcucggguuuccgagcuucugccucaggcaucuccgcgaucuccucuccccuccaauccuauccgugauggacgaugcccacgagucgcccuccgacaaagguggagagacaggggagucggaugagacggccgcugugcccggggacccgggggcuaccgacaccgauggaaucccagaggaaacugacggagacgcagauguggacuugaaagaagcugcagcggaggaaggcgagguaggaagagauguacugaugaggcugaaggaauacccagagauuguguuacuggcugcucgccgggcuucugguuagucccuaacaaguuacgagaacucgaacucaccagaauucccuccagaucguuaaucuugagggggaagagaggggacgaccaaacaaaacuccagugcugguucgguuccagaggcucaagcacuguuaauauuuuuagucuugucuuuagggauuaaagcuacuucuaagggaguuauaauagcccguuggcuuugguggugaggaaauugggauccaaugucacacugagacguagugcaagagcuaaaacccaggauucguagcaccccuuucaccgcaauaugguuccucuuagauguuaagacaacuuuugucuuuauaggaaggagggucgaucagaccugucaaagggagauagacuuuuauaucgaaaagucuauaucgauauagacuuuuauaucgaacacgauuuaaccugagagucgcccgggcuggagaacaauggcgcgaucucuggcccacugcaaccugcgccuccuggguucacgcgauucuccugcuucagccucccgaguagcuaggauuacaggcgcacaccaccaugcccagcuaauuuuuguauuuuuaguagagacgggguuuuaccauguuggccaggcuggucuggaacuccugaccucgugauccgcccgccucggccucccaaagugcuaggauuacaggcgugagccaccgcacccggugaucagggacccaucaauugggucugguguuuuuaugcuacagagaguucagcaguguugccuagcugaguaucggucaggaccagaaacucaucguucucaggauuacauuucuagaaguagaaucuuggggucuuacagcuagaagggauuuaagagaucgugggugaacaguagauuagauggaaauagccuuucagagcauaaaguugcaucaaaauguauaaaguacaaacuuuuagaaaaagagaaaauuugucugggcguaguggcucacgccuguaaucccagcacuuugggaggccgagguggguggaucgccugaugucaggaguuugagaccagccuggccaacauggcgaaaccccgucucuacuaaaaauacaaaaauuagcugggcaugguggcgggcgccuguaaucccggcuacuuaggaggcugaggcacaagaaucgcuugaaccugggaggcggagauugcagugagccgagaucgcaccacugcacuccagcuuggguaccagagacuccgucucggaaaaaaaaaaagaaaagaaaagaaagaaaaaggaaaagagaacauuugacaaaaguauuuuaaggcagguuuuuuguuuguuuuuuguuuuuuguuuuuuguuuugagaccgagucucgcucuguugcccaggcuggagugugcaguggcgugaucuuggcucacugcaagcuccuuuaaggcaguuuuuguuuguugagacaaggucucacucugucacccagccuggagugcaguggcacagucucugccuccugggcucaagcaauccucuuaucccagccuccccaguaacugggacugcaggcaugcugcaccacgcucaucuaaaguuuuuguuuuguuuuguuucguuuuugagacagagucucgcucugccgcccaggcuggagugcaauggcgcaaucucggcucacugcaaccuccgccucucaggcucaagcgauucuccugccucagccuccccaguagcugggauuacagacacgugccaccgcgcccagcuaauuuuuguauuuuuaguagagcugagguuucacaaguuucacaaguugcccagccuggucuugaacuccugaccucaugauccauccgccucggccucccaaagugcugggauuauaggcaugagccaccgcacccggccagcuaaagguuuuuuaaauauuguuuugguagagacaaggucuuauuauguugcccagucuggucuccaacucguugggcucaagcaauccuccugccucagcuucccaaagugcuaagauuacagguggcagccaccaugccuggccaagaaggaaacuuuaaaacaggugucaaggacagcaaggauuugaauaauuagcuuaguacacagagggcucacuacauaucuaaauuugcaccgaacagaggauaaaauuauguuguuucugaaacacuuuuaaaaaucgaucauguaccagaccacaaagaaaaauaugaacucuuaaaaguagaaaucauaacaggccacaucuuguuaauguaaugcauuaaacuugaaauuaacuacaaaaagcuucucccccaccaaaaaagaacuaacccccuggaaauuuuaaacuauuuuuuaaauagccuuuagacuaaagaaauuaauagaacacuuuaucaaaguauaugggauuuggccaaagcuuuauuuaaagaaaaauauauagccuuacauauuuuuauuaacagccagaagauauugcaaauaagcaccuaacucaagaaaccagaaaaagggccuaguggagugggucacgccugcagaucuagcuaccuggcaggcugacacaagaggaucacuugaggcuucagugagcuaugauccagccugggcaacagagcgagucugggggagaaaaaaaagauaaagaacaaaauaaaucagaagaauguaggaacaaggaguuaauaaggauagaaguagacacuaaugaauuagcacauuaaaaaacauaaaugauaaaauuaaaacauuauuuaaaauguaaauguauaacauuacaaaauaugaaaggcuauaggcacuaauauggagaucuuuaaaguuauaaagacauuuaauguucaaguuuaggccaaauaaaugugaaaaucugagaaaaauaggugauuuuuuaaaggaaaauacaaaccaccaaacuugaagcacaguuagaaaacuuguauaaaucaguaacuaaaaagaaauugaaaagauugucaaagauagacuaccuucaucccaccuauucccauauuccuguaugaguuuaaauuugaauuccucuuuagggacaaguuaaaucucauuaaugaguuuuguaguauacuuaagauucuacauuaagucagagggggugaaguuuggauuugauuuuuauuauuaaacagccaguuuuuuaaguucagggguacaugugcaggaugugcagguuuuguuacauaaguaaaugugugucauagggguuuguuguauagauuauuucaucacccagguauuaagccuagugucccuuaguuauuuuuccugauccuuucccuccugccacccuucauccuuccauauacccuucacccuuccauauaccccaguguguguuccccucuauguguccgugugcugucaucauuuaguucccacuuauuagugagaacaugcaguauuugguuuucuguuccuacauuaguuugcuaaagauaauggucuccagcuccauccaugucccugcaaaggacaugaucuccuuuuuuauggcuguauaguauuucaugguguauacuggaaaauacauuuucuuuauccagucuaccauugaugggcauuuagguugauuccaugucuuugcuauugugaauagcacugcaaugaacauaaguguggaugugucuuuauaauagaacaauuuauauuccuuuggguauauacccaguaaugggauugcugggucaaaugguaauucugucuuuaggucuuugaggaauugucacacugccuuccucaauggugaacugauuuauacuccaaccaagaguuuaaaagcuuuccuuugccuccacaaccuugccaguaucuguuauuuuuugacuuuugaauaauagccauucugacugauaugagaugguaucucauuaugguuuugauuugcauuucucuaaucagugaagcugaccuuuuuuucacaugauuguuggccacagguaugucuuguuuugagaagugucuuugccuacuuuuaagugggguuugaacaggcauuuauuaaacauccagcauaaguaaaauugcauuaaaugcugaugggggggagauauaaauaauaagagacaaaccuaucuucaaaaagacuaguaaugugaaauaaacauuugcaugaaacaguaggauugaagaauaagaacaaaagagcacuacgugugagaagcucacuugaaagucccaaauugaaauaaacacuguuuugaugagaaggggccuccuuuuuaauauucuuuccauguggaaucaucagcaguaaagagaucuauagaucuggaagcagaagagcuggcuggauggaggggacuuugcugacauccccucugaaaaauaaggucagaagagugggcccgggggagggugauuuucaugauccauggcauuucauuacccuuguaaacagauacuggagcugugcucauagccaaacuggaaaacuagauuauuuagcagguuuucuuuccauagcugagccauaaucuucccuuaggagagauacuguaucuuauccuugaugguacagucagugccuagaacugaaaaacuacucaauaaauggauuuguuguuuugugauaaggaugaugucuucuuacuuugcccaagccuggaaaguaggccaaauauauaauagaguuucuuucaucuucccagcucgagagucaggaugucucagauuuaacaacaguugaaagggaagacucaucauuacuuaauccugcagccaaaaaacugaaaauagauaccaaagaaaagaaagagaaaaagcagaaaguagaugaagaugagauucagaagaugcaguaagucacuuucuuaucauuccccauuucgaggcucucacuugaccacacaaauuuaauaaauuuuucuugguguuuaaauuuucuuuuauaaacucaaaagaaaauaaaacgauuaauacauuauggcugggcaugguggcucacgccuguaaucccaacacuuuagaaggccaaggugggaggauuucuugaggccuaaguuugagaccagccugggcaacauagugaaacccuuucucuaauguuauguuauguuauguuuuuuuuuuuauuuuuuauuuuuuugagauagagucucacugugucgcccaggcuggagugcaauggugugaucucggcucacugcagccuccacauccugaguucaaacgauucucaugccucagccucccgaguagcugggacuacaggcaugcaccgccaugcccagcuaauuuuuguauuuuuaguagagacaggguuucacuauguuggccaggcuggucuugaacucaugaccucacgugaucugcccgccucggccucccaaagugcuaggauuacaggcaugagccacugugcccggccucuauuuaaaauuuuuuuuuuuugagacagaguuucgcucucguugcucaggcuggagugcgguggugcaaucucugcucacugcaaccuccgccuucugguuucgagcgauucuccugccucagccucccagguagcugggacuacaggcuccugccaccaugccuggcuaauuuuuguauuuuuaguagauacagguuuuugccauguuggccaggcgggucucgaacuccugacuucgugauccgcccgccucagccucccaaaaugcugggauuacaggugugagccacugugccuggccaaaaacaauuuuuucaaauaauuauguuacagcauagaaaauauaaauagauaaaaagaaggccgagaucgguggcucacaccuguaaucccagcacuuugggaggcugaggcggguggaucacuugaggucaggaguuugagaccagccuggccaacauggugaaaccccgucucuacuaaaauuacaaaaaauuagccaggugucguggugggugccuguagucccagcuacucgggaggcugagguaggagaauuacuugaacccaggaggcagagguugcagugagccaagacugcgccacugcacuccagccugggcgauagagccagaugcugucucaaaaaaaauaaauagauaagaagaaaaaauaauuaccuuaccacagagauauauccugcuuauaaguuucaagauaguuucuauacauauauaucuauaaauuuuuuuuuccacaaaugucaaauacuguuuuguagccuauuuuucacauuagauauggugaauguuuuccaugucacuaauuauacaucuaggucauaguuuucuuaaaaauagaaauagcuuuauuacauuuucugauuguaaaaguaguaugggcucauugcaaauaauucagagaauacagaaaaauagaaaaaaaucacccauaaacucaccacgcagaguucacucuaaguauauaguuggguauaauguuuggguauguaccuuuucaaaguuuuuuuagauguuugauauguauagcuaaauauuuucaugucaguaaauaugcucauaaaucauaauuuuuaauggcuacauuguaucccauuauguuguugaacuauaauuuaaccaaucccuauagugcuucugguuggguauuuuuacuuuugacauuaugaugaggaucuuuggacauaucuuugcauacuuguccauuacuuccuaagauaaacuccuagagguguaauugcuaauucaaauaguaugaacauuuucaaaggcuuuucauauguauuuccaaauuucucuccaaaaagguguuccaguucacucugccagcauguguuugugucccauauucuaauaccauucuuuuuuuaauaguggucugauuuaugaaaaauguuaucuaugaaaauaauauuuccuuaguuaauaaugaagguuguuucccccauguugauugaccauugguauuuugguaaauuuccuguucauguacuuuguucauuuucaaaaauugacauggccccuuuauucauuugaaagaauuauacauuaggaguauuaacuguuuccacauauuuugcagauauuuccccuaaaucuguuaauguugaaaacuacugguuugauuauaaauuuguauauuaaauuuuuaccaucagugugaaauucaauaagauagaguuauggagauagugucuaaugcugcaaacagucuguguaguacgauacagugacccaguguuguucuuuuuguuaacagguaagaaaagaaguuuuuguuuuacguuuucucaaauuccuuuggaguagaaguguuuuaucuucauuccucaaggcaccaagccuaaugccauugaccccuuuaagaauucguuuuugaauugucugaaacuuuuauugacuucauaauaucuugaguauucguucuuauaaguuaacuuaguuaccuggaucuuuguuuagaauccugguuucuucuuuuucugaggagcagcugaaccguuaugaaauguaucgccgcucagcuuucccuaaggcagccaucaaaaggguaaggauggaccaccacacuucaucuccaucacguuuuagaacugaacucaagagccauguccauuggcauuugaagugagguguuagacaagucaggggauuauuuaggugggaaaaaaaaugcacuucaguuaucuuaccuuuuucugugaauuacuugguacuguguuccaaagccagucuuugacuauugugaucacggagucuuugugcuucuuucaagcugauccaguccaucacuggcaccucugugucucagaauguuguuauugcuaugucugguauuuccaagguuuucgucggggaggugguagaagaaggugaguaguguugguuacaaauacuggauuguaccugugguggucuuauuuuuaagaauaucuacacaaaggagcuuauuaaagcaccuaugggaguucucauuugcacuugaaguugaccaaguggggagcccuuuauuuaggagaacaugacuguuauuccuugcaaguuucaauaacagaugguaaggaaccaucugggaaauccccucccugauuccuuuccucagcccagggugaaagaaguagacuuuguauuuucugcaguggacuuugcucauuucugcugccaaaaguaaagauacaagaaaagcaaucacaggggugaccugugugggauggugaguugucccuaauguugugaucccuaggaacugccugaccccuuuauugaguaaaaagccuggcuguuucccauugcuacucuagcuggugaaauuuuuuuuuuuuuuuugagcaggagauauauacuuuuaaauuauuauuauuuuuugagacagggucucacucugucacccaggcuggagugcaguggcaugaucuuuauuauuuuuuuuaauauuuuuuauuuuuccuuuuacaaaucacaaauuaagaugguauacaaaaugagaugguaacaguggugugaucauagcucacuacaaccucaaacuccugggcucaaaggauccucuugccucagccucccaaguagcugggacuguaggcgugcacuaccauaccuggcuaauuuuuaauuuuauuuuuauguaguuauuugagacagggucucacucugucacccaggcuggagugccuugaucaugcgaucacagcucacuguaacaguuagcuccugggcucgggugauucuccugccucagucugaguaguugagaccacaggugcgcaccaccaccccuggcuaacuuuuuaauuuuuuguagagacaagguuuggccauguugcccagguuggucucgaacuccuaggcucaagcaauccucccaccuuggccucccuaacugcugggauuauaggcaugagccacagcauauggccuauaggaaauauauuuuaaacuguugucuaugauaaagccuguuaugagacguuauacuaauauucucuuaaaaaggaaaaaugucuguuuauuuccuuagcaagcuuaagaaaaguuaacaagaauuacaggacucaaaaggauuaugugauuaguaaauuauugugugauaaucagacuuucuccuuacccucuguuuagcacuggaugugugugagaaguggggagaaaugccaccacuacaacccaaacauaugagggaagccguuagaagguuaaagucaaaaggacagaucccuaacucgaagcacaaaaaaaucaucuucuucuagaccaaagucuagaaaggccuauguuacugacggaagaaguauugguuccagacuuccuauaagacugucugcauuggugcuuuaguaucucaggccuccaaggauuccaugaugauuuuaaugucuuucucaaaacucugauauuugucacaccuagaaaguauguagccugauugauacuugccuugacuaaauuuugggaccucuuggggcauuuugaaguauuuaacugucuugaccaguuggaagaagauacgugggccauaagcaucuucuggacaggggaacugcuuucagagagaaaaccuuuccaagagaguuuuguuuuguuuugguuucguuuuguuugagauagggucuugcucuaucaccuaggcuggagugcagcggcaugacugcagccuugaacuccugggcuuaagugacccucccaccucagucuccugaguagcuaggacuacaggcacacacuacugugcccagcuaacuuauuuuuauuuuuuauggagauggggucuugcuuuguugcccaggcuggucgugaacuccuggcuucaagcaguccuccugccucagccuccuaaagugcugagggcuuuaaugguuucacauugaagccugaaguugcuaagacuuagguuguuucuuauaucugguuuuaaguagaugaaacaaccagaaacuuuuacuugugauacucuaccaugaaggaugcgguaauggcaggaauagcagaauaauuggugcuuguaaacauuuaagauucuccuguggauuuuggugagugaucauuaaacuguuuuccaacuugcccuagguguauucauuuucugucuagcugguuggaaugggaaguugaucauucuuuuuugguguuccaauacaacu

SEQ ID NO: 18268 - RNA, 2840 nt, Homo sapiens
gagcacaacgagcgggaccgcaggauauacgccaacauguucaagaaguuugcagagcaggaugccaaggugugugcagagccugaugacugcagguggaucaagagccugaccaugccccuuugauuuuaggggacaggaacagcuaaacaacccaagaggcucaagagcagggaaaacgauuuccaaucuaaucugaggcugcuuuggauccaaaggucgaguagggcaguuccagucaccaaaggcacacgucaugagagaugagaaaacuaaauucccuucagauguauuagauugguucaaaaguaauugugguuuuuaccauuacuuucaauggcaaaaacagcaauuuugcaccaacuccccccgcccgccccccgggccccugcccgagucagagucucacucugucacccagacuguaaugcagucgugcuaacauggcucacugcagccuugacuucucuggaucaagugauccucccaccucagccuccugaguagcuaggacaagcacacuaccacacugggcuaauuuuuuaaaauuuuuuguaaagauaggguuucacuuuguugucuaggcuggucucgaaccccuggcuucaaggguuccuccugcuuuggucucccaaagugcugggauuauagacaugagccaccaugcccagcccuuuugucauuuuugaaaaauuguaaacccaucaggauuuuuuuuucaaguaagacuuacgauuuucccaggaaaugggauguuauaggagccccaucaucacaccuguuaucuugagggucggcagccagccugaaaaauguggcaggagaggucugucugcagagagggcggccucccuacagcauaguuggcauucugguccuguccccagucuccaggaaugcccagacuucauuaucccacagcugucccaugugucaaccaaagaaaggugaagcucccacucuaacuauugguagcacagcccugaccuacccagcuagauauccuagagaaaaucauugcaauaccucguguuugggaccugauacacagucuggaggagccaggaauuauuucacuucuuuauucucuaaccuucuugauugcuuauuucuuccuuaggaagaggccaauaaagcaaugggcaagaagacuucagaaggggucacuaaugaaaaaggaacagacagucaagcaauggaagaagagaaaccugagggccacguaugacgccacgccaaggagggaagagucccagugaacucggccccuccucaaugggcuuucccccaacucaggacagaacaguguuuaauguaaaguuuguuauagucuaugugauucuggaagcaaauggcaaaaccaguagcuucccaaaaacagccccccugcugcugcccggaggguucacugagggguggcacgggaccacuccagguggaacaaacagaaaugacugugguguggagggagugagccagcagcuuaaguccagcucauuucaguuucuaucaaccuucaaguauccaauucagggucccuggagaucauccuaacaauguggggcuguuagguuuuaccuuugaacuuucauagcacugcagaaaccuuuaaaaaaaaaaugcuucaugaauuucuccuuuccuacaguuggguaggguaggggaaggaggauaagcuuuuguuuuuuaaaugacugaagugcuauaaauguagucuguugcauuuuuaaccaacagaacccacaguagaggggucucaugucuccccaguuccacagcagugucacagacgugaaagccagaaccucagaggccacuugcuugcugacuuagccuccucccaaagucccccuccucagccagccuccuugugagaguggcuuucuaccacacacagccugucccugggggaguaauucugucauuccuaaaacacccuucagcaaugauaaugagcagaugagaguuucuggauuagcuuuuccuauuuucgaugaaguucugagauacugaaaugugaaaagagcaaucagaauugugcuuuuucuccccuccucuauuccuuuuagggaauaauauucaauacacaguacuuccucccagcauugcuacugcucagcuucuucuuucauucuaauccuugcuauuaagaauuuaagacuugugcuuacaauauuuuugaccuggaguggaucuauuuacauagucauuuaggauccaugcagcuuuuuuugucuuuuuaagauuauuggcucauaagcauauguauacugguuuauggaacuuuauuuacacuccucuaucaugcaaaaaaauuuugacuuuuuaguacuaagcuuaauuuuuaaaaacaaaaucuguaggguugacaaauaaauaguugcucuucuacacuagggguuucaccugcagguuugacacgcaguugcucgcuuuuccugcccugucaagcuucucuguucuggcgugaguugugaaagaguugaagacagcuucccaugccgguacacagccaguagccuaaaucuccaguacuugagcugaccauugaacuagggcaagucuuaaauguguacauguaguugaauuucaguccuuacggguaaacagauugagcauggcucucuauucccucagccuaagaaacacucaugggaaugcauuuggcaacccaaggaaccauuugcuuaaaccuggaacaucucaccuuuuuaaauccuaaaaaacacuggcaguuauauuuuaaauuaguuuuuauuuuuaugaugguuuuaucaaaagacuuuuauuauuagauugggacccccuucaaaccuaaaaaucaaguuauuuccuuuuau

SEQ ID NO: 18269 - RNA, 2952 nt, Homo sapiens
aaguaaaaucauccuccacccagcuuccccaggucuguuccaguuuccccaacucugcaggaggcagccccacuccucccuacccccaggcuaaaagugaggccucagccuugacucacccugcccauccaaccagucccuggcccugagagucuucugcagcaauaacuucauuaacuugucuuccugcagcugccacccuggccuggccaccaucauccuaggagaaugggccaccauccuccuuccucauucuccagccccagucucaucuuccuuccaaggcucugcaucuugagaccucuccaagcuccuccucaugucgcauguggaucaagccuuccccuuuggacccugccuuucuauuccaccuuaucucuggggucuaucuguuccagaagccuugacucuuacuacccucugauaaccacagacgugccgugugccaggcguccuacagccauuaccuuuagccuuuacagcuacugugcagcauaggaaugacaguauugucccuuucacagaugaggaaaacugaggcccagagagaucaugcacaggucacacugccuguaaauagcagaguugggauccaaugucaugacucagaaggguucucauccaaagcccuucauccugugaaacaggucccauuacaccccuucccuucucugcaaggggcucuugcugcuccucgaccagugccugccugcuccucccagcugccuccagucccgcagcccacaccuccgccgcacagcuccucagauguuccagcccacacugcucagccccgccuccuaacuuuucuggcaggaaucucagcccugcacaguuuaguacuuaauuauagauugccuuguacaguuuucugcuuauuucacauuugccugucuuguucccaagaagccugcaaauaucugauuuggggauggagcuucugugugcuccugucccccagggccccgacacagcacagggcuuggcacacaagcccucaguggagcugaccucaccucccaggaagggggcagggucucugcuguccaaaagcugacuggacuccacccugacacacccgcccccaccccagcaguaugccucagauaucugcacacacaugcacacaugcauacacacgcauguacgcacacacacuuuaucuaaucuaaagcucucuuuucaaccugaggcaaugauaugccuggaauuaccuacccaagacagaaaacucccuccuaacugaagccuggccuugcccucacuguggaauucccaugcagauaagugaguccaccagaauggugcaagcuccccagaagcggggaagccacugaugucacauccuggauuggcacuugguggaggccuuggugucuugauucugauucugguccuguugcuguguggucuuugaggggagcgggagacgccaucuugccuucuuuguuauaucuccaugaggggacauuuugugggugugagaaccacuccuccccaucaggaccacaugauacagccccucagggggcagaaccgcagccccuggagcuaacccugguccucucacaccaccucccuuaccaaaacgucucucugcccugaccccgacguccccacaggugaccuccccagcugcuccuccuugggguuaaacauugcuaucucaaacuucucauuucugagcgggaagaagaacacgcaacacgaagccucacacacuuagaaugaucuagauuucagguugauuucuuccugcacacuuagaagauagcaugagggcuuggggcuugucgagagggcacugaccaaggucacagggucagugaagggcccaggagaagaaacagagagaggugcagaggcggugguggguggggccgccaaagucacacuucucuuaaaauuuuacccagggccaaugcuaacauguaaauaaacaagugaauaaacaaagggguguuuauguaagaaaaacaaauaaaaaugcuuguguaacacaucacacauaccacauagccugaaggagcccaggaggggcaucucuuuugggggacccguccaaaagagaugggguaggcaccguccuccuggagggaggcgggcuuggaagcccuucacggccgcagcagcauguuggggagggagguguacaccgauaaccaucacggagguuuugcaacugaauguugcagcugagggcugggcagagcccgccuccuugggcauggcccugugcuggggagcagugaaugcgcccugguauaccauggaugggcagagggcugaggaucccgugcccgagaugaaucuagccaagaaaugaagccaguggggggcucacaggaccaagacccugcucacacaccgggggagccuucugcaucucauucuggggccccuuuccaaccuuuggaguugccuccuggcggagcuuaacaggcugaggcagcuuccugagcagccugugguugcuccagccggguagagacagccacauuccaagcuccgggguggcagggaagcuggguagggaguuccuacagggagcggcagcccaggcucgggcaggcaagugcugaaggguggcuccgccuuccgcagaaagucagaggccgaggagauggaagaacagguguucaagggggacccggacaccccucacuccaucuccuucucgggcaguggauuccucuccuucuaccaggcgggggcuguggacgcccugcgggaccuggccccccggaugcuggaaacagcccaccgcuuugcggggacaucggcaggugcugugaucgccgcccuggccaucugcgggauugaaaugggugaggccuguguucuggguccccugggaagucucuugggggauuccacagagacagaaggagcgugagggaggcuggggaugcuuugggggacaaagccaggccuggguggcaggaagggaag

SEQ ID NO: 18270 - RNA, 2952 nt, Homo sapiens
cuucccuuccugccacccaggccuggcuuugucccccaaagcauccccagccucccucacgcuccuucugucucuguggaaucccccaagagacuucccaggggacccagaacacaggccucacccauuucaaucccgcagauggccagggcggcgaucacagcaccugccgauguccccgcaaagcggugggcuguuuccagcauccggggggccaggucccgcagggcguccacagcccccgccugguagaaggagaggaauccacugcccgagaaggagauggagugagggguguccgggucccccuugaacaccuguucuuccaucuccucggccucugacuuucugcggaaggcggagccacccuucagcacuugccugcccgagccugggcugccgcucccuguaggaacucccuacccagcuucccugccaccccggagcuuggaauguggcugucucuacccggcuggagcaaccacaggcugcucaggaagcugccucagccuguuaagcuccgccaggaggcaacuccaaagguuggaaaggggccccagaaugagaugcagaaggcucccccggugugugagcagggucuugguccugugagccccccacuggcuucauuucuuggcuagauucaucucgggcacgggauccucagcccucugcccauccaugguauaccagggcgcauucacugcuccccagcacagggccaugcccaaggaggcgggcucugcccagcccucagcugcaacauucaguugcaaaaccuccgugaugguuaucgguguacaccucccuccccaacaugcugcugcggccgugaagggcuuccaagcccgccucccuccaggaggacggugccuaccccaucucuuuuggacgggucccccaaaagagaugccccuccugggcuccuucaggcuaugugguaugugugauguguuacacaagcauuuuuauuuguuuuucuuacauaaacaccccuuuguuuauucacuuguuuauuuacauguuagcauuggcccuggguaaaauuuuaagagaagugugacuuuggcggccccacccaccaccgccucugcaccucucucuguuucuucuccugggcccuucacugacccugugaccuuggucagugcccucucgacaagccccaagcccucaugcuaucuucuaagugugcaggaagaaaucaaccugaaaucuagaucauucuaagugugugaggcuucguguugcguguucuucuucccgcucagaaaugagaaguuugagauagcaauguuuaaccccaaggaggagcagcuggggaggucaccuguggggacgucggggucagggcagagagacguuuugguaagggagguggugugagaggaccaggguuagcuccaggggcugcgguucugcccccugaggggcuguaucaugugguccugauggggaggagugguucucacacccacaaaauguccccucauggagauauaacaaagaaggcaagauggcgucucccgcuccccucaaagaccacacagcaacaggaccagaaucagaaucaagacaccaaggccuccaccaagugccaauccaggaugugacaucaguggcuuccccgcuucuggggagcuugcaccauucugguggacucacuuaucugcaugggaauuccacagugagggcaaggccaggcuucaguuaggagggaguuuucugucuuggguagguaauuccaggcauaucauugccucagguugaaaagagagcuuuagauuagauaaagugugugugcguacaugcguguguaugcaugugugcaugugugugcagauaucugaggcauacugcuggggugggggcgggugugucaggguggaguccagucagcuuuuggacagcagagacccugcccccuuccugggaggugaggucagcuccacugagggcuugugugccaagcccugugcugugucggggcccugggggacaggagcacacagaagcuccauccccaaaucagauauuugcaggcuucuugggaacaagacaggcaaaugugaaauaagcagaaaacuguacaaggcaaucuauaauuaaguacuaaacugugcagggcugagauuccugccagaaaaguuaggaggcggggcugagcagugugggcuggaacaucugaggagcugugcggcggaggugugggcugcgggacuggaggcagcugggaggagcaggcaggcacuggucgaggagcagcaagagccccuugcagagaagggaagggguguaaugggaccuguuucacaggaugaagggcuuuggaugagaacccuucugagucaugacauuggaucccaacucugcuauuuacaggcagugugaccugugcaugaucucucugggccucaguuuuccucaucugugaaagggacaauacugucauuccuaugcugcacaguagcuguaaaggcuaaagguaauggcuguaggacgccuggcacacggcacgucugugguuaucagaggguaguaagagucaaggcuucuggaacagauagaccccagagauaagguggaauagaaaggcaggguccaaaggggaaggcuugauccacaugcgacaugaggaggagcuuggagaggucucaagaugcagagccuuggaaggaagaugagacuggggcuggagaaugaggaaggaggaugguggcccauucuccuaggaugaugguggccaggccaggguggcagcugcaggaagacaaguuaaugaaguuauugcugcagaagacucucagggccagggacugguuggaugggcagggugagucaaggcugaggccucacuuuuagccuggggguagggaggaguggggcugccuccugcagaguuggggaaacuggaacagaccuggggaagcuggguggaggaugauuuuacuu

SEQ ID NO: 18271 - RNA, 10830 nt, Homo sapiens
aagucacuaagaaucauuuauugagcaccugcuguauauucagcauugugggaggagcugugaaagacacagaacaguacaggguguggucccugcccucgagagguuuacagucuagguggagaaacgggaaccaggacacauggggagccgagagaaaacaguccaggccaguauguuacaggagcuggaagguguuuggggucagaccccaauacuccaaguacacuaagcacuucagugccuccaggggcucaacguuagugccaggaaagacaacuacucccagccccauaugagcccacguggcaugcccuguccauagccucuacugccaccaucuuaaaaugucugacuccuuguuccgcugcuaaucaaagugcaaugaacuggggagggaugggguggaugaggaaggucgcuggacgauuugaggggccagugucucccuccuagaaagaucuacucccccaucauauaccccuaacacagagauaaccccacucaagggggccugugccaccacaugggacccucacccccacagcuagaggagggggcggucgcugcuugagcugccugagguagaacuagggugcccuucuucuugugugucccuuccccuuccaguccauugagcugggggugggggugggacaggcaccucagagccaccuggagcugagaggguacugaagggaaaggacaagggggagggacagcagcagaggggaauugcagagcccagcuggagaaaaaggguagcuggggcuccucaaaagguacaggggagccaaagagggaaaaggcucaacacugagacgggcuccccagugcaggucagaggggccaugagggcaggcgggguggucugcuccaggaccccaccuucccccugccuucacaagacagagggggguaucaagagccaggaggguaccagguccccagcucagcccuaggcugugcucacuucagggucacccugcccaaccuuagaggaggugaggggacuccaaaguuuuugaugaugcccccacucggugaggccccuucaaagugccaucuguuuacuucucaaaugaaaaagaauucaggucugaguguccaggaaagggggugaauuucauaaccgccugugacagcgaugggaaggagccacaccccuccagaggguaccacccagcggacaaguggggaggaggaaguagcuggcaugaagccggcccacccaaccuccgggagagaggaaaaggagaacacgggaugaggaggcuuuaaauaguauuucauaaaauaaaaaugcccagcacucuuaggaaccucucauucaaccgccuaguuuuuguuuaaauaauucuaaugccagaggcuggggggcagggggcggccaggguauguacaugaggagguguuuaaauuaaaacacaaauaauaauuaagacacacaaacugagacuaaggcagaagauguagagcgggccuuugaggcccucgcgcuuccaggacugcaggcuuccugugggcggauuagggcuuccucuuggagaagaucagccggcguuuggagugguagaaaucugaggagagacagcagaagucagccaggccaagaagaagaggacgcggcggagcugcccaacugaggaagacaguggggggccaggacacccuucccuggggccaauggggccgacugcugagaacaggaagaacucggggaacguccacucugucucuugagggguauuauggagugucccaccaugcuucacagaugugauuuuauccaucaccgcacccgcacccaugggucugcucuaagucaagcugcccagcagaggaaccacuacuagcucugugugcuuguuuaaacagacuacaaucaaauaaaaugaacaauucaguuccucagucacaugagcugugugucaaaugcacaacagccguauguggcucguggccccuguaccggacacucccaucccugcagaguuacuggacagugcugaucuagggauucuguuacaaaauccaugaaaguguucagcacaaugccgggcccauauaaacgucaguaguuguuguuauuauaauuagucuugacccaacggcaaauucacuuugagaccuuagauaaaucacucuaccucucugagccugguuuccuugcccuaaaaggauggcaaggggcugggcaugguggcucacgccuguaaucacaacacuuugggaggcugaggcaggaggacugcuugagcucaggaguucaagaccagcccgggcaacauggugagaccuugucucuacaaaaacucaaaaaauuaaccgggcguagugguguacaacuauagucccagcuucccagcuacccaggaggcugagguaggaagaucgcuugagcccaggaguuugaagcugcagugagccaugaucguaucacugcacuccagucuggccaacagaguuaagacaccugucucaaaaagaaaggcgggcagggugacaagaaugucuuauguuauaacauugcuauaaggacuaaauaaaucuaccuuagaagcuuggcaaagggccuggcauaaugaacauucccaauaaauguuagcuaguuggucuuugcugccuacuugcugugugaccucagggagguugcuuccccucucugggccuguuuccuucuaccuggagcaugcuggaccaggaccagacaggucagcccuuggaccauggauucugagaauccuggucccuuacaaaguccuuccgugcacauguccgcaccugucaugcuggucugccgccguuuucgacccugagagucuccagguccaccuggggacccuucagccugcuccccugagcgaggcacaaggguacaagacagugacagguccacauggucuuccucugcuguccccugcagcagagcaggugaggugccaggccgccugccuccucccaacucaucccggccucgccggggccccgugggaagguagagcuugggcaggccaaggccccgcacacgcucccaggcgaagucacccuccaguggugucucggugacaaagucgaaguuccaucgcucacgggccuccuggaugcagcccgccauuagcgcaucacagucgcggcucagcugcucgcuguccacugggccgaagaggcggcggcaggccuugcugccgcauggguucugacggacauccccagccgguucugacauggcgccugcagcagagauacaaggaaggcccuggucacggcggagauuagacacuauguuaccuggccgggcuuugcugugucaccucaggugacgucuuccuaccagagggucucucucacuccuuccagcuggucuuccugcuuccuucccacaggaggccugacccccaccagcagagcucagccagccuggcacaccaaggucacugggagagcaggcaacugaagggcaagcuaaugucaacaaaggcaagucuauugcaagagcaaggaccaggguccuguuugccaccagguauuaucagcuaaaaucaauuuguuuuccccccagaggugucccucaugggugugaaugccccccaaauaugugugaauugccagaguccagcaguuuccuaaucgcagcccuggccagaaggucaauucccaaaagaagaaacagucugacaguuccuccagccuccuaagucccccgacccagauccccaaguaggguaacccugcucugccaaguaaaaguacccgggacuuuggggcaaaaagcacccggguugugguccuagcucugccaguuacuacguaagcuuuaaaaagccacuuaaugucucuaggucucaguuuccucauccauaaauggggccauguacaaguuuaaagagcauggcuacagacacauacucaagaaauugaucacagaguccaugcagcaaggcagacagaacagagcugaaugaaaggcuguauccuggugguuaagcaggagggcucuggagccagaucaccugggcuggaguccagguuuuacuaggugacccugggcaagcaacuuaacuugucugagcucuaguuuccucaucuauaaaauggggauaguaauagugacugucucagaggauagacaugagaauuaacugaguuaauguagguaacgugccagcagcacuucguauagagaagugcauugaaaacagaaguaugauuauuccucucugccuucaguuuuacugagccuccccccuaucacuucccccugccaacuaccuccuucagacagcagcugacaggugcuguaggcugagggccuuucccaaggaugucgucaggcggguggccuagggguaaggaggggccgggcggggcagcgcaagggaugauuucucccaggcugagccacauccugccaggcacaucaggugaucugaagucuagacaccuggcagccccugccucguguugccuguguccaaggaaaccguuuugcaggcaaaaagaaaauuaaagguggcuggucuaccuggcuccucuccucccccuucaggagagggaaaacggagagugaguuugcccaugagggagcccuggcaccuaccugccugcucuggcuugacuccagggcugagugacugcacgaccuuggcagcaacuggauuuuccuagggacaagucccaacuugcaguuucugggggugaaagcucugcugaguccucaugaggcaggaagcccgggacacaugccacaucugcuccaccccaccucaccccacugcuugugaucaguggagcccacaguuucacgucccagcugguugggagaggaggcucuugguaacuucacaccaaguuuaaagggcaggagauggaagagauaugagacuugccccugagucauacagcuaaaaaggccaaaggccacugccccauaaaggggucacccaguacaguggacagagcccucaaauaaccucuauccacccucugcuaggcaugaguugggauuuauuuauauauuuuuauguuugggggcuguucuaagcaguuuaaaaauaucaauccuccuaaaaaguggauaucuauuagcucccuuuuuacagaagaggcaaccaaggcucagauaaguuaaguaacuugccuaacaucacacaguucauaaguggcacagccaggaucugaacccaggccuguuugcccugaguccugugcuguaguauugaaccccacucccucucuaauuuugagguuucuuaaccagagaggcccaucacaaucacuuggggaggccaggggcaguggcuuaugccuguaauccuaauacucugggaggcagaggugggagaaucauuugagcccaaggguccaagacuagccugggcaacuagcugagacccugucucuacuaaaaauaaaaauaaauaaaaauuagcugggugguugggugcagugucucacaccuguaaucccagcacuuugggaggccgaggagggcggagcacgaggucaggagauugagaccauccuggcuaacacggugaaaccccgucucuacuaaaaauacaaaaaaaaauuagccgggcaugauggcagcaccuguagucccagcuacucgggaggcugaggcaggagaauggcgugaacccgggaggcggagcuugcagugagccgagaucacgccacugcacuccagccugggugacagagcgagaccgcaucucaaaaaaaaaaaaaaaaaaaaaaaaaucugggcaugggggcggggggaucacgccuguggucccgguuacuugggaggcugaaacaggaggacuacuugaguccaggauggugccauugcacuccagccugggugacagagugcaacucugucgaaagaaaagaaagaaagagagaaagagaaagaaagagagaaagagaaaggaagaaagaaagaaagaaagaaagaaagaaagaaagaaagaaagaaaagaaagaaaaagaaagaaagaaagaaaaagaaagaaagaaagaaagaaagaaagaaagaaagaaagaaagaaagaaagaaaaaaagaaagaaagaaaagcaccuagggaguuuuuucaaaauauagauugcugaggcccugccucccgagaccaacuuaauccagauugaagauucaagcaaguguuuggcacaauuccucagaugggcacucuuggguugccagccaagcggagacacacugguauguuugaaauggacauucugggucucaauacaucauaggcacaaggaggaggcgcccgccuagggcuucaucaaggugcuggauauucccuggcucucgggaguucaagacaggacuaggaucuaggcaggcacccucuccucuucuaccaccccuccuucucuuauggcucucauaggccucuccucccccaucaaaaucugcucucaugcucauaauaacuuucagcccaaagaaaacucagaaacgcaaacccuuguuuuagaaacaauuaaaaauagccuccuuuauuggccuuccugccuuagacuucagccauauuuuaauuuccaguaagagcucagugaauacuguugaaccuaaggagugcuccuuugaaggggugguaauggcauagggguugaucucggaugagcccaggaguagccgcggcgguucgcgccggccagccccacuccgcgggaaagccugugugcuauucccgccagggccgggagggggcgccggccuccaggaaaucacgcgcggagugggaggugcgugggcagagccucggaccgcuggagggaguagugaugagucaguuuccugcaaggcgcugcucgcccgccaaaacugcuuccacuccggcugcgcgucacccugggguggggagggggagaaugggaggggaccggggggccgcgaacacgucacgcugagccggccaggcuuccgaaacucccgccgcuguugggaaaccgcgcgcucuugugccgucucugacacagacacacacacacacacacacacacacacacacacacacgcccgcgcagacacgcacgcgcgcgcgcgccgggagccggccccuccaccuuaucuccacgcccaaagcacgggaugagucagaucccuggaaaauaaaaauagacgggagcaacgaaaacaaaaccgcucgcaaguccucccagaaacgcgacguggagggaggcaaggagaggggaagcugccugggcgccccaaguuccuaacccagcuccaagaugcuuuuccucacgaagagggcgcaagugucccccagggguuugggacggagaggacgcgcugugguccgcgccaggcggcggcgccccagggggcgacucgccccccugcuccgcucagcccuguagcuuucggagagggaaucugggcuaggucgggaagcccugagcccccgaggcagcugauagaggcccugagcagcgucgugccccccagaccccccaccccucaaagacaugaacccuccccgccucccauccaggcgugggcuccgcucccgccccggaguccagcgccccgacccgaggacaggcugggccgcgauucucccggccgcggugggaaagagguagaggagacccuugcccuuccccgacugacaggcugguuagagcccgcccagagcagggccgugacuccccgaccccuacagcgcgccgcggagcggggacccgacgcggugucccggaccuccagugcccggcuuccuugggaacaaacuguuccagccaaauaggucacugugccgaugggaggacggagaccgcgaaggggcaggggagagggcuucuggagucccgcuguaccccaucccgggcgggguucugaccucauacaguccguucccuggggucuccuugucacagugagucaccuccucgcuaguccuuaggggacggguccuggcacauucccaagggccaggaaacagcccgcgcugaccucagcgcucagccaggugguggacacaguggcguaaaggaccugaaccugggaccugggccagggcggcgcagauuggaucccagagccacccgggaccgauccuagacgaacuuacuccacuccgcuuuccucgcccuuccugggccccuccagggacacggacuucauccccacgccgcgagcaaacugcgccuggggccuggagccaaccgcagccaaaggcgagcucccagaacggucccguccacgcccucccucgccccagcuggguuuccaggggcggggagcgugaccagggauuccuguacuuguaaucccgcucuccgccccggggucuccggcacaucccgacucucgucacccgcgcacuuagagacaccgugugcgcaagccgagcgcgcaccgacccacgcccgucauucaccugccgcagaaacaccugugaacgcagcacacacccgcgaacacgcauccucgcggacacgcagggacacacgcgggcacgcuuggcucggcucugggccgccggcccgggguccccuguugucugccgccgcucucucaccuccucugagugccucggugccucggcgaauccgcgcccagcuccggcuccacaaggaacugacuucggcagcugcucacaccucagcuggcgcagcucagcgcggcccugauauacaaccgccccgcccgggcccgccucaaggaggcgggacccgcgcucggcccaccgcgccgcccgggaccgcccuccccggggcccaggcuccuggcugcccagcgccgagccagcugagccuggccgaguuccagcaggccagccggucccggaaccucgcgugcugcaggagggcacuucccuccucccccagucccucgccugcguuggugcgcuggacacauuuccccacgaagugagccacaaaucuggcuuuuuuuacuuggagaaugaguuggcacucuccaggaggacacagcacuguuagaaugagcccccuuucuggcucaccgcugacccacucuggcaggcaaggauuuacccaaugcagcugaaaagaucaggaggaugacauuaauacauaaaaauucauaaauuauaaaaacgaugcaccucucugcaauuuccagaaaagccccacaauaucaccucuauucccacugaucccucacuaggucaccucucccagaagcaccuggagcaccuagacaccccaacaaagcaucuugaggccagaaugauuuuucagucccguuuauuucacagaugaggaaauugagguccacugaacuuaaguauacaaaguuguugauugucacaugcuuccgggaaggagggaauuggagagacuaccaaaaaagggcaaccugaucuccagggaaacagaagaauuggacauugaaccaaucucccuacacccuacacucaccugaacagaagaaaucccugugguugcagcagcuuuguuggccaggaaggggaggauuugacgagugaguugucugucuccugaauacuccccacauagcccguauacacugcuggggaaacuggggcucagagaagucuggugaccuaacucagaucaugcagcaaagaaaugacuauaguuggaacacaggacuuuugccuccugcccggggcucucugcuugucauccuuuauuucuguggcuccaaaaugacaaaaaugccaaauaacccucauuugcagaugguuuauggagaugacauaaauaaaggacaauucuggaagugucuacugguucuucugacagacacagaaaugagugaugugucuauccgcucccaucuaccucacaccccugaccuccccuggacuucaccuuugccuccuuucugugccugaaacauuugcaguuuugcuuuuaaaaaauugcagaggauggauuguucaucugaacagaaaucccacuaaaaaacagaacccaggcuuggagcagcuacaauuacugacaucucaggcugcucagagucuggaaaucucugcccagacaugcccagucuucuuccucuaacgcagcugaccucggggaggacaggcuucuuucuccucugcuguggggaugggagcccagguaggggugggaggacacaguagcagacccccuuggccugccucgcccuggagucaggccaggauuguggcuaaaccccagaaaggccacggcacagccucaggaccccacucuaagccccacugcugucugcaccuucgcuccuauacauccaaaccauccaaagggcugguugucaaauguccagcagaggacaggcaccuucucccacugccuugaagccccucugcuuucaggcauuucaaauagacuagacauugucugucuguuuacuuuggggagaaaauuuuuuuuaauaaaggcuuguaaugaauuauuuaaauuuuugugguacugagcuucacaaugaaauaauucuuuuuguuguuguuuuugggaaagaauuuuuuuuauaacuucuagcucaccaccaccacgacauucaauauuucuuaaguaccuacuaagugucuaguacuauucagugcuuuaaaaaaaaaaguuugcaaccaugcacuugaauguguacccagacacacucuaagggaggacuucugcccugaaaaaggcaagggagcaggcuguuaaaagucacacacagaaucugacucccagcacacacucacacaagcacacaugcaucagaucccagcccugucgcaaggaucugcuggcagaucacauacccuguucagaguaacaggcuaagguuuaccuggggucuuuagaggucuccugucuccuaccauccccuuccucaccugaaaacaggcagcccaaggaca

SEQ ID NO: 18272 - RNA, 38757 nt, Homo sapiens
uuaggacucaccagagcauucuguuuccuauguugugguugaccucugacuagccaauauuuugccucuguucugccuuacucuucucuggauucccaugaguuaaaacacauucuaaaccaucuccuuggaaaagcaggcuugguuccauccccugagaaugacagagcaggaaaguggagcugguccaguaguaggccuggguccugugcuuacuccaucuaacaagcccagugaccuucuaaaauaacucaacacugagcugcuucuucaucaaucagauggugaucagugaaaacacuucaagaacucucgaugaagaugagguagugauguuauucuuaguccuucucuuuucucuuucccaccccauuccuugugcucucauuucaggguuucucgguggaggggcaggagaaccugcaggagauccucagcaagcagcugcuucugugucaguuccucauggcgcuguccauuguccggacaggugacacuuccucagcugucuccucaccccaggacccacuuagaggcccuauuggacaagaacauguacaagggguugguggggaaguuaaaaaaaucugcuuauauuagaggacagguagcuaaaugaguaauuuagggaagaaagggcuguggaauccucaaaguccccuccaaagaugguucucccccuuaaauugucucugaguuuuaacagacccaggugcugguuuccuugacuuugucauauuuacucccaagacuacuucacccaucucuuggaauagacccauuggcugcuuuugguguuuucucucuaaucuaggaggccacuucaucuguaaaaccuuugaccuguucacaccguuuaguguggggcuugucuaccugcuguacugcugcuuugaacgaguuugucucuucaagccuauuaccagccguccugccaacucagagaggugaagccuuucucucuauauuagccagauuaauuggcuaaaugucagaacagcaaaucauggugcaucucucuggcaugaccucuuaagcuacguuuaaaaccuugacuuuaaagaagugaugagagccaacaggauucaggauuccuggaucuuuuggucuugugauaugccaguucagccucugccuccuucuuccaagccuuaugcuccaugcuuaugugagggauucucagcuuggccaaggagaaagugaccaauaguagggacacuucaggggucuugggcugggaaggggcaaggagccgcuauccagaggcacuacuggggucccagugugacacugcccacacacaaggugagagaaaaugcaaccaaucagaauugcccgguggcuuuguuacaaacacauauuucugggccuucuccugggagaguuugauucauuaggucuauaauuuaacagacuccccaggugauugugacacagcccgucugucacagggaaguuaggaacuacugcgauagagaguagaaauagagcucaacagagaaggauuugaggggaacuuuagcaccacaaagggucuguguuguucuuugugcguaggccuaagguugaacagggaagccauuaagcuuugugauuccacaagggguugggggaaaaggaauguauggggaggaagcccuugcucgguggagugacagaguaucuucugccagguauguggugugcaagggccugaaggugggcauagaugauguucgggauuaccucuucgcagugaauauuaaacucaaucagcugcggaacacggauuccgacgucaacuugguggucccccuggaggugaucaagggagaccaugaauuuacugacuacaugauacgguccaaugagagguaagccaacgggcugguuuuugcugguaacacugagguccuaaggaagaccagagagugaaagacugaaugguuggcucuugguaucacuuugucaacccugacaaauuggcaacuggguuuggucugcugguuucagggcucccugggacuuugguuaguuacccucagggacccccauccugcugccaugcccuaucccaaggguggcagguaggugccuggcuaguauaggccugccugcaggagccuguguauaacagugaaagcugacagagcagccugugucccuggaggcaggaguaauuucccuuuaauugcugcuguuuguaaaaggccaucaugcuuguugccuggugaagucccuguuuggaggcaggagauggauggaaagcauguguacaacaugcuuuggaagugcccaaacuuuugccauuucuucaugaguuccccagcuggugauccaaaugcuguuuucuguaucuucuuuguuuuccccacucccuguuagugguaauaauuuaaaguugugacauuuggcuuaguuuucucagugggcaggccuuugaaaaaaguguuuggagauaggcuggaggguuguauaguaguagugauucaauagaaaaugcucucuuagggggcuaaacagguguuggaaaggccuuaguuaaggguccaaccuuaagucccccagagaaguuugaagauagagguggcccuggagaaucauagaaggggaggaagucuuuauccuauucucuccuauuuuuccaguauugccugguguuuuaacuuuccacaguacugccauauaagcgcccucauuuugauagcaaugguaggcaccaagguggagcagacaguaaacuucagcauguuauagaugaggaagcaaacaggcccagcgacccgccuggcuagggcuuuguaacacuucuggguuauggaacaugucuuuuggcugaacaagugugcauagaugcauggcagaacuggaauucuuuucagggguuccaauaacacagaguguuuaagcaacucuauaaccagccacuuuucuuuuucuaaaaaaguugagguauaauucuguaagugaaaugcaaaucuuaaguguauaaucaguuuacaaaugcauauauccuuguagccuacaucccuauuaagauaaaaaauguggccgggcguaguggcucacaccuguaaucccagcacuuugggaggcugaggcagauggaucacgagauccggagaucgagaccauccuggcuaacacggugaaaccccaucucuacuaaaaauucaaaaaaaauuagccaggcgugguggcgggcgccuguagucccagccacuugggaggcugaggcaggagaauggcgugaacccaggaggcagagcuugcagugagccgagaucgcgccacugcacuccauccugggcgacagaggaagacuccaucucaaaaaaaaaaaaaaagauaaaaaacguuuccaucaccuaaggaaauuuucuuaugccccuacucaggcagccccaaaguaaccccucuucugaguuuuaucaccacaaguuaguuuuacuuuuguauuuugugucugggauuuuuuccuccucauguuuuugagauucauucauauuauguuaguugguuucuuuuucuugcugacuaguauuccauuccauuguaugaggauucuuuugucaauggccacuugagauauuuccaguuuggggcuguuacgaauaaagcugauacagacauucuuguacaaaguuuuugguggacaaauguuguaauuucccuuggguaaauaccugagugggaaauucuggaucauagaggagauguauguuuauuuuaaaauaccacauaguuuucuaaaacgcuguguguguguguguguguguguguguguguguguguacagacaaacaauaaaacaauguauauguauauaguauacauauaauauguauauuauggccgggcgcgguggcucacgccuguaauccagcacuuugggaggccaaggcggguggaucaccugaggucgggaguuugagaccagccuggccaacauggugaaaccccaucucuacugaaaauacaaaauuagcugggcaugguggcgcaugucuguaaucccagcuacuggggaggcugaggcaggagaaucgcuugaacccgggaggcgagguugcggugagccgagaucgcgccaucguacuccagccugggcaaugagugagacucugucucaaaaaaaaaaaaaguauauuauauauaaaaacaauagaacaauuuauauauauuguuuuauucuccuuucagcaaagugugaaguucugauuacgucuuugucagcauuugguauuaucagucuuuuauuuuaaccauuuggugcaauguaguguuacaucauugugguuucaauauguauuucugugacaacuaauuauauugaaccccuuuuuaugugcuuauuggcuauuuguauaucuuauuuuaugaagugcuucuucaagucuuuugaacauuuaaaaaaauugauuugccucuuuauuaaguugcaggaauuauuuuacauucuggauacaaguccugugaguagcuggaguagcuaggauuacaggcacccaccaccacccccagcuaauuuuuguauuuuuaguagagacagguuacagcauguuggccaggcuggucuugaacucaugaccucaggugaucugcccaccuaggccucccaaaguacugggauuucaggcaugagccaccaugucuggcugaccuuuggcuguuuuuaauuguuuuuuuguuuguuuguuguuguuguuguugaacuguaggaguucuuuauauauuucuggauauuaaucacuugucagauaugugauuugaaaauaucugugauucuguagguuuuuuuuuuccccacugcauugauuguguccuuugaugcacugaaguuuaaaauuuugauguaauccaauuuaccaauuuuuuucuuuuauuccuugugcuuuugguguuauaugcaggaaaucauuguuaaauucaaugucauuaaucuuuccucuauguuuuuaaagaguuuuacaguuuuuguuuuuuuuuuuuuuuuugaaacggagucuugcucuguuaccaggcuggaguacaguggcacaaucucggcucacugcaaccucugccucccggguucaagcaauucucccaucucagccucccgaguagcugggauuacaggugcgugccaccacgcccagcuaauuuuuguauuuuugguagagauggaguuucaccauguuggccaggauggucucgaucucuuggccaggauggucucaaucucuugacuucgugauccuccugccucggccucccaaagugcuggaauuacgggugugaaccacugcacccggccgaauuuuacaguuuuaucuguuacauuuagaucuuugauucauuuuaaguuaauuuuuguauagaguauuagguaaggguccuucugcaugugaauauccaguuuucccagcaccauuaguugaaaacacugcccuuuccccguugauuggucuuggcaucugucauuuaaccauauauauguaagaguuuauuucugggcuaucucuuccauugguauaugugucugucuuuaugccaguaguagacaguuuuuaguacuguagcuuuguaggaaguuuuaaaauuagaaagugugaguucuccaacuuugcucaucauuuucaagauuauuuuggcuauuuggugucccuugagauuccauauaaauuuuaggauggguuuuucuauuucugcacauacguguauauauauauaauuuuuaauguuauaaauuuuccuuuaaggauccuuuagggccaggcacgguggcucacaccuguaaucccagcccuuugggaggcugaggcaguugauuacuugugcucaggaguuugagacuagccugggcaacauggugaagcccugucucuacaaaacguacaaaaauuagcugggcaugguggcuuacaccugugguagcuacucaggaggcugaggcaggaggauugcuugaacucagaagguagagguugcagugagccaagaucgcaccacugcccuccagccugggugacagaacgagaccgugucucaaaaaaaaggaugcuuuagcugaaucuccuacauuuugauaugugucuuuuaauuaaccuauggcucauauauuuuaaauuuuuccuuaugauuuguucuuugauucauagauuauguauauguguuguauuuaauauucagauaauuuaggauuuucaagauaucuauuagauuuagucacaccauucucagagaauguauucuguaugauuuugauccuuugaaacuuaaugaagcuuauuuuaugacccaucauaugcucuaucuugguguugcuuggcauaauguucuauaaauguuaauuuggucaaguugguucauaguguuuuucaaauuuucuaaaucuuaacugauauuuugaguacuuauucuguuaacugcuaagaggguuguuaaagucuuuaacuaugauuauugagcugucugugucuucuguuaguuuugucaauucuucagcuauuugggaucuuuguuauuaggcacauguacauuuaagauaguuuuguuuucuugaugaauugaccuuuuauuguuaugaaauacccuauuuauuuccaguaauacuccuugucugaaagucugcuuuaucugacauuaguauagccacauaagcuuucuuuagcuuaguguuuauauggucuuuuuuuguccuucuaccuuugucuuuaugauuaaauauguuucuuauagacaacaugugguugagucuuaccuuuuuguccagucugaucuggauaaaagucucugcauuuuaauuggggugauuggugcauuuacauugaguguaauuauuaauguuuagcuuuaaauccccuaucuugguuguuugauuucuauuuauccugucugcucuuuguuccucucuuccuuucuucccucuguuuuguggggggggggacuaauucaguauuuuuuaauaacuaauucaguauuuuuaaaauaauucaguauuuuuuaguauuccuuuuaucucuuugagguuuuuuagaugccuuuuuuuuuuugcuauguuucaauuguugcuguagagauuacuauaugcaccuuuaaguaaucagucugccuuccaaaacuauuucauuguuuuaugaacaguguaagaaccuuacaacacgauacaugcuauuguucuuuugucuuuguguuuuuguuuuuauauaaacucuacuuuauauuguuacuauuuuuacuuuaaaccguuuauagucuuuuaaagaugcacaugcaugcacauauauaucuaauuuuuuuaaaaagguccuugguauuuacugacauacuuaccuuucugguguucuucauuccuuccuguagaaccagauuucuauuuggaaucauuuugcuucacccuaaagaauuucuucuagccugucuuuguaguacaagucugcuggagacuaauucccugcuuuugucuauuuaaaaauguauuuaggccaggcaugguggcucacgccuguaaucccaggacuuugggaggcugaggcagguggaucaccugaggucaggaguucgagaccagccugaccaacauggugaaaccccgucucuacaaaaguacaaaaauuagcccggcaugauggcggguaccuguaaucccagcuacucgggaggcugaggcagaagaaucacuugaaccugggaggcagagguugcaguuagccgggauugugccauugcacucuagccuaggugagagaguaagacuccgucucaaaaaauaaauaaauaaauaaauaaaaauaauguauuuagacugggcaugguggcucacgccuguaaucccagcacuuugggaggccaaggcagguggaucaccucaggccaggagcuugagacuggccuggccaacauggcaaaacucccuucuggccaaagaauugcuugaacccaggagauggaggcugcagugagccgagaucgugccacugcacuccagccugggugauagagucagacucuguuuaaaaaaaaaacaaaaacaaaaaacaaaacaaaaaacuauuucccuuucauuuuugaaggauauuuucacuggguauggaauuugagguugauguuuuuucucuuagcacuuuaaagauaugauuccaugguucucugcuucccuuguuucugaugaaaagucagccauuauaccuguuguuuuucuguaugucaugugucuuuuuccccucuggcugcuuuuaauauuuuaucuguuauuuuuaauaucucaaucuugauauauuuauaugugguuuucuuuguauuuauucugcuugggguucauugaccuuggaucuguggauugauuucauucaacucuucaggaaauuucuuggccauuaguuugucaauauguuguuuuauccuuuuuuuuuuuuuuuuuuuuuuuugagauggagucucgcucuguugcccaggcuggagugcaauggugugaucucggcucgcugccaccuccgccucugggguucaagugauucaccugccucagccuccugaguaguugggauuacaggugcccaccaccaugccuggcuaguuuuuguauuuuuaguagagacagaguuuugcuauguuggucagucuggucucgaacuccugaccucaggugauccgccaaccuuaacuuuccaaagugcugggauuacaggugugagccaccgcaccuggccuaauauauuguuuuauucuuuccucugcuucuggaacuccaauuauguuuauguuaagcaguuugcuauuguccccaauaccuagaugaucuguuuuuuuuuuucacuuuuuuuccucuuuuauguuucaguuuggguuucuguugacaugucuguccucagguucacugauucuuuccucuacuauguucagucugccaaucccagcaaaauaauuauucaucucuaacauauuuucauuucuagaauuucuauuugccuuuuaaaaauauaguuucuauaucuuugcugaaaaucuucaccuuuuuauauaugucauucacccuuuuuuuuuuuugagauggagucuugcacuguugcccaggcuggagugcaguggcgcgaucucggcucacugcaagcuccaccuccuggguucacgccauucuccugccucagccuccugaguagcugggacuacaggcgcccgccaccacgcccggcugauuuuuuguauuuuuaguagagacgggguuucaccguguuagccaggauggucuugaucuccugaccucgugauccgcccgccucagccucccaaagugcugggauuacaggugugagccaccgcgccuggccgucauucacccuuuccaguagaucuuuuaacauguuuaucacaguuaucuuaaaggccccaucugagaauuccaacauuugggccaucuccgggucuuguucuguuggccuguuuucccucuugucaauggguagcauuuucuugcuucaucguaugccucauaauuuuuuuauuaaaugccagacauuguguguaaagaacagugaagacuaaaguagaaaggguggcuguuaguauacauaggucgaguaagcuuagucuauaguugaacugaaucugggcuuugaaugagcucaccacuacuuucagauuauuuaagggugggauuagaagcuuccuuuuaguaggacuugggaucuaagaacugagugacccaguuuuccuguucuacccucauccuucaguaagccccacauaacugcacugugggguagggguguggguuucuuucucaacucuccagcuccuucaccaaauauagauggccacugcucccguuuaaccucucuguccugaugucaguuaccugucuuuuuugguaauccugagaucaaauaauuuuuuuuucuucuagccacuguagucugcagaucaaagcucuggcgaaaauccaugccuuuguucaagacacgugaguguugcccacuuuucagaaaccaccuauuucaagggaagaucuugcuuuuccuccccacaagcuguuuguuuuuuucauuucaacaaacauuuuaaaacaccugcuuuuuucucauacucugcuauggucucugaaggaugccagagaagcauaugacaugagcuuuguccccaaauacuuuacauugucuuugggcagauaagaguaacccaggaaaaggauacaggaaagguuauuaacagugcaucagaggguguagaguggcauggcacaaguagaauacauaauguucaggggacacagaguaaagagugaucaagagaggagagguaggacugaucagagaaaccucggguagggggugaacauaagcuaauucagcuuuguggggcauggugacauccagugggauggguuuaguguggccugugucagcagaagaggagcuagaacaugcugaugggugauugaaaagggugucggggaggacccuggcauccaggucgucuggagggcacuuucuccuuucccauuguggugagaagggcagguaaucccauuucguguauguuugagcuccugucuucaaaaggagagccuugcauguguuguaaucacgcugggccaguggcagcauagugucuguguguacacucacauguucauucauucaggccuccucucuaugggauaugaggggugcacagggggcacuccugugccucuuagagauuuuaaucacuaacuggcuucauauucccaggacacugagugagccucgacaggcagagauacggaaggagugccuccgacucuggggggugaguaucucccccgcccauugcugcuucagggcagggaagccauagagaagaaugggguugacucccaauccugucaccuuagggugucucugcauccaaaaauaucugcuacccucacagcaucccagagguugacaucucggcauuguugguaguuacguccuuggcccuuucacugcugguuuggcccugcagcugggucagaaaggacuaaggggugggguguggggaggugggccggugucaguuuugcaacugguggccccuuguagcagcacugacaacagagagccccagagaaaaggaaguagccuuugggguccauugccacaggaucugaaagggagcagugagugaauuauccaccuccaucccugucagccuagccuccuuuguugugugccauuccuccuccccagucugacccuaucuccuccaccugcauauacucauacacggucuuggucaaaagggcauuugaaagucaaagcucuuugcugucuuauuucagaucccagaccaggcucguguggcuccuucuuccuccgacccuaaaucgaaguucuuugagcuaauccagguaagacugguaucugugguggacauaaaaaguuagagaucugucucuagauguggaugguaucacugaggccccagaugcauggucuccagagggcuugugcagaugcccaccaugggcucuaaggggcggagcuaaggcugccacaggugggaaccuuugguauaggguguugaauuccccaagagcacagucaggccaacggaagauucucauguucagugcuugggcucagcauuccugccacccaaagggugguucuggcugugucacccuggcaaguucaggguccugugggauuugccuacaaaggagacauagagugugggaugaucuuaggcaagggagcugggcacagggugaagggagcugccagggaagcccgcagcaggguuggccuaaccccagguucuuugucuuauuucuggugagcugguccucagaguucuuuugcccuguuucuucuaccacucaaccuccagcuuuuacuugggccucauuuaaaucugucccagaucaugggcaauugugcugguuuugugggggucagggaguagagacugagguucaagaugcccucaaaagaauaguauguguacauuuuucuaaaugggguaaagagaucacuaaacuguucucaaaccaacugcuggagaauccuugcuuugaguuuuauugaaggggcagcuuuuauauucuggugacauuuucuuauaggucugguaaauugaucuguacuuggggacucaguguucuuuccuuuuccagccucuccuaauagguccuacaggaacauuccaagcagauggaaauagaucccauuuagugcacaguuagguagagaagggggugcaggggagcauauuucagagagccaaugcuuccugucccuugccuugucgagccugcccccagcccagauaggcacccauacugucccuucccccaacccggcaguguuuucucugacucguggcugcagggcacugagauugacaucuucagcuacaagcccacacugcucaccucuaaaacccuggagaagauccgcccuguguuugacuaccgcugcaugguaucuggcagugagcagaaguuccucaucggccuggggguaagucugcagcuggcuuccugcccagcuuggaaugguggauuugcccuuugcggaaucuggacagcugccugccacacuugguacauguucucuuggcauuaaguagcuguugcuuugacccuagugaagguauuucuugaaacuucguuuccuuucuuccucugaguuugccaagugucauucauucauucuuucauuuguuucuucaauucugugcauugcuaaagggaacacugcuacuuuucuugugauacagagcuucccaggcuagcagaguggucagcaggcuuaucuggcuugagcccaggcagccauuccuuugcaacaccaccaccaccccaugccaucccauccccugucuugcaaagauacucccugucccuacccugggcccccuggagucuaaagugaggugagggaaagccuuggcaagcucuuuaucuuacuuaacuggguaaagucauugcuuuuucuuucaacucuugacuuguguuucuauauaauuugauccugucuuccucaguuacuucuuuuguacccucucacacuuugucuuuuucucauuuuacuuacucucuccuucucugcucucuggacucuucacuaaacccaccuuagacauauacgaaacuggaucuuuuuugagggccacuaauuauggacuuaggucuuuugaguggugcccugcacccguuccaaggcugagccagaucucugcuucucuucugcugaggcacuggagaacacuacuaucauuaucacuaaaguauaauggauuuaaucucucauagacauuuucuucugacauuucccagucccaucaguuuguagcugccaacuaaaagcucuuuugagaaguaagccucuuaucccucgaucuccaugccuuccuuaccuggcuguuucucucugccuguagaaaucccagaucuacacaugggauggccgccagucagaccgcuggaucaagcuagaccugaagacagagcugccccgggacacucugcuaucuguggaaauugugcaugagcugaaaggggaggucagagaugguucugcucagguguuggcccugcagcuaggggacuagggggcugcugaaccuggccuuuugcccugaguuaacuugguuacauugugugguggcugacagggcccagggcugggguaaggguuuauaaugacuccuccccgagcaguugcucuaagccacagugguucagguaaggaggagcgcagucuccgugcgucagaggagaccucgauugucucugugcauugagggcccuggugagucuacuggguauuuuuuagcagcugauuuaguuuuugaccagagaucccuugggaaacaagagacuuguuucucaggagccaugaguaugaaaucuauauggugacauucagaacagucaguaggagcaacuggcaagggggguaagccagauccuggcuggagugccauggcagcagccucacuggguuugagguucaaggggccuuaucacccaaugccuuggaucuuacccugcucagaagccgaggccagucugaugcugaggagcagcugggagggagacaagaaaaauauccugcauuuagagcccuacccuucccccagcuguaggcagaauggagccagcaugccaugguggguagugggggcugaaggcugacaccuggcagagugggcaguguaccuacuuauccuucuaggggaaggcccagaggaagaucagugccauccacauccucgauguccuugugcugaauggcaccgacguucgggagcagcacuuuaaccagcggucugaccugggccccaggguagggaggguggggguaggccagggcagcuugggaggacagcggccucccgagguguggccccuuaucuaggccuucucugcuuguugacauccugagaguuucccccucccacccacugacuggucccaaagucagggugagaauuggaguugccacuucagaguuugcuagggcuugggcccugguuaucagagauaccagcacacuccauuuugccacagcugcucagguugagguauuuauguuaagguugagcaagagggugaccuugcggguagaggggguacuccuuggaagaaauauccugugcuugaguggucccauuuaaguugcucaucugagugggugcacuguaguuuccaugcuuuggggugacagggcagacacauacaauaaagaugauacuugaaguucuaguggaggugacugagcacagcugaaggcacacuucaggaaaaccaaccgacauagugaaauuagaggucagaauccacaggggcggggcaugaauaaagacgucgguggagaagggcagggcgggcuuccugggggacaugggugcugccucuuagagcagucuugccgcagauucagaagguucuccuacuggagcugugaaaaugcccuggggguaggggugcugguggaggcauccuuggcuugccucucagagagacuguuuggauuguagaauucagcuugccgagaaauuugugaaagccguuuccaagccuagucggcccgacaugaaucccaucaggugagcauguggucccuacccuccaugcuucuuucuggccaguaccugcugcucccguccagugagggacaggagggcucaguggagggcacuaggcaaguggguguuagagacaagaccauucuugccaugaaguuuguuugggggugcuagguaggugacuugccccagagcaucuccccauccugccuggcagugggugaacuucauucugagggguuaaggcauccuuguuuaggaugcacgugcuucugagagugccagcccaccucaugaauacccguucccacuugagcauuguuagcacauuaccuggccuuuuaauuuuuuuucagguaagaaaugggugcugagggaauaggaauuuugaacaugaaaaagagaaggauuguuugagggaaugggacccccagugcugagggagaaggaggccaggguuguaauguuagauagugggaaaguuccaggacccugagagagaaaggaggaagagaacagagucaggaggagacagauggaggacacacuuuuccaggguaggcugaggucugagguuauugccaaagggcacugcuuagcccugcucucgggagcuucaugcggcuggagacugagguaucuauuuacacuuuauccacauuguuuuuguucuuuuuaacauaaauuuacuuaguuaaaauuaaauccaguauugagaaugcacuuuauagauggcaugugaaaguuucaaaggaauuucuuucugcacuuuaaaauguccugucugcuagguccugaaagacagcucccagggggaacccugccuucauugcuugugguuugguugcucgauuucugggaacguuccccacuagcaguuccaaagacauguucagggcccccaagagcugagcaugggcaucaaacaagagcccugcauucuuguuaggguuuccccacccgcuguggguaauaggacuauuaggacuguuuagcaguaacuuguuauggaaggccuaaaauccauguggacagaccugggcaagagccuacuccuuuguuuucugcccucuggugauggugaagaugacuugggggugggaaugcugacagagacaucuuugucugccagacuuuucuuccucuuucucccuccugucuucaguauccaguuucacuccccaguugcccugacgcaggccugaggaggugcuuggcagcucugaaacccagggcuugucuguguagaacagccauguuggcaggcuugguguccucgcugccggugggcugggugguuucagggagggccuggggcagaagccaaggucaagugcagucuccugccucccagcugccuccuggaugagaaugucccccaggaagccuuugucuugucucugucccucuaccugcagggugaaggagguguacagacuggaagagauggagaagauuuuugucaggugagugacuugaccggugaagcucagauucaagaggaggugggggugcggccguguccuguagucauccuccguuucauaagaugggucgggggcgggggguggugagcugccuccagcgguccccucaccucaucugccucgcugcagcacugcuugcagucaagagucccccagcugacagcugcuucagcauccuaucaggagggagccaggcgggcugugucaggcagaaauacgggcucauugaugcugucauaguuacgaugggcccugcgaggggcagagcagcaagcugcuugaaauaccauaaaucccagcucccgcugcugagagagaaauugagccuggagggguagaaggggcauaaaugcguccuuauauucuuaguggugugcgggugcucacagaacucagucuccuucugggugugcuuauguagagguuacauuaacucuucaguggcugcaguguugccaugggcacccguggugucagaucucacccuuacuggugucacccugaaaucccucaagcagcagugacacagcagggucauuuguuacuccccugccuccacugccugagugggaauucagggccugaauucuaaacucagcauggccacccacucggcugugugccucaguuucaucuuaagucaaaccaggaucagauacugcaguuggggugauuuuauuagucagagacuaauuuuaucagccagggccuuuucucucucaugcacguaccuucucggggaaaucagguuggagaugaagaucaucaagggcuccaguggcaccccaaagcucagcuacacagggcgugaugaccggcacuuuguacccaugggccucuacaucgucaggacagugaauggugggugaggagggacuguucccgccauccccuccccucuccccucuccucgccaggugauggguccagacccuaccugagccagagcgaagggcucccagcuaagguggguagcagccaggcuggcauuucucugaggcauauguuaggggacaguguucccugagccucuucuguucuuccgugggcccugggaguugguuaggcaauagggagaggagcucaacuuguacacacgcacguguuguucucauggcaggaaaagggccuucucaguagacagcagcaaauccagaaagucaagcuugguuucuguccauuugcaucccccuuucuucagagcgcucuggcuaacagaguccuacaucugucagaguccuagagauguuacccugauggaggguuggcaggacugggguggggucguugagaagaagucaucgcguagucauucuccugcagccccuuugggcuggugaugaaggcugcugccucacgggcuauucccugcuugcuuuuggugggaggcaggaauaggaccaccgggaguggaggaagguacacgccuguccuccacaagugcuuugugucccuucugggcuucauccccucuuccucccaucagagcccuggacuaugggauucagcaaaagcuucaagaagaaguucuucuacaacaagaaaaccaaggacucuacuuuugaccucccugcagacuccauugccccauuucaguaaguagcucuccuccaagccugcccuccuuagcagccucaaguacuccugcaggaugccagccagcugucuugggggcacacccuggguccugagacuguugcccaugcagggguuccccugagcacaggccugagaauacuuguggggauggcagcccccugcagguguggcuggaccuggguagagcuggugagggaagcacgaugccuggaccugcuaaugguuacgggccuggcugugaaggcccaucugggcagcguauccaccccauggagcagccacguuucggugacauuccaacacuggccugauggugggaaccugcugagggcccacagcccugccccuuggcacucaaggucccagcugucccucauuaggacccgguguccauuagucagacuguuggucauaggcuuccccagcagcccuaaugugccuguaauuagccacugacauuuucugucaccacacuacuaauacuguauauuagagaagcacagacagauaagucaggaauaucagucacuguaggaauccaguuggaugcaauuagcagcaacagcuguuuguugggaaaaguugguucugggaggcaggggaguuagggccuaccggguaccuuuugccugccgggggaagaaccucaacuaaagucauugacagaccccuccgccccacacccuuaagaacacaugacccugugccaucugggugcaguccugaccucuuucccaucccucuccuccccagcauuugcuacuauggccggcucuucugggaguggggggauggcauucgugugcaugacucccagaagccccaggaccaggacaagcuguccaaggaggacguccucuccuucauccagaugcacagggccuaagagccucagaaugugccaccccugcagaaugcccugucauuccugagauggggccaccuggggcccacagugcuggcuucuucccccucuugaaaagggacuggggagcauugcaccuggcaugaggaguggguggccuccucuccauccccugaagagcucaggcagggcccugcagagaacacucauguuccuucugggacaccugccugggaacuuuccccugccaggacucagccugaaggaagcugcuccugaggcagguaugaggucagugccuagggcacgugggacugauggaggacauaucagaguggcagagcugugggcucugcuguucucuccugcauccuguagacucacuuuucugaguuccaugcacugcccugaggguagccaugcccuugcuuugcccaacuuuuuauugggccaucccugaguggguggagaccugcugucaugagcuggccaggagaaccugcuauaaaaaaaucaagguuuuguuucuuugaacuuacucuguuuugaugccaaauuggagaccauuuucuugucuccuucccccacucauccuggccuucccuggaguucuuccuagcccagagcucugacaguccagcagggugggaaggagggaguuugggcaaacucucaucccugauaccacauugagauccugggagcccucuuuucguacugaguauggaguuguagagccauccuaggugccauccccuuuugguccaaacauugggcagcgcuagauggcaggaagcagccuugaagacccgucuuucccccacagcagcaggggccccagcaguaacaaaggguaccuccagggguuuggguagcgcugcccucuggcagucaugcaccgcugucugccauagccgcucuagggucuuggcagaauucugagcuugaagugcagcucccuuacuacccuuucccuuccuuuuucuucccuaauaggagguacaaucugcuuuuguuugucguuaaguggucacucccauuuccuuuaucuuggccgacaacacagagaggagggggagcugggcaguagcuuggggugggggugggcaccugugguuguuuuuaaugggaaauaccucucagagauguucaugcaggcucccuagggccccaucccagugccaggcugguuuccauggagauagggcacugaggcucccgugagguuggaaucgacuucaccauggggguccuucagccagcauccagcuccccacccccaggcuggcaguagcacugcugagaugcuguauuuccacccaauucuggguauaucagugugucuugcagaaucuuggaucauuaaagauaaacauauuuuuaaugccuguguggcucuguguuggggcugcugcuguuuguccucagugcuuugugaucugagacuggcuuggaugaaacagcuugagccagaggugaaggggaagcagcucuacucaaagcagaggagagaaaagaggguuuguuuaaucggagccuguucaagcucuugggcaccugcagggcucccagggcugcugcuugcugcucaagagggggcucaaagaagaguugggggaaauugugcagcuccuguuacaagcagggacugcagaaugaaugaacccacagccccggaagggcagagaggcaccuuccccccuuacauaaaucacacagcucacuccaugguggcacugugacaauccaggaucagucugugugacuaaaauaacagaggcgucagaccaauuagugucacuagacuugggcgaaagagggagggagagauagaugguuucacugacccuagccugccuccccuccaaggagggcugguucugccugcacgggacugugcuugggggugggggaugcagaugcugcaggcaccucccucucuguucccggcugguuucuccaccaguuagucaucgcccuggugcugguugccccccaaaguccgccuucacuuugcuggacuuccucacuuuggccccaagaguccuuuguguauggccuuaguucccugggcaaccccaucccuuguuuuuccuacuuaacugguuucaucucggccauccacgcccuuccucuguucugccuugcuguagccucccaccugcuccccuccuuauuccaaagcuaggaguuuuagaguugggggguggaaggguaagggagaugucugaguuugcugcuccugccacaacucccccucugaucagccccaccccuacuucucacuacaaacccuaccugauuuacuggccacugucaccguaagucugucuggucauuaccaugacucuuccugcccacucacagccuccccagccuugccugccugucgaagauggauuaacuccgcacuccccugggaucgccacaugaccacuucaaguccccaagccgcccuucgcugcacagacugcauuuuuuucugccauaauuacaagcaauggcacugacuggagggcaugacagugugugguggggggauggacagguggcacaaugucugcugcucaaccccagcagugcccgagcccuggaaguaacucccacuauuuggcuuggaaagugcuucccacugucuccuucccacucgagcugggggccuucuccucuauucugaauuguaauccagagcuuucccuugaacaucucuucuuccuugauuccugagugccgccucugcugcugcugccucuuccugcccccaccguccacccuccgcuagucagaccaugacauuuacucagcagacgggaacagcuuuguguucuuuauugccucucccuugggcuaagggagggaccagcaccauguccuucuggagacccggaaccccccagcaggccagggaggcaaggccugggccgccaggaagccaugcuugaacacuagguugggaggggaacaccccagcaccuugguccuauugaggcuugaagugccugcuugauccugaucaaggggccaaguggaagccugugcugguuguggggaagugccaggcucacaugguccaguaggcauagacgagcgucaggaggauaaagauggccacagagagcagcauguucuuccgguucucuugccgaagaaacuucaguuccuucucugggaggaaagagggugauagggauaggacaggcaguuuaggcccgucuguucugcucugccucuccaacgaguggguacacacugcugagggcaaagacgcacccuuccagccaccuccuuacccauaaaaaugacucugcccuucuuaaucugcccaaauccugacacccuuuuggcuauagagccagccugauaaagucccaacgcccagugcugcucaacuauggcucuuuaaaugugguugagguugagggugaggugggugaggagucaccaaaaaugccacaccugaaagccaagcuaggagguggugugaccgccaggugagucugcuugccugucaugggguuggcuguggugcucauccuucaaggcaucucauccgccaaccagaaacugagggcaccuggggccuccuugggccugacaguggaggaggugcuagguggggccacguguuuccugagucccugcccucugccgggugccugguugagcagaaucuagggacgcuaagaugcaguuuguguccaugaggcagcuggucuugacucuagaggaaaucaguccugcugcucuauggccacacuuguaucaaaguauccccuccaggugacacgcagguaggggguacucugugagggcuaaauugagugguggugugguuuugugugaaaaccgcuaaacuugaagggaaacuaaugucccaucccugucugugcugggcagugggaagagacaccugcagagcugcucugggcaggccagacugaguccagggcccagggugcaccggcccagacaugcugaacuccaggcagggcugguaggugugcacugugccuacggcauucaucagaccagcgcuucugggggacuccuugccauuagaaccuuccuggggcugauucauggccaggccuggucccccaggggagaacagaaccgacaagucugaggagcaccuauagaccgugguccuccccagccuuuagcagggagcccaccagccugccagccgcccucuggcgccccgccgggccuggccucuaccugccucugcccccagcgcccagaagguggcggcaucgcuccacccacaggagcccuugccguacccaagugggagguucggcuuccuucaccccucacuucccacugcaugguuuuccugggagggugugguggguugggguggggugggcuggggcguggggagagcagacuuccgaugucuaggugaaugauugucuccuagaccuggccacggccacaucccuucaucccaaagagcagacagacccacaggcggucucauccucccuuagaacaaagcaacaaaccugcucucccgcaggcugcuggaccuagcaggggugucugcagccucugggggcugguucccucccaaagaacccccuugcucccugcugccuugucaggccccuugggcuucugacccuuccugguucuggggacuggaggcuggggcugguaacugaaaggaacuuucuuaccguaguuggaggcuuuguucauuaggcuguuuuucuccuucuccagggaccuccugugaggggaaaggagcuucauggaccaaacccuuuuccuuuuccccacccgaggggcagcuggcaugccaguuggcagggcuugggucuuguucggcggcagggggggugugcacugaagcuaagaugucagggacccaaacccucugccucaggccuacuuugggggacccaggauagauacagggggugggggccugauggggaagggugggguggcugggcaggagcauuaccuggccucugggcucagcucccggcuguggagucuggaguucacggccuccaggucucuccgacacugggacagcuucuccucuagcccaucgaucugaaacaaaggccacagagaggugggcugccgaggcuucuagcucucaaaacacugggacugggaagcagggccuccgggagucuucuuggacagguguuccccccauucguuuuggcagggcagggcacccaggccugucuucccuggagugucuuuguuuugcuguccucugccuccacgugguucagcucugaacugcacaggacaguggccugagccacacuguaaacaguaguggguguugcccagggucucacagcugucccagcccucugggccaagcacagguuggggguggagaggagcagccccuuggucuguugucuccccagcacgaugccccaguugggcgcacaacaggagcaaccagaacccugaacacggcaugcaccugccccacgggcguauccuagaguggcggagaugcugugaagaaacuggcuuccaaacacuccacacguguggggccgggugauuagacaucuaggggcaacacagagguguuuuucucauugacauacuucaucuuaauaacuuaguaguccaaguuguaaaaauauacauuuuucugugagaaucaaaaauuacugagaaaaaugcucaaaaacaccuuucuuccucucugacuugguucuuaagcaaaaacuuuaccuaccaucaagguagcaaaauaguuaagguaucuguuuuuuccauuuguuugauuagaguuucagagaaguguucuuggggaaauacuugaguuguggagaaauguuuaauaacauacuggacuggguuguccaaaccuggguuuuggcauugaaaguccaucucccugugucugacucagucuccagguguuuagcuggccaccucucuggcuggggcgagccugggugucaguggguggaaggguucagggggcucugugacccucccagcagcugacugaauaguaccucggagccccauaaugcuccauuucccaucucugacuucacucauucucaccacuucccuaggagacauggcaaauaagaccuccauuucacgaauggaagaaugggggucccccaaauggaaugacuuucugagaagucaggguggggcaccccucuccuuaucagucucagccaguucucugccccauucgcuucuggaguuagccccugcaggguuaguaaucaaugacugcagguaagaucccugccucccacaauggcugguuagaggguagcaggcauucuggggcugagugucaggagaguugcauuccaagucucugggccuucugucucucuccacggccaacacccaucucagccacuuccaugucagccacuuuuccuucuucccgagggaggccuggcaaugacacaccauccacccccugcccugcagccccaccauggccaccuccagccccauaagcagggcccugugggagagagcgaccacagagccuugaguuaauugccugguuaauugugucguuucucugcuacugggcacccaaaaggagggcuguccugggaaacagacccagccaggagauggggcugucccuggggaggccaaaggccuaccuagaaccugugcagcauggaaaugaacacugggaagccagauucagggaagagcggcagccccaugcccagugccucaggccaccauguggccuccccuuuacagcagcacccccagcacacagcccagccccucaguacccugagacucagauuccacucaagagcacaaauaaagcuuaauucuugaugcccuaccuccuccaccaggcuucccugcugcccuuggcuguggcagggggguggggguuggggggcaggggacggggugcauuccacccuccuucuccugggaaauuaaccaguccuuccuucaugaggcugaguauauucuuuguugcccuucuguuuguguccaaacuuuaucuucccaaacucuaggggucucuaaauggugccaacuggcagcccguaggucaggucuagcccacagauuggcccauuccacuuauauaugugaacugccuggucccggcagaggcccgagucuaaagcuccuguccuagaaggaacagugaccaucugucuccucuuugugcccaccaaggccuagccugcugcagucuuuguauuuuuagccacaaugaguggaguugagcuugggugggacugaggggcaaggacagacgguuuaggucucacguagcaacuggagccugaaaccuccguucuucuuguccauagaagcuagaaaaagcuaggaggaggagaagcaacuagacaugcacauaaauuguacgcuuugcagauugcccagugcaagucuuaguccuaggugagauuucuccuuaacaguccuugagccaggccuugguuugcgugucauucuggggagggagcagauugcggaauuccaucccugaacaccucuggaaggcuaccaagugcccaaacaagugguaauugcccccagagcaaggccaggaacucaugcuaagcaaaaucuuaaaauuuugagguuggcaaaccacaaguggccaagccaaucugcuaucaugcucugggcagagccugcggagcuggcagucgggggccuuuaucugaacaagcccaauuuaucugcaguuccacugaauauucccacuuucauuugccacuuuuuaaugaggcuuaaacggucgaacacaaaucaagguuuuagggacucaaguucuaaccucccucuaugaauauuuauguccugcugacagcucucgcugauucccuucuaaauagcaaguuccccuucuuuauaacccagcugcuugaugugggcugagugaggggaggcuaagacugucaagaggcucuucagaggccacaaacccauccucagaaggugacccugcgggguccccagcacugggccugguucgggaagcugacaaucaaacacccugcagcauuugcugaagcaggagccagcugucaacaugaguggagagacuccaggggaccuggcugcagaggcagggagggaagguagguccagaugccucuuuuaguuguggcuggggucaggagugguggcuacagagcagagcugacacagcaggaugggccugaaaggugggagaggacccagaaagugggucuuaaaggaagucccgacuuggauuuucagccagcucucaacuacaugcacacggauuaugcacuuugcagacgacccgaggcaaaugugcagucguugguuagcucucuccuugccaccaccaggcuaaaggcaacggaagacaagacagccaggaccaggagagaagauguggggauuaggaccagauaaggagacaaaugucaagaagauucuagaaguguaagggccagaacugggcaagcaguugggagcucaagugcccagaagccuggaauggugguuccagguaagugagugguaaggagcaugggcuauaaucagugccccuggcucugucacucacuugugguaugacugggcaacucccuuaguucugugcucaguugacucacguguaaaacaaagauaaccacauuucauauuucaaagaguuuugugaggaugacauggagccaacagguaagaugcccagaacaugcuuuacauggucagaguucaguaaguguuugcuaucuuuauuaucagagagugguuugcacuagaucuuuggagaauaaaagaaaaccugguuaguccauggcaagaguaagagaaggugauagaagcagggguguggcugggcaugguggcucacgccuguaauuccagcaccuugggagaccaaggugggcggaucacgaggucaggagauccagaccauccuggccaacauggugaaacucugucucuacuaaaaauacaaaaauuagccaggcgugguggcgcacgccuguagucccagcuacucaggaggcugaggcagaagaauugcuugaacccaggggguggaggcugcagugagccgagauggcaccacugcacuccagccugggugacagagcgagacucuaucucaaaaacaaacaaacaaacaaaaaaaaacagcaggggugugagguggagaggaaucuccaugaguugcugacuggcagugcagggaggagggccccucuaccuuggauguggccauucccaguccaugaagagguucagcagggagggcccccaggguagaugucagaacaacaacaggccacaggccagcucgcuccgcuuacuccagacauggcauggugggaaccuugcgauccuucccugggacaaagcuggggugggccucuggagccagggccagguugcagacauggcaccugguagaauccuagcgugagaggccuggagccauguccaagguggaacagccugggggcggucugggcaucagugggcaucugaggaaauguggaacagcaggugaggcccagcagccagagccagggcucacucacaccaugguucuaggcagccugaagaggccccguggaagggaucccaccaagcccaguaggaagggaaaguuauacucugaaggccacaggggcucccaggacuccugcccgacaggcugcauaguagggccagcuggcaggaagaggcaugccuggcucaggggccaggacuugccuggagcuaucagggggcagcacuuacggcugugacugugaccggcaaaguagagacagccaaggcagagaccuagacggcacagugugggggcagagagcaggugcccccugcuguacaauaacauuaagaaccacccgugcauuauauuuacacucagaaaaccaaggucaauuuuuacauggggaaaaagcacugugucccagucacugagaugagucagcagggggcacagggcugcgaucugcaggggcuuuggggaccccaggaaguaagagaggcgaugguaugaacccacugucagccagcacacugcuuccuggcaucuggcccagccugagcccuggggaggcgcugugugaagcccugugugagcgguccaggggcccaaggaacagguuggagagugugaaggguguccuggggaaagucuguucuuuacccagagaccagcaguggcuaaaaacugccuggggggauggcuggggagucugccuaggcaggggagacacagagcacaaaggaagaggggaggaggaaggaaaaagaggcauaugaggcagggaauggagaaggagcaucccucagguagacaggugggaaaggccccaggggaggccuuagggagugggacccaacaaguccguucuuuuaacagaaaagccccguagugaugcugccuaaauuacugagaacugcugcuucucaguaucagagccuggggcagggaauugaggccugcugggugaaggagugagcucagcgaggagacccaugagaccaaaggcccuccacagaggggguguucugugcagaagaaugagaagaucuaaagucagcccagcagucaaggcugcagaggcuguguuguaggccugaggggugcuggggacaaggcccuagccaaguagggccgucaauccugcuggcaggugccaagagcagaaagggcuucuucaugcccagcggcaggggcagggacucuuccugcagccucccugagagcccaucagacagaugcagcuccaagcacccgggccuggaguucagcagcccccaggcagauaagcaaacuccccucugcagccugacuuggggaauaucaccuuauucugggagcuuuaaggaagucucccugggguccuauaugccauaaaaccacuguguuaagagaaacuguaaaauucgugugaaauccccgcgaggcaucuuuucaggaguguaggcccucucagaaucagagccccacggaggccucacugggggcagggaauuucgugccagcucaugcacagauaacugccccagcauccuggccaggucagcugauggggugccagcuccacggcuagcugcuguugggggccucauaugcagcuuuucugccaacaagcacgagacaguucgagccacaggcuaccguucacucuauucuccuacugaaugguguucccacagagcaucuagacagccggggagguggcucucugcccacucccuaaugaaccacugucuagggccagaccuguuucugggaaagggcagaaggcacccccggggccuggugcugggcuacacaggccacucugcuuucugauuuaggaagcuguuugcugucucuccggcuuuacucuugggagcuucuggccagcgagugacagguuugcuacagggucaggcagugguaauggggcauacacugcaccuggcuggacagguccuuacugggcacucagaccuuccaauaaagagcguggugccaggguagcugagccgagccaagucacagagucuccagugucugcaugacagcaugaguguaagcagccucuggaaaccaaaagucccagcaaaauggaaccacaacagugacagcagcagcaacacuucuguagucugugcugugugccaggcacugaccuacaugcuuuacaccgauuaacucacauaaugcucgcaagaacccugugaggugggcaguauuaucagcauccacauuugacagaugaggggacucagacauagguaacuguccagggucacacaggcauuaaguccgggagcugggcagccacgucugugcccuuaaccaccaugccacauggagaaggcagcgcucaucagcucugagggacuccuagcuccugggcacaaccuccacaccuuaccccuggagcugggcagguugugggcagcuuccugugucugcaaccgcccugcaaggaagggcccaucuccaucuuacagaggugcaagcucccuugcagagguuuucagcaccuugcccaaggucguguaacugggaaggggcagaauugaagccugaaucuggguuuuucugcuucagggcuuaugcucuuuccaccacuucaagcucuuucuccaaaaucccucaugaaaacauucaugacaagaguucugcagaacagucauuccacaucccagcugaagcccaucuaagcuugcugaucuggcuucaacagauucucuacucggaauaaucuuguacaaggcucugcucaguuucugucuacauaacagauacucucugugagggaaagcccucauugaaauuuguuuguugagacagaggagacaggagcccagcgucugcccuuacacugggccaacucaaugagcuucacaaacaucccaggcauuuugccccagaucaccucgacugucaaagcauccuccaaaauucacacaaaacagauccaguuuggagacggaaaaaggugggcuacuugggccugauaaacccuucuuuccccagcaguaccgaagccuucccuuucacuugcuaauucacagccuggagaguggugucagcuguuucaucuccagccccagcagccugggaacuggauuuuugaaaauucacucauuuucacacgucaggagaccccaggacauuuauuauaauggguaaagcagccaagugccugcccagauggucucuggcaagagugcaggggcuuuccauuuggagccuucaggcuccacagcaagucacacgggguucuuaggccucaauuuuccaggugacaagccucaaaccccaaggggcccauuauccccacaucguuuaagggauguuuuucuguggaggcggcucacagagcucugugggggcagaaaaaccuccgcccauggcuccccacaucaacaggcccuguaaggauuucucucgcagguugugcagcugaagacggcagaccuucccaguuuuuaaucaaugaacaauuuucaggaagagcagggagagccuaggggcuugucgcucgccuggacacacccccaugccaggucagaaaggcgagggaaccgcugcagcccacgcgagucccgacgccuucccgcgaggagacggaggccgagccagccuugcaaguuagcgcccgagccaguccgcgcccgaagaugccagcugucccugggccggaagguggugugggguuuguuuugucuucuuuccccccgauaucuauuuuuugauaaacuagcaaaagcuuguucaucgcugaaaggcucaaagcacuuuucaagaacuggcauccaccccgagccuuaugaauucauuaauuaagaugcuggcagacagccacuccacacacgccgccauccagccgcgcuagguaaugagguuuuagucuccugacccccgucaaguggcgcagagccagauguaggcugccgcgagaaaucaccugcccaauggcgaccugucgcucucgccuggcagcaggugaggcucauuuaauggucagcggccccugaacaguccucugcgugcugcgagccuuucucccagccccuggcuugggguucagggucccagcaagguggcgucuaaccgccugcucuacugugaccuccacucaacugggcccagacgucaggguggaagguucaaugccuccuccugccaaucgagccaguucagcaaauauuuauugacaguccacucaccugcuccuagcccuugucucaggaaagugggagguuccccugagcccugugcacagccugcuccagagcggagaccgucuucagccacacuuggugcuucugccugcccugccccacggaggcuacugcaguggcuggcaccauacaaauaaccacaagcgucaagccuuccggugcucuuccuggccuaggccauucucuccccucagccuaccacuucucauggucagugauccugccuuuuuuuuuuuuuuuuuuuuuuuuuugagacgaaguuucccucuuguugcccaggcuagagugcgauggcaccaucucggcucaccgcaaccuccaccucccagguucaagcgauucuccugccucagccucccgaguagcugggauuacaggcauguacccccaugccuggcuaauuuuguauuuuuaguagaugggguuucuccacguuggucaggcuggucucgaacucgugaccucaggugauccgcccgccugggccucccaaaguguugggauuacaggcgugagccaccgcacccagccgauccugcccucuuuuucugguaaggauuccagugaauuuucaaugacucccauuagcauuuauuccuuacagcagauacugucaacuggccaacacaacaccgacuccccaccccugcuccuuugcccaccucuacuccagaagguggaaaagcucagcagaugcucucccaaccucacugcagcuaggcuugcucaugacccaguucuggccaaugagacguuccagaagucagcuaggagacuccuggggaagcuuaugcuuuguugauaaaagggacaguguuguuccuuccuccuccuuccugaguuaaaguugaauauuagacuggagcuguggcagcuauauugugaccaugaggaaacagugaagagaaugcagaaauaccaacucugacauagcuaagcuuuugaaccaaugccaguagccaccuaccuacaaauuuuuuuuuuuuuuuugagacggggucucuguugcccagacuggagugcaguggcacgaucuuggcucacugcaaccuccaccuccuggguucaagcaauucuccugccucagccucccgaguagcugggauuacaggcguguaccaccacuccuggcuaauuuuuguauuuuuaguagagaugguguuucaccauguuggucaggcuggucucgaacuccugaccucaaaugaugcaccugccucagccucccaaaauacugggauuacaggcgugagccacugcaccuggccccuacaaauuucuauaaggggaaaagucuacucccauuugcuuaaaucauugaggucaguuuucuauaacuuguagccaaaagcuuuccaaacugauaaacuuucuguacuaggggucagauccaaccaaguuauccacuuuaggauaccggcuaagacaccacacaucuguuaacucaagaccaacuggucacugaaacaucuaaagacaccaguuugaacaguccagcuacaaaagaaaagugcaaugacaaaggaacagcucauuaccaucagagauccgaaaacacaaacagguuuuacaucagucaaaauucuccuaucaguuuagacugaaauucaaccuuuccuuccucccacacaacauuaaaaucaguacugggugggugauuucucauuugaacuauaauuuucuuuucuuauuaagaaugaaaucucagaagcuaaaacucacaguuuuuuccaacucugagaucucauaugguggcaaaugaauuggauaaaaagaccucaaaaggaaccacuuugagggggaggcuagagggugcccugguuguccuaagagguggcugcuuauacagcuggcccaagccagcccuaagggugagugcugccugcuugguaauugcuucauuacaaguggagacuguuugcaggugcugagaucacucacuuguggggguuuuauugcacucgucagauuaacaaacauuuuugauuaaaucaccacuucauuggcucugagcacacaacuuuuaauaagaggacaauaucuacugcuacugagcaucagugcacauucaauacucagacccgcugggggcaacugagaagcaagguggggagacagccagccagaugucaggcuuuuuccaaggcacacgguuacagaugucaaaucuucgaauauccaagcaaaaaguaaacuuagggaccaagauagcaaauauaaacaucuaccgugguauggagaggguaaaacaauggaaucugccccaguauaaggcacuuggagaauacaugccccaccaaguuuaaaaacguaaaaauccggccgagugugguggcucacgccuguaaucccagcacuuugggaggccgaggcgggcggaucacuugaggucaggaguucaagaccagcuggccaacauggugaaaccccgucucuacuaaaaauacaaaacuuagcugggcaugguggugcacgccuguagucucagcuucucgggaggcuaaggcacgagaauugcuugaacccgggaggcuggaggcugcagugagcugagaucaugccgcugcacuacagccugggcaacagagcaagacccugucuaaaaauaaaauaaaauaaaauaaaaacuuaaaagucugucagccaaacagaagacaucugugaucuguauuugggccauagucaaggaguuuguaaccccuggugaaauucaaguccuucauguuauagaugagugaacgaaugcccaagaacgaguuugacuuagccaugguggaaggaugcaaaagaaauacaaaggcuggagcuaccauguauugauuaccaauccggugccaggcacgugcugggcacuuaacgcaaugucucauuuaauccucacaaccacacugugaggugaggugccaucuguagugagacuacaggcugucugugaaaacacacuggucucuuccuccauaguaagcaaacaguagcuggcuauguggccuccugacuggugaacgcauuucccugaucccuugcagucaggugggguuuuaguucuugccaauggaaaguggacaguuugggcccaggacagugggugugcuuccuccauucuccucuuucucugccgguggacacaucagugggguaugccccgguuccacugauaaggugacaagaucucaagagauggugaagccacagaggaagggaaucuggcagaaccaccauagaccugguacucuagaccaggaguuggcaacuaagcccuguggccaaauggucuaaggacuguucuugcagauaaagcuuuaguggaacacugacacacccacuuauuuacauauuccuucauuuacauacuccuaccuuagccugaauacaguugguucuuguuguuccugguagcuauguccuauaaaguugccucuaauauugaauuagcaaauaccaaaccaggugagguuccugcaagccuauggacacaacauuuuugcaaccuuguuucaugugugauucuguuuaaagugaccuuauucaauauauauuguugauucauuaacacuggacucacaaccaacagcacuauacgugcuguuacaucaugaguuauaucaugccugaacaguuuaucuaaaaaaccuguuuucuucuacaacacaucacagccuucuuggauuuaggaaugccagacagcacuucagcccuaugcuuggggucgggggucggggaucgggggcacuuuaaacagcaaaaucaggcaguggcucacaccucuaaucccagcacuuugggaggccgaggugggcagaucaccuaaggucaggaguucgagaccagccuggccgacauggcaagacccccgucuuuaccaaaaauacaaaaauuagccggauguggugguggucuaauccuggcuacuagagaggcugugucgggggaaggugggggugaacacuugaaugggagguggagguugcagagccaagagugcaccacuacacuccagccugggcgagagugagauucugucucaaaagcaaaacacagcgaaauaccaauaaaaaacaugagaaugaaaaaaacaaaacaaaacaaaaacagggcacuaaauagaacacaauaaggacccuuguuuacaguaggacagcugaaacaaggcagggcaucaucaccuguucaacuuuagcugagaacauggacugcgagcgacucaauuuuuuucccacugcuuugcauuugccacaaaagcacugugaguacugauuuugggguuacaaauacauuuuagccauuagggaaauucgcaaauguggaaucugugaauaaugaggaucaacuguaguugcaacccagaccauuuggcucucuagaagagaccaugucucuucuaaaauaguuacuaucugaccauuugcagacaucuccugccccuugcucuagccuguuagaaaaaaacucacuuucuuguucuugaagccacugaguuuuggaguuucucuguuacugcagcuuauuguacccuaaugcagguuacaaagucuauguucuucccgccacaaaguaccaucucagucaccacucauaaaccauccucuucacauuuccaucaaccuuuuuccuaccaagugggccaauauuucucaagggaugccacuaaaacuacccacaucaccaugggguguguguggcuuguaaaaaaaaaaaaaaugcagauucuggccggcugugguggcucaugccuguaaucccagcacuuugggaggcuaaggcgggcgggcagaucacuugaggucaagaguucaagaccagccuggccaacacggugaaaccccgucucuacaaaaauacaaaaauuagccaggcaugguggcacgugccuguaaucccagcuacucgggaggcugaggcacgagaaucgcuugaacccagaaggcagaguuuacagugagccgagaucacgccacugcacuucagccuggacaacagagcgagacucugucuuaaaaaaaaaaaagcagauuccuuguuaagaaugcacaucaaaguccuacugaauuacucggggugugggaagaguucaacucuccauuuuuaacaagcccugugacucuaugcaugcuaaaguuugagaaucacugaacucacuaguaagccugaagaagacuaugacccuguaccucuccugcaaccuccgggaggaugcccuaagggaaggaaaacaggggaagcaagaugaauuuccaggaagaccaccugugcuugauucccaggcuccaccacuuccaccaucucagccuggguuccaccuggaaccucaauuuccucaucuguacaaaccucacaggcuugcagugaggauuaacaaugcaaugaaaguagcacauagcgguugcucaguauguauguuuucuuucccuucuauaugcagcaaauuauuuuuaagccauucagugacaucaccaauuccagaauucucuuuacauauucccaaaguaauuuugaagguacaagcuuccauacuccggaggaaaaauuuccccuuuuagaggauauuuaaaccauuaauaauauacaccagaaugggcucccucaucuuugaguccuagcccuuugggaguucuccuuagauucuacaggucccuauuucucuggggucucccucaccucuguacccaucccuuuuguucugugucccccgcuuugaguucccucacuucuaugccaggccgucuuuggggcuccccuucacuuccaugucucuuccucucuggagaugcccucuccagagagucugguucgcccauccggcaccuccucgggcucccuguccuccgggaaccccgugggccuucucaccccucccgucccucuccccaaaccgcgucgcccucucauccuacgcuuggcuccuccuccuaucuauagcccagccuaucccuuaucccgcggccaggagaaggcaacuaacgagguggcccaacccccacuuuuccccucaccucuagagcgacgcccagauucucccgcuucuuuuuagucauguuacuugccgggaucccccagucaucacuggacgcgcccaccaagucg

SEQ ID NO: 18273 - RNA, 876 nt, Homo sapiens
ugcucagcuaagccuaagcgcuuccaagccugaaggccccuucagcuucucaugugaauuaccaaccccuggauuuuccuuguggggguacaagagcaggaguggggcaagaguuugaaaauaaagccgcuuccuugugaacuaacuauauuuuagccauaacuguuugugauguacacaauguuaagggauuuauaugcagugggcuuuucugggagaaaguuauucagcucuugagcaaguuuaagucuggcugaauccugaggccacugugaauuugcugauguucuuccaacucaguugagugauuuuaagguuuuccaaaucuucuauggcucucuuuuuaauauauauauauauauauauauauauauauauauauauauauauauauaucuaucugguagaucacauguagauguacaguguguauauuaagcugaauuucaaccaacuuuauuacuaagaccagccuagcagggcauucaucuuugauguucuuccuuuucacauuucagaaucggcaaugccuggcccacuccugagagcucuaguuuucuaguuuuccauuuccagauugcgccagcauuacaguaacuaacucuuucuaaccaaccgugaugccacguaacuuacccuauggacaaaagcaggaaugacuaacacauccuaggagggaaaguccaguguaccugucaucacggacgcacuguggucacagacuggaauacgaaauacuacagcccugcucccaggugugcaucuuacuggaugagguugcugugauugagauaguuaaauacaugcuaauuuaaaaaugcagauguuuuacauuugauuucuaccaagaguugaaauguugagagaugauuaaaa

SEQ ID NO: 18274 - RNA, 512 nt, Homo sapiens
cuucacugccugacugccgccaucaugggucgcaugcaugcuccugggaagggcccgucccgguuggcuuugcccuaucgccacagcauccccacuuggcugaaguugacaucugaugacgugaaggagcagauuuacuaaguggccaagaagggccugacuccuucacaaauuggugugauccugagagacugacauaguguugcacaaguacguuuugugacaggcaauaaaaucuuaagaaaucuuaagucuaagggacuugcuccugaucucccugaagaucucuaccauuuaauuaagaaagcaguugcuguucaaaagcaucuugagaggaacagaaaggauaagaaugcuaaauuccaucugauucugauagagagcuggauucaccacuuggcucgauauuacaagaccaagcgaguccucccucccaauuggaaauaugaaucaucuacagccucugcccugguagcauaaauuugucuauguacucaagcaauaaaaugauu

SEQ ID NO: 18275 - RNA, 512 nt, Homo sapiens
aaucauuuuauugcuugaguacauagacaaauuuaugcuaccagggcagaggcuguagaugauucauauuuccaauugggagggaggacucgcuuggucuuguaauaucgagccaaguggugaauccagcucucuaucagaaucagauggaauuuagcauucuuauccuuucuguuccucucaagaugcuuuugaacagcaacugcuuucuuaauuaaaugguagagaucuucagggagaucaggagcaagucccuuagacuuaagauuucuuaagauuuuauugccugucacaaaacguacuugugcaacacuaugucagucucucaggaucacaccaauuugugaaggagucaggcccuucuuggccacuuaguaaaucugcuccuucacgucaucagaugucaacuucagccaaguggggaugcuguggcgauagggcaaagccaaccgggacgggcccuucccaggagcaugcaugcgacccaugauggcggcagucaggcagugaag

SEQ ID NO: 18276 - RNA, 1575 nt, Homo sapiens
uucauuuagaguuaucuuuuugaauauugauaugugaggaaaacacacacgcacuagcaauuuuagaacaucaacuuuuuaauguagaaagaguaauuaaggaauuacuggggagaaaagacacacacaucacugagucccucaauagcacaggcugucuauguggguucuggugcccugagcagauggaaaugaacuuacuugaugucacacaaaagggccacuccucucaggauccagugauccggggacaacacuguucguaaauauaccacagugaugaaggucaaaucaguucgccuggguuucuuguaaauaggacacacauacagcuugggguccuugggugccguggaguuaauggcaaagauguggagcacggguaacugcgugaagaguaccuuggggguggauuccaugagcuucccauuccgucugucccaggcugcuccauccauguagagcccauaaauauacacaccuuccuggaagagucaagcauaagguaauaggauuuauuuuuuaaacuaggugcugcaaaauuagucauaaaggcugucaguuuggaaauaaaacacacaccagucuuaaaacacuaccaaagggagaaagcaccaccggguacauugcauucgugaaauacugagcccaguuuucuccugcagccuguguugaggcuaugagugcuguagagauguucguguuuguuauuaguuauuuaagugugggguggccucccugagcaacaggcuuagccgguagcaccagaucaccucuauagggaggugaaagucucugagaggucugguuugaguugguggaaggugggagcauggaacaggaucuagagcugcugucaggugggaucucagccugcccccggccaaccaaccugugucucaacuucaucucagucacaggaugaagugagguuuccacagccaggcccagcuagcgggagagucagagcgcccccagaggccaggcaugguagagccaggggaaucauggccagggcagcaucuggccacccuccccagugucucucucauacaauaggcccuacccugggguuccucaucauuaaaucagggagauaagaugcauaggugcagaaaaauuuuuuaaagauaagaauugaauagcagcacacacuuguuacugguggugcccggugaacuguucugggggugagggcggugaauucugaggcaaggucccuguggcuggagugcucaggagccucuguagaggggauggccuugaugggccuugaugggcuugcagcagggggcuguguuuggaaagacagaggagagagcguaggcaucacaggcagaaguaacacuacaaagaaaggcagggcgagccggaaaagccccaguauuuccuuuaucagagggcucgaugguuguaaaagaagucagggguugacuguggaaggaucugggugcuaagcugaagaguuuaaacuggauccuguaggcaguauauucacuaaaaaaagaaaggcugaaggagaaucacaggggaggcuccaacaaucaugccagcucaccaaauagguaaauguag

SEQ ID NO: 18277 - RNA, 943 nt, Homo sapiens
agcagccuccuaauuugaucacaguggcgagaggagaggaaaaacgaucgcugugaaaaugaggaggauugcuucuugugaaaccacaggcccuugggguucccccagacagagccgcaaaucaaccccagacucaaacucaaggucaacggcuuauuagugaaacuggggcuugcaagaggaggugguucugaaaguggcucuucuaaccucagccaaacacagagcgggagugacgggagccuccucugcuugcaucacuuggggucaccacccuccccugucuucucucaaagggaagcuguuugugugucuggguugcuuauuucccucaucuugcccccucaucucacugcccaguuucuuuuugaggggcuuuguuugggccacugccagcagcuguuucuggaaauggcuguaggugguguugagaaagaaugagcauugagacggugcucgcuucuccuccagguauuugaguuguuuuggugccugccucugccaugcccagagaaucagggcaggcuugccaccggggaacccagcccugggguaugagcugccaagucuauuuuaaagacgcucaagaauccucugggguucaucuagggacacguuaggaauguccagacuguggguguagauuaccugccacuuccaggagcccagagggccaagagagacauugccuccaccucuccuuggaaauacuuuaucugugaccacacgcugucucuugagaauuuggauacacucucuagcuuuaggggaccaugaagagacucucuuagggaaaccaauaguccccaucagcaccauggaggcaggcucccccugccuuugaaauucccccacuugggagcuuguauauacuucacucacuuuucuuuauugcugugaauagucugugugcacaaugggcaauucugacuucucccaucua

SEQ ID NO: 18278 - RNA, 2180 nt, Homo sapiens
agcaacaaagaaacagauugauauaaucugugugaaauaaauugcugaggagagggauuguagggaagaaguugcuuaguuaggcaccugggaagcucaaaucauuuaguuuaaacuguaaguagaguugucuucccaacgagaacuggugauuccugauuucagaaggcucaucagaccccuacacccaagucuuuuaacacggaggaaguuuuuccuucaugaauacauacaagauaccgaacugaagaaaucuuuucuuugcuccaacccccgcucccccggccccccgaagcuauuaauagucauucaaauggcacugcacucuuuccaagcuuuccuaagcuaaauauggcuccaacaggucugggaacuauugaaugcaauguacucugaaauuccagcagcuguuuacaugccugaugccuaaugccauacgccuggaacuugcugagaacucucggcugccucuguccugggguacuauugcugaccagcaggguguaggcgcugcuuuuguuugagcuuuguagccacaaggucugaugucuguugugaacagcagcugacuucagcacucuggccagcuuccucaaacuuguuaguggcuugcauuuugucaauuuuucuuugccauuucagucuuucaagcagcugaaucgcagaacugaaacaaaacacuuauauugcaaaguuccuucccuuuaaaaugagcuucuggauugcagagaugauuuuuuauggucuuagcgugccucaugcuguagaccacaucguuggagcucugggagagcucugagcagagaaagaccuuggugauccccccuggcccgaucuauaggauugaggaaugaggcuuguagagguggcuugcccaaggucacaacacuagagggugguugagcugggccaggacccagacaagcccuuuucucucagucuagugaggccucugggaaggauaggugaaaacuauaaauagcuguucaagauacucugaguaaaagucagugguguuaucuggaauuucuacugaagaggaaauacagcagcaaagguagacucaucagauggugaaagugucaucuccuuuguaauuuauacuggugagaggaggggaaggaugugcuuuccuauuuuuacacugguacuucauucauccuugucuuaaacuuaagaaaugaaaugcaucagggcacacauauacauagaaacagcacauaagccauuuuggauggcaauuccagcacucuuuuaauggauuggcuuaauuuuuuuuucugaugccucucuauguguuugaaaaguuguauugauagucacacagaguguacuaaaauaaccuaaaaggucuugaaccuccccuuuaccucuuuagaaccucugaauuuggagacagcuagcaaacggcaacuguagccuagcaaagauggcacagcaccacaaagggcaaauggagucaacucccuuccaugcucugaaggucuuggccacucucaucaggguuggcuguguacuauccagcagcucacagucaggagaccuccccuccucagucccucccauuucuuucuuccgcaaggaaagaacauugcaugugggcguguguguguguaugugugugcaugugugugugcauguuucuucugugcauagcagcauaaaguuaggagaugaugacuccagaaucaucacacccgcugugcaggucauaggaccgcacacccgaggcugggagucuaagugguagaugcuuccucuccaugcgcagacagggcucccauuauuugcuaaugccugcgacgugcucagggaaggcaaaaucuauuccaaagguuuauuuucccucuguugaauugauucuaaucuacagugcuuacccugcuuuuggcuccuacgaggcaaacuauaaaaauucucaaauaaaauacagaggcuuacucugcaaagacaccugugugaaugacgugcuaaacauucagcagaaaccaaauuaggaucaacucuuaacauuuuuucccucuuuuguggcuggaaugaguuccccugggaaagaaaaucgcccaagugagaaacuuaugccaaccacauucccaugccccuacaguuaccugcuggcccagaucagcucucugggucugcagagggccgagacaggaagcauuauuaagcaguauaau

SEQ ID NO: 18279 - RNA, 2180 nt, Homo sapiens
auuauacugcuuaauaaugcuuccugucucggcccucugcagacccagagagcugaucugggccagcagguaacuguaggggcaugggaaugugguuggcauaaguuucucacuugggcgauuuucuuucccaggggaacucauuccagccacaaaagagggaaaaaauguuaagaguugauccuaauuugguuucugcugaauguuuagcacgucauucacacaggugucuuugcagaguaagccucuguauuuuauuugagaauuuuuauaguuugccucguaggagccaaaagcaggguaagcacuguagauuagaaucaauucaacagagggaaaauaaaccuuuggaauagauuuugccuucccugagcacgucgcaggcauuagcaaauaaugggagcccugucugcgcauggagaggaagcaucuaccacuuagacucccagccucgggugugcgguccuaugaccugcacagcgggugugaugauucuggagucaucaucuccuaacuuuaugcugcuaugcacagaagaaacaugcacacacacaugcacacacauacacacacacacgcccacaugcaauguucuuuccuugcggaagaaagaaaugggagggacugaggaggggaggucuccugacugugagcugcuggauaguacacagccaacccugaugagaguggccaagaccuucagagcauggaagggaguugacuccauuugcccuuuguggugcugugccaucuuugcuaggcuacaguugccguuugcuagcugucuccaaauucagagguucuaaagagguaaaggggagguucaagaccuuuuagguuauuuuaguacacucugugugacuaucaauacaacuuuucaaacacauagagaggcaucagaaaaaaaaauuaagccaauccauuaaaagagugcuggaauugccauccaaaauggcuuaugugcuguuucuauguauaugugugcccugaugcauuucauuucuuaaguuuaagacaaggaugaaugaaguaccaguguaaaaauaggaaagcacauccuuccccuccucucaccaguauaaauuacaaaggagaugacacuuucaccaucugaugagucuaccuuugcugcuguauuuccucuucaguagaaauuccagauaacaccacugacuuuuacucagaguaucuugaacagcuauuuauaguuuucaccuauccuucccagaggccucacuagacugagagaaaagggcuugucuggguccuggcccagcucaaccacccucuaguguugugaccuugggcaagccaccucuacaagccucauuccucaauccuauagaucgggccaggggggaucaccaaggucuuucucugcucagagcucucccagagcuccaacgauguggucuacagcaugaggcacgcuaagaccauaaaaaaucaucucugcaauccagaagcucauuuuaaagggaaggaacuuugcaauauaaguguuuuguuucaguucugcgauucagcugcuugaaagacugaaauggcaaagaaaaauugacaaaaugcaagccacuaacaaguuugaggaagcuggccagagugcugaagucagcugcuguucacaacagacaucagaccuuguggcuacaaagcucaaacaaaagcagcgccuacacccugcuggucagcaauaguaccccaggacagaggcagccgagaguucucagcaaguuccaggcguauggcauuaggcaucaggcauguaaacagcugcuggaauuucagaguacauugcauucaauaguucccagaccuguuggagccauauuuagcuuaggaaagcuuggaaagagugcagugccauuugaaugacuauuaauagcuucggggggccgggggagcggggguuggagcaaagaaaagauuucuucaguucgguaucuuguauguauucaugaaggaaaaacuuccuccguguuaaaagacuuggguguaggggucugaugagccuucugaaaucaggaaucaccaguucucguugggaagacaacucuacuuacaguuuaaacuaaaugauuugagcuucccaggugccuaacuaagcaacuucuucccuacaaucccucuccucagcaauuuauuucacacagauuauaucaaucuguuucuuuguugcu

SEQ ID NO: 18280 - RNA, 12656 nt, Homo sapiens
ugagagagagaggaagggaaaaagucaagguuuuuuccuuccaaauauuuuauuuaaauauuaaauuaaaaaacauacaucaacuaaucauuuggcauacauuucucauguuaacauaagagauaaaauaauucaguuaugguaaaaaaaaaaacuauguacaucucaaucagaucacguagugucuuuaaauaggcuauugcauugccgucuguauuacagcacugucaagaaaucuacaaaacacacaucacacacucuuaaaaaaacaaguaaaacacgccuuuaacguccuccaaaagagguuccacagcaauaagaaaaaacaaaaaccaccgugaaaguaaagugcuugucauugcuucaaagaggaaacacacaaugguuucugaggccuuugaucuauggcauuagaacagaaaucauuuuaaaaaggggaagggguuuuguguuggaaucaguugugcuaccucuguaaaaaugaaggcaagggccuggcugccccaagauggucuggauucucucccaucccaaaaacuucuuuaugagcgaacaggagacuuugguguuuucucugcggcaaggcaccuggucugcccuccggacagccuuucgcccagucuuugaaacagccacagagcagcagcagcagcagcagcaggaaugggggcagccagcuucccugcggcccggcacaggcacagcccccggugggcaccagcaggccagggaugcagccuccugcacugggcccgccucccuacccucaaguaacugggucaaucuuuggcuuuuaaaaauacccgccuuuccccuuucucaaugccucuguuuaacacugcaggguuuaagaagccgaaguagcugaaggcaccugggcuggguuugggggcggggacuggacucagggagcagcauugccuucguugccuuccagaggcuucuggcugguggagccccacggaguccaccugcuaaaggugcgcccagaccugccagguaagggccgccccuuccugccgccuccaccccagugcugagggagcgaaggcccuggggccccuuccucaaugcacaccugugcugacagggacgcuucuuaacaacaggagcgagggaagcugaaaccuggaacacaaacguauaguacaaaauguaacaaauaaguagugucuaccugucucccauguagauacauauacaggauuugcuuuaaaaaaaaaacaaaaacuuaaaaacacugaccuaaaccucucacuuuaccuuccuugaacaaaacccaaaaagccuaggugggggguggggaggggggucccggcccagggcaggcaccgcccugagccaugagccaugagccaugagccugucucccagcugcccagcccuacagucagccuccaauauugcacaacuucacccaagucagguguucuuguuggaccccaucaugaaaugcauaaacgucagcagcagcggaaacgggaggugcagcaggaagaagcuucugggcuuccgcaagggcacgcaggggcucagggccaagugacccucaggacggaguccccagcacuuugaagucaccucugcccucucugagguucuuccugccguuccuccgcagaguccuggaaaacuaauccuugagcaguuuaugaaacuucucaacuaaaauaagaaaaaaaagucuuccagguuuugauuucaggggagagaauuccuagaaucuguagaugaucuuugccugggcugcuuuaaaacugauacaugaagcagaaaguucacaguuuuccuuaaagcagaaaucaggaaguggagagcguugacuaaagaaauggauaguaaucaaugcacgcgcacacacacacacacacacacacacacaagcggacaacaaugcgcccgcucguuuccguagacguccgagguaaucaucucaaccacgacgaacccagagagaggggccgagauccccacaccacggcacugcacguguucccuccaccccgcuccccuccugcccccgcccccagacacgccccucaauuaucuuucuuccuaaaguuuccagucccuacucaaaguugaggucacucagugcaagaaaaaaauaaaacaaaaauaaacuaaaaagccaaaacaccuaacguauugcuuauuucgcuucuagaaaguucuuggcuuugaggccagaugucuucaccuccucugaaguuauugcuguaagagucaguguccgugccaggaugcagggcugcccucacugcaccaggacaaacgugccuagggagcagggcaucagguccuccaucucacagucccccugcagcagccccaggggcucacaaccuggggccagccuggccaggcguggugggggcacagcggggagggcgguggggccggugccaaugugcagguguguguccaggagcugcgccgcugaggccaccggggacgcgccggucugcaggagugggggcggcagcagcgggagccccgacgugaggagggugcuggggagcggggcagccccagggccaucacagggggcgaucacaaacggggcaggggccggcuggggggccugggagcagccgggugcagcggccggguggugcuguaacuggagcagccugugggaacagaggacagguggucacugcgccggcucgcaggguucucggguuuccgagugcccguguggcagggcccgcccgaggagcugccagccgcggcugccgagggcaggugcguggcugaucccugaccgcgccccaccuuucauucuccacccgguuucucagcagcucagagaugcggccacaaggcgcccucgcuccccgccacccucacccacccagggacuuuaaaggacacgcccgccugcugcacccccauggcucagcaccuaggaccuacgccccacacaucucccuggcugggagcgggggugugcacugggcuacagagaggagggaaccacuuagcagaugagguuccucgaggagauaaccugccgugugcccacccggggucccagggcgggggcaggcccuaccucugcugcucuagcaccuccuccagcaggcuccagcccucccggcugccggcugcgccgccgugcaggccugggcucugugcaggggcguggaaggggcucaggccgccccugcuggcccggcuggcgggggccuggcacaccuggcgagccagccccuugauuuuguucagucccagaaacccuuugguccgcguggucuuccucagcugcugccgaaaggccuucagcccugcagggagaaugaaucaggaggucaacggccacccggcucucagcccagcauccacggcccuuggcuuaagggguuuccaagccucagguuggggguaaggaaaggacgggugacacaagcacgucuggacaggagucuggcaccuaagccccaggauggcguggaggcagccggcagccaggggcccucccuccuccaagucgggaggugcugcccagcacagagucgucuccugugcuuucagaaccagccauggaggccgcgugcucagggacccaugugugucuaucccagcaggccgugacgccccgagccaccagagcacugagcaccccagccugcccagagcacugagggucccacccaggcccgguggagaacagggggugccaucugccaucacggacaaagucacguacugccagagacacacaugguccccuggggaagguggagguaagugugggaggagcguggcucaccuugagucagugagguguccgacgcccgccgucccuccuggaagcugacagggagcagaacagcuccucccaagccccccugagccugcagcacugggguggcggacugcgaccccaggaagggcgaggccagccugaccggggagcaggcgcccagcagccccugaguggccggggugccacugagccccgcggggcuuuugcucgcagagaaggucagacaacugucagagcugguucccucugcaggacuugccgugguggagggggagacgacuauaccuguggggggaggacagcgcuuuugaugcugcagugcaaaggaauaggcucccccggccacugcugggcacacauggcugcgcuggccuccccauccccaccaucaaccuggugggaagagggcucgaggccaccagagcccagggagccacaaaggcaagccaccaucacggugcagcugcagggggcaggucauagugggccucaggccaaggggcugcccucccggcacccaggggcggccuggggaggacccugcuggaggccagaccccaugcuguauccuccacuggaacgaccacaugcagggcaggcucuaaacaucaacuguguggucucagggauuaaaacaaauggcaaauccugagaaguccaaccugagaggcugccgggcaaaacguccauucuaaauuagcccacccucacgucgaccguaagccuauccaccgguguccuccugggcccccggggacacuuacauggcgcggugaguggggagaggcggguggagaccucggccagggugugccuccggcccgugcugcugggcagggacuccugcguguccugcuccuccucuaggcccggccccugccuggccuccucacugauggcuguguccagcaggcugcuuggggacacgggccggggccggaacacuccgcugcagcuggcauccaccgggaagaacaagggcugcguuggagagacacaagccagugacuucucggacuccaggugacccgggcacaccgggggcaccagggcugggcugaggcgagcccucugcacacccgcugugggcacucacccacugcagcgagcucuggagcucacaguccaucucggccuggaggacggacugcaccaaggucugcggcugcgggcacagcaaggcaggucggaaagggucgguggaaagaccuuccugaggcaccuggggccggcagacgggaaagacgcugucaggggagcgacuccggaccaccagcgccaucaagagaagaaacaagcuggcuucugucuggagugcaagcugccucgcuggugggcaugacagcugacggagggacacuggcuggccaggcugggcucaggaccaggugcuggugcugcgcugccagaagguggcgugacaggccggccccagggaugagucagggacaaguggccucugggcagaguccagcccccagcagcuggcacccccuuccccacgaggccugggacccacugcccacgcaaggaaccgcccuccaagccggugccugacaggggagggagccuggggccugggaggagacuccucccccucaccuccaaaccacugagguccgagcuccgaggccgcggcugccuggcaggcccggggcgggcgcacugggcauuccgauacuccuugagccgcucaaggaggagguaauaaauggcagcaaagugguuauagcugcuguuuugcagugacugggaacaagaggagcagagaucagcauggggauggcggggagccccagggcccacccgaucccagguuauucuugggugacugagaauauccuuuagugggguggacaagccggccccuaaauuagccugugcucccguuuuaacucagcuggugagugccugcuuccccugagacagcugccuagccccugcgggugaggccagggcaaguguggccaggcucaccuccaccguccucugccgguccacgcccagggucugcaugauacccagcgccugcucaucguagucgcccagguuggagguguagcugugugcggagaaggcggggcaggcgggucccggcaagcagggcucagcccgcauccaccggugcugccggaucugggcgauggugaugcgccuggcgggguccaccaccagcaugcggcggaucaggcucucacagucuguggaggggccaggaggcugagccagggcggccgggaccucggcugcgcucccacccaccgccccacgugguuugacacgccagggcccaggagcaggggccgggccaucggcucaguccugccacccaaggggagccaucagccagggauccagacccugggggcugccacacuuuguguccaccacacagagaaccacuuagguucacccuucugccgugccccacaccugagcaccagguggacaggcaucuuuaugacacagaaaagccgggugagccacagccaguggguuggacucagggaugaugccagcacccugggugcggguacugggcggggacggcaggcgcaaggcacaagccugugcagcaagggcacccguccacccucgaaauagggcacugagaaggcauccaugggcuggguuucucccgcagcccacaguaaccugggccugauucccagacucaacaaggacucagaagccagccacgaaggggcugcaggagacacaggccccugcccaggcgagaccacacgacucaccuugagacaugaagaaggggaugcggaagcggcccuccagcacccgcugucucagcgucggcagguuaggcccaucgaaggggagagaaccgcagaccaggacguacagcaccacgcccaggcucuguugaggaccacagagccacaucagcgccagggcggugcccccgggaacacggcgcccucggggaacgcggccucgggaagggggucugcgcgcacagggcuccuacccagauguccagcugggggccuucauacuccuuccccucaaagacuuccggggcggcauacggggggcucccacaccacguggacagaggcucuccugacuuguagaaauucccaaauccaaaaucugagcggcaaagaaacagauggaugagguuaaacggcaaauggcaaggggcugcgguuucggcacaggggcugugguuucggcacaugccgggaagcuggggcugcuugcgggcacacucccaccccggggccuccgugccugccagcuugaugucccugcucccaccccggacccuccgugccugccagcuugaugucccugcucccaccccagacccuccgugccugccagcuugaugucccugcucccaccccggacccuccgugccugccagcuugauguccauguugccauccagcaggagguucucggucuugaggucccgguggacgaugugauggucgugacaguacuccacggccgacaggauuugccagaacuucuuccgcgccucguucucacucaggugcccguuggaagucaaauaaucugaggagccacaaaacaaagcuacagcccccagggcaaagccugcccaccacccauggagcccuggggaacaccgcgggguccugggauguguggcccagacacuggccgcgcaaauccagacgcguucgugccauugguuuucaacagauacugaaaacgaguguggcuuaccaaacauuucuccauuuuuagcaaauucagugacgauguaaagcauguccuuuguuuccauaaccuaaagaagaaagaccugacauuuaaccgcacaaaaaaggcacaaggcagcgcuacaaaccauccaccagaaccccaggaaauuucuaacuucucuaggacaaaggcauucaucauuuaaaaaugcaaagaaaaagaaaaauuucucaaauaaaaaaaaaauaggagauuccuacucacaaagacagcuuugaaaaaucagaggugaauuccucacugacuugccuauccugauacaccuuugcucucacaaaaggucuaaauauauuagaauuccccucuguggucauauuuaauucaagacaccucacauacaauuugagaaugcuuaggccggggcaugguggcucacgcccuguaaucccagcacuucgggaggccaaggcaggagaaucgcuugaguucgagaccagccuggucaacacggcaagaccccaucucuacaaaaaauacaaaaacuagcuaggugagguggugggcaccuguaaucccagcuacucaggaggcugaggcaagaggaucauucgaacccgcaaggcggagguugcagugagccgagaucguaccacugcacuccaacuugggcgacagagcgagacuccaucucaaaaaaggagagacaguauucugaaggcuacagaggaggagauugcuggaagucugcugggcuuuauagaagccuaguaggcaacagaugauuccagccaacggucagagccaccuggguaauagagaaugcacaccccauucccacucgcuugauugacaggaugaaugacgcugugggaacccagcuuuauugacaggaugaaugaggcugugagaauccagccucauucacucagcauguagccauucacucagcauguagccacacaacagccaugccaacauagcccuuugaaguucauucacuaaucaauaacuuuauuuuacuuaaaaagagauuuaaaaauauaacuuaugucugugaguauugaaaaauuuuggagaggaugaggcaauauauucuuaugaaaaaagauuuuuuuggguucaaaauauaguuauuccuuuaaaaagaugcuuugugcuggaggugguggcucaugcuuguaaucccaguacuuugggaucacccaggcugaucacuugagguuaggaguucgagaccagccuggucaacauggugaaaccccaucucuacuaaaaauacaaaaauuagccaggugugguggcgcgugccuguagucccagcuacuugggaggcugagguaggagaaucgcuugaacccaggagguggagguugcagugagucacgauccauagcgccacugcacuccagccugggcgacagugagacuccaucucaaaaaaaaaaaaaaaaaaaaaagaugcuucaaagauugcugcuuugaguuauaaaucuaaaaagaaaaguguucuauaaauucuagcaguuuggcaagaauuuuaacugccccgccccugugggugguacaauaacucuaagaccacugcugacccguccccaacugaagaaagggaggaggaggaaaagaauuaaaagucaaaguguuugaacuuuuugaaaacuugaaaaaaagagggaagugucucagcaggguucuggggccccggccagcggaaugaaaauuagacacuaguggccgggcgcggugguucaugccuguaaucccagcacuuugggaggccgaggcgggcggaucacaaggucaggagauccagacuauccuggcuaacacggugaaacccugucucuacuaaaaauacaaaaaauuagcuggguguuguggcgggcgccuguagucccagcuacuugggaggcugaggcagaagaauugcuugaacccaggaggcggcaguugcagugagccgaaaucgcgccacugcacuccagccugggugacggacagagacuccgucucaaaaaagaaaaaaaaaaaaaagacaggaagaaagaaagaaaagaaagaaaauuagacauuagcaucaaaaccagaggaguaaaagucauugcuacaccacugaauucuaucaucucccaacaguuaagaaucacauacagcagcaguaagaaaaugcaccuccagaaaagaccucagcagcaaacacaugggcaauuuguuucuuuaacggagcuaauuccacacaaugggcaaaggagaagaacaggaagaaaaggaagguacuaccauuaggguucagcccuugagcaaagucaaaaacaaaaccagcucagcccacuccugaggaaaugggcugggcacgcugcacaggcaguacaccaguggccauggagcacacaacuuaaaaaugacaacagaaacaaaacacaaaccaggcgcacacggcaugaauucugugcuuaaagacacugagcaaacugucguaagcuccaccaauacugcuacuuuuauuuucaaucuagugcagaggcuuuugggggauaauuucgaaucauaauucucucuccuaccacacuguacaccgagcuguccuaauugcacaaacacacacaacaacaucccagagucaucucacauuccauuucauaagaaucauuacgaggaacuucaacccaacacaaauggaugaaauagcaccugcaaagaacuucuucugcaagaagacuugauuucaccuugcaaaaguggucauuugucauuagggagguguaaaugauugcuuugcuguucuaauuaaauuaguacuuauuuccugaugauauaauuuauuaauuucaacaugagaacaaaaauuaagucacaaaauaaaccaacagagagacagggcaagccauguuccuagcauggauuaaaugacaagcuccuugcucuuacuauggaaaaguauuuucaucucuccguuuuucauggaagaguuuaaauagggaaaacaaaugcucacuacuguccuugcaaaaauaaacuaaugaaaaccaguaagagcagcuggcuuuaaaguuuaauaauuaucugcaaaggcagaaguuuccaguuucacucaaauuuguccuuuuauacuaaaugcgugaccuguggcaauaccuacagauaaguuugucuguuuucauaguaaagcaaauuuacaacagacuucuacacauuuaaaacuggaucagguuaggauacuaaauaaaauucuaaugaagcaaaucucaauuaugauccaaaagcaauaaaauaauuguaaauauaucugcacagccuauaaaaaucaaucuauuuaccuuauacaaccaaaugcccaacuuccacacacuccccaaaagggaagccaccuucagaaauugcagacuuaugcuguuggaaauaaaauauaacacauuugccaggauuagcagagaaaggcaagcugaccccuuaccugguaaagcuuuaugauguguggaugguucagaagcuucaucagcugaaccucacgauagauuuucuccaaauugcuugaaucuaaucguguuuuaucaauuauuuuuauugcaaccuacaaauuuaaaaagaaaaaggauauucuguggguuuuuuuaaaaaaagaaaagaaacccucaaccuaauuuacacauuucauuuuuugcaaguuaauuucucaacacucugucuccagaaggucacaagaaguugggaaaacauaaccaaaguaaccacuaauguuauuuaaaauaaucagaguuaaguaagugacuuaaguauuugcaggcucacuuuacaggguuuagcucugaguccaugaaccacugcaaucuuagguugguccuuuuuuuugcuauuauccucucugcuuucucccaauauauguccaaauuaugcagcaacauaauauaaagcauuauuuuucuuuaccgaacuaaaaacgguuacuauuuacccaccacgacaaucaagccuggagcagugaaucugcaugggguccacccgccaaaggucgggucgccccggguccaguggggaggccccgccggcugggucccaccgcccccacgcaccugcguuuuggugacucgaugccgcgccagcuucaccaccgcgaaguugccuuugcccaggguccgcucgaugucguaaaaacccacccggaggggcuucugcuggcccugacccuggcccgcgggguccgcgcugaacuccgacaugauaaccauggcuccgcgcgcaccugcggggccgcacagagcucagagcccaccagcgcccccgccgcccgcggucggcuccauccgugcccgcggagcccccaguccccacgggacgcagggaccugcucccacgccugucgcccccacucuauccacgggccccuccagccccgugggagguguggacccgcccccgccgcccgcuccacccggacccccgacccucuugagccccgcggggcgcacggacccgcucucauagaggccccugccgcccgaguccgguuccgucccgaucccgggacccccugagccgggauuccacacucgccucccgccgcccgcugucgguuccguccccacccucgaccccuuuagcaccucugggcgcggacccgcucccacaccuggcccugccacccgaggucggcucgauccggaucccaggaccguccccugccccgcucccacacccugcccccgccgcccgcgauccguccgguccccacccccgacaucccaggcaccucggggaucgcggacccgccccccacacccgguaucuccgcccgcggucggcuccaaccugacccccggcuccccagccccugagccccgcggacucacuccuaccccggccccccaacaaaggggagcccgagggcggccaggccgccaaccccgcccgcgaaccccgcgcgcgcaaggccagggacccugcgcgguggcugcaaccccgagccccggcccggcgcccgcgcggagcccccacggcggccaccuccgcccgcccggagcccgccgcugccgccgcugccgccgcugccgccgccucaccuccgccgccaccggagcgcccaggccaggaagccgcccgcucggccgcuggcgcugcucgggugccuacugcuccggcugccgccgccgcugcugcugccuccggggccgcgccgcaugucagcccggag

SEQ ID NO: 18281 - RNA, 95710 nt, Homo sapiens
cgucagugcgcuggcggcggcggcggcggcggcggcggcggcugggcuguuuguucuggucucccgcagccgaggagccgaagcaguggcggcggcagcggcugcggcggcugccggcggugcccgcgggcgagcgcggccugugagcucggcagagcggcgggcgggccccggcgccgcgcaggcagcucggggagggggcggcggcagcgggcggacggccggcgggggcggcgugcggccuagcgucucaggugaggacuggugcccuuuggggcggcggacgacacugggcggcuggcggaggcucgcggcgcgguccgcguaaccugcauugcguaauggggccggggcgccgccaccuacgccauccgcgcggcgcgggggcggggaggccggggcuacgcgggcucgggccugcgggccucccgcgccguucguuccgggccggggcggccugcgccguuggugucggggcggcggggucgcucgcggcuguccugccuuuggugccgucggacccgggcuugggcuggccggcggggcgcggguggggggcgcgggcgccgcggcggggccggcggucgggggcgggcggggggcgggccgaggcgcccggcacuuccugccgccgccauuuuguuaagugaggaggaggaggaggaggaggaagcggccgccgcgggguccgcggcgcgcccggcccggguaagucccggccuggcgcgggggccgcgagcgcagcugucccgguccgcgguccucuaggcgggcucggccgcggcgcucacgugggccggggccggcgcgcucuccuucuggcacccaggucguuuugccugggccggggcagcgcgcccccacccccaucucuucaccuucccggcgguccccggagugcugcggagaaaggggcagguccccugcggagggagguggcugcggcugcacgccggucugaggccaggccucagggcgggagcggugcccuggaggcgagcuuggcccgcuugacgcacccacucucagccuggcagccccuugcugggcgcuuuguuuugcucgguccgugcucgccggcguccuugcaacggccuauuuuauuugcaguguuguguggugguggugauuguggugauuugggguggggaugugggggaguugugauucagcgaaauaaaaugaucccccuccucccaaacggaaauagcauggcuucacucggcugagaugcccccaaggcuuggguuugcuugaagaugggaaaccccacucuguuguaguggacgguguaaauacuuuaguucaggccggugcaugagucaugugcuucuccuggguggcugaccucccuuuuacucaagacuacgcuuuguuuuuuuaagauuuuuauuugcuuguuuacuuguuuacguuucgugcagccugguggggugucuggucuuggguucauuucucugcguguguguuggaugcuagugaccccuuggaauguaugccucacgagaauuggaaugucuuugcuuaccuucgacagggcucuaccaguccgugguuccaaaaaccaagucgcaguuuaccucguaagccaguggcucuuuggggcuguaacaauggucgggaguuuuuugugaauggagcugucaaguucccuaccgucuuuggaaguuguaaagaaagcgauacucaaaaggauuuaugaauguguuuuuaauuucaagaaaguuuuugauggcacaaucuguuuuaugaucuugccaauauauacauauacuuuuagauggagucucgcucugucgcccaggcuguagugcaguggcgcgaucucggcucacugcaaccucugccuccuggguucaagcgauucuccugucucagccucucgaguagcugggacuacaggcgcccgccaccacaucuagcuaauuuuugcauuuuuaggagagacgcggguuucaccauguuggccaggcuggucucgaacuccugaccucagguguuccauccuccucggcuucccaaaguguugggauuacaggcaugagccaccguucccggccgccaauaauuucauaaagcauuuauuucgguuuaauuuggguggggauuauguuuuuuaucuuuuuaucuuaucacugaugcguuguagauaaccaagcgcuuccccccaaaaacuucagccagggaaagauaaaccacucaggguuuccauugaucaaauggagaaggcaaagccuaaucugaaacaaaauguauugcugcucuguuauccaccauaccucuuucuuugguaggaaacauaguaucuuaaaggcucaaacuggaguuagccggucucagaauggcuuuaguuggucuuaauuggaaggagucgaguccaccuccgaguaucuugcuagcagucagcccaguggaauugcugaagauaaggaacuuugccuacggaugaaagauaagaagguagcugcugaguuuuaaggauuguuuggcuguucuggggugcuauaugccuagcuucgcuagucuggaggacagcgagggaaaauuuuuagcuaagaauaacgagaaucauuggccacuuaguaacauuuccacuaaauuauugaauuguuuaaaggaauuuagacuuuguuucuaaaaguugccuuuuugagccaguuguugugaucuuuguacuaaauugcacuuuugcuuuaggagguggggguaacaauauuuucuuguuucacaauucagguuauugaaugacuucagauuuacagauuuaagagauugaauuuuguuuuguuuuuauuuuuuauuuuuuugagagagucugaagucagucgacaggcuggagugcaguggugcgaucucggcucacugcaaccucugccuccuggguucaagcgagucuccugccucagccucccgaguagcugggauuacaggcacgcgccgccacgcccagcuaauuuuuguauuuuuaguagagacgggguuucaucauauuggccaguauggucucgaucuccugaucucgugauccgccagccucggccucccaaaguacuggguuuacaggcaugagccacugcgcccggccuguuuuguuuuuaaagcaaaaaaccauuuggcaccucagugauuugaagacccugggcuguuaaaucugcuucugacaaccuacuguauaguguguuguauuuugugaauguaaaauguuuugguuucugauuuugaauaaacuuguagaguagaccauguuugucuuuauguuccuggcaaaucuguaaaaaggaaagauaagcuugucauuggagcuccuaauguuucauaaaucuuugugauuuuuggugucuagaaaagaguguacauuugcgaggugagaauuguggggaauuccuugcuggugcugacauuuaauacauaagagaugaguuuggaaagauaaaauuuccuuguuaacuuaaaaaaaaaaaaagcagaaugcgccgggcgugguggcucacgccugugaucccagcacuuugagaggccgaggcgggcagaucaccuggggucaaaaguucgacaccagccugacaaacauggagaaaccacgucucuauuaaaaauacaaaauuagccgggcauaguggcgcaugccuguaaucccagcuacucgggaggcugaggcaggagaaucgcuugaacccgggaggcggagguugcggugagccaaggucaugccauugcacuccagucuggucaauaagagcgaaacuccgucccaaaacaaaaaacaaaaccagaauguaaguuggaugagggcaggguuuuguuugcuuggcuuugccuguuuuauucuguuguaucuugugccuagaagagcaccuuaaauagucucaaugaauaaacgggagaaguaauugagcaagaauuuugcaugccguaaugccaaaugcaaauaaucccgcuuuaaaaauguuguuagccguggacauaauuguucgguagugacuuacaaggaaugugaguuucaacuaagauaacgcuggggucccucgguguuguaguaaacuuauuaguccgagcagccuggcaugcaguguguuuccaugcacuacuggacauuucccacuuagcaguuugaagugcggugaguggcuuugcgcugugguucaacccugaccugccaaaaguauuuucaagagggauaugaagugggcaauaaacacauauggguagcauuucuuaaugugaaucucauguugucaauaaaaaccuguuaaguuuuuuuuuaaacauugaacacauuuuuaaauauuuugauuuuaugugugcaugauuggccaaucugucucuacaauuaguccuugagcccuuacuauguacaaggaaagacugaaagauauuuguauaaugacuuuaauaugcguagucuuuauuauuagcguguucauccuccacguuuauugaauaucaauuauguauaauuugagcauacuauuauuguaaaauccuaccaaacaucuuuuuaagaaaauaauagcuuugagauaaacguuguuauacaugauacaaucaucaguuuuuaaauguauuuacagagauuugcagccaucacugcaaccaauuuuaggacauuuccaccccccccccccaaaagaaauccauuaccuaucauuccccaugcuccugcccaccccccgccacuuuugccccuggaagccacucaucuacucucugucucuauggaucugccuguuauggauauuucaggaauccuacaauauguaaccuuuugugccuggcaucuuucacucacuguacuguuuccaaaagguucuugcuguguagcaugaaucaguacuucauuccuuuuuauaacugaaugauacuccauuauauggcuaugcuacauuuuguuuacccauucauuaguggugaacauuuggguuguuuucacuuuuuggcaauugugaauaguacuguuaaaaauacauuuguguacuuuuuuuucucuuuuuuucuuuuucgagacggagucuugcugugucgcccaggcuggagugcaguggcacgaucucagcccacugcagccuccaccccccggguucaagcacuucuccugcuucaaccucccaaguaauugggauuacaggcaccugccaccaugcccggcuaauuuuuguguuuacuauuuaguagagaugggguuucaccauguuggccuggcuggucuugaacuccggagcucaagugauccacccaccuuagcuuuccaaagugcugggauuacaggcgugagccaccgcgccuggccuuuugcguacagguuuuaguuucucugggacagauaucugggaguggaauugcugggucauauaucuauguuuaaguuuuugagggugcacagcgacuuuuuaauggcauugauguuucuaguacuuagguagaaugguuaaaagcuuagugggauacugaguaacuguuuaaaugaaugaggaaguggaacugcaaggauaucagcauguugacauguuguauucugccuucaugguuuggucaccguuugguuuuuuacauugugcaugguuacagaacaguuugaaaugcugcuccauagagaacagucucggagaugcaccccaaacuugcaguuccuuuauuguaaagggugauguuuuaaagcaguuuguuuucagucucgacaggcuaccaaccucaauuaaaccacgugcacauguccuagcauaauucauggaauguaguccacucugaagaagcagaggaagagaguucugagucagggugagggcagagcagccgucugucccauucuuguccucguccugaagaggaauaacauugguuguuccacaucauuugaaaaggagauuguaaggcuuuuucuuuaaacaaaaguagugcauggucauuuuaaggaauuuggaaaaaguagaauguuaaaaugaugguuaaaaaugaucucuuaaucccauuuucuuuccuuccaguuauuugucuuugucugaguaacacaauuugguuguagugaaguucuuuguuuuuaauuuuaauuuuuauuuauuuauuuauuuugaggcagaguuuugcucugucaccuaugcugaagucuuugcucugucacccaugcagagacuggcucauugcaaccucugccuccccgguucaagccauucuugugccucagccucccaaguagcugggacuacaggcgccccaugcugccacaccuggauaauuucuuguaguuuuaauagagaugggauuuugccauguuguccccacuggucuugaaccucucgccucaagugaucugccuaccucggcgucccaaagugcugggauuaggauuacaggcaugagccacagcgcccggccuuuuuuuuuuuuuuuuuuuuuaaugcuacauugugaacauuuccaaaauguuucguuuuaacuggcugcuuagcugucguaugaauguaccauaacuuaauucugcuauuuuuggacauuuggacaugauuuccaaguuuucuuuuucuuucuuucuuuuuuuuuuuuuuuuuuuuugagacggagucuugcucuguugcccaggcuggagugcaauggcacgaucucagcuaacugcagccucugccucccggguucaagugauucuccugccucagccuccuuaguagcuaggauuacaggcaugcaccaccacgcccagcuaauuuuguauuucuaguagagacgggguuucuccauguuggucaggcuggucuggaacucccgaccucaggugauccgcccgccucagccucccaaaguggugggauuauaggugugagccacuucaucugguguuuucucuuuuuucaucuuugaauugggagguguauauuuuugaaaacuugauuuaacuuauuuucuggaaagguugcauguauuuccauuucuccaaucagagcuugacagggucuuguuuauaggggugagauuuuaaacauuuuuucccccacaaaugaugauguaugaaaacaaaaugugucuuuuuuaauguggugagaaguagaagugucucuaggcucuugcccuuugacuuuucuacccucuccugcccagaguuggacuuuguuuccugaaaucaagucuccugacccggcaguacgagcccaguccagucuuaacuggaaugcucuagggagggugaccuuggagggcuugggcagccucuuggcauccaguccuaucucauuuuugcugccuugcuccaaagacugauaacaccaguacggcacauucaggccucgguuagaauccuggcccugcuaccugcuguguaacauucauucugucacucagccuucccagagcuucauuggcccaucuuucagaugagguuaaaaugagacagugccuuagaggacacacagcacagggcuuggcagcagugcugugcccucucaagguuagcuacugccguccuugcccaaggugaagaauagaagugggaagaggaagccaggggucagaguagagcugcugacagccaggaggugcaccagcugauccagggcaugguacugggugacacuacagcccaccaggugccuuccagaggugccacgucuuccaagugagcucugaguggagaccaguggaagaggugcuugaaagagggauuguguuuguuuuuaucugauaaugagauuaagagcagugauaaugggauuaguggaggugcagcagcuuugggggcauccacccugggauguuugcugcagaguuuggggaaaugauccagcaggggaagcuggcucaguguauccucaagccuaaaauguaacuuacccaucuuaugaaaaccugguuaucugaacacaaagacuuggucagggagccagaaggcacuggugggccaaaguuuuuccagaacacuggaacaucuuuccauaccuuucuggccuccauuggcucugauucugauuguauuggcaucugggcuuggugaaaggauucugguccccaggaagguguaaggucucccuggaaaaguuugguagaguaauuuuggcagcuggauguguggagguccugacugggagucuggcauacugccgaucgacuuugggccuuuugaccagaagaaccaguuaaguccaguuacuuacuaggcgucauugggauccgguuccacaaagguugccuuuugcuugugugaaaugcaauugaaagauauauuuucuuuagagguuggucacauaaucuaagcauuagcuucaaauuaagagaaugugaauaaauuugacauuuguucuauuuuucguuuauccuagguguagacaguugugugauccuuccccuuccccccuccccaggcauguguuagccuguucugcccaguguaggaaguuucugggaccuugggcuguggcagacagcauugguugggcuuggguggagccguguaccagagcaggagaggagagagaacaccauggaguucacuguugggugcagucccagccccacccccuucuggccuugaccucaggggaguuacaucgucuccauaagccucaguuuucucuucuguaaaaugggaucagugugccugcacagugacaaaagggggaccauguggguacugaccugggccucaugucuaauuguauaaagaugccugggacuguugagaaagaugggggccgaggagugcuggcuuugcuuucugccugaaaaagugugagaaaugcuauccaggcccuuccuacuuaguauguguggucaccuuccuugucuuggucuccacucaaggcugaaacucuuuauuuguuccuagcugcuguuagucaggagacacugguacauugucagccagcaccaggggagagguguugggcuugguauuacacaauuuucagaaacgugaauuaguaauucucguguccuuguguguugcuaaugucugcaguuguuccuucucaggcaguaacacauacaugucuauggguggauuagccuucaaaguuuuguuuuguguaaagaaaagggaagagggugagaaaaauuuggggacuucauacuugaaaauuuuccaugcuguuugaggaaacauauuuugugggagcagaucauuaucaugagaguugaaacaaaaaaacuacauggagguggaaccugccagcccagugguggaugccagucugggccauacugggcugcuggggcacacucagcaggggacaucugccuguguccuuggacccguugccuaaccacucuagccucaguuuuucauauauaaaguagggcgcauagguuuugauuccagagaaauuugaucagaaucuggauuuuaagagagagcaguucuuuuuuuuuuuuuuuuuuuuuuuuuuaaagagauggagucuugcuguguugcucaggcuggacuugaacuucuggguucaaaugauccuccugccucagccucccaauuaauuggaagaaaauaauucuuuguauuuuuguuuguuuguuuguuugaggcagagucucacugugucacccaggcuggagugcagugguaugauuucagcucacugaaagcuccaccucccagguccacgccauucuccugccucagccucccaaguagcugggacuacaggcgcccaccaccacacccggcuaauuuuucuuuucuuuucuuuuuuuuuuuuuuuuuggagacagagucucucucuaucucccaggcuagagugcaguggcgcagucucagcucacugcaagcucugccucccagguucacgcuauucuccugcuucagccucccaaguagcugggacuacaggcaccugccaccaugccuggcuaauuuuuuuuuuuuuuuuuuuuguauuuuuuaguagagaugggguuucacuguguuaaccaggauggucuugaucuccugaccucgugaucugccugccucggccucccaaagugcugggacuacaggcgcccgccaccacgccuggcuaauuuuuuuuuuuuuuguauguuuuaguagagacgggguuucaccguguuagccaggaugcucucgaucuccugaccucgugauccacccgccucggccucccaaagugcugggauuacaggcgugagccacugcgccuggcuuucuuuguguuuuuaaaaccaugggucauggcauggcuugagggaggagaauggcgugaacccgggaggcggagcuugcagugagccgagaucgugucacugcacuccagccugggcgacagagcgagacuccaucucagaagaaaacaaaacaaaacaaaacaaaaccaugggucaugaaacaaauaugguggauugcaauugguguauaggggagaaaagggaaaugucagagggugucacaauuuucaaggauauuucauaaaaccuuugcuuugaucuuagguguuguguacaugauaaaauguguuucuuaugggggggucaugucagaggaguugaauuacauugguuuccaugcuacuugauggcaauugugaauaccuugauuuguguguguguguauguaugugccauuuugugaucuguuucuuugucauuugcccaaugaugacuguccuggauaugcuuucuaguagcaggugaaagcauggaucuuuaguuucguuucuucccuguacccacuguguuuuagaagcuuuguaggggguagggugagggaaguuggagaagcauggaguggugaaggucuaguaguuugccacaggugaaacaagaaguauguagagugucauuugugugcaugugugguaagcuacuugucgauuauucucagauguuauucuccuaacuuuauucagaugacugugaggaaaugguuguauuacuuaugucuuucucugguauaaauaaacaaaauuagcugaaacagaagggaguuuguugccugaugcaacaugaggcucaagaguaguugaaucuaagggcuccacaaugacuucaguacuuguucuuuaucacuaauguucugaccucaaggucaagagugagucuucccaguagugcuuucugauggcaguggauucuagguuggaucauugcccaucucugaccaugugcagaaugggaaugcuuaacuggcuugccucaagcauggcgccuguagcuggucucugcccuccauucccucaacccaagugguagcuccagcagcaucucgcuuguugauaagaggcaugcuagaugggaugcuuuguccaauggacagaguccccucccucuuucccuuccuuccuuccuucuuucucuuuuucuuuuuucuuuguuuucuuuccuuucuuuccuuucccuuucccauucuuucuugauggagucucgcucuuucgcccaggcuggagugcaguggcaccaucucggcucacugccuccugggucaagcaauucuccugccucagccucccgaguagcugggauuagaggcaugcgccaccaugcccggcuaguuuuuguauuuuuaguaggggcaggguuucaccccguuggccaggcuggucucaaacuccugaccucaggugauccauccgccuuggccucccaaaguguugggauuacaggcgugagccacuaugccuggcccagaguccuauacuaaaaguaaaauguacccccgaacuuggagcaagaaauuauggauggcugaaaggagguuuccauacuaguuuguaaaccagaauuaguggaaaacaguucagaauugaguuacucacaaaggguagaaugaagauaguuaaggauguguguaucccaaauauuuucguagaagaugaaaugaaagacacuguguaucuuaccugugucaggcauagaaggagcucugggagaagucaagccaagucucaggaguuacuugggugggcugaaugauccaguuuggcgggaaaacagcccugaagggagcacaggagugagaccagcuuaaaguguucaggaaaaucuuggauaagagaccagguagauauaaaguuuaaauaaaugcuuacaagauugaaauuguguuuaucacauuaggucucucuuccauauaaauaacaaguuguuauuuauauaacuuauguaaucuguaugguauauuguuauuacuaguaacuauuguuaguucaggagacuggauucaucuaucuuccgugccugcaaaagguacaguuguaauuuugcuauuugcuaagcuauuuccauacucaaguucucguagucugcugcuuggcauuccucaagcauuacgaaaagccuccucagauuuccauaaucaaaaacaaguguuaaguucuacuguaauaaucguuuuccuacaguucucacuguuggaaauauuauuccuuuaggagacacaaaauaauugagucuaguggcuaagaaugggacugacccugcuucucucuagaucaucacuccuuaagaggaggcuggaggucuccuugaguaugcuacagaugcuuuggauccucucuccacaaaaaugcacauaggcauaaacauugaacucuaaagaccagguaccagaaugaauuuccugauuuuacucuguggaagaaaaauuuauuacgauguugguuaaagggcuauugauggcuuuuuuguuuuguuuuguuuuggagguagagucucacuguguugcccaggccguagugcaguggcaugaucacagcuaacuguagucucagccuccccaaacucagguaauccucccaccucagcuuccuaaguaacugggcuacaggugugggccaccacacucaucuaauuuugguauuuuuuuguagagacgggguuucaccauguugcuuaggcaggcuggucuggaguccugggcuuaagcaguucaucugcuuaggccuccuaaagugcugggauuacaggcggagccacuucacccugccucuugaugguuuugaauacuuuuuauuuuuauuuuuuaagacagggucuugcucuguugcccaggcuggagugcaguggcaugaucuuggcucacugcagcuuugaccucccagguuuaagugauccucccaccucagccugcugaguagcugcaacuacaggugugugucaccaugccuagcuuauuuuuauuuuuugguacgaggucucacuuugucauccaggcuggagugcagucauucacuguagcaucggccuccuggccuaggugauccuccuacuucagccucccagguagcugggacuacaggugugagccaccaugcccagcuaauuuuuuguauuuuuguggagaugggguuucaccauguuucccaggcugcaacuccugggcucaagugaucugcccaccuuggccucccagaguucugagauuacaggugugaggcaccgcucccagccuuuuuuuuauuuuuugaagggacgaggucacacuauguugcccaggcuggucuugaacuccugaacuugagcaagccuccugccuucuuugucucccagacugcugggauuacacaggugagccacugugccaggcugguuuucacauguaucuuacuuuucuagacauuuacaacuuuaugacuuggaaacaggguggaucacccauuuugguuuguccuugcaaaaauccuccagagguuucacagaguugucagguaacgugucaacagugaugugaaccuucccagggccccugugcccccaacuuugucagccugugcucuuuccuggggauaaggaauuugagaauguaccagaaugggucuguugcaaaggccgcagaugagggucuuggaacuagggcucuacacugaagcugcugcuguuuguaaacugucuccaugauuugcuguugguauggagccuuugcuccagaagguaacugaaugguuccuagccagccucauuauuuaugugguaguguuggauguggguaggcuuacaagauuuaugcuguggucccuuacguggcuuaaugugugcccugugcugcgggacauuugcuuacgcaugcacuggaaccugcagauugaggaagaaagcuugugggaaacuaccauucuucagcaugacaugcuuacguuuagggauaucgacaugcuacaccaagcaguguacacagugccacucucuuucuccucacauccuugucugguggaaggaauaggaaauauaauaccauaaacuugaauaauucauacuucuguaauuggggcagaguugagucagaggauggaaaagaacucuuauuacuucuaagaauagcaccuauuacagacuccuucacccccccgccccaaucucuauaguuugaagauuaaacuuguaugugccaauggauguuuucccucauucauguaccauuggucuuggcuuuuauuaaucccauuucucugcucaguugaauugcagucuuacuguacaggcaugauuuuuguaacuuaagcaguuuccccuuucuauuuuguaauuaagagaaauaagaucaugugcgugaaagaguucugugaaagguggugcuaucuguguguagguuguuuucauuuguaaucuucauuaaaaauuacuuggcucugaagcacuuucaguuauaaaaagcugccaaguaauagaguuguguguguaugagacucuucauauguuuuccuuuugacaguaggaaaccauucagcugacagauuagcugccuggaaauaauaccaccuucguguucaucuuuuucaaaauaauagcucagcuaucuguaaucccaggaaugcaguuuuaaauuaccaguguuagagcggucucucuauugggcccuuuugaguugcguagcaugcugccugcagcuugcuuauccucagucuuuaggccugucugcucugguaacugauguccuuugcacuugugagagcugguuuacccuuucuggccugugucucuuuccccugaccuuccugaccaccaccaccaccaccaccaccccuugcccaccaccccccacucccauuguucaccuuaaagcaguccuuaucuuuguugacucugaaaaguucaggguuuguagcaaauagcugccuaugaauaggcuucccuguaaaguauaaaacuacauuuucugacuggaugcuugacaucuuccuuaauuuuuuucuauugcuuacugcaugccuguuuuaaagugguggagccagacauccaucaguccaguuucugugucaaccaugaugcuguagggagcugcagacuuggucacuucacugccacauugcccuccccagacccugagcuugagcacacugcugcugauuguucuguuuuagcgaauauuucuaagccucuacgcauuccuuaaguccucagaaaacaaccauauacacugggcacuaguaucaucccgguuugcagauacggaagguggugcuuggagagcugucacuugggcaggguugcagggucacagaguugguaaguacuuggagcacuuguguccagagcccacuagcucuugucugcuguggcauaagcugugggaguccaccauauucagcuuuguucucagugaacucagaugguuuggaugauacguagugagcacaggguagagcucagaagugcuuuccaagauguccaggcaaggcagccugagagggaggagaccuuccaacugggagcauaggaagggggcuagcauugagucugguucuucaaugaggacagcagagguuuggaaagagaccuggacaggucugaaagcaaguaccugucccuuggaggugcucaccagugugaggggaugaucagaagagggaugcagaaugcugacuggacaggucuccuuuucacccagacaucuggucaguaaaaacagugcuucccuccugaggaguuucucaugaagacauucacaagaguggaauuuaaccucaucuucaaaaaguuuccgcuagagaaccaaguugccuugauuugguuucacuucuauuuuuucuuuuucuuuuucuuuuuuuuugagauggaguuuggcucuuguugcccaggcuggaauggaaugguguggucucagcucacugcaaccuccgucucccagguucaggugauucuccugccucagccuccugaguugcugggauuacaggcaugcgccaccaugcccgacuguuuuuuuguauuuuuauuagagacaggguuucaccacguuggccaggcuggucucgaacuccugaucucaggugauccaccgcuccgggccuucacuuccauuuauccuuuugcuacucagagcaagucugggaauauagaagcgggaugguuggggggaaguaaguaaacuggagugugucuuuaguccaggugccccaggcuuguuaaaauuauggugugaacuggauacucuuucaggauuauggugagcuucucagucuuuuuuuuuuuuuuuuuuuuuuuuugagacggugucucgcucugucgcccagucuggagugcaguggcgcgaucucggcucacugcaagcucugccucccggguucacgccauucuucugccucggccucccaaguagcugggaccacaggcgcccgccacuacgcccggcuaauuuuuuguauuuuuaguagagaugggguuucaucgaguuagaccaggauggucuugaucuccugaccucgugauccgcccgccucggccucccaaagugcuaggauuacaggcaugagccauggcgcccggccgcuucucggucuugaggugcuuuuuuuugagacagagucacccaggcuggagugcaguggugugaucucagcucacugcagcuuccaccucccggguucaagugauucucaugccucagccucccaaguagcugggacuacaggcgccggccaccacgcccggcugguuuuuuuguauuuuuaguggagaugaggcuucacuauauuuucagacuggucuuuaacuucugaucucaagugauucacgugccugguccucccaacaugcugggauuacaggcgugagccaccaugcccggcccuugaagugcugcuuacuguaggguagaauugaguucuagcucaugggugcuucccccccccaauccccuuaaggauucuguuuccaagagaauuuccugccugccucaggcacaccaaguggaacucggucaacauccauguccaaugcgugugcuggauguacuugguaaucagacacuguucugcauucacugcagacaugacagugagugaggcagguguuucagggauccuaaugucuccgguggugauuguugcacaagauccuaauaccccugugcuagaaagguggugauucauuuaacaggugugcccugaaggauuuuacuuuuacaucuuuucuuugacuucguaaaaugacacgugaucucauucaguaggaaauuggcucugaauaccuguggggggaaaaaaaaaacaaagccaguccagagaaaaugguagaagugguuaaacuccacgcacagugcuacuaguaagcuaguugaaaaguacacaaucaaaauagaauagaugacuacagcaugauuaugcuacccugaaaccgcacugcauauaggauaagaccuacacuccugucauguagcacccugggcuccuggguucugugacacacuguugccucauuccguucauuugauucuucuuccagacauccccccaaacuccauuuccuccaucuuccaaggucuggucuagaccuuacuuauuuuacaguguauuacccaauuuccaaagcagugcuguccagggggacuuucugcaguguugggacuguucugcagcuggguuauccagccugguagccacuguccccugugguaagugggccuuugaagggggcuuggaacacucaguagggcuguugucacccuguuuugacagguuuuagagaaaauggggucacuuuaguuccuugaccauguggagcuugucgacauccucauggaugcugucauugaagcgguuggaugugcaagccuggaaugcaaggguggaucuagaccagacuugggggcauugggcaucuccaggaggauggaugugagggcuccucccaauaggacgucggaaauaagagucccagcagggucccagacuugagaaagccaggccccuguguaguaagaacacagauuagugaauuugcuuuaaucuggggaauggugaagggcuuuucuuuccaaaacaauguguccuagagugaacucuagugaccuagauaaguaucauguuuaauaguuuuguccucuguucuuggaggcuagaaaauuucccacuucucuuuggaauuugcuuugucugacaucuuucauuucauucauucuaugcguccacacccucacguccuccauuuugugagcaggguuuugggagcaggacuggcucauuuuggcacauuauauuuguguguggaaaaugugaagugcgaacgaaaguucaagcacauacucaaggcugagcugugguacuagaaggugccagugguggguccaccuggagugagucaagcagugguugaggugacuugaaaauauccccuaucgaugguucaggcaggauagccccugaguuccuaaggcagagauucuuaaauuuggucuguguaaucuucccucucccucaucauggaguuuuuccggcaagcacuugauguuucugguuauugagcaguuacuugugcugagugccagggauugucugggugcuggaggucagcgguaagcaagguggaugaugcacacccuccugccugcccauuaguucaugugcuaggagacugcagggcaagugaugcagccugcuuggcuuuuacuccaugauuacagauuaugaaauauaaauauuaauacauuaaacaguucuuacuaaaucauuacauucacacuuuuuuugagauggaguuuugcucuuguugcccaggcuggagugcagugcgcaaucucggcucacugcaaccuccgccugccggguucaagcaauucuccugccucagccuccugagcagcugggauuacaggcacccaccaccacgcccggcaaauuuuuuuguauuuuuaguagagacaggguuucaccaugucagccaggcuuagucuugaacuccugaccucagaugauccacccgccucggccucccaaagugcugggauuacaggcaugagccaccgcucggccuuuuuuuuuuuuuuuuuuuaaagauggagucuugcuuuguugcccaggcuggagugaaguggcacgauauuggcuuacggcaagcuccgccuuccggauucacaccauucuccugccucggccucccaaguagcugggacucuagcuguccgccaccacgcccggcuaauuuuuuguauuuugaguagagagacgggguuucaccguguuagccaggauggucucgaucuccugaccucgugauccgcccgccucagccucccaaaguggugggauuacgggcgugagccaccgugcccggccacaauucacacuuuuuuuuuugaagacagggucucccucauccaagcuggagugcaguggcacagucuuggcucauggcaaccuccacccuccagucucaagcuauccucucaccucagucuccugaguagcuacgccugacaucuuuguuuuguuuugagagucucgcucugucacccaggcuggagugcaaugacaugaccuccgcucacugcaacuucugccucccggcuucuaagcaauucucuugccucagccucugggguagcuggaauuacaggcacgcgcccccacgcccggcuaauuuuguauuuuuaguagagaugggguuuccccauguuggccaggcuggucuagaacuccugaccucaggugguucaccuaccucagccucccaaaguucuaggauugcagaugugagccaccgugcacagccuguuuuugguuguuguuugauuugacggauuuucacuccuguugcccaggcuggagugcaauggugcgaucucggcucacugcaacuuccgccucccgcguucaagcaauucuccugccucagccuccugaguagcugggauuacaggcgcacaccaccacgcccagcuaauuuuuuguauuuuuaguagagacgggguuucaccauggccaggcuggucuugaacuccugaucucaggugaucugcccgccucggccucccagagugcugggauuacaggugugagccaccgcaccuggccccuuuuuuguacuuuuaguagagauggggucucaccacauugcccaggcuggccuugaacuccugaguucaagcaaugugccugucuuggccgcucaaacugcagggauuacaaaugggagcuacaagcuacugugccuggccgaugcuugcuuuuauuaguaguagguguuuauugaacacuugcuuuguguggcauuucauuugacccagcccugugagggcauuuucccauguuaguauugaggaaugucggcugaacccauuugccuacaugcacacgcauguguuucaaaacauaaaaugcaacauccuaaccauuuuacaguguaaacuauaugcauauugucgugcagcagaucacuagaaaguuuucaucuugcaaagcugacacuguauccuucgaauaacuuccuuuuccuucuuucucccagccuguggcagccagucuucuacuuucuguuucuaugaguuugacuaccauaguuauucauauaaguagaaucagacaguauuuuuuguuuguugaguauuuuucguuuguuuguuugagauggaguuucauucuuguugcccaggcuggagugcaauggcgcgauguuggcuuacugcaaugucugccucccggguucaagugauucuccugccucagccucucaaguagcugggauuacaggcacccgccaccaugccuggcuaauuuuuuuuuuuuuaauguauuuuuaguagagacaggguuucaucauguuggccagguuggucuugaacuccugaucucaggugauccacccaccucugccucccaaaguacugggauuacaggcgugagccacugcaccuggccgauucagacaguauuuagaauuuuguuacuggcuuacuucacuaagcauaauaaccuguucuccagguccauccguguuguagcaugucagaauuccacuccuuuguugauggaguuggguugcuuccaccucuuggcuguugugaauaauacagcagugaacaugagugugcaaauauccaccugccuacuguuuuuuguuuuuuuguuuuuuuuugagacagaguuucgcucuguugcccaggcuggagugcaguggcacgaucucgacucaccgcaaccuccgccuccugugcucaagcaauucucgugccucagccucucaaguagcugggacuacaggccccuugccaccaugccuggcuaauuuuuguauuuuuaauacagacaggguuucgccauguuggccaugcuggucucaaacuccuggccucaagggauccaccugccucggccucccaaagugcugggauuacaggcaugagccccugcuccuggccaucuugcuuacuuuuugaacacauguuagaacuaagaacgugggugcggaagccugcugaggggcuuuaaauuccccauauccugccuccacacggaaacugauuuuggggauggauauugggcaucggugaagaguaggcacaaagguacgggagaugguucaaacaguggugcagccaggugucuuucaggacugccuaaaggacuguuuaaggccaggcacgguggcucaugccuguaauccuagcacuuugggaggccgaggcagguggaucaccugagaucaggaguuugagaccagccuggccaguauggugaaaccccgucucuaauaaaaacuauaaaaauuggccaggcgcgguggcucacgccuguaaucccaguacuuugggaggccgaggcgggcggaucacgaggucaggagauugagaccuccuggcuaacacggugaaguccugucucgacucaaaauagaagaaauuagccaggcgugguggugggcaccuguagucccagcuacugaggaagcugaggcaggagaauggcgugaacccgggaggcggagcuugcagugagccuagaucgcgccacugcacuccagccugggccacagagugagacuccuucggggggggggggggggggggggaauccaaaaaucagccggacauggugccaugcuccuauaguuccagucacccaggaggcggagguugcagugagcugagaucacgccauugcacuucagcuuggucaacaaagugagacucucuuucaaaaaaaaaaaaaaaaaaggacuguuuaaaaauggauuggaucucacccuuucaucagcucccaggggacucauccuaucagugggcuucucacuccuacccacuuuguacaaugauuuccacagcaaguaguuucugucuugaugucaccuugaaaaggcucacagaauuaacauuucucuaugcauugccucagaauguaaccacaaaagcuuggguuuuggaauguuuuaagugcgagggugcuuaccaacucuugagcagacagagaacaggugagaggagcccccggugaagccagauuggcaagcucugccucucuccgcacucaguguucugugacuugugccuggaugacuugauugcuuuguccuucacuccggcacagugauucuuggguacaguaccucaguccuuggaagggcagcauggagccucagaauugauugccacacuacccgguuugcuccuugagaaggaaacaucuuugauuccccuccccuacccccaauuucagaaaaucugguuguauccuuagaaaugacacuauccguucaucaguucauggauauuuugguuucuaguuuuuggcucuuaugaauaauaccucugugagugcccacacacacuuuuuauguagaaauguuucccuuucucuuggcauaugcguaggggaggaauuucugggacauucauuauuuauguuuuaaccuuuuggaggaacugccagacuguuuuacaguggcugccccauuuuacauugcuggacauaugaggguuccaguuucuccacaucuuugccgacaauuguuguuugucuuuuagaugauagcaaagauuccuuuuaaaccuaccagagauugacaguuuguugguuuuuuuuuuuuuuuuuuggagguggagucuugcucugucgcccaggcuggaguacaguggcacaaucucugcucugcucacugcaagcuccaccuccuggguucaugccauucuccugccucagccucccgaguagcugggauuacaggcgcccaccaccacgccuggcuaauuuuuuguauuuuuaguagagaugggguuucgccguguuagccaggauggucuugaucugaccuugugaucugcucgccucagccucccaaagugcugggauuacaggugugagccaccgcacccggcccuaaaguuuuuauuuuuguuuguuuguuuguuuguuuguugagauggagucuugcucugucucccaggcuggagugcaguggugcaaucuuggcucacugcaaccuucaccugcuggguugaagcaauucuccugccucaggcucccaaguagcuggggcuacagucgugugccaccaugcccggcuaauuuuuuguauuuuuaguagagacgggguuucaccaugcugggcaggcugguuucaaacuccugaccucgugauccucccgccucggccucccaaagugcugguauuacaaguuugagccaccgcgcccagcccagauguuuaaaguuuaaggaguuucagcuuauguuuuuugcccccuuuuuaaaaauuuauguccucaauuuuuuucuuacaaauuuuuauuuuugccacuuucuucauccagugucacagcuuauacuauuacuuuuuuuuuuuuuuagguagacucucgcucuguugcccaggcgggagugcaguggcgcaaucuuggcucacugcaacguccgcuuccuggguucaagcgauuguucugccucagccuccugaguagcugggacuacaggugcacgccaccacacccagcuaauuuuuguauuuuuaguagagacaggguuucaccacauuggccagucugcucucgaacuccugacaucguaauucacccgccugggccucccaaagugcugggauuacaggggugagccaccgcgcccagccaaccuaccguuuuaagagacgaggucuccacuguguugcccaggcuggaguacaguggugagucacaugcaugaccccacugcugauagguaugggaguuuugacuugcccccuuucuuuuuuuucuucacuacgcgacccacccccccccccccccccggccccgcaacuuuuuuuuuuuuuuuuuuuuugagacggagucucacucacucuuuugugcaggcuggagugcaguggcacagucuuggcucacugcagccuguuucccggguucaagcaguucuugugccacagccuccugaguagcugagauuacagaugcccgccaccaugcccaguuaauguuuguauuuuaauauaguugggguuuugccuuguuggccaggcuggucucgaacucccggccucaagcgauccgcccgccagggccucccaaaaugcugggauuacaagugugagccaccacaucuggccgaccugggcugguucaccccuucuuaggcaaucugguaguacccacuccuuggaggucaccacacugaugccaaacguagugcggccaccugauuggcaccaugcaauauagcccagaacuccugggcucaggacauccucuucccuccucagccucucaaguaguugggacuauaggugcucacuuccgcgcccaggcuuuuuuccuuuuuggcauugucuuguccuggaaagggcaugagauagacucaguguugcauuuugugcuuaaagaucucuguaccucugauguguuuuauaugggcaauuagaacuugcugaaaauggaauauacuaccuaagcaggugcacagaugaguaccacugugacuagugguacugaagcucaaaauggacauucacccacuggaauuuggagacauuggcagugaucuggagcagguugcuuaaucuuugauccuguuucccugucagugagauuggguagcagaagcacuccauccaccugucagaguuagcucugcuuguuacugaugagggucaagcacagcagagggaauugcuccuacccacccugcagcgcucuuacuucacugaaggugcuguaggugauugacggugcaguguuuugguuagccuuucaauuuugagugauucugauuugugucacucaacuugaggagacuuggccugaccaguucagucaccucugcuuccuguguguguuccuuucccuacuucauuuccuugcccauccugaauuuugaguuuaccgguuuuguguuuguugcauguauagguauaccucguuuuauugugcuuugcagauaauugcgguuuuuuuauuuacaaauugagaauuuguggugacccugcauugagcaagucuuuuaucagugccauuuuuccaacagcgugugcucacuucaucucugugucacauuuugguaaugugaccaacguuucagacuauuauaucuguuaugauucgugaucagugauuuugggugucauuaucauaguuuuggggaaccacaaaccauguccaucuaagaaggugaauucagucuauaaauguuuguguucugacugcuccagcuacugacuauuucccaucucuuuuccucuccucagaccucucuauuccuugagacacaacugucuuaaaauuaggccgguuaauaacccuauaauagccuuuaaaguguucagaugaaaggaagggucucgcgucucucacaccaagucagaagcuaaaaauggccaggcgugggguucaugccuguaauccuagcauuuuuuggcaggcguaggugggaggaucgcuugaggacaagaguuugagaccagccugggcaacauagugaggccucgucuucauaaaaaaaauggaaaaaguagccaggcaugguggcacacgccuguggucccagcuacuugggaggcugagaugggaggauugcuugagccuaggagguugaggcugcagcgagcugugaucaugccacugcacuccagccuggaugacagagcaauacccuuuaacaacgcuaaaaggccaauaacauauuuugaaagccaaaagcuaggcugcuuaagccagagaguuagccagauugugaaugcaaaggaguucucgaaggaaauuaaaagugugacuccagugaaugccugagugauaagaaagugaaacaaccuuauugcugacauggagaaaguuguaguggucuggauagaucaggucagcugcaauauucccuuaagccaaagccuaaucuagcaaggccguaguaacucuauucaauucuuuggaggcugaaagaggugagaaagcugcagaagaaaaguuugaagccagcagagguugguucaugagguuuaaggaaagaagccaucuccaaaacauaaaagugcaaggugaagcagcaagugcugauggaaaaacuguagcaaguuauccagaucuagcuaagauaauugauaaagguggcuacaguaaacauuuuaguguagacaaaauaguuuauuggaagaaaaugccaucuaggcuuuuauagcuguagaaaaaucaauacuuggcuucaaaggacaggcugccucucauuaggggcuacuguagcugaugacuuuaaguugaagcuacugcucauuagccauucugaauauccaaggaccuuaagaauuaugguaaaucuaaauuaugcuaaaucuacucugccugugcucuguaaagggaaaaacaaagucugggugacagcacaucuguuuacagcaucauuugcagaauauuuuaagcccgcuguugagaccuacugcuuagaaaaaauauuuuucaaaauauuacaacucauuggugaugcaccuugucacccaagaccucugauggacaugcacaaggaggugaauguuuucgugccugcuaaaacauccauacagcagcccauggaucaguuucaccuuucaagucuuauuauuaagaaauaacauuucaggcugggugcuguggcucaugccuguaaucccagcacuuggguagccaaggcagguggaucaccugaggucaggaguuugagaccagccugacuaacauggagaaacccugucccuacuaaaaauacaaaauuagccaggcgugguggcuccugccuggcuacuugggaggcugaggugggagaaaucccagcuacucgggaggcugaggcgggagaaucgcuugaacccaggagguggagguuguggugugcugagaucgcgccauugcacuccagccugggcaacaacuccgucucaaaaaaaaaaaaaaaaaaaagauggucuuaauuuuaauguaggugaauuuaugaaucuuuguuuuacgguuggugggaagaacacuauccugaagugaaauauauuuuauauuuucuucuggaaguuguaagguuuugcccuuccaauucaugcccuugauccaucaggaaaugauuuuuuggggguauaaggugaggagucaggugugaccuuagaugaauuaccgauuucuucucgcaucagcuuccuuggcugcaaaacugagacccuaaucccugcccugugcgagguucuugugaggucggaauacagcauacagacacauugagccccaugucucaguaagcauucaguaauugcuuguugguuuaaguccaaccuucuucccuaagcauguggacacucagggaaaguuggcgcuuaacugggaaaguuguugcucguacauugucugccagcuuacuacaagcaucauggccaggcuggguuuggcugcucagcacauccccuggcagggcacuggcggccuggaaaauguauagcaggcaggugcucagucaguccuagagcugauuucaugugauaucugaugcauuuauuauagaaaugaaagcauaaaaauguguuuuaacuguuuccuacucccccggcacagugacaaggcugauuccaggcacagcuugguuaggccagcacuuguaacuaugguggggagccucgaggcacugagugagcucagccuccuugggcagaaaagcuuguuuaguuauugccagcacacacuguguguuccugugggcaaacaaacagacggcuggagauccgggggaccugguagucgucagcauuuaugucaccaccguaugccuucucugaaugacuugcggaagaauagaguggguugggauuaugugguaaguguaaaaaaguuagcgaucagagggacuuuggguuuaccucuggagaggacauaaugaagguaauccuucacugugacggaugaguggauauuucuuuguacccugagcucuuucauccuaccuugguggucaaaugugagagcaagugcuuuggggcucagagggcaucacuccaagcauucugcauggagucuguuguggugaauguucuugcuggcaucuugaucaaggacuuugucaucauuagccaucaaaugcuuguugguccuucucaacccuguaauguugauacuuaaaaaacuggaaacauccugacagaaacagucgagaagugguugugugagcucugguuaucgcauuacaguuaaaguuggcagauagguucuguauucagugccccaucaaaaacagaacacagacuauauaaggggaauauuguuuguaaguaacucugugggcuaauugugcaaauaggugcuagaaugcugggcagccuuuuuccuucuucguggcuuuguugcauuuuauuguauuguuguauugcauuuuauuguaaugacaguuacuccuuuugauaagaugaucucaguagauaggcugaauuguccuguuuaaggcuacuuuucuccucugaaucuaaagguguucgcugucagagcuaguacggaguuuugaauuuggcacuguguugccuaaccgucuucuccccccgccccauccccgcauaggcaaauaguuuuacuaguuugacauuuaaucaaaauuuaaacauggggccaaggaagguccuccaggaagcauuaguaugaaaaauauuguaaacaguagcuuuguucuagccacacaauuuggauuucucaagauuaacugucuguacauaaacacucuugaauagcuauguauuaacuuuccccuacuuugagcuggaaauagcuucucuucuccaguugaugugaaugcagggguaguguacccuacauggacuguguauuacuccuuuaagauuguuggucuugcugcuuuguucucucaguguaaagcacaagucacagaaccaugguuuaccuuaacuagagcccuccuuucagaaaagcacuuuuuuuuuuuuuuuuuuugcgacggagucucgcucuguggcccaggcuggagugcaguggcgcgaucucggcucacugcaagcuccgccucccggguucacgccauucuccugccucggccucucaaguagcugggacuacaggugaccgccaccacgccuggcuaauuuuuuuuguauuuuuuaguagagacgggguuucacuguuuuagccaggauggucucgaucuccuaaccucgugaugcgcccgccucggccucccaaagugcugagauuacaggcgugaaccacugcgcccggcccagaaaagcacuuuuuaauuuuuuaauccuuuuuuuuuuuuuuuuuuuuuuuuuugagucggagucuugcucaguuguccaggcuggagugcaguggcacgaucucagcucacugcaacuuccgccuccugggcucaagcaauucuccugccucagccuccugaguugcuggaauuacaggcaugugccacgaugccuggcuaauuuuugcauuuuuaguagagacaggguuuugccauguuggccaggcuggccuugaucuguugaccucgugagccaccgugcguggccgaacugcucuguuuuacagacaggaaacacaaggcugagaacaucuguuacucagagucccccagguuagcauggaagcucgugguucagaccaggcuguccuugccugcugcacuugcaggucugucugccuucccugcaaagcagcaucucccaguccuggggggucucuguaccaggucuaaagggggucagggugguguacugcaugugguuuguuuauucucuuaaguuuauaugcaauaaaauuccccuuuuuuuuuuuugagaugaagucccacucugucucccagacuggagggcaguggcguaaucuuggcucacugcaaccucugccugcuggguucaagcaauucuggagucucaaccucucaaguagcuggaauuacaggccugcgccaccauguccagcugauuuuuguauuuuuagugcagauggaguuuuaccauguuggccaggcuggucucaaacuccugaccucaaaugauacuccugccucauccuccuaaugugcugggaccauaggcgugagacucagcaacuuuuuuuuuuuuuuuuuuuuuuuucuuugagacggagucucgcucugucgcccaggcuggagugcaguggcacagucuucggcuuacugcaaccucugccucccagguucacaccauucuccugccucagccuccugaguagcugggacuacaggcgcccaccaccaugccuggccaauuuuuuguauuuuuaguagagaugagguuucacuguguuagccaggauggucucgaucuccugaccucgugaucuguccaccucggcuucccaaagugcugggauuacaggcgugagucacugcacccagccuuuuuuuuuuuuguuuugagacguagucuugcucugucgcccaggcuggagugcaguguggugcgaucucggcucacugcaaccucugccucucggguucaagugauucuccugcuucagccuccugaguaccugggauuacaggugcgcaccaccaugcccgacuaauuuuuguauuuuuaguagaggcgggguuucaccauguuggucaggcuggucuugaacuccugacgucgugauuugcccgccuuggccucccaaagugcugggauuacaggcgugagccaccguguccggcuccucagcaacgauugaucuguuuucugugucuaugauuuugcuuuuucuagaaugucauauuaaauggaaaauggcaucauacaaugcaggggagguagagguugagucaggcuucuuuucguuaacauaguuuauuagagucaucugacuacuuagugggaguguuucaguuguuucuuuucauugcugaguaguguuucaucauauggauagaccccagcuuuuucugcauuucucaguugaaggacacguggaugguuucuaguuuuuggugauucuuaaugaagcugcuaaagcuauucacaugcaguucuuugugugaacauguuuuucuuucuuuugguuaaagaccugcaagugagauggcugggucauuggaauaaauacauguuuagcuuuacaggaaacucucagauguuucuggaggguugcaucauuuuucgcccucaucagcaguggaugagaguuuuagucguugcucaucuucacuagcacuugguauugucaggguuuuaggggugggaagcaguggauucacauagucuugcagugguaucaguguggcugugauuuguauuucuucaugacuagugacggggagcaucuucccaggugcauuuucuuucuuuuuuuuuuugguauauauuuaucuuuuuauuuugucuuacgggugauugcccuaccccacacaugguuuuguuugauuuuuuguuuuuguuuuuguuaagauggagucucccacuaucacccaggcuggagugcaguggcacgaucucugcucacugcaaccucugcuucccagauuaaagugauucuuccaccucagccucccaaguagcugggauuacaggcacccaccgccacaccuggcuuuuuguauuuuuuuuuuuaguggagacaggguuucaccauguuggccaggcuggucuugaacuccugaccucaagugauuggccugcuaaagugcugggauuacaggggugagccaccacacccagccgacacauagguuuuuauuuguuuuuauuuauuuaucggaucagggucuugcucugucgcccaggcagcaguugcaguggcugugacgucucacugcagccucugccucccggguucaagcgguccucccuccucagccaccagaguagcuggaacuacaggcacacaccaccacacucagcuaauuuuaaaauuuuuuaguagagguggaguuucacuauguuguccaguuggucuccagcuccugggcucaagugauccucucaccucagccucccaaagugcugggauugcaggcaugaaucacugugccuggccaggugcaaacuccaagggauucucuuuguagauggagaggcagcucuucauacgcucucuguagaacagcaguucuguggagcagcaauuaagucguguuuuccucgugaaccuuaacaggccugggugggugaagugcagaaguggguggccacuugccguaaggacacauagcacuggaauguugagccccacucuccugagugaagccagcugguuaaugcagacuugccuuagggaaaaggaaacagaacgucauaccaaggaauccacucaugcugggccacugaaggaaccauggaaacaugucccuguaaaugugucccuguucugugugugucucuacauguguccauauugagaguuaugcuugaagcuggggaucacaaaaucgaaaauugugucgaccagcuucuuagcugggcuuggccauggcggggaugucccaggccuuaccugucuucuucauucacccccuacccaccaccaccaccaagggacucuugaguugauuacuuugcugugggcauagcauagcaaucugugugcggaauguguggaagugugucaggcuuugauggguaaaagacuuugauggguauaugagcacauauaucaugagaaaggaauugugugaguuucugugaaaguuacagaacucuccagcaaccauuagucuuggggaauucuuuuuaaaauggcaggggucauucuguucauucucuaugugauggucacuucucauagagugauggggccuucucccuuaagacagacacguggaucaggaauagacaggacugacaagagccccucuucuuucccagauggaagacacugccuauuucuacaaaaugggggauaccuagccaccccggugggcagccaugauagcugagcauguuugcuccccaugugcccacuuacugcaaguguuuguggugccaccaugacuggggaagggcucugugccggcagaagaggguuguugcuacaccuggggugugaccuguaaaggugacacgaugugccagcaguuacccaaaugccagaauccuaggaaauuauccugggcugcuuggggaugucuuagugugagaccuguuuucuuucuuugggucuuaggcggagucggauugauauuugaaugauugggcauucuuucuguuaagcugauuuucugguugugggaaguagauuguuauaauuuuggcuuaguucaaaguguuagggaagcuguauagaauuucuuucaucucuuuuucaggguggggugaggagagaagggaugugaccacaagcuuuuuuuuuuuuuuuuuuuuuuuuuuuuuuuuuuuuuuuugaguuggagucucgcccuguugcccaggcuggagugcagugaugcaaucucugcucacugcaaccgcugccccccggguucaagugauucuucugcuucagccuccugaauagcugggacuacaggcgccugccaccgugccgggcuaauuuuuguauuuuuaauagauacugggcaggcuggucuugaucuccugagcucgugaucugcccgccucagccucccaaagugcugggauuacaggcgugagccaccgugcccggccaaccacaagcuuuuauauuaagaaugcaaagaaagcauuuugcauuuuucuugaaagccguugaguuaacuacaguccuguacauacuuagcuaagauucaaggcaaaaacaggccaaauauuccaucagugcuuacgcuaaguguuuuuguuuguggaccuccacccguguuugugccuuuugcagagcccaccuuaauaaacuguugcuuauaauaaaguccaaauuuggcuaugagucauugggccugcagaggcaggcacagagggaucuuuucucaggauuguugggugcugcuguaacccuugugaggcaggccaucaucuugugccucauaguggcucucccaacugcagauuccacugguuguaauagaaucuccuguaaugcuuccuuuucuuucaucuugcaggcaggauugcagaaaugcuugagguuguggaugggcacacauguaggcagcacucuuucaccgugcugcaccuggucccuuggguuuccugggcaugguccuuauaugcugccauuaccauuucaccugcaauuuuccagcugguuucugccucuuacaucaucugcugugacgaaggcuggcuucauacagaggaagugaggacgccugguuagaguccacagcuguauuccauuugccagcagguggggcaucucccacuaaaccugaucccugagcaaaggcauguccaaaagcagaugagaugucaacuugcugugaaagaggcccauuagcucuguaaauacagagcguaucuuaguucuuugcacuuguccaguaaacacuacaaaggaauguguggaagugcgucaggcuuugauggguaaaagacuugaaaagcaaccgcaguaccccaaggcgauuuuaaaacucugugaagccaggguuuggggggguucgguggcaguggcucagugcuucucuguaucguguguacguuguuuauucaggaagguagggagcagcaguauaguccaucugauguuuucuuagcagcggcucucaaguagauuuaggacugcagaaggagcagcuuggaaggcucugcagucugugcagccuggucaacgggagggcacaacuggagaccaugccaggccuggcugccaugcuauguugugucuuuuguuaagaauguagcugagggcuaauguaacugagggcuacugcuguaucacauccugugacuuugugugucaaaggggaaggaacuuuuaaacgucuaucuguuagaagcuaugcuggcugcuuuuauguaucuuuuguuuacuccucacagauacaagguagauguuacgaaauccaccuagaagauggaccuggggcugaggugccugcccaggggcaggaucugaacaaagaucuucuggcuuugaaguaucuguuuguuucaugugguggcuguugguggggggggcuucugccgucagagccuacucuccaugagaggugggcagaaaggguuauaugccuagagaaccagggagaaacaguugcucuucagauuagagaagucucugucaacacaacuccuuuguuaagggaauuuucagaggauuuagaguaaguugauuugucucccuuuaugccccuggauuuuccaacuuaaagcucugccgcuggacggaguggugcuucagaaucucaguguggcuggacggucaggagacugcacuuugggaugcugccucacauccagauccuuuuggcucccuguccacuucagcggccauaguuuacucuccgcgccacugcucucuaaagacacacuggcuggucugcggacaucaugugcuagccucugccucaggcuuugggccuuguguggcugaccaucguggcuaaucucuggcuuucuucaaacacacauugaggccugucaaccugcgaagcacucacuagauacuauccaugccaauaugcacuuggaagaaggggaacaaaugcggccacagcauuacagugugguagaugcugugguugcuuguaauugugcauuacugguauauaaagaagcaguugauguuuguguaucucgcagccuugcuucuuauccaggagucuucgggauucuuuuuuuuuuuauuuugagauggagucucgcucugucgccgggcuggagugcaguggcacgaucuuggcucacugcaaccucucucucccggguucaagcgauucuccugccucagccuccugaguagcugggacuacaggcgugcgccaccacccccagcuaauuuuuguauuuuuaguagagacgggauaucaccauguuggccaggauggucuugaucuccuggccuugugaugugccuggccggaauucuuuaccuaaacaaucauaucugugaacaaagacaguuuuuuuuggagacugaguuucgccuuuguugcccaggcuggagugcaguggcacaaucucagcucacugcaaccuccacuugccggguucaagcaguucuccugccucagucuuccgaauagcugggauuacaggcgugugccacuaugccuggcuaauuuuuguauuuuuaguagagacagaguuucacuauguuggccaggcuggucuugaacuccugaccucaggugauccaccugccucggccucccaaagugcugcgauuacaggcgugagccaccgcacgcagcccccacaaaggcaguuuuauuucuuccuucccaaucugugccucucucauuuccuuuucuugucuuauuacauuaguucggacuugaaguaugauugaaaaagaguaguaagaauaugcuugucuuguuccagaugcagggggaaagcaucuaguuucucagcauuaaguagauacccugugauugugauaaggcaaauucuggccacagcaacaguugggaaagccacccaaggcaggcuugaaauuagcaaaaauggaggacacacggaaagccuuuugaaggaaagauuuuagccagauggagugucuuggagaacaagguauucccggcagagaaagccuaguguauugauagaagaaaucgagggucaggaggccacaugagcuagcaacagcaagugcauccgugagagagaugcgggaaccugucucuagucccugggcucuuguuagaugcccagugccaugaggugcuagggauacaguaugcauagacaccagacacacaccguggcacccccaggcugcagugggacauggcacagguuucuccagcaagcugguuuucugggaugggcagagguucaacuucaacaauaugguuuguuuucugggcuguugcccccuuuuauggaaccuuuuauuuaauagcaggcuaggaaauuguaaacagcacaaaguaguaguaugguguugaguguuuagacggaaaacauucauagcugaacuguaguuuuuaucuucauuuuggaguuagucauguucuuuggucucugaauggccuucugggcguggggucugggacagccugcacaccuuucaauauccuugacugccugcuacuucacugcacagggcuccagaugccccucacuggcugucugugucccaggcaccuuggauguuggccaggcccuagggacccaggcucugaggagauagcgauucuguucauuuuggauuagccauggcacccagccaucauuuacaacauucuucccugggaaccuggcagagaagucccaaugauuggcucgaugaacauuuggagcacgauccucuccugagcuguuggcugccugugguauauugagauuucugcaaaaacagugggaaaggggaacaaaauuagcccuggauuucugggccaguucuuuuagugucauccucccacaccuaaccuuccagguggcaagauaaccaagcuucgcuugaguucagugcuugcugcaaaaaucacauaccaacauuccucuucucauccccuuuuggaguggagaggaagcaaaugggcccauucacaugagguguuuccaccuagcuggcagacagcaucuugagggcugggugccugucguccagauguguccagagcagccacagucucucuccucugcugugaacugcacguccagaccuuuaucaguuacagcugcagaaaugcaagggaacaagaacauuucgccuuggcguuuauguuuugcucaacacagaaauguuuaguuucagaguaugagaaaaucauuacauuugcgaaaacucagacucaugguauguccuagcauggugcuccauuucuuaauuguuccugauugugcuauccaggagcccccagcccucagucuacucauuagccuacaaaaagacacuuagcguuuuggggauuccagggaaucguaugccaggaaacggugaagaccaaauauguauuucacaauaucacaugcuacaacuuggaugaaucuuaagacauuaugcuaagagaaagaagucagacacaaaagggcaaauauugugauucaacuuacaugagauaccaaaaauggucaaauacauacacaaaaaauagugguuaccacgagcaggaggauuaaggaguuacuguugaguggguagaguuucuuuuuggaaugaugcaaaaguuccagaggaggauaaugaugaugguagcacaacaguguaaauguacuuaaagccacugaauuguacaccuaaaaaugguuaaaauggcggauuuuagguucuguguauuuuacaauaaacauuuaaaauauaggugugcuuuaccccuuccgggucgcuagcuuggggacaccuuacuaucagucauauccacuagagacuaacgaguggugccugcacgagucggcuaaagcucuuacacucugccauggcgguuaaauuuuuggcugauuuuucuuuuggcaagaggacauagcugucugcuuuccugcuaucgaguugccagcuguugcuuccugucuuguaccuuuaacugcuacucuccuuuuaauggucugcuuaugaucugguguccugggaacugagauaagccugccaguggccuuacccggugccacccugcugggucuacccagugccacccuccuaggacuucugguuugggcucagguagccaggagcccuuaaaacaaccacucuagugucuuuaacaagcgaaacuguaugguuucaggcuuguuuuuuagcuucgguuuuuauauuggcaccugagguucagcuaaucuuuuucugaguuaaagaugagcuuauuuauuuauuuuuuucuuucagccuggaugucacuguuuugaguggugcugccauuggccuccuugaacuuuuagcaucgacaguagucggcuguuguggagacacccaggugugcacuugguguggucuggcaggaagcacccuuucaggggcacuuaacuccaagaggaguuaagagaguaggacauuaacuaccagcagugugagcagaguuacccuccuucuguugcugcaauccuuucacauccgaaauugugagaccuaaaacuagacuuuugguuuggggauguuucaggcuuuucuuuucuuucuuucuuucuuuuuuuuuuuuuuuuuuuuuuuuuuuuuuuuuuuuuugagacggagucuugaucugucaccuaggcuggagugcaguggcaccaucucagcucacugcaagcuccgccucccagguuuauaccauucuccugccucagccuccucaguagcugggacuacaggugcccgccaccacgcccagcuaauuuuuuguauuuuuaguacagacgggguuucaccauguuagccaagauggucucgaucuccugaccucgugauccgcccgccucggccucccagaguguugggauuacaggcgugagccacugcgcccggcccaggcuuuucaacgaaacaucuacaguuguuuucucauuugcucacgaugcccuauuaggcagguaguuuuccccguaguccauugugugguccaaauuagugccaagggcuucugggucuagcauuuccagcagcagaggcagacccuuugggguguagauaagucaucugagucugcagccguaauugagugucaugaaggcaccuccagauggcugugaaaugaagcucuuuuguuuuuggccuaugagaguuguauaacuucugagaauuccaggauacagagaacaccagggugggaucauuaaguauggugggauguugugauaacuagggggucuccuuuuggcuugcuuucccaauuaaagguggaacauauuuguaaaaugaaaaauguggcuuugauuagcugaguggcuaucauucagcacugcuuacaguuuauuuagggaaucauuuugucacuacguagcaaaauaacugguauaguggaaggaauuaccauccuuuuggcuguaagaauguaaaccuaaggauugcugacaucauaaccugccugaaggguagagucaaggaugacugaaccuucguuugacucaggaagauauacauaagcuucuuaaaaucaaugucuaggcaaaguaguacagcaugcaaaccacugaagucguaugggauugcuuaaugagcugcucuuuuacauauguacauuaauucucaaaggcauauucagucguuuuucauuaucuuuaaagaugauaguauaaagaugcuaucaccaaauggaagcugugguuuuaaguaagccacaagccccuguguucaaaauaguuauauaucaggggaaccagcuuuagagcaauuugcacauaaaugagauguuccaguggagaauguguauucucuggguggacuguuauccuguucagugcauaauacggaggcaaugagaagagauuaggaaccacagagccucacuugugaaagucauaaggaguaggaauuuuuaaagugccaucccaucugccaccuacauuucuuuuuuccauaggguuuaccaucuccuaauuuuaguuguuauuuucauucuugauugucuaucuguuccugugaacccacaagggcagaugucuuuguguugaaucuccugagcccacagucucccaagagauguaguaggaugagucagaacucccaguauuuucaccuaaaccaggaaaauuucaaaugauggggauacugagucauccccaggcaccugcuguuuggcuagccucaacuaggagcugauuugcagucuguucuucaccuuaacaccaucuccuuauaggccuacuccaggagcagggcauaacaagucaggagcaggcccaguagacacauguuaggaacaggaucgggguggugguggugggugauaagcaauggucaggucacaguuaccauaacccauugacuuggggguuuugcagggucugaagugccaucauacccacuucuuuccaucugggaccaguaaaaaaaauaccauaugcgucuuuaaugcaauagaguuuuuucuuuucuuuuucauuuaugaagaacgcuuuuuaaaaccucucaaauguuuccuuggguugaaaucaaauuuauaauagccuguauaucauccccuagagauagcaaaaccaacucaugagggagccuguguuuaugagggaagaggggguacacuuagguuuucguacauauggguaugagauggaacacacuggaaacaugaaaacugcaggcuuagaugagaagcggguguauauguugugagcuuuaccaucugaggcagagucccagccuggccagauuagcuguuugccuagagcaucuuucuagggguugguguucuguauguugaaaugaaugaaauugcuuccccagggcuggaacacaucuguuugggugguguucuagguguauacuugcacccauuuauuauuaaaggggugguuugaguuuguacuggauuugaugagaguuuuucuuuuucaguacucgugaugcauuucuucaccugaaaguauaaugcauuuugauuucuauggcaaccagugaacgccaagggaacaaauucuauuucuguuuucuaacguaacaggauuaguggaggcgcaucaaaaauuccauucuaagucagugcugcgucuugaagagaauugaaauggucuaguacuaacuuuuuaacauugacuuugaauacacuuuuaauaauccacaugucagucagcuuacucuugguguuaaaugucacucgagcaggaggaggccucgaugggagcuucuuuuuaaucuccaauggauccucagugaaguccuuagggauuucauuuucuggguuucagaaguacacacaccugucauuagggcuucauaugccuagcgugugacccccugcccuacccuuaagccuaaggcagucauaugguuuuuaaugugucuauccugccuugaaaccaaaccucuccaagaacuaaaacaaaaaugugaauuacuccuugcccuucaggcugcuucguuggaaagccuucccucacuugagccccuugcugagagcccuguagcacccugugaaguggccccguuuuccuuccugucuaugcaggcagggaccuggcuguggguggugccccgugggcagaacccagaggcuggggggcuccaguguccuuacaagcacacuucucccauugcuugugagccacaucuuuccuagcuuccauucuccugguuucaucagaucuauuaggauggugcaaaaguaacugcuguuuuggcuuuuuuuuuucuuuuuuuuuuuggaucaaaaccgcaauuacuuuugcacuaaccuagcuaccuugagagugguuuugagugggaaguaauacccaucuauuuucugauuuauuuuauuuauuuauuuauuuauuuuaagauggaguuucgcucuuguugcccaggcuggagugcaguggcgcgaucucggcucaucgcaaccuccgccuccaggguucaagugauucucaugccucagccuccugaguagcugggauuacagacaugugccaccaugcccggccaauuuuauauuuuuaguagagacgggguuucuccauguuggucagguuggucccgaacuccugaccucaggugauccacccgccucggccucccaaagugcugggauuauaggcgugagccaccgcacccagcuguuuucugauuuuaaguagcuaaggagucuggcuuucugcuggaaucauuuggaaaggucgugggagaaacaucucaagccugccuagguugucucuuuagggccuggccucuggcuuagggcacuaguugucagaacccagaaaacagagcuauggggccugugucggggagugggguuacuaaacaaagguauuuugagguaaaagacgugaagcauuucuaacgugguucuguaguuugcuuucccuagguuguuauggaccaagagacuguagcugacuuuguuuaacucucauguucaggaguggaggaggggacuugaguauuaacagccgccuugacacaguggggaccugguggcuguggaagccugaggagucggugccugcuccucugaacuuucccuccccucagcagaugguacuguugcguguucucucuggugccagugaaagagcucauucaugccauucacagaguagugugcuuagaacucagcccuccuccaucugcaggggcaggcacccgccacggcuuaguggccacccucgggcguugacuuccucccuucggcggcccugugugucugcugggcagugcaccagccuguguagcaccagcugcucggcugcuuugguaaaaacaagggaagacugugaagcuguucugugcucugcacaccagcaggagaagccagcggaggguguggaugggcuuagggcagugucugcaguuccggaugaauucugccugugccuuauaaacaucuucugggaaggagcugauuuuugaugggugauuguccaaguuuauaacuggauccuguguuucacuccucuucuucuauuuauuuuuauuuauuauuuuuugagauguggucuugcucugucaccagucuggagggcagaucauagcucacugcagccugaaacuccuggcuucaagcgauccuucccagccacccauaaauccuuuuaauaaguugcagaugugauauuaccucuguguacuucagcaaacauuucuuaagggcauucucuuugaaagcagggacugaaacauguauuuguacgcccauguucauagcagcccuauacacaguagccaaaagguauuauagaagcaaccuguguccauugauggauggauagauaggcaaaauaugaaguauuaaucagccuuaagaaggaaugaaauucaggccagguacaguggcucacaccuguaaucccagcacuuugggaggccgaggugggcagaucaucuaagucaggaguuugagaucagccugaccaaguuggugaaacccagucccuacuaaaaauacagaaauuagccagacgugguggcacgugucuguagucccagcuacucgggaggcugaggcacaagaaucgccgaacccaggagguggagguugcaaugagccuagaucguaccacugcacuccagcuugggcgacaaagggagacugucucaaaaaaaaaaaagaaauucagaggugcuacaauguggaugaaccuagaagacguuaugccaagugaaauacgacaaccacaaaaagacaaauacuuugugguuucacucacgcuggguaccuauaggagucacuuccacagagacagaaaguagaauggugguugccagaggcagggauugggaguuaguguuuaguggauauauggguuacagaguuuguuuuacaaggugaaagcguucugaaacgcccaguugugguggcucaucuguagucccagcacuuugggagacugaggcaggaauauugcuugagcccaggaguuugagaccagccugagcaacauagcaagaccccaucuuuaaagaaaauaaauacauaaauuaaaaaguucuggagcuagauagugauugcauaguagcgugaaugcacuuaaugucaccaaacuauacaguaaaaaaugguuaaagugguaaguuuuauguuacauauauuuuaccauaauaaaaauaagauuauuaaaguuuuuacugugucuuaaaaaaaaaaagaauaaaggcacuguccucuaaaaccgcauaaacauuuuuuugcauacaggaaacucaacaaugauuguauccuguguugagauuucccauauguuucccccauucacacaggugauguguuaauacuaaugcuauguuaauguuuucuuuuaaauagauauauuuuaguugagcagguugauuuaaagcacagguggaucugugggugauaaaagugguagguguggaaacugacuggggucuaaccagccugaauguguaguauuccccaucccuguggccccagagcagaguuccuaaaaugccugcccuuggccuccuagccagugaaaccucuuagauuuucacagugaggucagcacuaaccccacguggcucuugagcaucaaaaaauguggcuagugcuaccgaggaaaugaauuuuuacuuuaaucaaauucuaauuaauuuucaaagcugaugcucaguuuaguuagugaaaaacauccagauauguuggggacaccucggguaugugaaucuacuuuuucagcugcaaguuuuauggaaucuaaauacagaucacauauuuugggugaaaauuuagcaccugaauugugcugugacuguggggcaugcacacuuagauuucacagauuuaguaaggaaaaaaauguuacacguuuauaugucgaaaugguauuuuggguaagcauaccugcuuucucuguuaauguggcuccuagaaauuuuaaaauggcaugaguagccacauuguauuucuguuggacaugcgcagaugugcaaguauggaguuucacuuccuccgugcagcagccaccuuccucucccaugcccuccaccugaugucccuauuacuucccugucucugcugcugaagucucuuucucgucuucugugcuaauaaggccuccagccugugaguaccacggugccugauuauggucuugcugcagcacuguguuggcuccuccauguuaggccggugcaggggaggggcuaugcuccuuuucucaucugcucgggguggaggggacuggacugauuuguguuacuggauaccugaggaaagaccuuugucccccuuugucuggcuuuuggccuuagguccauaggacagaggcgugggaagaauuggugggaggguauugggacuuaggagaggguaauggggcaccuccuugagguggcucccucccuggacgaggcaagccuagcauggcaucugggagaaccugggaauaacuuagggagcuagggaaggccagugggucucaugcugccagcauguugcucucuggcucuccucacacacgccuccuaaagcaguuacuaaacucagagugggcaccauccuaacuaagccaggugucucuccugcugugcuucgugcccccacccaccccuggccauuuaaguccuccuuaaaguauuuuuucccuuuaguuccugauugauaacuauguugaugguauuucagggaguugggaaaaacaaauguaaaaaguaguaauaaaaauuagccaaaguuuuauguuaucuugccaucucuuuucuacucagggaugugcacuuuuuaaaauuuuuucauucuguaugcuagacccuagucuaaggcuuuauuuaugugugaugcaccuuauuucuacauccuuagauuuuuuuuucuuuuuuugagauggggucucacucugucacccaaguuggagugcaguggugugauuucggcucacagcaaccucugucucccaggcucaagcgauccucccuccuuggccucccaaguagcuggagcugggcagaguagcugggaccacaggcgugcaccaccaagccuggcuaaucuuuuguauuuuugguagagacacgguuuugccauguugcccaggcugggccugaacuccugaacuuaaucagauuuuuaguagaaagguggugaggcguuccuagggacugccacagguuccauacgagugugauagucgcugcccuggguuuugguuucuauuggucugaaaauuccuuaccaguuaaguggcuguuacuccucaguggacucagaggacaagcuggccacaucugcaggggagugaacuuagguugugugauggacucuugagucugcaagaugccaacuuggcugcauccaaggcucccuuguggcacagcacccagggcugcucugugaguggcugcugccugcaggggcuggagagaggaggaagggugugcacagugaggagaugaggcaugcucugugucuuuucucuccagcaccuccauguacucgccugucaguguaagaguugggcugcuugacuucuguggguuauuuacuuuguggaaguuagguggaauuaggggcaaacaagaacaugguucucacaaagugauuaugccugccaaguuuuuugcuuccuuagcuguagucgucugaagugguguggguuucauuuuauucugcuccuuuauauucugaaaguuacugagaugagagggugacagcuauuuacuuccaagcaucccucuccagcagauucaguucaguugucuggacagaaguagacacugaauguguguggagggccucccagcagugcauggaauggguuaucuggguggcuugcuuuuaccugagggaagagaagcuugaaagugaaguuaauguugccuggaagguggggaccccuuggccuguuuaccuaggacggcauugaccaucaaaggcuucuguaaaguuguaagaauggccuuuuguguacccuuggggguguguaucagauauaaauccagcacuugagacacugucagcucucacugacuggucaucuuugggucuugggucagucuucaguuccugcuuugucagccagggacuuggggucuuuggaagcuggaagcucugacguuaauuuagugucacauucugcguucccuuuucuucaagaaaagugaugccguuccuccuccugauccccauagauuggauucuguaccuaaugaguggugagggcaagaugagaagaaaagucuucuugucugaagccauuucuugagcgugucuagauacugacagguguaacguuuuuuccagaucuuucucuuaaaaucacaaugaagugcccaggguaauaucauugaagaaaagaucaucccauuaacgucagcucuucaucgagauacccaggcuuugauaccucuggacccugagucauugugugcuauugccuuucaugcaugugucuguuccuggcuccaucucuccucgugcccaucaaaggucuaguuuggcuuucccacccagcaagggcucuugcuagucauggcuaaaauguugcugguggggguguugggucauggugucucugaaagcacuugugccagcccuguucccuuuuguguccccagugagugugggcagguuccagggacaccuugagucagccgcugcucugcugcuuugagaagaaacuuaagaggcgugauacacucuugcuuacucacccgggcggcuucccagugggugaaauuagagcaguugauuggaaugucaccauucccacucguggaucuguuucaagaguucaguguuguuuccacuuacacauaacaggacuguguguuaagcugguguguuuuggaacauuucagccacaggcauuguggucaugaaccaugcagauuguuguuugcauuucacucaucucucucuuggcuucccaaauucccaaagggcgugaucuugaccacucacauagaagcugucauaacauguuucccugguguuugguauauaggaaauuuuuauaguuuuaaauuuaaaugaggauuauaagcuuaguuuuuaugcuuuuguuugcaaugggaaaauuucagaagaccggugugaugucauccggagaaauuuucugauugacaccaggggcagcccaggaguguauuaucagcugaguuuaacuaaaccugucuuucacucuuaaacuuucuucucauuuuaauucuucgugcccucuaagaagugaacuuccucucccacucuugcugucuuuguagucuuucauucuccaagugugucccccguauuuccuuccuccuaggaaacaccccucuuaagcagagcaaagugcccagcucacugccagccccuacuuugugaucugcauugcucccuggccaucuuggagucucucucaaagcaggguuuuaauccauaaauucacagucaugucacauugcguuucauaauuuaauuauuuaauuuauuauuauuuuuaaagacagagucuuacucugucgccuaggcuggagugcagugacaugaucauagcuuaacugcuguagccuugcugagcucaagcaaugcucccaccugagccuccuaagagcugggacugugugugucagcacuuccagcuguguuucauauuaugguguggaugaaucucagugccacauaccccacagcucuguugaaaaagaugaauagcugaaaagguguaaagugaagacagguaaaggagauggggaaauggcuuuaaaggagucaacaaggagaaaaugccacucuuaacugugaagggcacagcugagucagugggaaugcauagcuugaauuaaugacauuucuaucauaaucuuucagccuguaauuuggccagguguagugccugaagggccaacuuaccagguagaaguggacagacaccaagaggccaguaugggcuugucaaaggggauagauugcauagaggcugaguaguuuuuacauguguggccgagugguugguugguuuucaguguaaguagguguugucauccacacaccugccaccaccucuggcuucauucugugggucuuugugcccacccaccuggcauuguuaccuaauuucaucuguaauuuugcauccugcauuucugauguaacaucacauucucuuaccuucacaaagucuagaaaucuauggaaugggcugcaaacuauggccugcaggccagucaguuuuuuuggcacacagugaggcucauuuguuucaggauuauuuguggcugcuuucauuuuaugaugauggcagaauggaauauuuuaacaggcuguuuguccugcacagcugacaauauuugcucucuggcccuuuacaggaaaaguuagccuagccugccccugcuggaauacauuuuaacccaacaguuuuuguuuguuuguuuguuuguuuguuuuggagauggagucucgcucuguugcccaggcuggagugcaguggcacaaucucggcucacugcaaccucugccucccaaguucaagcaauuauccugccucagccuccugaguagcugggacuacaggugcacgccgccaugccuggcuaauuuuuuguauauuaguagagauaggguuucacuguguugcccaugguggucuugaacuccugaacucaggcaauccacccgccucggccucccaaaguguugagauuauagacguaagccaccaugccuggccaacccaacaguuuugaucuuguccaugucaaaguuuuguuuuugcuacaugcuucucacaggaacauuuuacauuucaugaauccauccgcccagauuuaacaaucagcaacaugauguaacccacauguaacaauggauccuuucacuguaccugagccacuugucccuccaguugcuggcagcuuuugcagugaaaagaugcugcagcauuuucagugcuacuaguuuaauuagccugcugaugaguuucaaaagcagagagacuggaauucugguuggugagauugugucccgcccaguuuccuggccuccugacugcaagauccuugugugccuguguccccuccaguggggaacagagagcuugaguguggcucacacucuccccuagcagcaaggccaguauaucucugccuuggcuugucuaauccaaggcaaguugcagggucugggguacugcagagucaagagguaauggggccccaccacuuggcugguccaagggguggggggcaggguguauacacacugcgugaaggaggauuaaggccucuaagagcugccucggcgcacggccacuggcccggcuccaggcggcgcagucuggcugaugacacgagcgcuguucucaccagcugccugagccagucagauggaaaaguaauccuauuugugcuuccccacugacacagauugcacaauuaaagaagccgcugucaggaauuugaaguagaugccacucuagcaccuaggaggggaacagaccuucugauauugauguuguguaaucagcauuucagcaaagauguuucuaggacaagauaagauguaaauugcuguaaauugaauuguauugagaaauuaccagguuuuuaccagucagggucccucauccucuuguuuuugucccugggcagaaucuagcauucccugaaaauaauuguuuauucaagagccuuggagcgguggagaggugaccuccucuaccugaaggguaugugugacugugaacuugugauuucaugaggggcuguagucaguuggcauuggcuggcagucuguauggaauaaaacaaauuuaagccauguccccucaggcaucuuacugcuugggaagcauaaauaacaacuuggugucccuuccccuugcccccacaccucaugacuucagcacagugguauguuuuagauuucaccuaugacacgggauauaucucauuguaagcagauggccaggugcugcagggagaggucuuggcucugauuuguuuacgaggaugaaauucuuuggaauacuacugcuagaagucugacuuaagacccagcuuaugggccacauggcacccagcugcuucugcagagaaggcaggccacugauggguacagcaaaguguggugcugcuggccaagccaaagacccguguaggaugacugggccucugccccuuguggguguugccacugugcuuggugaguggagacagcuguggagcagaggacuugaagcacacacuguuccaaaugacguccagccaaccaggccaccauccacucugccucuguccccauggggaugaugaugaagaugauaaagucgcagccugcuuuuuaggguuguuguguggauaacuaagccaauacagaugaagugcucgauaacagcaucagcucaagaaguggcagguaccuccuguggagcucuucuaggcccuggugcaggucugugugaugauggcuugcauaaagcucugcuaagugugguuuaaccagccaucgucuuggcgacugcuucugccuucccuggcgucuuucuaccugugugcuccaucacuuuaggagaggggugagucugaacagaccagacagaaugaaggcaggauuacuggguuucaagagguccgcugggaggccaggacuucagguagaacugcaaauacaaaguauagcuggucccaacccauugguuuucucagugacuugugauggacggaacugggaacugaaucuccagcaaucagcagauucugggcaguuguuuguggucuuucucuuuuccucucuggcuugccuuuagagucccagaacuaagccugcccugcaugucuguaucuaucuauauccugcuuucuaaucuccuuuccuggucugggaacagguugcuuggggccagacugcuuugugaugaguggguucagaacaaagccugucuggagacccugaaagccccuuugaaggauaggagcuaauugggacgggcgauggagagaacuaugacuugauggaggauaccagugaagagggcuugcugccauccacuuugcaaguagggacuccaucauugcagaaaguguucaaacuuucugagcugguuuuggauuuuuuguuuucuauaucuuuuguuagauuucuaauuugucugaacuauugacuagauuguaaauaaaguuaguccaaggaaacaguuuguuuccuguucagaguuauaaaacauuacaguuguguucucuguuaaguacugucuaucccuaauauuuucccaaaauucacuuaaauauuaugauugcaaagaacaucuuugaaaacaggcaugcuuagccgggugcgguggcucacgccuguaaucccagcacuuugggcggccgaagugggcggaucaucugauguugggaguuugagaccagccugaccaacauggagaaaccccaucucuacuaaaaauacaaaauuagccaggcgugcaggcgcaugcuuguaauaccagcuacucaggaggcugaggccggagaauugcuggaaccugggaggcggagguuacagugagucgagaucacgcuauugcacuccagccugggcaacaagagcaaaacuccgucucaaaaaagaaaagaaaacaggcaugcuuaaucagaggucuaugaauuuagagggaaaauuuacauuuuuauuuucauuaacccagaaguucccaaauuuucuugguucacaacauccuuaaacgucucaguuuuuucugugaugccucaggccagaggaaguagccaacaauauuguuuauuaggugguuaagcacaagcagcagaauaaguaccaaugucucaacaacuguguagcugucugaaaaaaaaaaacaggaauauauauuuuauucuuacauaaccauaguuauuucuuuuuuuuuuuuuuuuuuuuuggcggggguugggcagagucuugcuuuguugcccaggcuggaguacaguggcacaaucucugcucacugcaaccuccaccucccggguucaagugauucuccugucucagccucuggaguagcuggauuacaagcaugcgccaccauaccuggcugauuuuucuguauuuuuaguagagaugggguuucaccagauuggcaggcuggucugcaacuccugaccucaagugaucugccuaccucguuuucccagagugcugggauuacagguguggcccgccaugccuggcccauaguuacuuucuaauaggaugugucugccuguuggaugcugcacaaauccucaaaccuuagaaccagguuggaugucacuaccugcaucuccuguugauguugauuuugauuuuuuuuuuuuuuuuuuuuuuuuuuuuuuuuuuugagacggagucuugcucugucucccaggcuggaaugcaguugugcuaucuuggcucacugcaggcuccaccucccagguucacaccaugcuccugccucagccucccaaguagcugggacuacaggcgcccgcugccaugccuggcuaauuuuuuguauuuuuaguagagaugggguuucacuguguuagccaggauggucucggucuccugaccucgugauccgccugccucggccucccaaagugcugggauuacagguguucauguugauuuuuauaugaccuuugcuuuuuguuuuguuuuguuuuguuuuggagacggagucuugcuguguugcccaggcuggaguauaguggcgccaucucugcucacugcaaccuccaccuccuggguuuaaguaauucuccugccucagccuccugaguagcugggaccacagguguacaccaccaugccuggguacuuuuuuuuuuuuuuuuuuuuugguagagauaggguugcacuguguuggccaggcuggucucaaauuccagacuuaaggugauccaccugccauggccucccaaagugcugggauuacaggcgugagccacugugccuggacaaucuuuguuuuauuacagcaacuugcugaucaaguguugcaggcugugacacuguugaauauagugcaaucugguguugaaaugaucaauugccuugugcugauaguuccugcaaugccaucugaguuuaccaugacauccccaaggcaccugggcacucaguuugggaacuacagcauugucuaaccuugcuucauccuuuucuucuacacugggaacaugauauaggguuucuguuggaaguagauacaaaaguaggacaucaaguucgauuauguagccgccuuuggauuggaaacaauaagcgaaauucuuuuccuuuuccuugaccuucagcuaacucuuaacguggugaaugguggcuccugcuuuuuggccacaggucaguaugaaaauggagagggagcagcaguuuuuaaucuuuucaacggaaaacuuugaagauguugucuccuguuaucuaugccaggcaugccuucucuugccacugccugccugacccccaccacagaagcgcacacacucuucccccgccucuggucucauucucugucccuucuucagagaugccgccugucccucgggucagugcagaucccucuccccguccauggccagagcagcccugcccuucuccuccacaguauucaccccauguauugccuaaucacucgggagaaugccaugucaaccgcugaguccuagggcaaggcauguuaggaccuguugccugagcgagugacugagucugguggucuccacauuauccaugugagagugugaacuguuuugcuuuuccagagcuuugagauugagcuggaagccccaggaugacaauguggguauggucacuaaggguucaccuccugugugcugggaagauaaaagugaaauaaagaugagccugccuucagguuccuagggggcugaccauggaacucaguagauggagaugagggaagcaccagaugcuaugggccagagagagagagagagagagucugugagccuaugucugcauccauccaucugucuggcaguagggcuagcagaucaaaggcugaaggugacaggguuggcugacuuguuguuagagccuagaugcuaggggccuggggcagugugggguuggggggaaccgcugugggaagaauucgcccaaggaggcugaccucauaucaaaucugggccuuagaaaagucaucugggucucacauaggacuucucacuguaccucucuuucuugccccauaacagacuagaagugguugguuuuccucauguuucuugucauugcaguaagagugggcucuugaaguuucccaagggucuuacuuuccuguagucaugggaaggcugugggcauagcaguaggucaguguggucccuugaggugcaggugcugcacaggcccagagugggugcaggagucccagguaucuuauggugaucucccuuguggggccauggauaucacuuucuuuucuuuucuuuuucuuuuuuugagauggaguuuuacucuuguugcccaggcuggaguacaguggcacaaucauggcucacugcaguuuccgccucccagguucaaggcaguucuccggccucggccucccgaguagcuggccaccaugcccggcuaauuuuuugucuuuuuaguagagaugggguuccaucauguuguccaggcucaucuccaauuccugaccucaagugacccacccuucuuggccucccgaagugcugggauuacagacgugagccaccgugcccggccagaugucacuuucauugguuaucuucagagccuccuuaaagaaacuuugggguacugguagcuaccagguuugucuuaugugucgaacaugucauaccuucacauuugaacagacaaccuccagcaguuucuuuccucaggggccuggguguguguguguuaaggauggccacugugucacgaccaucuguguuggacacuucugaugugugugugugcagcucacuaaugaggacuuccuuaauucaaaggccaacuuaacugcccaggaaucagaugccagguuuugggccacucuaucugcuuagaccugguguuuccacuccugggucagguacuucucucugccuugguuucccuaucuguaaaguggggaugaggccagaagcaauguuagcauuuuugaggauuuaacuguuacugugcaucacuugugagcuggcuggcuagggagggguguuuuggcuuuugcaauggcuuaaaacaccaaaugaggcaagguucaagagucagguuuucuguagaaaacuguuuuuuuccucuugugaacagaaaauucagcuucuguccgggcaugguggcucacgccuguaaccccagcaauuugggaggccgaggcagguggaucaccugaggucaggaguuugagaccagccuggccaacauggugaaaccccaucuccacuaaaaauacaaauauuagccagccaugguggcacacgccuguaauccuagcuacuggggaggcugaggugggagaaucacuugacccuggaaggcagagguugcagugagccaagauugcaccacugcacugccugggcgacagacccugucuccaaaaaaaaaaaaaaaggaaaauucagcuuccucggcucaagggccuaucuaggccuggugagaaggugaagaagaguggucacuggccuagagcacacaugaguuuuugucccuuggcuuugcugcaagucuuuuuggaaagagacaagcauggcccagcccagaaguucuagaaguccuuggccucaucuugccucaagggcauugcuuagagauuuccagaaugucauuacuuaauggaaaauuuauagggucugcuuccuuuugggacagcuuggcucugcacccuggccgccuguguccuuguggcugggcugcuccugccccugccugccaucacuuaccuggcgugugcuuggugcgcagcaucagcuauauguuucuggagcugcuuucuaggagaaaucuaaucauagaaaccaaacugaauggcauuccuuggccucacucuuuguacccuccaucuugggauccaggcuuccacagugccuuuaggccuccccuccccuugaccccaucacacuuguccccauuggucacuuuggacuugcugguccugcugcauggaagcccucuccagccuacuccacaugugagugggguuuaaaccccacugacuuguuuccuugucugugaugcuguccuucuaccaauacuuguguccagucacuugguguguccuguaaucuaucugugucuggaccaagacugguacacuggacccaagguucccagcaagcugauauguggcuugugucauuugucccugugucuucuccuaucucacuggccuccuaucuccacagccuaguccauggaguugcuuuauguagcaaauucuccguuuggagcuuuuaaaauaggauuauuugccagaacugcauuuacaaaaaaaguuuguguaauccugguuuaaauaaauuacacaaaguaauucacuggcagcuagggugccuagugugugcuaggcauaaagcugcuucugaacccacuaaaaguucaucccagaaugauaucuccacugaguucuuagguuuauuacuagagaugaaaaaaaaaaaaaaaaaagaaaaugguaggucuaguauggauucauuuuuauuuuaucggcaguaaacaugcagauucuuuccucagcagaccugcauuauuuaaguuaccaagaaaauauucuuaguagguuuguggcuuugcccugagcacuuggcaguggacugggugggccauccaugggugggcagacccagccuuccugcuucuccuugccuggcccaccaaaugaaaugauugacuuugcucgaugcuuugugugugauaaaugcaaggaguuuuaauguaaaugucauaugugggagccugcacaucauccccuuccacacacaggcagcaucuccuaaaaacucacaggugggaaaagggaugugcagguuugugagacguggcuucauuguacauccuuccccaugaccuucauaguucccagagccuuugcuggcuccuagugggcucucaccaccucacucugccuccucuguugguuuguggucuccucccugcuggaggguaagucuuuggggagaggagacauuggaacccuuucagucaaagcaugggguggucccucuggccaacuuggcuagcuaccgccagggaacucaguccuuggagaccacagccagagggacuugucauucugagcggugcccaucugcugacugauaucucacgggggcucuucucuuccuuuguagagugccuggugaagaaugugaugggaucacuagcaugucugcggagagcggcccugggacgagauugagaaaucugccaguaaugggggauggacuagaaacuucccaaaugucuacaacacaggcccaggcccaaccccagccagccaacgcagccagcaccaaccccccgcccccagagaccuccaacccuaacaagcccaagaggcagaccaaccaacugcaauaccugcucagaguggugcucaagacacuauggaaacaccaguuugcauggccuuuccagcagccuguggaugccgucaagcugaaccucccugugaguagugugggcagggcccaggguggccguccuggaggucgucuccugcaugucuccuggucagggcaguuccuggggggaggguaggagaugcauuuggaaucauggugagagcugcagggcccuugagugagugguuucagcaguucugaucaguugaaaucagggagaaagaaugagcuaauuggcuuaacaauaacugguuucuuagauauuggaauccuggggaaaauuguguagagguugaagcagugggagaaaggaaggcccacagaucuacuuccaguuccauggugaguugaagucagagcacuuggccauccuagccccuucauuucucagguguggacauaguugaucaaggauaaguagacguaguugaucaaacuaugcuagaggggaauuggcuugcugcaguaguggucaccuagcaucaucgucacugucacccggagcacacgguggggaaagauagugggauuaccucgcagggagugcaaguacauggaggcguccccaguuggagaaagguggcuguggcugcagcugcacaggugguguugcccucccucccucuggcuacagcacacuugcucuugugcuuuugugagcccgccccucuucucuuucccuggagaguuuuccauaugcccaugucccuagcaaacuguucugcaagcaaaccuguaucuccagcugaaccucagggagcagauggaauaaaugcuucaguuuuuuuuucuuuaaagcaccaaagacuaauugucuuuaaauuguccuuugcuguuugccaaguccuguacacccccuggcaagugcauuaggugguugcagccacugacccagacuggugugugcacaccagagccacuggugugugcacaccagagccacugguguguaggagcggccuuagccucugccaggcauccuuacucccaaguuuaaagucauugugucuguaagaacugucuggugcuauugcuucacugaauacgugucaagcacucgggggaagauaaucagaacagggcaguacgugucugggucuugaaauggcucaggaaagguauggaggcagaagaggcgccacgcucuccauugaccaagaugaggaguggaggcagucagcuguguuggccugcgggagggagacuguugggggagcucacugcaccaaucucuagcugggcuggacaggguccauaguugagagugaaauucucagagcagaugcacagaaccaggagagaaggaacuggggacuggaguggaacccagagcguugugaggcccuuagggguuggagggaaggcagaaggccuacagaagagagcauuuccccagauuccaacaucagaagcuacagggaggucaaagagaugaggauuccgaccugaucauccuguugaccuuuaggagggcauuggugaccuuaggaagacgugacacagaaguagaaaccagauugcgacggugugaaugagaaggugaggaugugaagccaccauuucaagaagcuuggcuuugaagggaaacgcaucagugccagaauagcagaggggucagcuuguuacaagaaaacgcagugggaacugaagcagggagggcugagaaggugaagacaggagaaggaagggcugggggacuugagauugccgagaagcagcagcaucccaguugagguugagggaacagugcuggccagcgggacagacaaguaugggugauugguuaggccaugggguuugggaguucaaggucagucucugaagugcaggcuggagaguggccaggacguucuugguccaggcagagugugaaucuaccugucccuaugacuguugacgucgcccucauuagcucugacauaagaagaagggacugauccaugguggcccugaucugaugucuucagagaugggagagugaggagcugaggaaggagcuugcugagugagaguggucucagggcauuuggugggggcugagccaaaggggaugcuugaucaggagcaucaucaugcuaaaucuguauucuggggacuuccuucuucaggagauguuaauaaggccacccuaaaaaguauuccuugucuguuuucugaugccuucuaggucuucacccgcauuuugaucuccuaucauggccccaaaccguacuauccaggcuggcaguuccucuucccccaccguucucucugccuucaccccaauuccucuucacuauucuguuggccauugagacaugugacacacuguggccaauucaguggccuuuggccauagaauaaaauuuaaauuuccacugggauagaucuauucagacuugguucucuugggaaaggaggucagagcauagaaaguggcaccgauagucugcuuccagucuccccucuugaccacuugccuaaggugccugggugugcacuuguagcccucacccccagggcaguuccaugagcugugccaaaaccuuacauguaagcagguggcccuugacucuuucucguggaugucagaacaucucaaaaaccccacacccauacccugugcuggccuuuccaacgcuguccacuaccaucccgagcagggccucagugcuugcuguuaguauaccugcucucuucucccugcaacagccucuccaccugcagccugugccucuaccgugggacuccacuuggauuugguucugauacaccacuugaacuuaauuacaggagcaccuguccucagucagagugaugacucagaaaguuuggcuaucggugggucaggccaacagccugagcuggucuagucauuggggacuugcugucugggugcagcccccugccuggcccucugugauccucacaccuggaaacccaggcacugcuugaucuguccgcacauuccuucugugguuguuuuuaaaaaugaacuuaguuuuagaauagguuuagauuuagagaagaaguugugagaauaacgugguuugauuucgggcacuuuaagacguuuacaucuguuaucuggcuccuucuguuuggcacuuaguaagaucugaaaguuugaggguugggaugguggauuuuuuauuuuuauuuuuuuaaacuaaggauugugaaggcuguccagauuugucauuuggcaguuaaccuggucagucagcaguaucuggauacuaaagaauccuuagugguagacugugugcaaaugaaagaaacguuaaguccagugaauuugacuagggguggaaacuuaugcuccgcagcucuucauggugacaaggaggcaggagugccagggucaaggguuacaaguggacuccagcauuggcgccaggggaauuugcauuuuauggacauguaaaauuucaaaugggacaaguaggaccugccauggguugucuuacuaggugaggauugcuuuuuaaaaggcugccugguuucccccuuauuuauuaaaagugaaagaauauuuuaguauccauaaaaagaaaaaaugugcauuucaaugaaggcagccuauuucaagauagagugguuggaaacuuguacguuucccucugaauuacuccccagcauccaggaacccuuccccgcuccacuuuauuuugguguucccccucaagaucacuugcugaugccaguaggagcuguggcucccguggauuuaccuguggagcagccaggggugagguccccaggccagccuggccagcccagcguuugugcugccuggcugccuaggugacacuggacuuuugcucucugcucuccaggauuacuauaagaucauuaaaacgccuauggauaugggaacaauaaagaagcgcuuggaaaacaacuauuacuggaaugcucaggaauguauccaggacuucaacacuauguuuacaaauuguuacaucuacaacaaggugagauguagggguggguguccagcugcccuggggagagaggaggggaggcgacggcagugggcaugucaggagcccgugggcagggguguuggguguggcugggcuuggagucuggcaagaggagacccuuggagguagagguaaugagaccugugguuguuccugugacugggugugggcuuuuuugcugggaggagggugcuggccauguugaacuugcaagcuguccuuguuagccugaagcaugugcuucuggugcccuugggauuuugguuccugagcaugucuaguagagaaggugugaggagaauaguggcgacucaugacaaaguccauuugggugauguaaauuguuaggaaagagccugcuaaaauguaguugugcagaggugugcccaaacagagaccuccacgugagagagggugugauggggccggcgcagagcucaguugcucugugggugauggucugcuggaacuguggacaugacugucaauaacucuuggccauagaugaaguguccccccgauccuacauguagaccugaaggucacuuccuaaccccguagccaaaccuuucggcucggcugugccaugaagccagaucauuuguuuacaguucagaccacagaugugauuaaaaucaacccuuucaaauagaacgacucuggagggagacacuauacagaacucagcuuuugaccucugcugguguaguggguaaaaaugcccagaagagauggguaggugaguuucuugaaguuuacuguguuuuuuaaagucucagcucucaccacuuagguuugagcaaaaugugcagaccaggcucucaguuuagaacugagugggaacagcauguuauagaugaggugacagagugggaccccucaacuagugugagaugugcagugcccagaguccuggugagcugccauggggguacguuggggagcauugcuggggcccugcuaauguaucauggcaagaaauccugugucauucacguauuucuggugaaauugaauugugucaaaggagggccccuuucagugauuggcugagcuugguagaugcuuaaggcauuaggauggcuucucagauaggccagagcuuaaaagaugagggaggugcagguagacaaguguaggcucagcacaccugugggaacacaagccucugugauaccugguaguguagccauuguggcuccuuugggugcagaucggggaaggacccggaauacgacgcuucauguuuugggggcaggggguggguggcauggggugcccugucuacagagguggggaggggagggcccucugacucuaccccugugucuccuuauccagccuggagaugacauagucuuaauggcagaagcucuggaaaagcucuucuugcaaaaaauaaaugagcuacccacagaagaaaccgagaucaugauaguccaggcaaaaggaagaggacgugggaggaaagaaacagguagaguacugaaauagcaaguaaauuggcuuucuccccgaccuuugucccuuuuccaaguuugguggggggcugggaguggcaggaggaugugacauuauauacugcaugccguguugguguuuggacaugugagauuggguuugguguuggauccaucccauagggucauguggcccuguggccucuucuaagcagaaauaauugggcccugccuuuucugaggguaggugauggacuuaggguaaaaggaaaguguaacuucucaaagcacuuugacguuuguugaacacuucacccugccaguaucauaggugguuuuuacuuuuccauuuuaaggacauuaacaugaccagaaaucauuuuaacuaacaucucaguucuaaacuuugagguuugugauuggaauuaccuuaaugcacuggugucagaguuaucccugcuucugaugcucagucaucugaagugaaagcccuccucauccaucucugccugucaccacccccaacugacacaggguuccaggggccagcuggcagagcugcccacucuaggaaaugauucugucuaggaaacucuccagcagcuacuggcuacaucuuguccuuugcaacuccaugcugcagaagggugacauuugcgagguggucccugagugugaguuguuugcuucucugagcagcagccuuucaccuggccucccaugcuguucugaagugguggcagaaaggggguugcuacauccccugcugcacccaaagguaaccaaggagaacuagucucacgugucacccuguggcucuuguaccuaucagaucacauuccugauccucauguaagucacaucccuuauccuuacaugaggauauugguccucacucccugggaccagggguuugggcugcacgcugggcagacagacgugguggcaucuccuauuccagucugggagaagcccaggaguugugccugaggaaggagaauugggaaacucagcagaaucucacccuugcuccuugagaugcacagggaacaugggugcugcuugagcugauagaugaaggcacugggugucuuuguccauuuucauggcagccagcaugcacacgaaggauguggugacccagguuaugcuccuagacauucucacccugguccacccaguuuuguuagagcucuggccauaaccccucacuuuuugcagcugguugggugugccacgugaccauuguguguucggacugccugcacagcugcugggaggcagcgcucgagccagucaugaagggcagcaguccagcugcccccugugguuccaggaggugggggccugccaguuuccagaaaccuuggcaagggcggcuacugccggcucccugccagaagcucuuacucagaaggcagugcuucugggaacaagggcagcugugccuggaagcucugaggaguguuuucccgcucucuguccccugucagcaugugcuuccugcuccuugagccugggccuccaggcuucaugaaggggucuuugugccugaguugggaguugcagccaggacgcccuaggaaaugggaagugcgguuuucugcuguucuuugagccccagggacagguggaaggguuuggcagaguggagucugggauguucgucucucaggcaaaugcaacacgcgaaugugcguucacugugugugguguauguccccacgaggucagccagcauguggaugucagcauggucucuaacucgccgucuuauuaugauuuguagggacagcaaaaccuggcguuuccacgguaccaaacacaacucaagcaucgacuccuccgcagacccagaccccucagccgaauccuccuccugugcaggccacgccucaccccuucccugccgucaccccggaccucaucguccagaccccugucaugacaguggugccuccccagccacugcagacgcccccgccagugcccccccagccacaacccccacccgcuccagcuccccagcccguacagagccacccacccaucaucgcggccaccccacagccugugaaggugagucuccuggacucuggagggcugcuucaccagggaggagagcggcccuguccuugcccgugcuuuacacagagccuguccugggucccgggcacugguggguguuucuggggagaucuugcuguguugaaauugcagcccagaaacagccgccccacugacucaaaggucccauaauugugucacaccuccuaguggguuccugcccccugcaccucuuuuauuuagacugugcauauuugcagaugggccaucuaaauagucucugaauugugccuccccugggcacuuggggagaggcccugguguuagguacuaagcagccuccagaggucccuuggcuuccaagugagcacacaguuuuaugcuuucuccugccacaggcagguccugucccagcugcagagcagaguggugggacacgaucugccuguccuuggcccuuugccugugcaauuaucuuuggguccauucugugugagcgaugggccccaagacagggccuggcuuugggggugacccugagggcagcugugccggcugccacuucugacugugccuguuggcguccguguucuuggcagacaaagaagggagugaagaggaaagcagacaccaccacccccaccaccauugaccccauucacgagccacccucgcugcccccggagcccaagaccaccaagcugggccagcggcgggagagcagccggccugugaaaccuccaaagaaggacgugcccgacucucagcagcacccagcaccagagaagagcagcaaggucucggagcagcucaagugcugcagcggcauccucaaggagauguuugccaagaagcacgccgccuacgccuggcccuucuacaagccuguggacguggaggcacugggccuacacgacuacugugacaucaucaagcaccccauggacaugagcacaaucaagguuagcgggaugugccugagggaagggacaaggugggcaggcugucccuccacaucagaaccuuccuagaccuuuuaguccaagaggaagcccaggcccuggaacgguggcugcguggauuuuucccgccaacucgaagaaacucagcgcccccugcugucugcugugggacgugcucugagaccuggugcuuggccauuguggcuacagaugccugugcugccccuuccccuagucugaggaaaagcaagacaagcccucuggccuugggggcccagugccccagguaccuugcccacacaguagaugcuccaugggaguuggggcuuggcggccuugccagccucuuugugguggagaaggccuugcugucuccucuguguuggaggcacgcuguaagugccgacauuuucaccauaguguuuugaggcuuuuuuaguuuuaagacuuguuacguguuucuucuucugggaguggagucccaagcauggggcaggcagagcagggaacagugcugugucccuuugaccagcuccuguacugugucaucacgaugagcugggcccagcccucuccaucaguucuccccgucauuucuggcucaggcuccgccuccuguggguucugaguccaccugccugcgagccaggcaggugagcugggauguuggcagggccagucccagcccugaggcugagaacuggggugauggccuguccccccacuagagucuugaccaaacugagagccaagaaaccaacuugcucuucuaggcaucccuuucgucugcugccagccacuucuccauggucacaugggcagacacagcuaacagggacuugucuuguuuuccagucuaaacuggaggcccgugaguaccgugaugcucaggaguuuggugcugacguccgauugauguucuccaacugcuauaaguacaacccuccugaccaugaggugguggccauggcccgcaagcuccaggugaggcuugggagggcgcagccacccucagcagagcaggcugagguccucgugggagcagacuucugugggccuuggcagaguuuuuuuuucugucacuuuccuugggauaaugccauguugcuuuagaaaagugccuaaagucagccuagugcauacauuuuaaguugggguuauucaauuaaagcagaguggguguuccacugcaagcccccuccaccagcacucauuugcuuuuggcuggaagaccgggugugugcugugcauggcccagucucuucuacaaaacacaccugucucaaguggguuggggguggggggcacucuugccgagaagucgcugucacagucgugagcugaggacaucugcacuguggacaucccuccaccagagccguaagagccuucuagcugcagagugguuguuuccacauggccacaauucugauuggggguccugggucacuuccuucaaguugagagccuggguggugcacagugugaaguacacgugugggcggggaggggagguuacagcauagauguguaaacuuaauuuuuuuaaaaaaggaaaaauaccuaaguuuaaaaaaugacuuucuuugaauaauaagauuggguuaaaaauuuuggagaauaaagucaauauuuaguacuaucaucaucaucuuuucuauuuuuuuuguuuuaauuauuggagacagggucucguucugucacccaggcuggaguguaguggcacagucauagcucacggcagccucugccuuccagguucaagcgauccucccaccucagccucccgaguaucuaggacuacaggcuugcaccaccaugcccagcuaauuuugccucguuuauuuucuuuuuuuuuuucuuuuuuuuuuuuuuuuuuaaagagauggguuuugccauguugcacaggcuggucuggaaccccugggcuuaagugauccaccugccucggacucucagagugcugggauuagagacucaucuucuuuuuuaaauucuuuaagacuguagauaaaugaucauaaaaauucccagcaucuucuccccaaggccauggguugcuucuguucucagggucagagccaucaugaggugcugaugugcucauuguaggccucagcgggcuucugcacaccuggcugucgcagccaucugcuuccagggcagaagugaggacuuggaaagccuuuggugaccuguggaucggugccaggcagagccccacugccugccugccucccagcugcacuaguucucauguuguccuagacuccccagcauagcagcccguaccugcucccacuggaccuaaggcacugucucuccuauucucuguggaucaggggcugccuuggguucagaggacaugugcucaaacucuugagguaggauaaacacuucccuugugaaguuuguuggucucuuucuuacuaguguggauguggcucuuguuauuuaaaugcaugcucaggcuuggagcuuuuuauuucuacuuuuuuuuauuuauuuauuuuuggaaacggggugucauucugcuuacuguagccucaaccugcugugcucaauugagccucucagguaggacagcaagcgugugccaccaugccuggcuaauuuuuguauuuugguagagauggcaugucacuguauugcccaggcuggucucaaacuccugggcuuaggugauccaccugcuucagccucccauacuaccaggauuacaggcaugagccacggcaccuggccuguuucuuaguuuuauuuucugugacuuggggaauuguugcccucucuucacuuugguguugucugugugccuucuucacaaacaacauugccccuucaucauucauguuugcauuucccauccuugaaggaguucaggcuuuuuaauuucuuucuuucuuucuuucuuuuuuuuuugagauggagucucuuucugucgcccaggcuggagugcaguggcacgaccucagcucacugcaaccuccgccuccugguucaagcaguucuccugccucagccuccugaguagcugggauuacaggcgcacgccaccacgcccagcuaauuuuuguuuuuuaguagagaggggguuuugccgauuggucaggcuggucuugaacuucugaccucaugaucugccugccugggccucccaaagugcuggaauuacaggcgugagccaccgugcccggccagacuuuuuaauuucaaugcaguuuuuguucagggccacccgguggcaguggcgcccucagauuggugccuucaacuccuccaccgcucccucucucccacucucuugagaagacaggggcgcagcuuuugcccacacugcucacauugauacccaugcccuucaucuacucucauaggaagaacucagcagaaacaaauucucuuccagcaccaaaggugacuguuuugagcuacuuuacuaagagaaagaaaagaaaaagcacccucugauguguucuagcccuuccuuccucauuuuugucucauuuuuucuguccucuccugacacccuggagccaccuccuuuucgcagauuuucuccaacaaagauuuuuggguuuuaagugguuuuuuuuuuuuuuuuugcauuuuucuccuucugagaggggaguaagccugccugaauguagaguuuaccaaggccacuggaugucugucacaccacagacacugcagcaguagaguuucuuccuacacacgggcuccaggugccggacuggaguggacacaggccucaaucucaagggggccuagugcaggcaagggguggggggugcuguaggugggcugccucuggcccagccuguuucgccugcccuugggagggacaccucucugccagugcuugguagagguguuucuguuugagcaacagaguugaugguggaggguuccagagcaggcuucucuucagugggcaguuguguuuguggcauuucaggcuuuguuuuucuuacuucucucuacuuucucugcaucagcagguagagagcaaauucuccaucagggaaggggagggacaaagcuuccagcccuugcucacuucuucaggagcuauugggaccugcuuaauugggucucuuaauuuggcugggcccaagaagugggauuaucuggaaaguuacuuggaaaaggagccacuuuauuuuucucucugagccucuaaauucucgggucauugagaaaaccuguguuccacagccugacagcugagauacuugucugaaaccagugaggugugcugaaacugagaagcaugaccucagacccagaccuccagaggagugagguguaggucugugggaugccgggcagggggcugggccucagcugggucucaagagacugucagcccaacagaaugccugcacucgguguucccuggcgggugcuggugccugcuaccccucaccaucaccauccucccuugugagaggcuugccucggugcaucuugaauugggcuuuacuguccucuugcuggccccauagcaccccugacuguguucuuuucacucuuaggucucagcacacuuccaguucauggcaaccccuugcugcccauguguucauucaccuuucuguuuccagcuagacugagcuccuugaacagggagcucgucauuccugucuaccaucaagcugguacuuggagacuugugacuguugaagccacacagcaagguuuuccuacagcagcccugggcccacuggcuuguggguuucccaggaugccccccacucaggcuacaacaagaguucucacauccaagagacagggaaggaugacagggucacacaacuggacacgccaggaagcuggcaguucccagucccaccaauguuaguuucucaucuuagcugacuuugugucuuguauuuuuugcucuuuguuguuggggccuuuggagagccagggccaugagcacccagggaauggaaggaggccucagagugaaugccacacacccccaccccagcauuuacccaacagucaucaccugguggggaggaacaaggacauccucaagucuugaagcuggcccaggcuuacagaccaguucgcugagguagcuaccacucaguagagggcacucccuuuguccugggaggcauagcugauuaucucccuucaugauguccuggcacuucugaggcccacuucucuaaccugcuuccugcugcuuggcagcaggccuggcucuuccagaagcucauguggccccagcugccucuuggagucauuuugggaccugagcccacccacauccagggcacuacccaccugccacguagccgggugcugcagggcuagggaucugucuuacucucucacuggggccuccacucugaugugaagccccccaccuuuuccucccugggccccacuccugggaggcuaacuggugauggccucuggucgucccuuguuguguaucuucuuccuugucucagaccugcucaaggaguuauuucugaauaaagguauuugcugggugcaguggcucaugccuguaauccuggcacuuuucauuguagaccaccuugugggaggaucccuugaucccaggaguuggagaccagccugggcaacaugucaaaacccugucugcacaaaaauuuagcugggcaugguggucucaguucucaaggaggcugaggcaggaggaucucuugagccuaggaggaugaggcuguagugagccaugauugagccauugauugcauuccacccugggcaacagagcaaggcccuaucuccaaaaagaagaagaagaagaaagaaagaaaaaaguuauugggccaggcgcaguggcucacgcuggucaucccaacccuuugggaggcuguggcaaguggaucuguugaggucaggaguuuaagaccagccuggccaacaugguagaacgcugccucugcuaaaaauacaaaaauuaguugggcaugguggugugcaccuguaauuccagcuacuugggagacagagguuacagugagcugagauugcgccacugcacuccagccugggugaagacugucuccaaaaaaaaaguuauuggcuaaaagaagucauacuccggguguccuggaggggagggaaucaacaccacaguuauaugggaugccugcuccagcagcgugggagaggaagccucaaggaguguuuccugagccaucaggaggggauuccagggccgugguccucucugaagcacugacacacauuugggggaaggucuuugccaugguguguuuccacgaugaucaguuuauuccugguuugaagcgggucccagaauccugcugggaagccaggccugugcuucugccucugucuugagccaucacuggauugagcacagcgcccccgggguagggcagggacuugacagcuggcuggcaguauguguggccagaccccaguguccaugcauggcugcuguucccugagcuccaugaccccacgugguuccaucugauugcuggaucuuaggguugaaaggucuuagggucuccugcgcacaguggcucccuccuguagccuguccucagugccccacaccugcugccuaaaccucucuuaccuuguccugugugugcuggagaugccuccuccaguggugcagcccugcuugguuaagugcugcaggggcuaucugaggaaugaggagaccgacuuagaaccgugucugcuacagcagagccuaguccccuagaggaggugcgcuuguggcagguacauucccaccggggaccucugcgugugcuguguccucugccuggaaugcccucucaaaccacagacaacuccugcucccccgcacgcaucuggugggagccucggcuaacuguuuugggguuugaggaugcccuugguccaguaccaucucagacuucagugagcuggcugucuuaguggccugggucucauguccuugccugggcgguguccuccagggagugagugccccgcuaucucuggaccaccuuguucuucaaagugagauuugagagaagaguguugcaagaguugucagaggcccuuggcuggcccuugccccugucucggcagcaaagagacaggaucaccauccucuuucgcccucgguugcuuucuguugaguuggccccagcagccaaugagggcaggugaugcuaggccgcggccuggguacccagcagccgucacagcaugucuuucccucaccaggauguguucgaaaugcgcuuugccaagaugccggacgagccugaggagccagugguggccguguccuccccggcagugcccccucccaccaagguuguggccccgcccucauccagcgacagcagcagcgauagcuccucggacagugacaguucgacugaugacucugaggaggagcgagcccagcggcuggcugagcuccaggagcaggugagggcauugguggcuccauucuuaauccccagaguccguggaccaggguggccuccccagaaguuucuaagagauguucuugguucugaguucccaagggagcauaauucccacuggaccaccuguggccuuuuccccuuugcuaggucaaaugcauguugaucauacacguauguaugauauauguguugagcuugcgguuggggauggggagggacauggccauuuucugggcagagaggagguggcuugauccuuucaguaucuggaaggaggagguugagccaggauguucgucucuccuggggcuaccuguuugcuccucucccuauagccagucaucaggcccuucgugccugacguguccgugugcucuuacuuagauucuuaggggcccuccuucugcgaucaggauggccgugagacuuggugucugucggcuugaucagcuccucuggugaggaagacacuggcagucuuuggaguugagugaauggguggagauagucuuguuaggaaucugguuaacaugacaggcgcaaagcugggggccuucccuuccccugccuccccuaugcccacacccugaugccccaggugcaugcugucgcauguuuuuuggagcagacgccugggucuugggugacaggaaggugguuucagcccugagugugugucuugccugucuggucuacagcucaaagccgugcacgagcagcuugcagcccucucucagccccagcagaacaaaccaaagaaaaaggagaaagacaagaaggaaaagaaaaaagaaaagcacaaaaggaaagaggaaguggaagagaauaaaaaaagcaaagccaaggaaccuccuccuaaaaagacgaagaaaaauaauagcagcaacagcaaugugaggucuguguccccugaauuuguccuggguggggacccuccuuccagggcuugcucugagacugugugggccacugccccucccuguccucauugggugcggaggcugccccucugcagccguggcuucacaggccaggcugguggccacuugcacacaggacuuagcugcacugucucugccucuuucuguaggaugagccuucggagcucaccauguuugguuggggaggauaggcggcaaggauggggcuguagugcaucccccacuugggcagccuccagucacaguuugcuucggucuccacugggugcucccagagauugaguugcccaugccccguuuccugugaaggcuggugggugggggguaugggaagggcaccccuuccccccaacauacauguggaggaaugagugccuggcuuccucagggggcccguucuugauggugucugcaucgucccuucguagcaagaaggagccagcgcccaugaagagcaagcccccucccacguaugagucggaggaagaggacaagugcaagccuauguccuaugaggagaagcggcagcucagcuuggacaucaacaagcuccccggcgagaagcugggccgcguggugcacaucauccagucacgggagcccucccugaagaauuccaaccccgacgagauugaaaucgacuuugagacccugaagccguccacacugcgugagcuggagcgcuaugucaccuccuguuugcggaagaaaaggaaaccucaaggugugcuugggcccccugggcaugggguuccuucugugggcacccucagaguaacuuuucccuccuugcucaguccacucuuucugcgcccccccccuuuuuuuuuuccaauuauaauaucuguguucuugacacagaaaccuccgaaagguugugacauugcacucaccccuaggcugucagugccuuucuacauaucugacugguggugucuggggccucucugcaccuuguugccugcagcuguguucuaagccggagcugcuuucaacccaggcuaccugcugcugagucuuccuccggccucuuuggggaaggaggaaaggcgggucugcagggucccaggaccuguguaccgauacguuaugcagcacugagccagccucugucccucucuagcagggacaguucgguguggcauccuuucuggacucuuccaggcagcucuuuugugucacacagcucauccuggccuacggcuuuccucugaggaucggugucagggcauugcacacagucuuuguccccagcccugacuagcuccugggguccuugggccccuaccuggggcacaccacaugaugauuccagcgugcgucugaacagcugugcugagagacccccgggggucucucccugccuugcguuaccuuuuggcagcauguuccuuuuggaucuucuucuuccccugcuagaagaguaacugggagaauccaagccuuaugcccagcgguaccuuguguuaggaaauuauccuucugccuggucucuugaauccuugauaaaccccccaaaggagacuuuuugagagauugaaggaaccuugaaauuccauuguaagcagucuacccaugggaacugugggaccacguggguucugggaguggcagcuggcaguugggagcagccccugggcccaccgugcacaggcuccucacugguccuuccuccagauggauggggugugcccauggcuuagagcggcuuccugggccacagcccugccugaccagcucccauugcuuggauugcagcugagaaaguugaugugauugccggcuccuccaagaugaagggcuucucguccucagagucggagagcuccagugaguccagcuccucugacagcgaagacuccgaaacagguuaggugacuuguguucuacgugucuuaccaaacucuucccaccugugccuggcacuagcucgguccuguguccaggaugcuagagcccagagacggcacucccagaacuugcuggguuccucugucugucugucucuuuguuaacugucucccuggggccaugaauagcccugcacucugugcaguaguguccauucucucggccuggccguuaugcucucccugccagggucuggucauggaggaugaauggccaagggcguugacacugcggagcccuggauggugggcggggaagcugggccaugaggacugugggcguggggguccaggcugugcuguugaccuugaugugaccacacccagcuuucugcaccaguggagacuucguguccccagggccuuccccguaucacagucacgugcagugcggccgcuucagggagaugcuucgcugguuucugguggauguggagcagacugcagcuggccagccgcaucgccagucugcugcuggcccugccaucaccugggccccagccauugccuaccccuccccagagugugcucguugcuguguuggcugcuccugaaucugcccuaacuccacacgcaccuggacuugcgugucccuccugcaguucuaacuaacagucccuucuuuucaagccccgugggucugcacguuggacccuggguuccccauuagagcccaccuucugagcagcagccucagugggagguggaggcagguagugaugcugggugccaggugggaguggagaggggacugcucuccuccaagugugcacuuuccucauuauucucaggggcgcagaugcucaggcuggcgcaggggagaggcuagggagggagccauggugcccagaaggccuggcgaccagccccugcugagagauggagcuaacauccuguguuuacggccaacgggguugccgcuaggcuggugcagcugucagugagcuggcgugcugcagaccaccugagagcuggcccuagggucucaggcagacuggggaguggggauccacagugggaaaccuguguuuuggcaguagacuccugcauguucucccacgggccugucccaucccugggauuuuauucuaacuagaaauaaaugcuaacccucaauaaucagugcauguaaauaacuugaucgugccaaggaagauugaggacccuucacggcagcuggggagagccauguugcucugaggugugugugcacagaugggguggggguagguggcaccucgggccuugucaguauuccucuucccuuggacagccuggugcccucugcuucccaggugagugaggagacuugccuugaagugggcugaaggacccuccaggacuccagaugcccacauucucuaccacaacugcaugcagaaugccgugggcagcucacuggccuccuggccuucccugucgccauccuucacccuuucaucucuaaccguuacucuccccacacugcuuuuguaauccaucagccagcaggaggcacugcaccccauggcugcccaggaagggcuggcuuugccacccgaagcuagggcccccacucgcagcagagugacuggggugaauggcuguauucuuggauccaauuagcauuccugguggccgcugacuuuucacuuuccaugccagccaagccuccagcuugccuuccucuggguuuuugcaccuccuguuuucuaguugacuucuccuaccagggguuuuguagucuucucaucugaggaucugagugaccaaguggaaaccccagaugcugaaauugucaggggaccugauuaacuaaaaugacaugacguggucguggcagugugcugcuuuagcccucacaagacaagacaccuuagagggcuguggccaucacauccugauuuccagugugugaucauggccuuugcccuuggccucugcgucccucuucugggcuccucugcuuugggagaggagugggaaugcuccugguuuccugaacgagugccccacaccccuccugccgcugccgagauuuuauuauuuuuucacucccccacuuuaaaaaaaaguggaaagauugugcaacaaguaaucugagaguccugggaacagcuguccuggcgggaaggagggcgagauuuacagucucagagccgcuggcucccaggcucccaggcucuggcgguccagcccuggccgcucaugcagcuaucugggcucuggccuuccccucuucccaggcgcccuccccaccuuggguuuugccuggcucccuuuugucuucccaauccuggccagcaggggcuuuccuuugccuucugugugcacugagugagcucugucgugggccggcagggugcuucuccucucaggaggggccgcugcgaggguuucguacggcagaucccgaaaugggaacccacacccuggcaccaguaaauacagccuucugcugcccugucccgcacaggacucugcacucucagggcggggggcagagggggcguagcuccuucagcagcugcucuccuggguccaggaaucccggcagcccugauguccauggcccguuacaggcagcucugccuuaacgggagugggucagggugggggaacauuauuucccuuuggucuuuuggugccuaguugauuugcaggcccgcgcccccgcccccccccccccccccguucuuguguuuccauuuggauuggagccgaaauuccugaaagggccuauuuuugucacuuauacuacgggguuaguuccgcugacaacggcccugagacaugaaucaccagaagaaaacgaauggagucacuagauugaggcuggggggugugauacaugaacaccccucuugguagcuauccauagaccgggaugcuguggacugaugcaggcguggggugguccucuggggccaggcucuaguucagggagcaacggaacacaggcaggaggaggauggcgggggugggugcugcuuucccagcugugucccaggccaccauguauuccccacccucugccccagcagcaugcagugcagugggccagcccuaccacuuccucugauuccagcuauugcuugggcuguggucuuccauugagcugugauuccagcuaaagccuggagcugcuugaggauucuguauugagacaggcagggguagggcacaaaugccacucucccaccaccccuagggcaucugcagaccuggguggagcaggcuggaggaagacacugucccaggugggcuguggacaguacuguggcuuugcugucauuagcacugggguuaggucugccaagcacauggggcagggcauguccuaggaaucuucuagcuuucacuugucacauagcugacaucugguucuucccaagugucaugcacaggucuuugugagcagaaguguccccacagcuuaugucccucuuaggaauacccguuuaaccucagcuaccugggcugggacagggucucagggaggugugagagauccuccugggcuuuggucuggucgucuaguuggaacgggagcgcaguccagcuauuuuaguuuccuggcuuccuuuucccaggauuggagcauguggguguuucuuaauagcuccaggggaaaaaggaaugcuugauguuuuggaaagauuugagcugggaagugcagacagaggccauggggcguucuuaccacacaaccagccucagcuuccugacccccagggucuuugagggacuuaguccaucuccaggccugcugcuugccugcuccagaguguggcgcuuaccuaggggaauggugaggacccuggaggugggggaguaggaagagacuugaagauagggcaguagccuuucugucugcacagccaggugacuccccccacaaacagccagcauuugcagcuggagggauucuggggcuucaugggcgggugagggcgagccuuguggaauguggcccagagugagaggccgccagugggcggguuuuucccaugcccgcacucaggggccagggaguagcacgucgguugcauccgugacuccagcagaggcauccgcucugcuacgugggugggaacaagcccagugccccucccugguccagggagccauguuggauaccccaaaaaaggaaagaaaggacaagacuuuauuccuuagccuguuucuuuuucuuuuuuuucuccuccucaacaguguauauaauagguucugcuuuuuagaguuugagcuuuuuguuugggggaucuggaggaaugcagagaugaggcuguuugcucuuuccccuccacuggggguccugcauucugguaccuccuuucuuguagacccaggaggaagggcuggcaucgccuuccugagacuagacagugcacagccccugggugagaugagcucagagucagcaggggccuggugggcuugccacaccuggcuggugggacagggcaggggcaucacucaaauucaaaagaagccacuugagggcaguaaaggaaaugccggcgugcgcucaggcagggcacacguggagcuugcuagugggaaccagggccacucucuagaagcugagcaggcugggggcgguuuccaaggcauccaugcauucugccucugugaccuuucuaagcgggcggugggucugucccuacccaggguuagccaggcacggggcagggcuccagucuccagugccguucuugugcccaucagccaccagggcgcaggagguuggcucagucugcgguucuucuguucuugugacuuaaaugguacauuccacaccauuucucucacacugguuucucucucccucuacguagguccugccuaaucauuggacacggacucuuaauaaaacggucuucaguuccagauuccuucccagcaagcuauagcuuaaguccauuuucuuccgugaaagggacaggacuccaucaaguuauggaauuccucagagcccugggccugucccccgggguggauuagucauguccagcagcacacgccuagucccgccuucgggaaggcugccugccuggccagccgcccaggccucucuguguaaagacugccuggcuguccugcccagccuuccugguucucugggguccucuggguggguggcaucuccuggagggugaugacaauccccaacacaugcauucauguggugcuacucugugugcaaagccagaccccaaguauguuuucucucuuugucccaucccucuuuuucugggacuuuggacccuaacuacuucccuccugaaccuugcagugacaucaguccaggagagcucucguucagugugcggaagaacacucugaccucuagagcuguccuagauaaggagugggagcuuuagaggcaaggccucuagacccuggaaggcucagugaggcucuucccacagcaugcuucucacuggugcccuguaaggcucgagccaccgcugacucugagccuuuuggagucuuuccuccuucgucuccauuguucccgugcauuuccaaaagcuuaaguugccuggugggcauuuccccaguuucuuuggccuccgucuucucaagucacauagggaaaguaccuccuggaaccaggcugcaguaugcaggaccugccaggcaggcacuggugaagggccuugggccuaucauccccccaaccccaccucaccccacccgccuccucuaguggggugagucugggcugguggaccagagagggugucacagacccucagggacugccccauggacaccucugacugguguuaacagugugaacauuuuccccgucuucagucccuuagaaugacgacagccccugggguuggggcaggcgaguguggccacaucauccaagcccucccagagacacaaauaggcuuuuuugcucuaaaaauaaauaccagcccuuuuuuggucacaaauccagcaucucagcagaaaacugccugacaugaaaaguccccugaggaacugcaucugcguuucaggggcuuuucauuuuuucuccuuuuuuaaaguguagauugugggugcuuccuagaggccugccuucuucuggaacuggaagugggcuaucaccaugggcaagcccuugggugcaggcuccccaccugccugggaacucuggcagcucuccucagcuccuugggcuugagcagcugcaacugccccagauuugcuguggaagcaggggcuagcccuggccucaccagggccucccggggcccugcauugaugcucaggaguuccugggcugcucuugauccuuucugggcauccagcuuccaguuaagcucuguuugccaaacaaacuauucucagcugcccuuuggccugcgccugauguguuccuguugcagucccgccugccugagacaggagcaggcaggagagccuucaugcccagauucccacaggacaauuggggagcugcuggcauugucuuucugggaagauucugcuuucuuggaccaaauggcagccugauuaccagugucgggccugcaugcugcccccgacacacgcacgcacgcgcacacacgugugcacaugggccauagccacaagccagcucuccuccaggguccuuucaaccucgcuguccagggacccuguccuucuugcccguggggcuuccaucuggcagagaacguucagggcuuguugaacuugaaagcucauuagacuuaagcugucaccugugcuuggugccccaggaacagccagagaggacagugcccacucacuucuuguuggcagccuccugugcaggaagugccagccgggccucgacgcaccagcuggcuguggguccugaggaggggcgggaggcggccgcucagugcagauggggacuccucuccucugcccugaccuuacccuccauuaccuccuucacuggaguggggcugggggguggguggaaucaguguuuuaaucggauuuuuaaaaaacauuuuauuucuuuguacaauuaccauccuauguaaagaugaaauuuguguugaguugaagauugucauggaauaaagaucacaccguacuugaggccaucuucauguaacccuuucuagagaguuuugugugggggugucuuggggcugguguguugugaagcugugcacuuccugucuugucuuuuacugguaacucugacacaaggcucagaccacaugggccagaaggggguaccucuaccaccagccccuuuaggcaucugguccugggggucugccgugcacaugccgccuucucucccccacuuuuuaggccugccuugccugggggccccagcacuugcaaggggcccuggagacaaguccucaggauauucccuguggccuuuccaaggcagcugagacaugcccccuggaaccccccacaggcccugcugcgcuuugucccuacaucuucuccuaugggccucugcucacagccugcaggcugugagggguuagagugaccaucccucuuuuacaaccaaaaaaacaagguuucuuccaaggccacgagacaacaggcgagccccagcauauccuucccuugcacacacacuuuuucccucaacucuauaucuggacacaucccugaggcuucuccuagucggacuucacacgguggcccugcugcuucccccuaccuuccgccuucugccccggguccccuccaaggugugcccagcaugcccccagacagcgcggcuccaucaccuccuugugccaggagagaagcccuggccuuuucuucccaguucccuagugugcagggucccccugguccuguggcugccaaccucugcagccagcgcuccuccccccaccaccacagcagucagacucccuguugcccugacacugcaaaucuacucaagcuuucccuucuggcaugucucacccacaacaguaucucucucaucagaugucauacucugacccagagcguccugagcccuguaugcagguuuuaggcggggccccagguucccccguguccccaguugcagccccuggucauuuguacgaggacgugugucuguagcugcugaggucugugucugugucuugucuggcguggaguggugagcucuuacagggcacaagguccuuccccaucccuuuugguggcaugcugcacugagggccacgugccucacagaagcuuagcguggcccuccacgaagcagauccaaguggaaggagccuggauuugggcaaagcauguguccuccaacaccagcagcaagaggcagcacccugacaaggagcucaggcgaagccaggcagugccaugaggugcuucucagugacaggaauccaaaaggcgccauaccaugggcccggccucccaucugguggcaggcgacugugaccugccagcccaugagcacuggccagggcucaugucccccuguggggcuuguacaccauccauguuuggugaggggacauccaacuggcaaaagucccuuaguguaaaucucuggggugaggacagaggugggcacgcuggcucucgaguacaccucucaggggcagacacacccuggacccauccacccuacuguggugccaagccgucggcccacacgagugggggcguaugcugccuucugucugcagcauggugacugugucccaaagcagggacuucugagguccaucuaccucuuuaguagcuggucauucccaggaggccagccugcuccuuuuuuuucucccggagugggcucucuguguuuucccuugccgauauguuccucaccguccuguggcucucagccccagcugagccucucugcuucccuuuggaggauggaaaggagugggccuuagagggccaugcaguuggaggcccccgagaagcugcuuuuuagccaugugacccuggacaaguccccucccuucugaagccccacuuuucucagcuguaagaugaaugugaccauugcaaccaucacagguuguuggaaaacugagcagguugcuguccaggccaugcacucagucacuauagugagugacugacccuugaguagugggaggcguugggcaagcucucagcuuccggugcaaccguggugaucugaagcuuggcaggggaggcuuuuucaggcacagucccugcuaggaaaagcagcaggcaaguggguaggugaugccucgcaugucucucccucucccgugaugaccaacucaucccucauugaacucggcugcccuuucucagggucacugguccuucuccugaaagugcccuguuuucucgucuuucuucauccaaggccagcucacucaccuucucccccagagccucacuaccuucucuuuuccucugcagagauggcuccgaagucaaaaaagaaggggcaccccgggagggagcagaagaagguacaugggcucaggggcauccuucauuaggugggacguugggucuggcccgggccaguucugccugccugacaucagccugucugucugucugucucucugucugcagcaccaucaucaccaccaucagcagaugcagcaggccccggcuccugugccccagcagccgcccccgccuccccagcagcccccaccgccuccaccuccgcagcagcaacagcagccgccacccccgccucccccacccuccaugccgcagcaggcagccccggcgaugaaguccucgcccccacccuucauugccacccaggugcccguccuggagccccagcucccaggcagcgucuuugaccccaucggccacuucacccagcccauccugcaccugccgcagccugagcugcccccucaccugccccagccgccugagcacagcacuccaccccaucucaaccagcacgcaguggucucuccuccaggugagccguggccugccccaguguggguugagaccccuuccugccucgguuuacccaugugguguccgagcacucuggcugggcagcuucuuagccucagcugcucuggucucuagagggaagaucuguggcuucucgaggccaucuuggaaguuaaaggagaugccucaagacaggucaugcauggaguuauuaacacguugauucagaagauuuuuguuucuaaaacacugacaucauuugaguaacaaucuagaugauuuugacuuauuucugcugcugggccaggcgucauguuagaugggaaaagcugggaccccucugcagcuuuucucaucagggguugggggaugcacucaugagaugggauuccucccauggaaccuggacagcacucaccugggggauauggggacagggccaccuuccugggggccuggggaauggccgggcaagugagagaccgaguucugcacugaggcgugaagggccauugugagcauggggagcaggagcuggggacacagagcauagggcaggaugacaccgcccuaaagcucucucuggaagcuguuuacugcucuggaguuugugggaggccacgguagguggggagggagugccaguuugagggaggccaguaggagagcacuggaguccagaugaggucaggauggagcagaaaggccaggcuggggccacaggugcucaggccucaccgccucgguguuguguucuuccagcuuugcacaacgcacuaccccagcagccaucacggcccagcaaccgagccgcugcccugccucccaagcccgcccggcccccagccgugucaccagccuugacccaaacaccccugcucccacagccccccauggcccaacccccccaagugcugcuggaggaugaagagccaccugccccaccccucaccuccaugcagaugcagcuguaccugcagcagcugcagaaggugcagcccccuacgccgcuacucccuuccgugaaggugcagucccagcccccacccccccugccgcccccaccccaccccucugugcagcagcagcugcagcagcagccgccaccacccccaccaccccagccccagccuccaccccagcagcagcaucagcccccuccacggcccgugcacuugcagcccaugcaguuuuccacccacauccaacagcccccgccaccccagggccagcagcccccccauccgcccccaggccagcagccacccccgccgcagccugccaagccucagcaagucauccagcaccaccauucaccccggcaccacaagucggaccccuacucaaccgguaagugguccucacccguagacucuggggaggcuggugcugggccuauaguuuuguccucaggaagccagaaggguuaacucaugcuucaggcugcaguggguucagagcugagccucagcuuggagggggaccuggaagggucauuggugcuuccuacaguguguguuuaucaggugucucucuugcuugugaggugagaucacucagaauaaggccccucuggucccucucuugagucaggagcacgacaaugcuaggugacuucuugcuagguggggaagcuaggagcccaggggagguaccugaugcaccucagggggucaggauaugcuuccaagaggcagugaucgcagacagguagcagcuaacuuagcagagugaagaaugaaguucagggagagccagaaccaugguguggggagcacugagcuggaagcucaaaaggcagcucagagcccgcccaggaccuguccucaucgccuguuaccagccuccagcccaguccacgccacccuuuucccauugacagcauuggucaggccacacccuuucacuuuuccugggcgcuuaagugucaguaaccagaauguccuggcuggcuccggcaggggauguucuggucagugccuccugauguggugcugcaggguuaggguggaggguccuggccucagcaguguagauggugcugccugucuuggguguguaccgggugcugccugcaaaucaagcaacgaggcagggcugugauuacuccuaacccagcaaaagcugcuggaugcaggccgggcgcgguggcucacgccuguaaucccagcacuuugggaggccaaggcagguggaucaccugaugucaggaguuucaagaccagccugaccaagauggugaaacccuaucuguacuaaaaauacaaaaauuauccaggcaugguggcaggcaccuguaaucccagccacuugggaggcugaggcgggagaaucgcuugagucugggaggcggagguugcagugagcugagaucgugccacugcacuccagucugggcaacagauggagacucuaucucaaaaaaaaaaaaaaaaaaaaaaaaagucaggugccaaguggaucucugcaugcccugagccaagaacaagcugccuguccucccugggaaauacugguguugggccuggcagcugugcggcugugccuguucucaugcgaagcagggcuggacuccuguugggggugauagacaggggaugcaaggcauuuagaagagccagcacucgggugcaccaggcaccuaucggggcugaggcaggucuucuccagccagcucuacuucaggucccuggccgugacccaagccccagcaggcuaggauggggcaucaagagcaguguggauugggauccugcuaggggcuuuguaggccaaaagccaaguuguuagacucccaaagagacuuaacaggcaucccugggcccccagccagcuuucaggagucauccgugagccauccucugaacccaccagcaggcaggugguuucuauaaaccacagccccuggagccuaccguugcccaggucagccucagcaggugcugaaggcacugcccuaguugggugggaggcuguugcagucaugugccuguggaucccuggcaggccagaccuggggcccuccagcacugaauggaauuggcagugcccaaaguggucccgaugugcuagaauuggaggagaugucaacgccaggaaaaccagccacacacagcagugggcugcggggacaggaugggccuggccaccaugugggcuccaagcagcugcagugucuucuggcguuaggaguggguccuggcucuagagaggaucuaccacaccuggggcauugugguuugcuccaggccuaugaaaauagaugccuccagccagcagggcuccuggagaacccaagggugccugugcugacagacaguggaaggagaugggcaugaggcuaggcugggagcaaaagcguugcagaggggcagccuccucuguggacaguguggcuugucccgagcugcagcuagccaaagagcggugaggccccuugccugcagggauuccagcagagagaggccacauguuggauggguaggacucagcugcuccagcugcacagucccgaggugcuggcucacugugauugagggcccaguagucccuguggcugcuggauccuucccagccuuggguuggaugcaggugucaggcuggccuguuuccuaagagacagcuccaggcccuuuuccgccugcuccccacucggcgcagguggaggccaauuccaggcuucucucuuccgugggggcgugcaggcugaguggggaauaggacuguggggaggguccugagcauccccacccccaggacugggucuugcacccccugcaaucauccaggugggccaggcuaguuggcaggaacccaggcugagcuuuguggguuuaaaaaguauuagggcccaggcccugccaagcccacaugugucaggaucuguguuuuccacaguaucccagaugauucugaugcacacaggagggucaaacaccaggacuggugccacagggcccuagaaagcucugcugcacacugaguuaugccccacaugcagggggacacagggcacucagcccuuucggggaggggucauguccucaccaggcccagucacuugugugggucuucacccuuuuugagcugggcuaauggacccuugucccagggccugggcggcacaugcaguuucuccauacagcccacguuuuccuucccgacaauucucucagggccagcaguucuaagccagccccuugacacauuccuugucccuucuccuaggucaccuccgcgaagcccccuccccgcuuaugauacauuccccccagaugucacaguuccagagccugacccaccagucuccaccccagcaaaacguccagccuaagaaacagguaacuggcagggcugggccauaguccugugggcuagggccgggggugccugcccaccucaccggccgcugugccugugccaucccaggagcugcgugcugccuccgugguccagccccagccccucgugguggugaaggaggagaagauccacucacccaucauccgcagcgagcccuucagccccucgcugcggccggagccccccaagcacccggagagcaucaaggcccccguccaccugccccagcgugagugcucucccugcccacagccagggcucaggccccccgaggcccguguuggacauaagcuugcuguggggcugguggaccaugccccacuggggugaggugggccagggcccaccggcuguuuauguuccagggccggaaaugaagccuguggaugucgggaggccugugauccggcccccagagcagaacgcaccgccaccaggggccccugacaaggacaaacagaaacaggagccgaagacuccaguugcgcccaaaaagguugggauggagguccaugggugucgcuugccccuuggcccuggaaggugccaugcugggcacacccccagcuaugcccuuuaggcacagcagaccccucacccaccccaaccucucuguucugcaggaccugaaaaucaagaacaugggcuccugggccagccuagugcagaagcauccgaccacccccuccuccacagccaagucauccagcgacagcuucgagcaguuccgccgcgccgcucgggagaaagaggagcgugagaaggcccugaaggcucaggccgagcacgcugagaaggagaaggagcggcugcggcaggagcgcaugaggugggcgggugucuggguggggcauggggacucuuggggccacaccaguccccaggcugacugggacccucugcccaggagccgagaggacgaggaugcgcuggagcaggcccggcgggcccaugaggaggcacgucggcgccaggagcagcagcagcagcagcgccaggagcaacagcagcagcagcaacagcaagcagcugcgguggcugccgccgccaccccacaggcccagagcucccagccccaguccaugcuggaccagcagagggaguuggcccggaagcgggagcaggagcgaagacgccgggaagccgugagucuggaggccugguggggacccuggucuaaggauuagcuccugagggagcugggaaagggggacuggagccuggacagggaggggcagcgggggagccccgucccugcuggucggcaugugguccucuggacucagcuguagggcccugagugcuguguggacggggugagcgcuaugaggggucagccacggggagggcuacggggcugacugcugguagcggguaugagggcuuguagcugcaggguggcuaggucauccuccugacucccuccuuccuuucuccuccagauggcagcuaccauugacaugaauuuccagagugaucuauugucaauauuugaagaaaaucuuuucugagcgcaccuagguggcuucugacuuugauuuucuggcaaaacauugacuuuccauaguguuaggggcggugguggaggugggaucagcggccaggggaugccucagggccuggcccuccugcaugcuaugcccggggcaggccugacgggcagcugaggauugcagagccugucugccuuacggccagucggacagacgucccgccacccaccaccccucacaggacguccgcucagcacacgccuuguuacgagcaagugccggcuggacccaagcccugcauccccacaugcggggcagaggcccuucucuccgccaaaugucuacacaguauacacaggacaucguugcugccgccgugacugguuuucuguccccaagaacgugacguucgugauguccugcccgccgggagucuuuccccacaccccagccaucgccgcccgcucccaggaggccagggcaggccugcgugggcuggaggcgggcgaggccggcccacccccucgcuggcacugacuuugccuugaacagaccccccgacccucccccacaagccuuuaauugagagccgcucucuguaaguguuugcuugugcaaaagggaauagugccguggagguguguguguccauggcauccggagcgaggcgacuguccugcguggguagcccucggccggggagugaggccaccaaccaaagucaguuccuucccaccuguguuucuguuucguuuuuuuuuuucuuuuuuuucuauauauauuuuuuguugaauucuauuuuauuuuuaauucucucuucuccuccagacacaauggcacugcuuaucuccgaaauggugugaucgucuccucauugagcagcggcugccaccgcgcuguggguagugugugaccguggcuguacuguauagugaacauaguuggcauaucuuuguuugaaguuuguuggugacuccaccaaacuggugugaaaaaagaaaaaagcucaaaaaaauccacaaaaagacaaaacacacaaaaaaaauccugccuauauuuuacucaguuucaaacuuuauuagucuauuuuuaauuauaaaaccagaaagcuacaauuucuuuucuuuccccuccaccccccccccccccacccauuuguuggcuuuuuuguuuuuuaaugucagaucuguugaguugguuuuuuugguuuugguuuuuguuuuuguuuuuguuuuuuacugagaaaggaagggccaagggaugaggugggaaccgggcccugggggcgccacagacuaaggcagagacuccccuaccuggcgcccagccccaaccagcuggccgcuccugcccaugcuuuuuuuuuuuuuuuuuuuuaauuuuuauaauuggagccccuggugagguuacgcgugccaugagaacccacucuacaccacgacgcuggugccucaguguuggccaaacucuggagucacugacugguuugacuuucauacggugaauaugcauuuggucuguacugaucauggaauaaacacaucucucuuuuuuuaaugcu

SEQ ID NO: 18282 - RNA, 658 nt, Homo sapiens
caccccgccccgcccgcgcggcacaguaacagagaaacccggaggugggaugggaaaacuuuauuagguuugguuuccagcuucggccacgcgggcuccgcccgccccgagcucgggucacggggcgcccccgccgcccuccucgucguccuccacgucgaggcccgggaugccgcggaucuggcguugcagcgccccucccagcaagggcacggcgcccuccuccuccuccucugggggcggcggcgguggcggcgacacggccccgggggcuggcucugggggcacgggaggcugcgccggcacgcccucugcgcccuccgagaucccugccgcuucgcccugcgcccccucguccagggcaccgcccucagccuccuccugcuccuucuccuccucggggcugucggugaaaggguucucgcccuguggggaggggcgcggacacugaagggagggagcacaggcggggacuaagcuggggacagggcaggcccggaccagugccucaccuucagguagcgcuccagcuucuugcugaugagcuuguuguugagaauacugcgggccaccaugagggaggacuucuuggacugcuccaucaugagcugcgggcagggcagaaggagcuggagaggcugcucugagugcccuacaa

SEQ ID NO: 18283 - RNA, 658 nt, Homo sapiens
uuguagggcacucagagcagccucuccagcuccuucugcccugcccgcagcucaugauggagcaguccaagaaguccucccucaugguggcccgcaguauucucaacaacaagcucaucagcaagaagcuggagcgcuaccugaaggugaggcacugguccgggccugcccuguccccagcuuaguccccgccugugcucccucccuucaguguccgcgccccuccccacagggcgagaacccuuucaccgacagccccgaggaggagaaggagcaggaggaggcugagggcggugcccuggacgagggggcgcagggcgaagcggcagggaucucggagggcgcagagggcgugccggcgcagccucccgugcccccagagccagcccccggggccgugucgccgccaccgccgccgcccccagaggaggaggaggagggcgccgugcccuugcugggaggggcgcugcaacgccagauccgcggcaucccgggccucgacguggaggacgacgaggagggcggcgggggcgccccgugacccgagcucggggcgggcggagcccgcguggccgaagcuggaaaccaaaccuaauaaaguuuucccaucccaccuccggguuucucuguuacugugccgcgcgggcggggcggggug

SEQ ID NO: 18284 - RNA, 556 nt, Homo sapiens
aggucaccuauggcuuuuauuccuuucucggcggggcccaggugaggccagggggugucugaggugggcaugggcugaggguggcacagauggcugccuugucagaugccugacuuguaggaccacguguuucugugauagggguuuuaaagaagauccuaggaaaaagggugugcucagagccuccugccccgucugguuucaguuggggcuggggucugggcuaggcucugggaauaugcaagcccacaugggggucccagacccagcuuccccccugucugcccaaggugaucugggugggguuggggguuccgggccugguuccuggcgcaguggggccgggaucuggguccugggugcagucagaccuuccaccuuggcccccaggaacugcaucgggcagaaguucgcgauggcagagaugaaggugguccuggcgcucacgcugcugcgcuuccgcauccugcccgaccacagggagccacgcaggacgccggagauuguuuugcgugcggaggacggacuuuggcugcgaguagaaccccugggcuga

SEQ ID NO: 18285 - RNA, 953 nt, Homo sapiens
cucaggaacuuggaggacagaauuuucuguaaaaguuuuuauuuauggcauucuucagcuccuuguuccuuaggcugaaaaugauugggcuaaggaagggggugaagacaguauaggugguggccaucaaggcgucacuguacauagaauggaggcccuugggcuugagguagauaaaggaggcaaaacuauagugcgugaccaccacagugaggugggauacacacguagaaaaugucuugugccggccuucggcagagggaauccucaagauggcagccacaaugaagacauaggagaggaugaugaggaauaaacagccuaucagggcugugacacacaccagcaucacacccaugaugacagaugaugucuuguuuucacaggccaacuucaagagggaaagcacaugacagaaaaaaugguggaucacauuagacccacagaaagugagguggaaaacuaucguugucaccaucauccccaugacugagccaccagcccagguacaggccacaagaugggcacagucacgggggcucaugagcacauuguaacgcaguggguggcagauggccacauagcgaucauagcccaugaccaggagaaggaaggagugagugaagccaaacaugaaggagaagaacaucugguuggcacaagccacaaaggugauggaaugauggguggaaagcagaucagccagcaugcgaggggugauggcaacagugaacagaaucucagagacggagagggugcacaagaagagguacauggguguguggagucuguguucaauccagauuguggccaugaugagaagguugcccagcaaugugaacaggaacaucaggagguacagcaggaacaagaugggcaggaggugcugggggaaggcugagaagccaaagagguuaaauucagauaugaugcuauaguucugacuaggcaug

SEQ ID NO: 18286 - RNA, 24115 nt, Homo sapiens
cgagagcugagagguggaaaauggcgcugacgugagcgcgaacucgcacugcccagaggguggccgccgccuaagcugcagccgccggagccgcagaaacaagaggccgagccgugucgaagauggugagcgcggcaccggggucgcgggcgcggcggagcugcggggacuggcggggagcggcccugucgcgccuacagccuccggccgaccccgcccccacauccgggcacccguccgccgcuggcugucacucggagagcgcccuacuuccgggcccggcccggaauggaccacgcccgucaggcuaggacuccgccccuaaacuucuuacauccgggcccccagcaccuccaagauuguccacacugcucgaggccggccggucucgguccucagacaauccaugucuagcuccucuagcaucuucccaguccaugccugcccauagccccgccuccguagccuuggccccgcccacucccucuaggccacgcuugugugcauacuggggcucccaccuauccuaguugaggagagcagauguuucucccguaugcauaaggagcucaauccgggccagugcaguggcugacgacucuaaucccagcacuuugggaggcugaggcaggaggaucacuugagaccagggguucaagaccagugagggcaacauggcgagaccccaucuuuauaaaaagaaaaaaagagcuuaguccacccuuacguauuccccuauccucuccugcuggugauuccuuaggaugggggccgacuggguugacccagagcccagaaggguucucuccgccucuuccuuccaccaggaggagaaacccucagggcccaucccagacaugcuggccacugcagagcccagcuccagugagaccgacaaggagguguuguccccggcugugccagcugcagccccuuccuccuccaugucggaggagccaggcccugagcaggcagccacaccgccagugugggaacguggaggggcuggagggaugcagcagggcuccuccccagccccagacagcugccagccuggccccggacccagcccuggccugaccagcauagucuccgggaccagcgaggaccugcggccucccagacgacgcccaccuccaggugaucugugauggggucuucuggggaaucacagucccugaaacaauagaagcgagacguagagaaucucuaaccucagggccuuucuagagggaugccacucaucauuuuacggagcagccgguggaugccaggcuguggcuccaauggugagccuggccaguccagccccugcacuguggcagaccagucuguugugguaggcagagaguaaaggccccagcacaucauauuugcuucucuggggcagaacccuggggucagggacagcacuagugaggaagggaccagugaccacuguucugugcguccugcagggaagcaaaucccuugcuccagcccuggcugcugccucaguuuucccagcguccgugaccuggcacagcaucugcgaacccacugcccgcccacacagucccuggaagguagggccaggacugguaauggggaggcagguuagggugggaaacaggcggagccccucggagccagccuuggccaccugucuccacuucucuguccuucaucccuaccaggcaagcucuuccgcugcucagcccugagcugcaccgagaccuuccccagcaugcaggagcugguggcucacagcaaacugcacuacaaacccaaucgcuacuucaagugagacccugaccucuugagcuccgcccugcccuagccucacccuaugugugggcuccaggccuuccucccuuccuggucaggguguuggagggcgggacuugaugugggugggccuuuggggaagccccgcccucaacucccuggauggggcggggcauacgugggcguggccccacccagccaggcuuuaccucccaaguggaaaaccggccgccuaacuuaaaauugagacuucuuuccggguuuccccagguucccacccgaaguggucaggaagggucgcugccacaguuguacaggagcggggaggugauuagugcccaggcuccguucccacgcucgaagggcggguggcauugcacaggacacucucccuggugccccuggaggcccagcccagcccagcccucugcccaccuccaggugugagaacugccuccugcgcuuccgcacgcaccgcucgcucuucaagcaccugcauguuugcgcggagcaugcgcagagcccagccccgccgccacccccggcccuggaccgagagccgcccgcgccggagcgccccccggagguugaccccgcaucagcgccgggccugccguucccgcugcuggaacccuucacgacccccgccccugcccccaccggaccguuccugcccuacuugaacccugcgcccuuuggccuaagccccccgcgccugcgccccuuccuggccgcugcacccgggccgccggcuuccagcgccgccgucuggaaaaagagccaaggugaguguggggucgggggccuccaggagggcuggcugggcucgcccugacucugaacuugacccgccccuuuaccgcaggugcuggcagcagcccccgaagaccccagggcggcuccgacgcgcccucaggugcgugcaggugaccaccagggagggguggaggggcuuucuuuccugcgcccugcggggucugguggauaccaggaggcagcagugcucauccccuucccagggggcacaaaugccaccgucccgaaauacaggauuuuugccuuaaaaaugacuggcaccugcgccuucaucugcgccggcguucccguauaaaccuugcgccccuuucaccguucaccucggagcgggcuucuccccaacagugaaucuggggaugauaguaggggacgcggagaagccaaguugggugcccccaacucuaggggcagacagacccgggagaaacugaacuaggcgcccggaagcugauggggggcgggaaaaagucccacccacccucgccggcguccuccauccuuggcgcacgggucuucugggcugggggagcccgggacugacggggucccgccugcccgcagggcacgcggccccgagccgcaucgugugggagcacacacgcggccgcuacucgugcaugcagugcgccuucuccacggccucgcggcccgccaugacccugcaccuggaggaccaccgccccggcgcccccgcggcccccgcggccgggccgccgcgccccgacgcccccgcggguaaggccgaggaaugcgcggguggagaggggggcgggggcccaaggcgcugaggcucaggcgccccccuccucugccccacccagauccggccccgcuugcacccaaggugucgccgcugcugucagagggggagcuuccaguguucucgcagcucugaaucccgccgcuuugggggugggccaugggauguggguaguuuugucauuuggagggggcugcagggaaggggggcugggguggacaauaaagaaggcgccaugagccagccuaugcuguguucccaucccuuguccauccaaagcauagugggcucgagcccagcagucauggauugaucacaucuugggaggaccaccuggguccacaggugcaggccucacagcccaccuguguccugucuucccaucaccccaauccugggacccagguccccaccuccagcugugguugagguccccaguacccacuguggcagcguucucccuuguccagaaaccaaaugggauggggacucuccaguuuucuuuuuuuuuuuuuuucuuuuuuuuuuuuucuuuuuugagacagucuugcucugucucccaggccggagugcaguggcacaaucuccucucacugcaagcuccaccuccuggguucacgccauucuccugcuucagccucccaaguagcugggauuacaggugcccaccacuaugcccggcuaauuuuuuguauuuuuaauagagauggaguuucaccgcguuagccaggauggucucgaucuccugaccucaugauccgcccgccuuagacucccaaagugcuggaauuacaggcgugagccaccacgcccggucuccaguuuucuuuuaagaagucccggccgggcacaguggcucacgccuguaaucccagcacuuugggaggcuggggcagguggagcaccugaggucaggaguucgagaccagccugacuuacaugguaaaaccccaucucuacuaaacacaaaaaauuagccaggugugguggcgcacaccuguagucccagcuacuugggaggcugaggcaggagaaucacuugaaccugggagguggaaguugcagugagcugagauugugcuauugcacuccagucugggcaauacgaguggaacuccaucucaaaaauaaagaaaauuaaaaagcaaucccguaaccaggagaggugacuaaugucugcagucucagugcuuuaggaagcugaggcaggaggggcgccucaggccaggaguucgagaccagcuugggcaaccuagcaagaucgcaucucuaccuccccgcccaccaaaaaaaauacaaaaaauaaucaggcauggcugggcaugguggcucaugcuuguaauccuagcacuuugggaggccgaaguggguggaucacuugaggucaggaguuggagacuagccuggccaacauggugaaaccccaucucuacuaaaaauaugaaaauuagucgggcaugguggugggcaccuauaaucccagcuacucgggagccugaggcaggagaaucgcuugaacccggugggauggagguugcagugagccgagaucaagacccugcacuccagccugggugauagagugaaacucugucuuaaaaaaaaaaaaaaaaaaaaauagccgugguggcuaccugggaggcugaggcaggaggaucacgagcacagcaguucaaggcugcagugagccaucaucacaccauugcaaccccagccugggagacaaaaaaagaaaaaaucccaggagcuucggggacaggcuggaaggcugguccugagaaagugcagggacuggccaggauggccugaagacccccagacccugaaccccauacugacuuaaggggaagaauccuuugggauuggggaggcaggcuggggacucaggucuucauccuccuugcugucugccagaccaauuuccaccaugucccagcucugaggaguggggugggucaaggccagcccuccauggccuggucuuucuccucaccccugaagccagccucccagguauggaagucccaggugauauccacagccaucccuuggaagcugguuuuaccuccaugaucccucucccuucuauccucaucucgccagccccaggguccccuagcccacccccuacucuccccaaccugcccuuaccccaagacugaaaacagaaaacagucucuucuuccucuuuuuauuuuauuuauuuuuuuuuuuuuggagacagagucucgccggagugcaauggcagugccaggcuggagugcaaugguacacucucagcucucacugcaaccuccgccuucuggguucacaugauucuccugccucagccuccaaguagcugggauuacaggcgccugccaccaccccggcuaacuuuuuguauuuuuaguagcgaugagguuucaacauguuggucaggcuggucucgaacuccugaccucaggugaucgacccaccuuggccucccaaaguacugggauuacaagugugagccaccacgcccugccagggucucuucugauuguuccccucuccugcccggcacccuucaguggcuucccauggcccucuggaugaagauccuguucucccaguagcccacaaggcccuaccuugaaccucucgguccccucccagaacaacacucacugucucccucauccuccuggauauacagacauccugugagcaagaacccagggaccuccuucacgcaguccaccuugucucaauccuuaccuccuccuccuuucuccauucucugaauccacuucgggguucccccucaccuccucauccugguaucugcagccgagacaccaguaaccccugggcggggcccccagaccccacuccuccgucacugcccucccaccuucuccuugccccccgccacccuccuuguugucuuccucagauuuuuuuuuuuuuuuuuuuuuuggaagauggagucucgcacugucacccaggcuggagugcaguggcaccaucucagcucacugcagccuccgccucccagguucacaccauucuccugccugagccucccaaguagcugggauuacaggugcccuccaccaugccuggcuaauuuuuuguauuuuuaguagagaugggguuucagcauguuggcgaggcuggucucgaacucuugaccucaugauccgcccgccucggccucccaaagugcugggauuacaggcgugauccaccgcaccuaucuuccuuggacuuuucauccaccaacguguccaccucaggcucugagucaaagccauccagguagacaagccaagggccaccugccccacaccugcucagugccaugucaccucaaagauggacagcucugggcuccagaagcccuucagccacugcaaggggcaggaggggauccucaggcccuugggacccgucugucugccccacugcccaccgccucaccaggggccugaagacugcucuguccuugauggggcugugaugugacggggcagcagccucagcugacguggcuugggcuggguguccacucucccagaaccuguaggccccagcugaggugguugucaggaugggguaggacaggccaucaggaggcccccuaagcucccccuucucagccagaagccuugaaaccaccacugugggacccuggaaaagagucgacuucccugccucccaauucccucguccuuaaaagggugucaugaugacuggugaguccuuugggguggacgcgaggaugaaaagagaggcugcagggagaggaggggcuugggaaaugucugcugagaacuucacgucccgagcccauggcugccugggacucucucgaccuggggaggagggugggacagggugaaggggcccauuuuacagauauauagagaaggugaggcuaggaggccucuagccagccccaguucccagucagcggcacugauucugcaccaucuugggagcugcgcacgguuaccacgagaagagaaaacccugccagcagguccagaggacacgccccuguucccgcauucugcaggucccuagaucuggcuguaguccaagccucucccccaucuccagggacagcgcuguguucucugucccccaggccccuaaccccucuccagggucccgggggcccccaggagucuuuguccccaucaguuucuuuauucggccacccccagaucuaggccacgccucuucccagucugucaguaucuuuccagagaaaccuagagccaacacguccguccagggaccucuccccuaccccaucacccacggagaugggacagcccuuccuguguguacagcgggcccacggccaccacacuacccucuggagugaacugacugccgcgaggccuggggagcuggcucaccaccuguccuccaccguucacccuguccacugcagaaacgaccuccuacccucaagccggcccccaacccccaugcacaggagcccagcccucuugggccccggcuccgcccagcagggggcgcccaggaaucucagacucgggggaaugaaagccgggagagcaguggggauagcgggcagguuggcuggaagccgcgggcucgcgcugaacagcucugaggccggccagaggcccgugcccggcauuuguccagccccagcugucacuugcaggugccgguccgguuacccucauugcgggccaggagcggggagguggagggcgcccugcggcccugggauccgccgcccacgugcuccccgggcuccucccccugcacaccguuguucgcguuuccgaccccgcagauuccccaaggcgcgcccuaacgaacucucacuccccugguccgggcucccuucuccgggauuccgguaacccuaucugucccugucugcagccgcgccgcgcggaacccugccgggagccccuacggaggcgccaaauacacaaaggguaguuggcggggaggcgcaccaugacuacagcuccgggaccugcgcuucacccccacggcgcccccguggggccuuggugcgcgcgcccuggcuggacccuccuagcugcgagagugcacggguagugaccagcccaggcaccugggaauccaucagcugucauccaauccuuuaauuaccuugauugagcuccuuacuguggccaagcauugcuugauuuauuuauuuacuuauuuuuauuauuuaauuuaauuuuuuuuuuuuugagacggugucucgccuugucacccagguuggagugcaauggcgcaaucucagcucacugcaaccuccgccucccggguucaagcgauucucccgccucagccucccagguaccugggauuacaggugugcacaaacaguauuuuuaguagagacaggguuucaucauguuggccaggcugcucucgaacuccugaccucaggugauacgcccgccuggccucccaaacuucugggauuacaggcgucagccaccgcgccuggccacuuguucuuucuuucauucuuuccuucacuugccaagguucuggagacccacagagagcccauacuguccucccgagacuccuuuuugggagggcaacccacaucugggaacugugccccaggacaggaugcaaaggcacaacagagauggcagaauccugaugucugugcucuuaaaggaggcgugaaaacaggcaggccaggcgcagugacuaaggccuguaaucccagcacuuugggaggcccacguggguagauugcuugaggucaggaguuugagaccagccuggccaauggugacaccccagcucugcuaaaaauccagaaaauuagccgggcauguuggcaggcaccuguaaucccagcuacuugaagccgggaggcagccugggagacagagcaagacuuugucucaaaaaaaaaauuuuaaaauguuuuaaaaauacuugcucgggccacaccccagacugauuaagucagaguuucuuguagguucuguuuuuuguuuuguuuuuuuuuagauggaguuuugcucugucacccagacuggagugcaguggagccaucucgucucacugcaaccuccgccuccuggguucaagcaauucuccugccucagccucccaaguagccaagauuacaggcaugcgccaccacgccgagcuaauuuuuguauuuuuaguagagaugggguuucuccauguugcccaggcuggucuugaacucccaaccucaggugaucaaccucaggugauccacccgacucagccucccaaagugcugggauuacaggcgugagccacacugcccaaccgccgguucuuuuuuuuuuuuuuuuaacuguucaggcaauuccaacaugugcucaaacugaaaaccagggcucucuacucucuuagcagguguuuucucccuuugucuaccgugacggagauuacugaucuccugugggcugagcucuguggucagggcuuguccuuaucuggccaguccucggcaccacaagugacugccuucacccccucuuggccccugucucugucuccugguuccucuucucucuacuaccucuaaccucugggaaucugguguguccucggguccucagacccccucacuccuccagaacugcaaagccuuuuuuuuuuuuuuuuuuugagauggagucucucucugucacccagcauggaguacaguggcgugaucuugacucugcaaccuccgccuucaggguucaagugauucucccaccccagccucccaagcagcugggaccacaggcgugcaccaucacaccuggcuaauuuuauauuuuuuguagagauggagucuugcuacauugcccaagcuggucuugaacuccugggcucaagugauccuccugccucagccucccaaaguguuaggauuacaggcgugagccaccgugcguggcccaggugcaaggccuuugacaccacucacccaccgacccccaaaucugcuguaccagcuaagcuuucugcccagggcggcagccugggacauccauggccugugauaucugccccagaacaagugaguccugcucagagccgggaauuggauuucauggaaguguugaaaugaggaaggcggaugagccaaccagggcagacagcagaggccucacccggucacaugggcccccacguccugggccucugggccuccccaggagccuccuaaaccccagagcuguccguaccccugaucugcugagaucuccccauccuguggcucucuagcccaggaggucaccagggccuggcauggaguccucccuggaguccagagauggggacaccaaaguaguaggaaugauggggacuauagagaguaagaaacuaguuggccaggcgugguugcucacgccuguagucccagcacuuugggaggccgaggcgggcagaucaucugagguugggaguuugagaccagccugaccaacauggugaaaccccgucucuacuaaaaauacaaaaaauuagccggcagugguggcacaugcauguaauuccagcuacucaggagacugaggcaggacaaucgcuugaaccugggaggcggagguugcagugagucgagauugcgccacuacacuccagccugggcaacaaagugauaccccgucucaaaaaaaaaaaaaaaaaaaaaaaaaagaaagaaacuagugaccauguuaggaacaugcgggcaaccagugccccaagcuugggacaguagcaggcaggacaggaauucaagcgaaauagaagugcccagcaggggccggggcaguggcucacaccuguaaucccagcacuuugguaggccgaggcggaccgaucccuugaggucaggaguuugagaccagccugcccaacauggugaaaccccuucucuacuaaagauacgaaaaguagccaggagcgguggugcgcgccuguaaucccagcuacucaggagguugaugcaaaagaauugccugaacccgggaggcagagguugcagugagccgagauggcaccauggcacuccagccugggcgacagagcaagacucagucucaaaaaaaaagaaguggcuggcaggaucuggagacggacuggagccuccccaccuccuucccuuccuccucugcccucccccgccccaccucuagcagcccccacccugugugcugaccguggagcagaagccacagucacuuccugaaggcagcggccccagcucgggucccacucaucccauggcccaucaccugccugcagccauggugagugcuggaagaggccugugccucacuggcugggaagcaagggacacagauguucccagaaggauaggauccaccuguggaggggcgggcgggggggcgggggguggcugcgaaagacaucugggaaacgggaagggucggcaaaaaggacccgagguaggcggccaccaggcacaccccaggacagcgcgggcuccuggggguucacgcucagguugggacugcgagggggacagaugggacuccccggggggacaacucccgucuccccaggucaacaugagcagccaugugggaacgggcugcuggggugagagcagugcuuuccugcggggugacaaagugggucaugacccucccccguccagucacccaaguugugaccugcuaacccugacuuaucuagcccuguggucgcccgggagcacuuccuucaaaccacucggggcuuugacaggggcacuucaggccccaggugggaauugcugccuuuccaaggagcaauccuggucucugguccucuggauggggaaagugaggcacacgcaggaagcaaaggccacacguuucugcccuuucccucccccaaucuccuugaccacaggugaaaggggcguuuguaggacuaaggaggccuggccuucuugugaaucugccuaccucugugaggagugguugcagggccagcuaggagggcagcugggacagcuggguaugcaggagacagcgccugugcccacggugucugcaccaauccucucaggcacugucaacugugagcauuccugaccaucagcccgcaugucagagacggugugagagggaccgcauggccgucuccaggcaucucuguguuuuccugauggucaggcugaguacauggcugucuuugugcugccugaauauuguuuauuucagcaaauauuuacugagcaccuaccauguuccaggcccugggaagacagcaaugaaugagccaagucucugccuugcagaggcugaggaacugagggaaguugugguguagagagacaaaaaaaaaaaaaaaaaaaaaucaagacacauuaaaaacaauguaaaauaguauaauacguagggguggguacgauggagaaaaucaugcaugcugaaugcagggcaguagugggauggggugauccauuuaaaauaggguggucuaggccaggcgugauggcucaugcacuuugggaggccgagguggguggaucacuugaggucaggaguucgagaccagccuggccaacaugguaaaacccuguuuccauuaaaaauacaaaaaaaauuagccaggcgucguggcagacaccugugaucccagcuacucaggaggcugagaaucgcuugaacccaggaggcggagguugcaguauggcgagauuccaccacugcauuccaaccugggugacagagugagacuccgucucaaaaaaaaaaaaaaaaaagaaagaaagaaaaauaggguggucuagguugggcacgguggcucacaccuguaaucccagcacuuugggaggcugaggcggguggaggguggaucaccugaggucgugaguuugagaccagccuggccaacguggugaaacccugucucuaguuaaaauacaaaaauuagccaggugugguggcgagugccuguaaucccagcuacuugggcggcugaggcacgagaaucauuugaaccugggaaguggagauugcagugagccgagaucgcgccauugcacuccagucugggugacagagcaagacuccaucucaaaaaauaaaaauaaacaaauaggguggccuuggauggccucucuaauaagaaaauaugagaacagaggcugggaggaggaaaaggagagacccagguggugcagagacauguccugggucagggacagggcagaggccccgaggucggagggaaguguucagggugcagggaggagaagguggcuggguagggaggcugguucgcccaggcuuuuaugaggcauuuagcuugaacuguggggacaugaggaagcauugccgaguuuugagcagagggacacaaacagacucaggguucaacaggcuucucccuccagcugccauggggggaacugaccagggaaggggguaggcagaggcccagggaagggcuuguuagaguaauccaggcaauugguugggggagggcagacacugccucccacuaccuccuggggugacaguggugaaggcagugagaagugguuggauuccggauguguuuugaaauuagcacagaagggacugggggccugggcgcggcggcucaagccuguaaucccagcuacuggggaggccgaggucgggggaaucauuggagcccaggaguugcaagcugcagugagcuaugauugcaccacugcucuccagccugggcaauggaacgagacuggagacaugcagugggaggggugaaagaaugagggggucaaggaugcugggggggugggguaccacccauggggggagggcagugggacuggaggcugcaggagggaugucgggaucuccagugcugcuagaggagguuggguguggaaucagcacuaaauggagaaguagggaggggugucggucccaggauccuaggauccaugggggcuccugggaaagagcugagggcugaccgggccugggcgcagggguggugguugugggcugugccugaggguccccaggcccauccuuccaugccccuucuguguguuugagccccugccucauuggcucugcgucuccuaggagagccaucaggacuuccggagcaucaaagcaaaguuccaggccucucagccggagcccagcgaccugcccaaaaaaccuccgaagccugaguuugguaaacugaagaaguucucccagccugagcuaagcgagcaccccaagaaggccccgcugccugaguuuggugcaguguccuugaagcccccgccgccugaggucacugaccuccccaagaagcccccgccgccugaggucacugaccuccccaagaagcccccgccgccugaggucacugaccuccccaagaagcccccgccgccugaggucacugaccuccccaagaagccguccaaacuggaguugagugaccucuccaagaaguucccacagcugggggccacuccguuuccaaggaagccccugcagccugaggucggugaggccccuuugaaggccucgcugccggagccuggugcgccggcccggaaaccccugcagcccgacgaacucagucaccccgccagaccccccuccgaacccaaauccggcgcauuccccaggaagcucuggcaacccgaggccggugaggcuaccccgagguccccgcagccugaguugaguaccuuucccaagaagccugcgcagccugaguucaacguguaccccaaaaagccuccgcagccucaggucgguggccucccuaagaaguccgugccgcagccugaguucagcgaggccgcucagacuccccucuggaagccucaguccagcgagccgaagcgcgacuccagcgccuuucccaaaaaggccucccagccuccgcugagugacuuucccaagaagccuccgcagccugagcuuggggaccucaccaggaccuccucagagcccgaagucagcgugcuucccaagaggccgcggccggccgaauucaaagcgcucuccaagaagcccccgcagcccgagcugggcggccuccccaggaccuccucagagcccgaguucaacucacuccccaggaagcugcugcagccggagcgccgggggccaccccgcaaguucucacagccugagcccagcgcuguccucaagagacacccgcagccugaguucuucggugaucucccucgaaagccuccacuccccagcuccgcuuccgagagcucacugccugcggccguggccggcuucagcucccggcacccgcucagcccuggguuuggagcggcugggacaccccgcuggaggucaggaggccugguucacaguggaggggccaggccaggccucagacccagccauccaccccggcggaggccucugcccccugccagcagccugggacacccuccagccaagcccccgcugcccccggggcccguggauaugcagagcuuucggagacccucugcagcauccauaggugggugagggcgggcggcaccggcaggagcgggggcugaggucccaggcagugccggcuucccugcccuacucucuaccccacagaucuacggaggacccgcucggccgcugggcuccacuuccaggaccgacagccugaagacaucccgcagugaguguggggaggaagcggaggugggugcggauuguggggcucaaagaggccucaucucggccuggagcucccagaacuucgggaggcugaagugggcggaucuccugaagucaggaguucgacaacagccuggccaacguggugaaaccccgucuacuaaaaauacaaaaauuagcccggugugguggggggcaccuguaaucccagcuacuugggaggcugaggcaggagaaucgcuugaacccgggagguggaggcugcagugagcccgagaucaugccccugcaccacuccagccugggcaacagagaaaaacuccgucucaaaaaaaaaaaaaaaaaaaaaaaaagaagaggccucaucucagguauccccgcagggucccagaugagaucuacgagcuguaugacgauguggaacccagagaugacuccagccccagccccaagggcagagguuuguugguggccugcccgagucccugcaaaacauucggggcaaggccauuuucugccaugcuccugguguaagagcaaguaacauuuuaggaccugcuggcuccugcuggguggaacuacauaaggggagcccagaggcgaaggaccagugagaaggcuguuguaggcagagguguggcccagguuggcagcaggagaugugggagcagugggugaauucaguaaucaaaagcaggcaucaggccgggugcaguggcucaugccuguaaucccagagcuuugggagcccgaggcaggaggaucguuugagccaaucccagggcuuugugaggccaagacaggaggaucccguaagcccaagauuccagaccagucugggccacagagcgagaccucaucucuacaaaaaaacuuaaaaaucagccaggugugacaagcaucuguagucccagcuauuugggaugcugagacaagaggauugcuugaguccaggaggucgagacugcagacugcagugaggcugugacuccaccacuguacuccagccugggcagcaaacacccugucucaaaaaaaaaaaaaaaaaaagcaggauuuggugguauauaaagcagggaaguuucaagccuagcacccaagggcaugacagagccgccccuggguugacgacaagauguuagguuccauucauucauccauccauccauccauccauucauuuauuuauuuauuuuuugagauggagucucgcucugucacccaggcuguagugcaguggagcaaucucagcucacugcaagcuccgccucccggguucaugccauucuccugccucagccuccccaguagcugggacuacaggcacccaccaccgcgcccagcuaauuuuuuuguauuuuuaguagagaugggguuucaccguggucucgaucuccugaccucgugauccaccugccuuggccucccaaagugcugggauuacaggcgugagccaccacgccugacccuuauuuauuuauguauucguuuuuuuguuugagauggaggcucgcucuguugcccagacuggagugcagugccgugaucuuggcuaacugcaaccucugccuuccguguucaagcgauucuccugucccacccucuggaguagcugggauuacaggcacgugccaccaagcccagcuacuuuuuguauuuuuaguagauaugggguuucaccauguuggcuaggcuggucucaagcuccugaccucaaacgauccacccaccuuagccuccacaagugcugggauuacagucaugagccaccgcgcccggccuuauauuuuuauuuuuuauuuuuuuggagacacagucucgcucuguuaucgcccaggcuggaguguaguggugccaucucagcucacugcaaccucugccucuuggauucaagcgauucuccugccucagccucccaaguagcugggauuacaggcgcccaccaccaugccuaguuaauuuuuguauuuuuaguagagcugggguuucacuacauuggccaggcuggccuugaacuccugaccucgugauccgcccaccucagccuaccaaagugcugagauuucaggcgugagccaccacgcccagccugauuuacuuagaccuguuguguucaagguagcugaggggauguccaggcagaacuugggccugaaacucagggggagguguggccugcaggcagguguggcaguggcaggggagggaggcugccaaagguuucuuagaaguuugugcugggugaauagggagcaggcccgcaccuccugcccagcuccacaguuaaugccuucaugaaaacacaagcagcuuccaggcaagcaccuugccugccugucccuaaaucuguacccuccacucccugcaugucccuaaaucuguccuuaaauccguacccuccacuccaaaguuaaugccuucaugaaaacacaagcagcuuccagggaagcaccuugccugccugucccuaaaucuguacgcuccacucccugcaugucccuaaaucuguccuuaaauccguccuuaaauccguacccuccacuccaaaguuaaugccuucaugaaaacacaagcagcuuccaggcaagcaccuugccugccugucccuaaauccguacccuccacucccaaauccccacagggcaguaaggcaaugcacccccauuuuacagaugcacaaggcuggcccggcguggcagcucacaccugucaucccagcaguuugggagguccggugggcggaucacuugaggucaggaguuccagaccagccuggcccgcauggcaaaaacccaucucuacuaaaaauaaaaaaacuagcuggggccgggcgugguggcucacgccuguaaucccagcacuuugggaggccgaggcggguggaucaccugaggucaggaguucgagaccagccugaacaacauggagaaaccccaucucuacuaaaaauacaaaaauucgccaggugugguggugcgugccuguagucccagcuacuagagaagcugaggcaggagaaucgcgugaaccugggaaggaaggguugcagugagccaagaucacgccauuggacuccagcuugggcgacagagugagacucaaucucaaaaaaaaaaaugagucgggcaugguggcaugcaccugucaucccagcuauucggaaggcugaggugggagaauuccuugaacccgggagguggagguugcagugagcugacaucgcgccgcugcacuccagccugggugacagagugagacucugugucugucucaguugaaaaaaaaaaaaaaggccaggcgcaguggcucacgccuguaaucccagcacuuugggaggccaaggcggguggauugccugaugucaagaguucaagaccagccuggccaacauagugaaaaccugucucuacuaaaaauacaaaaaauuagcugggugugguagcaggcgccuguaaucccagcuacuugggaggcugaggcaggagaaucgcuugaaccugggaggcagggguugcaguaagcugagauccugccauugcacuccagccugggugacagagugagacuccaucucaaaaaaaaaaaaagaaaaaaaaauagguacgcaagguugaggcucugggauggggcuugcccuggcuugcacagcugguccacgagcuggaucuguggcagggcuuucagcgggggccagagcuugagcuucuaaggugcuccugcucucgcugacagccucagagggccuggggcagagaggcccccucugcuucuccugggcuuucucccugagcuucuugcaacaccucccugugagcacacagcuuccugguggggccccuucugcuuccgcucuaggggaggcucuguggcuugggucugggggccaccguuggggaugcggauggccaggaguggggcugcugagcgccugggcuagugacagccugccuccaaccacucccagaagcccugcuggaaucccccaccucuuccgaggcuaggagcaucugccucuccucaaacuucauacaguccccacccuuggcccauuguuccugucaccaaauaaccuucucccccuuccuugccagucauuugagguucugauaggaaaaaagaaaaaaggggccgggcgcgguggcucaugccuaaaaucccaguucuuugggagguggaggcaggcggaucaguugagguugggaguucgagaccagccuggccaacauggugaaaccccgucucuacuaaaaauacaaaaauuaguuggacaugguguugcacaccuguagucccagcuucuggggaggcugaggugggaggaucgcuugaauccaggagauggaggcugcaaugagccgagauugcaccucugcacuccagccugggcaacagaacgagacccugucucaagaaaaaaagaaaaaaaaaaaggucccacuucccuggaucucccgcuucucaggaguggcgugggcuucucacugugggugcagcuucucaaaggcagcuuaggucucuuggggccaggacucuggacuccccuuucccacugucugccuuacuuggagcaguggcagcuccacugcagagguuccuggaaggcagggggcuccucugcagguggggagagcccagccuuucccagggaucugagcuggccaugcggggaaggcgggcagaggccugcucugggucagcuguggaugaaccagggcugccugcauggcggugccaagaggugcucuaauguggcggguuugcagggacccuggagugccaaggucagguucgcuccugguggagugacugcucacggccagggaagccucugagaggcaggagcagcuggaggggcuguguguuccaggugagacuguggauggccaugccugguaucuggcgggcacgauucaggugcugcuccuugggcugcuuggagggacuacaggccugaaauguccggcgggauacuuugagccauucggaaaggacaugcuggggcucuggguucuggaucuuucacucaccaggguuccuggggcucccaccugaagccaauuccuuggccagcagggcucugacuugggagccuggucauuugccaggaaguggcacagggagacuggcaccaugggagaccccucaguccagagucucaucaucagucaccaguccaggacgcuuacccuagcagcaucuuuuaaaaauuauuuuuauuuacuauuuugagacaggguccuggucugucgcccaggcuggagugcagcggcgccaucuugacucacugcaaccuccagcucccagguuccggcgauucuccugccucagccuccugaguagcuggcauuaugggcgcccaccaccacacccgucuaauuuuuguauuuuuaguagagacaggguuucaccauguuggccaggcugcugucaaacuccugaccucaagugaucugcccgacuuggccucccaaagugcugggaugacaggcaugagccaccaugccuggccaugauauuuuacugucaacuaucauugcccuccugugcaauggaacacccaauuucuucuuccuaacuguaacuuuguacccaugggccagccucuccucauccucccuucugccuuaguuuuucacccaaaucucauuacaguagaaccccagaaccuaccgggugcaguggcucaggccuguaaucccagcacuuugggaggcugaggcaggggcaucaccugaggucaggaguuagagaccagccuggccaacaugacgaaaccucaucuguacuaaaaauacaaaaaucagcuggguguggcagugggugcuuauaaucccagcuacucaggaugcugaggcaggagaaucgcuugaacccaggaggcagagguugcagugagcugagaucaugccauugcacuccagccugggcaacaagaaugaaacuccgucucaaaaacaaaaacaaaaacaaaagaaacaaaaaaaaaaacggcuaggcacgguggcucacgccuauaaucccagcacuuugggaggccgaggcggguggaucaccugaggucaggaguuugagaccagccuggccaacauggugaaacccgucucuacuaaaaauaaaaaaaaaaauuagccgggugugguggcaugugccuguaaucccaccuacuugggagguugagggaggagaaucgcuugaacccaggagguggagguugcagugagcugagaucgcgccauugcacacucuagccugggcaacaagagcaaaacuccgucucaaaaaauaaaaaagaacccuagacccaacuugcucuaggaggcagaagugaaauggccucgaagccuacagauaaauccugccuuuaccauuuaccagcugggugaccuugggcaguuugcuugaccucucugagccuuuauuuccuuguggacaaguugggcaugacaguggcgucuacuggcaugaacaagguugcugagagggcugccaugaggggcguggcccagcaguucccaccaugcugagcacguggcaggaguuaagggaauggaaggcaauccagaagaacccaugaccccugagaaaggcuugcggaagaaggugggcagggagagguuugggaggggaccuggugggauuuggggaguccucagaacugacacagggaggccuuacucaagauccagccaccugccaggcgcaguggcucacgccuguaaucccagcacuuuaggaggccgaggcgaguggauugccugaggucaggaguucaagaccagccuggcccacauggugaaaccugucuguguuaaaaauacaaaaaucagccagguguggugauggacaccuguaaucccagcuacucgggagccugagguaggagaaucgcuugaacccaggaggcgaagguugcagugagccgagauugugccauugcacuccagccugggugacagagcaagacuucgucucaaaacaaaaacacaaaaacaaacaaaaaacagcuaccaggguaaaggcugagccggcgggcccugccuugacucggaguccugacuguccccagaugaagcgcccucaguucagcaagccgccaggaggccaccacaagacccagcgcucaggugccaugggcagagggggugggcagacggggggcgagcuccaggaacccccagaggagcacaacuugcucacgagcacacaauuccuuggugggggcuaucaggaaggagaaggauccccagccacagcaguugccacccauggacccaaaguugcugaagcagcugaggaaggcagagaaggccgagagggaguuccggaagaaguucaaggugaggccucugagcuaagcaggaguccuggcagggcggagaccagggucccaccgaucccaggcucagaaagaagacaggggcccaagggcggcagcacaagcagaggcccuaacaucucgcgccccaguuugaaggggagaucgugguucacacgaagaugaugaucgaccccaacgcuaagacacgucgcggggguggcaagcaccucgggauccggcgcggggagauccuggaggugaucgaguucaccagcaaugaggagaugcugugccgggaccccaaaggcaaaugugagugcgcccggccccgcagccccgggagguccccgccgccacccugggccucagaacccaccaugcccacucucuccacagauggcuacgugcccagaacagcgcuccugccccugugagugccagcccugaccguggugggggagugcgggguguguggugcaggguggggggaaugggccacggugccccuugcugacccaacugugcucugccagggagacggagguguacgaugaugucgacuucugcgguacguggacacucugggagggcuggagggacccuggcgauuccccgggggcgcugcucacuauugggcuucuggggagagggguccauggaagucacgcuuccucggcagauccccuggaaaaccaaccacucccccugggacgguaagaccgguaggcguggggccaggacagccagccagcccagcgcccgcucacccaggagcccuggaucccggcgcgggaaagucacagagcugccugggcuuguaccuggccacauaaagccccaguuuaaagcagu

SEQ ID NO: 18287 - RNA, 24115 nt, Homo sapiens
acugcuuuaaacuggggcuuuauguggccagguacaagcccaggcagcucugugacuuucccgcgccgggauccagggcuccugggugagcgggcgcugggcuggcuggcuguccuggccccacgccuaccggucuuaccgucccagggggagugguugguuuuccaggggaucugccgaggaagcgugacuuccauggaccccucuccccagaagcccaauagugagcagcgcccccggggaaucgccagggucccuccagcccucccagaguguccacguaccgcagaagucgacaucaucguacaccuccgucucccuggcagagcacaguugggucagcaaggggcaccguggcccauuccccccacccugcaccacacaccccgcacucccccaccacggucagggcuggcacucacaggggcaggagcgcuguucugggcacguagccaucuguggagagagugggcaugguggguucugaggcccaggguggcggcggggaccucccggggcugcggggccgggcgcacucacauuugccuuuggggucccggcacagcaucuccucauugcuggugaacucgaucaccuccaggaucuccccgcgccggaucccgaggugcuugccacccccgcgacgugucuuagcguuggggucgaucaucaucuucgugugaaccacgaucuccccuucaaacuggggcgcgagauguuagggccucugcuugugcugccgcccuugggccccugucuucuuucugagccugggaucggugggacccuggucuccgcccugccaggacuccugcuuagcucagaggccucaccuugaacuucuuccggaacucccucucggccuucucugccuuccucagcugcuucagcaacuuuggguccauggguggcaacugcuguggcuggggauccuucuccuuccugauagcccccaccaaggaauugugugcucgugagcaaguugugcuccucuggggguuccuggagcucgccccccgucugcccacccccucugcccauggcaccugagcgcugggucuugugguggccuccuggcggcuugcugaacugagggcgcuucaucuggggacagucaggacuccgagucaaggcagggcccgccggcucagccuuuacccugguagcuguuuuuuguuuguuuuuguguuuuuguuuugagacgaagucuugcucugucacccaggcuggagugcaauggcacaaucucggcucacugcaaccuucgccuccuggguucaagcgauucuccuaccucaggcucccgaguagcugggauuacagguguccaucaccacaccuggcugauuuuuguauuuuuaacacagacagguuucaccaugugggccaggcuggucuugaacuccugaccucaggcaauccacucgccucggccuccuaaagugcugggauuacaggcgugagccacugcgccuggcagguggcuggaucuugaguaaggccucccugugucaguucugaggacuccccaaaucccaccagguccccucccaaaccucucccugcccaccuucuuccgcaagccuuucucaggggucauggguucuucuggauugccuuccauucccuuaacuccugccacgugcucagcauggugggaacugcugggccacgccccucauggcagcccucucagcaaccuuguucaugccaguagacgccacugucaugcccaacuuguccacaaggaaauaaaggcucagagaggucaagcaaacugcccaaggucacccagcugguaaaugguaaaggcaggauuuaucuguaggcuucgaggccauuucacuucugccuccuagagcaaguugggucuaggguucuuuuuuauuuuuugagacggaguuuugcucuuguugcccaggcuagagugugcaauggcgcgaucucagcucacugcaaccuccaccuccuggguucaagcgauucuccucccucaaccucccaaguaggugggauuacaggcacaugccaccacacccggcuaauuuuuuuuuuuauuuuuaguagagacggguuucaccauguuggccaggcuggucucaaacuccugaccucaggugauccacccgccucggccucccaaagugcugggauuauaggcgugagccaccgugccuagccguuuuuuuuuuuguuucuuuuguuuuuguuuuuguuuuugagacggaguuucauucuuguugcccaggcuggagugcaauggcaugaucucagcucacugcaaccucugccuccuggguucaagcgauucuccugccucagcauccugaguagcugggauuauaagcacccacugccacacccagcugauuuuuguauuuuuaguacagaugagguuucgucauguuggccaggcuggucucuaacuccugaccucaggugaugccccugccucagccucccaaagugcugggauuacaggccugagccacugcacccgguagguucugggguucuacuguaaugagauuugggugaaaaacuaaggcagaagggaggaugaggagaggcuggcccauggguacaaaguuacaguuaggaagaagaaauuggguguuccauugcacaggagggcaaugauaguugacaguaaaauaucauggccaggcaugguggcucaugccugucaucccagcacuuugggaggccaagucgggcagaucacuugaggucaggaguuugacagcagccuggccaacauggugaaacccugucucuacuaaaaauacaaaaauuagacgggugugguggugggcgcccauaaugccagcuacucaggaggcugaggcaggagaaucgccggaaccugggagcuggagguugcagugagucaagauggcgccgcugcacuccagccugggcgacagaccaggacccugucucaaaauaguaaauaaaaauaauuuuuaaaagaugcugcuaggguaagcguccuggacuggugacugaugaugagacucuggacugaggggucucccauggugccagucucccugugccacuuccuggcaaaugaccaggcucccaagucagagcccugcuggccaaggaauuggcuucaggugggagccccaggaacccuggugagugaaagauccagaacccagagccccagcauguccuuuccgaauggcucaaaguaucccgccggacauuucaggccuguagucccuccaagcagcccaaggagcagcaccugaaucgugcccgccagauaccaggcauggccauccacagucucaccuggaacacacagccccuccagcugcuccugccucucagaggcuucccuggccgugagcagucacuccaccaggagcgaaccugaccuuggcacuccagggucccugcaaacccgccacauuagagcaccucuuggcaccgccaugcaggcagcccugguucauccacagcugacccagagcaggccucugcccgccuuccccgcauggccagcucagaucccugggaaaggcugggcucuccccaccugcagaggagcccccugccuuccaggaaccucugcaguggagcugccacugcuccaaguaaggcagacagugggaaaggggaguccagaguccuggccccaagagaccuaagcugccuuugagaagcugcacccacagugagaagcccacgccacuccugagaagcgggagauccagggaagugggaccuuuuuuuuuuucuuuuuuucuugagacagggucucguucuguugcccaggcuggagugcagaggugcaaucucggcucauugcagccuccaucuccuggauucaagcgauccucccaccucagccuccccagaagcugggacuacaggugugcaacaccauguccaacuaauuuuuguauuuuuaguagagacgggguuucaccauguuggccaggcuggucucgaacucccaaccucaacugauccgccugccuccaccucccaaagaacugggauuuuaggcaugagccaccgcgcccggccccuuuuuucuuuuuuccuaucagaaccucaaaugacuggcaaggaagggggagaagguuauuuggugacaggaacaaugggccaaggguggggacuguaugaaguuugaggagaggcagaugcuccuagccucggaagaggugggggauuccagcagggcuucugggagugguuggaggcaggcugucacuagcccaggcgcucagcagccccacuccuggccauccgcauccccaacgguggcccccagacccaagccacagagccuccccuagagcggaagcagaaggggccccaccaggaagcugugugcucacagggagguguugcaagaagcucagggagaaagcccaggagaagcagagggggccucucugccccaggcccucugaggcugucagcgagagcaggagcaccuuagaagcucaagcucuggcccccgcugaaagcccugccacagauccagcucguggaccagcugugcaagccagggcaagccccaucccagagccucaaccuugcguaccuauuuuuuuuucuuuuuuuuuuuuugagauggagucucacucugucacccaggcuggagugcaauggcaggaucucagcuuacugcaaccccugccucccagguucaagcgauucuccugccucagccucccaaguagcugggauuacaggcgccugcuaccacacccagcuaauuuuuuguauuuuuaguagagacagguuuucacuauguuggccaggcuggucuugaacucuugacaucaggcaauccacccgccuuggccucccaaagugcugggauuacaggcgugagccacugcgccuggccuuuuuuuuuuuuuucaacugagacagacacagagucucacucugucacccaggcuggagugcagcggcgcgaugucagcucacugcaaccuccaccucccggguucaaggaauucucccaccucagccuuccgaauagcugggaugacaggugcaugccaccaugcccgacucauuuuuuuuuuugagauugagucucacucugucgcccaagcuggaguccaauggcgugaucuuggcucacugcaacccuuccuucccagguucacgcgauucuccugccucagcuucucuaguagcugggacuacaggcacgcaccaccacaccuggcgaauuuuuguauuuuuaguagagaugggguuucuccauguuguucaggcuggucucgaacuccugaccucaggugauccacccgccucggccucccaaagugcugggauuacaggcgugagccaccacgcccggccccagcuaguuuuuuuauuuuuaguagagauggguuuuugccaugcgggccaggcuggucuggaacuccugaccucaagugauccgcccaccggaccucccaaacugcugggaugacaggugugagcugccacgccgggccagccuugugcaucuguaaaaugggggugcauugccuuacugcccuguggggauuugggaguggaggguacggauuuagggacaggcaggcaaggugcuugccuggaagcugcuuguguuuucaugaaggcauuaacuuuggaguggaggguacggauuuaaggacggauuuaaggacagauuuagggacaugcagggaguggagcguacagauuuagggacaggcaggcaaggugcuucccuggaagcugcuuguguuuucaugaaggcauuaacuuuggaguggaggguacggauuuaaggacagauuuagggacaugcagggaguggaggguacagauuuagggacaggcaggcaaggugcuugccuggaagcugcuuguguuuucaugaaggcauuaacuguggagcugggcaggaggugcgggccugcucccuauucacccagcacaaacuucuaagaaaccuuuggcagccucccuccccugccacugccacaccugccugcaggccacaccucccccugaguuucaggcccaaguucugccuggacauccccucagcuaccuugaacacaacaggucuaaguaaaucaggcugggcgugguggcucacgccugaaaucucagcacuuugguaggcugaggugggcggaucacgaggucaggaguucaaggccagccuggccaauguagugaaaccccagcucuacuaaaaauacaaaaauuaacuaggcaugguggugggcgccuguaaucccagcuacuugggaggcugaggcaggagaaucgcuugaauccaagaggcagagguugcagugagcugagauggcaccacuacacuccagccugggcgauaacagagcgagacugugucuccaaaaaaauaaaaaauaaaaauauaaggccgggcgcgguggcucaugacuguaaucccagcacuuguggaggcuaagguggguggaucguuugaggucaggagcuugagaccagccuagccaacauggugaaaccccauaucuacuaaaaauacaaaaaguagcugggcuugguggcacgugccuguaaucccagcuacuccagagggugggacaggagaaucgcuugaacacggaaggcagagguugcaguuagccaagaucacggcacugcacuccagucugggcaacagagcgagccuccaucucaaacaaaaaaacgaauacauaaauaaauaagggucaggcgugguggcucacgccuguaaucccagcacuuugggaggccaaggcagguggaucacgaggucaggagaucgagaccacggugaaaccccaucucuacuaaaaauacaaaaaaauuagcugggcgcgguggugggugccuguagucccagcuacuggggaggcugaggcaggagaauggcaugaacccgggaggcggagcuugcagugagcugagauugcuccacugcacuacagccugggugacagagcgagacuccaucucaaaaaauaaauaaauaaaugaauggauggauggauggauggaugaaugaauggaaccuaacaucuugucgucaacccaggggcggcucugucaugcccuugggugcuaggcuugaaacuucccugcuuuauauaccaccaaauccugcuuuuuuuuuuuuuuuuuuugagacaggguguuugcugcccaggcuggaguacagugguggagucacagccucacugcagucugcagucucgaccuccuggacucaagcaauccucuugucucagcaucccaaauagcugggacuacagaugcuugucacaccuggcugauuuuuaaguuuuuuuguagagaugaggucucgcucuguggcccagacuggucuggaaucuugggcuuacgggauccuccugucuuggccucacaaagcccugggauuggcucaaacgauccuccugccucgggcucccaaagcucugggauuacaggcaugagccacugcacccggccugaugccugcuuuugauuacugaauucacccacugcucccacaucuccugcugccaaccugggccacaccucugccuacaacagccuucucacugguccuucgccucugggcuccccuuauguaguuccacccagcaggagccagcagguccuaaaauguuacuugcucuuacaccaggagcauggcagaaaauggccuugccccgaauguuuugcagggacucgggcaggccaccaacaaaccucugcccuuggggcuggggcuggagucaucucuggguuccacaucgucauacagcucguagaucucaucugggacccugcggggauaccugagaugaggccucuucuuuuuuuuuuuuuuuuuuuuuuuuugagacggaguuuuucucuguugcccaggcuggaguggugcaggggcaugaucucgggcucacugcagccuccaccucccggguucaagcgauucuccugccucagccucccaaguagcugggauuacaggugccccccaccacaccgggcuaauuuuuguauuuuuaguagacgggguuucaccacguuggccaggcuguugucgaacuccugacuucaggagauccgcccacuucagccucccgaaguucugggagcuccaggccgagaugaggccucuuugagccccacaauccgcacccaccuccgcuuccuccccacacucacugcgggaugucuucaggcugucgguccuggaaguggagcccagcggccgagcggguccuccguagaucugugggguagagaguagggcagggaagccggcacugccugggaccucagcccccgcuccugccggugccgcccgcccucacccaccuauggaugcugcagagggucuccgaaagcucugcauauccacgggccccgggggcagcgggggcuuggcuggagggugucccaggcugcuggcagggggcagaggccuccgccgggguggauggcugggucugaggccuggccuggccccuccacugugaaccaggccuccugaccuccagcggggugucccagccgcuccaaacccagggcugagcgggugccgggagcugaagccggccacggccgcaggcagugagcucucggaagcggagcuggggaguggaggcuuucgagggagaucaccgaagaacucaggcugcgggugucucuugaggacagcgcugggcucaggcugugagaacuugcgggguggcccccggcgcuccggcugcagcagcuuccuggggagugaguugaacucgggcucugaggagguccuggggaggccgcccagcucgggcugcgggggcuucuuggagagcgcuuugaauucggccggccgcggccucuugggaagcacgcugacuucgggcucugaggagguccuggugagguccccaagcucaggcugcggaggcuucuugggaaagucacucagcggaggcugggaggccuuuuugggaaaggcgcuggagucgcgcuucggcucgcuggacugaggcuuccagaggggagucugagcggccucgcugaacucaggcugcggcacggacuucuuagggaggccaccgaccugaggcugcggaggcuuuuugggguacacguugaacucaggcugcgcaggcuucuugggaaagguacucaacucaggcugcggggaccucgggguagccucaccggccucggguugccagagcuuccuggggaaugcgccggauuuggguucggaggggggucuggcggggugacugaguucgucgggcugcagggguuuccgggccggcgcaccaggcuccggcagcgaggccuucaaaggggccucaccgaccucaggcugcaggggcuuccuuggaaacggaguggcccccagcugugggaacuucuuggagaggucacucaacuccaguuuggacggcuucuuggggaggucagugaccucaggcggcgggggcuucuuggggaggucagugaccucaggcggcgggggcuucuuggggaggucagugaccucaggcggcgggggcuucuuggggaggucagugaccucaggcggcgggggcuucaaggacacugcaccaaacucaggcagcggggccuucuuggggugcucgcuuagcucaggcugggagaacuucuucaguuuaccaaacucaggcuucggagguuuuuugggcaggucgcugggcuccggcugagaggccuggaacuuugcuuugaugcuccggaaguccugauggcucuccuaggagacgcagagccaaugaggcaggggcucaaacacacagaaggggcauggaaggaugggccuggggacccucaggcacagcccacaaccaccaccccugcgcccaggcccggucagcccucagcucuuucccaggagcccccauggauccuaggauccugggaccgacaccccucccuacuucuccauuuagugcugauuccacacccaaccuccucuagcagcacuggagaucccgacaucccuccugcagccuccagucccacugcccuccccccaugggugguaccccacccccccagcauccuugacccccucauucuuucaccccucccacugcaugucuccagucucguuccauugcccaggcuggagagcaguggugcaaucauagcucacugcagcuugcaacuccugggcuccaaugauucccccgaccucggccuccccaguagcugggauuacaggcuugagccgccgcgcccaggcccccagucccuucugugcuaauuucaaaacacauccggaauccaaccacuucucacugccuucaccacugucaccccaggagguagugggaggcagugucugcccucccccaaccaauugccuggauuacucuaacaagcccuucccugggccucugccuacccccuucccuggucaguuccccccauggcagcuggagggagaagccuguugaacccugagucuguuugugucccucugcucaaaacucggcaaugcuuccucauguccccacaguucaagcuaaaugccucauaaaagccugggcgaaccagccucccuacccagccaccuucuccucccugcacccugaacacuucccuccgaccucggggccucugcccugucccugacccaggacaugucucugcaccaccugggucucuccuuuuccuccucccagccucuguucucauauuuucuuauuagagaggccauccaaggccacccuauuuguuuauuuuuauuuuuugagauggagucuugcucugucacccagacuggagugcaauggcgcgaucucggcucacugcaaucuccacuucccagguucaaaugauucucgugccucagccgcccaaguagcugggauuacaggcacucgccaccacaccuggcuaauuuuuguauuuuaacuagagacaggguuucaccacguuggccaggcuggucucaaacucacgaccucaggugauccacccuccacccgccucagccucccaaagugcugggauuacaggugugagccaccgugcccaaccuagaccacccuauuuuucuuucuuucuuuuuuuuuuuuuuuuuugagacggagucucacucugucacccagguuggaaugcagugguggaaucucgccauacugcaaccuccgccuccuggguucaagcgauucucagccuccugaguagcugggaucacaggugucugccacgacgccuggcuaauuuuuuuuguauuuuuaauggaaacaggguuuuaccauguuggccaggcuggucucgaacuccugaccucaagugauccacccaccucggccucccaaagugcaugagccaucacgccuggccuagaccacccuauuuuaaauggaucaccccaucccacuacugcccugcauucagcaugcaugauuuucuccaucguacccaccccuacguauuauacuauuuuacauuguuuuuaaugugucuugauuuuuuuuuuuuuuuuuuuuugucucucuacaccacaacuucccucaguuccucagccucugcaaggcagagacuuggcucauucauugcugucuucccagggccuggaacaugguaggugcucaguaaauauuugcugaaauaaacaauauucaggcagcacaaagacagccauguacucagccugaccaucaggaaaacacagagaugccuggagacggccaugcggucccucucacaccgucucugacaugcgggcugauggucaggaaugcucacaguugacagugccugagaggauuggugcagacaccgugggcacaggcgcugucuccugcauacccagcugucccagcugcccuccuagcuggcccugcaaccacuccucacagagguaggcagauucacaagaaggccaggccuccuuaguccuacaaacgccccuuucaccuguggucaaggagauugggggagggaaagggcagaaacguguggccuuugcuuccugcgugugccucacuuuccccauccagaggaccagagaccaggauugcuccuuggaaaggcagcaauucccaccuggggccugaagugccccugucaaagccccgagugguuugaaggaagugcucccgggcgaccacagggcuagauaagucaggguuagcaggucacaacuugggugacuggacgggggagggucaugacccacuuugucaccccgcaggaaagcacugcucucaccccagcagcccguucccacauggcugcucauguugaccuggggagacgggaguuguccccccggggagucccaucugucccccucgcagucccaaccugagcgugaacccccaggagcccgcgcuguccuggggugugccugguggccgccuaccucggguccuuuuugccgacccuucccguuucccagaugucuuucgcagccaccccccgcccccccgcccgccccuccacagguggauccuauccuucugggaacaucugugucccuugcuucccagccagugaggcacaggccucuuccagcacucaccauggcugcaggcaggugaugggccaugggaugagugggacccgagcuggggccgcugccuucaggaagugacuguggcuucugcuccacggucagcacacagggugggggcugcuagagguggggcgggggagggcagaggaggaagggaaggagguggggaggcuccaguccgucuccagauccugccagccacuucuuuuuuuuugagacugagucuugcucugucgcccaggcuggagugccauggugccaucucggcucacugcaaccucugccucccggguucaggcaauucuuuugcaucaaccuccugaguagcugggauuacaggcgcgcaccaccgcuccuggcuacuuuucguaucuuuaguagagaagggguuucaccauguugggcaggcuggucucaaacuccugaccucaagggaucgguccgccucggccuaccaaagugcugggauuacaggugugagccacugccccggccccugcugggcacuucuauuucgcuugaauuccuguccugccugcuacugucccaagcuuggggcacugguugcccgcauguuccuaacauggucacuaguuucuuucuuuuuuuuuuuuuuuuuuuuuuuuuugagacgggguaucacuuuguugcccaggcuggaguguaguggcgcaaucucgacucacugcaaccuccgccucccagguucaagcgauuguccugccucagucuccugaguagcuggaauuacaugcaugugccaccacugccggcuaauuuuuuguauuuuuaguagagacgggguuucaccauguuggucaggcuggucucaaacucccaaccucagaugaucugcccgccucggccucccaaagugcugggacuacaggcgugagcaaccacgccuggccaacuaguuucuuacucucuauaguccccaucauuccuacuacuuugguguccccaucucuggacuccagggaggacuccaugccaggcccuggugaccuccugggcuagagagccacaggauggggagaucucagcagaucagggguacggacagcucugggguuuaggaggcuccuggggaggcccagaggcccaggacgugggggcccaugugaccgggugaggccucugcugucugcccugguuggcucauccgccuuccucauuucaacacuuccaugaaauccaauucccggcucugagcaggacucacuuguucuggggcagauaucacaggccauggaugucccaggcugccgcccugggcagaaagcuuagcugguacagcagauuugggggucggugggugaguggugucaaaggccuugcaccugggccacgcacgguggcucacgccuguaauccuaacacuuugggaggcugaggcaggaggaucacuugagcccaggaguucaagaccagcuugggcaauguagcaagacuccaucucuacaaaaaauauaaaauuagccaggugugauggugcacgccuguggucccagcugcuugggaggcuggggugggagaaucacuugaacccugaaggcggagguugcagagucaagaucacgccacuguacuccaugcugggugacagagagagacuccaucucaaaaaaaaaaaaaaaaaaaggcuuugcaguucuggaggagugagggggucugaggacccgaggacacaccagauucccagagguuagagguaguagagagaagaggaaccaggagacagagacaggggccaagagggggugaaggcagucacuuguggugccgaggacuggccagauaaggacaagcccugaccacagagcucagcccacaggagaucaguaaucuccgucacgguagacaaagggagaaaacaccugcuaagagaguagagagcccugguuuucaguuugagcacauguuggaauugccugaacaguuaaaaaaaaaaaaaaaagaaccggcgguugggcaguguggcucacgccuguaaucccagcacuuugggaggcugagucggguggaucaccugagguugaucaccugagguugggaguucaagaccagccugggcaacauggagaaaccccaucucuacuaaaaauacaaaaauuagcucggcgugguggcgcaugccuguaaucuuggcuacuugggaggcugaggcaggagaauugcuugaacccaggaggcggagguugcagugagacgagauggcuccacugcacuccagucugggugacagagcaaaacuccaucuaaaaaaaaacaaaacaaaaaacagaaccuacaagaaacucugacuuaaucagucugggguguggcccgagcaaguauuuuuaaaacauuuuaaaauuuuuuuuuugagacaaagucuugcucugucucccaggcugccucccggcuucaaguagcugggauuacaggugccugccaacaugcccggcuaauuuucuggauuuuuagcagagcuggggugucaccauuggccaggcuggucucaaacuccugaccucaagcaaucuacccacgugggccucccaaagugcugggauuacaggccuuagucacugcgccuggccugccuguuuucacgccuccuuuaagagcacagacaucaggauucugccaucucuguugugccuuugcauccuguccuggggcacaguucccagauguggguugcccucccaaaaaggagucucgggaggacaguaugggcucucugugggucuccagaaccuuggcaagugaaggaaagaaugaaagaaagaacaaguggccaggcgcgguggcugacgccuguaaucccagaaguuugggaggccaggcgggcguaucaccugaggucaggaguucgagagcagccuggccaacaugaugaaacccugucucuacuaaaaauacuguuugugcacaccuguaaucccagguaccugggaggcugaggcgggagaaucgcuugaacccgggaggcggagguugcagugagcugagauugcgccauugcacuccaaccugggugacaaggcgagacaccgucucaaaaaaaaaaaaauuaaauuaaauaauaaaaauaaguaaauaaauaaaucaagcaaugcuuggccacaguaaggagcucaaucaagguaauuaaaggauuggaugacagcugauggauucccaggugccugggcuggucacuacccgugcacucucgcagcuaggaggguccagccagggcgcgcgcaccaaggccccacgggggcgccgugggggugaagcgcaggucccggagcuguagucauggugcgccuccccgccaacuacccuuuguguauuuggcgccuccguaggggcucccggcaggguuccgcgcggcgcggcugcagacagggacagauaggguuaccggaaucccggagaagggagcccggaccaggggagugagaguucguuagggcgcgccuuggggaaucugcggggucggaaacgcgaacaacggugugcagggggaggagcccggggagcacgugggcggcggaucccagggccgcagggcgcccuccaccuccccgcuccuggcccgcaaugaggguaaccggaccggcaccugcaagugacagcuggggcuggacaaaugccgggcacgggccucuggccggccucagagcuguucagcgcgagcccgcggcuuccagccaaccugcccgcuauccccacugcucucccggcuuucauucccccgagucugagauuccugggcgcccccugcugggcggagccggggcccaagagggcugggcuccugugcauggggguugggggccggcuugaggguaggaggucguuucugcaguggacagggugaacgguggaggacagguggugagccagcuccccaggccucgcggcagucaguucacuccagaggguagugugguggccgugggcccgcuguacacacaggaagggcugucccaucuccgugggugaugggguaggggagaggucccuggacggacguguuggcucuagguuucucuggaaagauacugacagacugggaagaggcguggccuagaucuggggguggccgaauaaagaaacugauggggacaaagacuccugggggcccccgggacccuggagagggguuaggggccugggggacagagaacacagcgcugucccuggagaugggggagaggcuuggacuacagccagaucuagggaccugcagaaugcgggaacaggggcguguccucuggaccugcuggcaggguuuucucuucucgugguaaccgugcgcagcucccaagauggugcagaaucagugccgcugacugggaacuggggcuggcuagaggccuccuagccucaccuucucuauauaucuguaaaaugggccccuucacccugucccacccuccuccccaggucgagagagucccaggcagccaugggcucgggacgugaaguucucagcagacauuucccaagccccuccucucccugcagccucucuuuucauccucgcguccaccccaaaggacucaccagucaucaugacacccuuuuaaggacgagggaauugggaggcagggaagucgacucuuuuccagggucccacaguggugguuucaaggcuucuggcugagaagggggagcuuagggggccuccugauggccuguccuaccccauccugacaaccaccucagcuggggccuacagguucugggagaguggacacccagcccaagccacgucagcugaggcugcugccccgucacaucacagccccaucaaggacagagcagucuucaggccccuggugaggcggugggcaguggggcagacagacgggucccaagggccugaggauccccuccugccccuugcaguggcugaagggcuucuggagcccagagcuguccaucuuugaggugacauggcacugagcagguguggggcagguggcccuuggcuugucuaccuggauggcuuugacucagagccugagguggacacguugguggaugaaaaguccaaggaagauaggugcgguggaucacgccuguaaucccagcacuuugggaggccgaggcgggcggaucaugaggucaagaguucgagaccagccucgccaacaugcugaaaccccaucucuacuaaaaauacaaaaaauuagccaggcaugguggagggcaccuguaaucccagcuacuugggaggcucaggcaggagaauggugugaaccugggaggcggaggcugcagugagcugagauggugccacugcacuccagccugggugacagugcgagacuccaucuuccaaaaaaaaaaaaaaaaaaaaaaucugaggaagacaacaaggaggguggcggggggcaaggagaaggugggagggcagugacggaggaguggggucugggggccccgcccagggguuacuggugucucggcugcagauaccaggaugaggaggugagggggaaccccgaaguggauucagagaauggagaaaggaggaggagguaaggauugagacaagguggacugcgugaaggaggucccuggguucuugcucacaggaugucuguauauccaggaggaugagggagacagugaguguuguucugggaggggaccgagagguucaagguagggccuugugggcuacugggagaacaggaucuucauccagagggccaugggaagccacugaagggugccgggcaggagaggggaacaaucagaagagacccuggcagggcgugguggcucacacuuguaaucccaguacuuugggaggccaaggugggucgaucaccugaggucaggaguucgagaccagccugaccaacauguugaaaccucaucgcuacuaaaaauacaaaaaguuagccggggugguggcaggcgccuguaaucccagcuacuuggaggcugaggcaggagaaucaugugaacccagaaggcggagguugcagugagagcugagaguguaccauugcacuccagccuggcacugccauugcacuccggcgagacucugucuccaaaaaaaaaaaaauaaauaaaauaaaaagaggaagaagagacuguuuucuguuuucagucuugggguaagggcagguuggggagaguagggggugggcuaggggacccuggggcuggcgagaugaggauagaagggagagggaucauggagguaaaaccagcuuccaagggauggcuguggauaucaccugggacuuccauaccugggaggcuggcuucaggggugaggagaaagaccaggccauggagggcuggccuugacccaccccacuccucagagcugggacaugguggaaauuggucuggcagacagcaaggaggaugaagaccugaguccccagccugccuccccaaucccaaaggauucuuccccuuaagucaguaugggguucagggucugggggucuucaggccauccuggccagucccugcacuuucucaggaccagccuuccagccuguccccgaagcuccugggauuuuuucuuuuuuugucucccaggcugggguugcaauggugugaugauggcucacugcagccuugaacugcugugcucgugauccuccugccucagccucccagguagccaccacggcuauuuuuuuuuuuuuuuuuuuuuaagacagaguuucacucuaucacccaggcuggagugcagggucuugaucucggcucacugcaaccuccaucccaccggguucaagcgauucuccugccucaggcucccgaguagcugggauuauaggugcccaccaccaugcccgacuaauuuucauauuuuuaguagagaugggguuucaccauguuggccaggcuagucuccaacuccugaccucaagugauccacccacuucggccucccaaagugcuaggauuacaagcaugagccaccaugcccagccaugccugauuauuuuuuguauuuuuuuuggugggcggggagguagagaugcgaucuugcuagguugcccaagcuggucucgaacuccuggccugaggcgccccuccugccucagcuuccuaaagcacugagacugcagacauuagucaccucuccugguuacgggauugcuuuuuaauuuucuuuauuuuugagauggaguuccacucguauugcccagacuggagugcaauagcacaaucucagcucacugcaacuuccaccucccagguucaagugauucuccugccucagccucccaaguagcugggacuacaggugugcgccaccacaccuggcuaauuuuuuguguuuaguagagaugggguuuuaccauguaagucaggcuggucucgaacuccugaccucaggugcuccaccugccccagccucccaaagugcugggauuacaggcgugagccacugugcccggccgggacuucuuaaaagaaaacuggagaccgggcgugguggcucacgccuguaauuccagcacuuugggagucuaaggcgggcggaucaugaggucaggagaucgagaccauccuggcuaacgcggugaaacuccaucucuauuaaaaauacaaaaaauuagccgggcauaguggugggcaccuguaaucccagcuacuugggaggcugaagcaggagaauggcgugaacccaggagguggagcuugcagugagaggagauugugccacugcacuccggccugggagacagagcaagacugucucaaaaaagaaaaaaaaaaaaagaaaaaaaaaaaaaaagaaaacuggagaguccccaucccauuugguuucuggacaagggagaacgcugccacaguggguacuggggaccucaaccacagcuggagguggggaccugggucccaggauuggggugaugggaagacaggacacaggugggcugugaggccugcaccuguggacccaggugguccucccaagaugugaucaauccaugacugcugggcucgagcccacuaugcuuuggauggacaagggaugggaacacagcauaggcuggcucauggcgccuucuuuauuguccaccccagccccccuucccugcagcccccuccaaaugacaaaacuacccacaucccauggcccacccccaaagcggcgggauucagagcugcgagaacacuggaagcucccccucugacagcagcggcgacaccuugggugcaagcggggccggaucuggguggggcagaggaggggggcgccugagccucagcgccuugggcccccgccccccucuccacccgcgcauuccucggccuuacccgcgggggcgucggggcgcggcggcccggccgcgggggccgcgggggcgccggggcggugguccuccaggugcagggucauggcgggccgcgaggccguggagaaggcgcacugcaugcacgaguagcggccgcgugugugcucccacacgaugcggcucggggccgcgugcccugcgggcaggcgggaccccgucagucccgggcucccccagcccagaagacccgugcgccaaggauggaggacgccggcgagggugggugggacuuuuucccgccccccaucagcuuccgggcgccuaguucaguuucucccgggucugucugccccuagaguugggggcacccaacuuggcuucuccgcguccccuacuaucauccccagauucacuguuggggagaagcccgcuccgaggugaacggugaaaggggcgcaagguuuauacgggaacgccggcgcagaugaaggcgcaggugccagucauuuuuaaggcaaaaauccuguauuucgggacgguggcauuugugcccccugggaaggggaugagcacugcugccuccugguauccaccagaccccgcagggcgcaggaaagaaagccccuccaccccucccugguggucaccugcacgcaccugagggcgcgucggagccgcccuggggucuucgggggcugcugccagcaccugcgguaaaggggcgggucaaguucagagucagggcgagcccagccagcccuccuggaggcccccgaccccacacucaccuuggcucuuuuuccagacggcggcgcuggaagccggcggcccgggugcagcggccaggaaggggcgcaggcgcggggggcuuaggccaaagggcgcaggguucaaguagggcaggaacgguccggugggggcaggggcgggggucgugaaggguuccagcagcgggaacggcaggcccggcgcugaugcggggucaaccuccggggggcgcuccggcgcgggcggcucucgguccagggccggggguggcggcggggcugggcucugcgcaugcuccgcgcaaacaugcaggugcuugaagagcgagcggugcgugcggaagcgcaggaggcaguucucacaccuggaggugggcagagggcugggcugggcugggccuccaggggcaccagggagaguguccugugcaaugccacccgcccuucgagcgugggaacggagccugggcacuaaucaccuccccgcuccuguacaacuguggcagcgacccuuccugaccacuucgggugggaaccuggggaaacccggaaagaagucucaauuuuaaguuaggcggccgguuuuccacuugggagguaaagccuggcuggguggggccacgcccacguaugccccgccccauccagggaguugagggcggggcuuccccaaaggcccacccacaucaagucccgcccuccaacacccugaccaggaagggaggaaggccuggagcccacacauagggugaggcuagggcagggcggagcucaagaggucagggucucacuugaaguagcgauuggguuuguagugcaguuugcugugagccaccagcuccugcaugcuggggaaggucucggugcagcucagggcugagcagcggaagagcuugccugguagggaugaaggacagagaaguggagacagguggccaaggcuggcuccgaggggcuccgccuguuucccacccuaaccugccuccccauuaccaguccuggcccuaccuuccagggacugugugggcgggcaguggguucgcagaugcugugccaggucacggacgcugggaaaacugaggcagcagccagggcuggagcaagggauuugcuucccugcaggacgcacagaacaguggucacuggucccuuccucacuagugcugucccugaccccaggguucugccccagagaagcaaauaugaugugcuggggccuuuacucucugccuaccacaacagacuggucugccacagugcaggggcuggacuggccaggcucaccauuggagccacagccuggcauccaccggcugcuccguaaaaugaugaguggcaucccucuagaaaggcccugagguuagagauucucuacgucucgcuucuauuguuucagggacugugauuccccagaagaccccaucacagaucaccuggaggugggcgucgucugggaggccgcagguccucgcuggucccggagacuaugcuggucaggccagggcuggguccggggccaggcuggcagcugucuggggcuggggaggagcccugcugcaucccuccagccccuccacguucccacacuggcgguguggcugccugcucagggccuggcuccuccgacauggaggaggaaggggcugcagcuggcacagccggggacaacaccuccuugucggucucacuggagcugggcucugcaguggccagcaugucugggaugggcccugaggguuucuccuccugguggaaggaagaggcggagagaacccuucugggcucugggucaacccagucggcccccauccuaaggaaucaccagcaggagaggauaggggaauacguaaggguggacuaagcucuuuuuuucuuuuuauaaagauggggucucgccauguugcccucacuggucuugaaccccuggucucaagugauccuccugccucagccucccaaagugcugggauuagagucgucagccacugcacuggcccggauugagcuccuuaugcauacgggagaaacaucugcucuccucaacuaggauaggugggagccccaguaugcacacaagcguggccuagagggagugggcggggccaaggcuacggaggcggggcuaugggcaggcauggacugggaagaugcuagaggagcuagacauggauugucugaggaccgagaccggccggccucgagcaguguggacaaucuuggaggugcugggggcccggauguaagaaguuuaggggcggaguccuagccugacgggcgugguccauuccgggccgggcccggaaguagggcgcucuccgagugacagccagcggcggacgggugcccggaugugggggcggggucggccggaggcuguaggcgcgacagggccgcuccccgccaguccccgcagcuccgccgcgcccgcgaccccggugccgcgcucaccaucuucgacacggcucggccucuuguuucugcggcuccggcggcugcagcuuaggcggcggccacccucugggcagugcgaguucgcgcucacgucagcgccauuuuccaccucucagcucucg

SEQ ID NO: 18288 - RNA, 20719 nt, Homo sapiens
aagcguaguaggaauguuuuauuagcaaagaaguuucagagaguggguggaucagggcucuaucacuugguccccaccucaccuugguggggccagagugagccccuuccugccacagucaccccaacugaaauugccuuucucuucggccaguguuagccucugagcaggggacccuggacccuucugugcgccaaaggcugaggugacugacgaggagaucuccccacagcuagguguagugagccagacgaggcagcuuacugaaccuggggguucucuccauugucaccgcauucuccuucaccagguguggcugucugggagccagggggugacucgcucuggagagaggggaaaagaggggggccugcugcaaucuccuugaggcaggaaacgugggauucagccccagccucacuuaguggagguucuuuuaccauggacccaggcugccugguuuguauccaaccucugccccuucugaccuggaagaggcgcuugaccuuccucccacaucccuuccaguggggugaguacagguguuccucaguuuacaauggguuacauuccggugaguacaucauagguugaaaguauugcaaguugaaauguguuuaauacaccuaaucucccaaacaucacagcuuagcaugguccaucuuaagcuuguucagaacgccuuagccuguaguuggggaaacucgucuaacacgaagccuguuuuaauaaaguauugaaugucuuauguaauuuauugaauacucugcugaagugugguuuuuacuaagcacacauugcuuuuaugcuaucaugaagucaaaaaauuguaaguugugccaggcgcgauggcucacagcuguuguaaucccagcuacuugggaggcugaggcaggagaauuucuugaaccugggagguggagguugcagugaacugagauugugccgcugcacuccagccugggugacagaacgagacucuugucuucaaaugaaaaaaaaaaauuagcugggcaugguagcacgugccuguagucccaacuacuugagaggcugaggcagaagaaucgcuugaaccccagagguggagguugcagugagcugcagucgccccacugcacucuagccucggugacagaggaagacuccaucucaaaaauaaauaaaaaaugguaaguggagccaugguaaauuggggucaaccuguacaggaugagugggcugauuagauaacuuggauuaugaaagugcuaaaacauccuggcacuuggccaucagaguauagugguguuggggguuaauguguucugcaaacucacccagucuccaguucugaagcucuggacccccuuccccacccugccugaugccaaagggcuccuuuuuccuuugauaagagccucccuggcaguagguaacaggagcccaggggcaugcaugaaaggucuuagcuaggucucugugaccuuagguuacuuccccccuugaggacucagucucaugaccugggguagugucaaccucacugggguuuugcugcuuucacaucaaaucccagccccugccaggcgcucugguuucacaccuguaaucccagcacuugaggaugcugaggcagaaggaucccuugagcucaggaguuuguggcugcagugagcucugaucacaccacuacaccccaacccggguuacagagugagacccugucucccaaaaaagaaaagcagccacauaggagaauccagacacugguucugcaccccuggugccaccuuuggggagcagaaagggaggcucagggcauauuuacuauccucugcaaacugaauuugcagcugggaaaguuuguuucuuccagagcugugcucaccugggugucgggcuggcccgagcucaggugggcauguagcagagcggccaccucauccugcucagccuccagggcgauggccagggcacuggugcccuccuguggaacguuagggacagucagaucccugagccaagccaugggcaccccccaagaugccagccccauuguggggucuuacauuguccaggauggcagggucacagccuggcugggugagcagcagccgcacgguguccaggcgcccauacucacuggcacacaucagcgcuguggccccauccgcauccugcgcauucacaucagccccacacgccaguaggguugccaccauguccugucggccauggcugauggccagcaugagggcugucugccccgucuggggaguggggaggaagagggaacaggcugggguaggcucagggaagggaggucacagguugacucccaaaguggaagugacuccuggcugagagccacagugggggcgcccacgcaccugacuggccuuggcauugacaucacccaugcagaagagucucuggaccacagccauguccuccucuuccugccucacagaggugagugcagccagcaugagggccgaguagccggcucgguucuggcgguugaccucgcaggccccugggagagaaaagggggccguccacggagaugccaacaccgcggcccgacuugauccacucaccucccugcaagccucgggcacagcaccugcauaugggguggucucaacguucuccccacaauagcuaccugguuccucccucacuaagguguugcucaaauaccaucugcucagugaaggaccuuccuguuucaucuuuuuuuuuuuuuuuuuuuuuuuuuugagacauagucucgcucugucacccaggcuggagugcaguggugcgaucucagcucacugcaaucuccaccuccggaguagcuggaacuacagcaugugccaucacacccagcuaauuuuuguauuauuuaguagagacaggguuucaccauguuggccaggcuagucucgaacuccugaccucaagugauccacccaccguagccucccaaagugcuggaauuagaggcaugagccacuggcccaguggcuauuucaaaucaagucccuguuucaaaucaggcagggacuugguuuuguuugcuucuguaucccucaguacuuagaacaauacuuggcacauaguagaugcucaguuaaacauuuguugacugaauaauaaaaggauauguuuauuuucauggccaccacccgccaagccaccaucauugcuccccuaaagaacagugccagccuccacccuucucucugaauccacuccagguuccacacagcagccaggagcaacuauuuauuuauuuagagauggagucucauucugucgcccaggcuggagugcaguggcacgaucucagcucacugcaaccucugccucccagguuuaagcgauucuucugccuuggccacuugaguagcugggauuacaggcaugcaccaccacgcccagcuaauuuuuguauuuuuaguagagacgguuucaccauguuggucaggcuggucucgaacuccgaccucaugauucgcuugccucagcuucccaaagugcugggauuacaggugugagccaccgcgccuggccaagagcaacaauucaaaaugaauuugguugccaggacacuggcucacgucuguaaucccagcacuuugagaggccgaggugguugaucacuugaggucaggaguucgagaccagccuggccaauguggugaaccccaucucuacuaaaaacacaaaaaauagccaggcgugguggcaggcaccuguaaucucagcuacucaggaggcugaggcaggauaaucacuugaaccugggagcugcagugagccaagaucacgccacugcacuccagccuggguaacacagugagacccugucucaaacaaacaaacaaaaacaccugccaacaccuugauuucagacuucuggccaccuguuguaaaaaaaaaaaaaaaaaaaaaaaaagccaggugcaguggcucacgccuuuaaucccagcacuuugggaggcugaggcgggcggaucaugaggucaggagauugagaucauccuggcuaacucagugaaaccccgucucuacuaaaaauacaaaaaaaaaaaaaaaauuagucgggugugguggugggugccuguagucccagcuacucaggaggcugaggcagaagaauggcaugaacccgggggacggagcuugcagugagccgagauugcgccacugcacuccagccugggugacacagcuagacuccaucucucagaaaaaaaaaaaaaaaccugccaacaccuugauuucagaagucuggccaccuguuguuugaagcagcucacagugauacuuugauggcagcccuaggaagcaaaacagccuggucaacacugccuauccugaaugaaacacaaacgugagcucaguuuccucugggaucaguucuguuaccauccuggucccuguuccucacagugccuguuuggaugauauuuccuggaguggcuguuuuaaucccugucuccugccauucugaaggcucugaggauugagguaguuuaaggaaaugaaugagaagcuuggggaaaggagcggggucggggucaugagauggauaaccuagugaggaaggagagcugagaugagggacugaggaguaaaggguuaagucaaaugacagcaaaaauggaggccaggcauggugacuaacgccuguacacccaaaugcuuagggaggccaaggcaggaggaucacuugaggccaggagucugaggccagccugagcaacauaggaagacccccccaucucuuaaaaaauuuggccggacacgguggcucacgucuguaaucccagcacuuugggaggccaaggcaggcagaucacaaggucaagagaucaagaccauccuggccaacauggugaaacaccgucucuaccaaaaauacaaaaaauuagccaggcgugguggugugcgccuguagucccagcuacuugagaggcugaggcaggagaaucacuugaacaugggagacagagguugcagugagccaauaucacaccacugcacuccagccuggugacagagcgacacucugcuccccgccaaaaaaaaaauuagcugaguguggugguucaugccuguggucccaaauacucaggaggcugagguggaaggaucgcuugagccugggagguugaggcugcaucacgccacuacaccccagccuggaacaaagcugucuguaaaaagggguuggggggacguucccuguuuggguggcaugcuguguggguguccaugccuuccacuaagacaccguguaaggcgucagguggucagggaggagcacccagaaauaaccagagugggguccuugcaggcuagccaaggacccaccuaucuuccugcucccucucccuuuucucuugcagcuaccuugaccuugcuuaacuaaagaaucacccuggcuaggcacaguggcuuacgccuauaauuccagaacacuggaggccaaggcaggaggaucacuugagcucuggaguucgagaacagccuggacaacagagcgagaccucaucucuacuaaaaauacaaaaauuagccgggugugguggagaacgccuguaauccccgcuacuugggagacugaggagggaggaucaauuaggcccaggaguuggagaucagccugagcaacauggugaaaccccaugccuacaaaaaaauuuaaaaagaaucacccuuuguugacuucauccccugguugucuucugcuacggcccuuacuagcauuugaaauuauuucacguuuuuacuugauaaucgucucucuccacucuucacucaccacccccaccacacacacacacacacacacacacacacacacacacacacacacacucaaaacuacacauuccugaaaguucugugggagcaggcauuuauucaacacuugacgguuugcuguggguuugucaggcaggcagguagggucgggugagagagggguauggagaagaauccacaacaggcugaaggaggaugacagaggcaaagagacaaggggugggggcagugaaacggagagggagcaguggguaauuguccccgcaagguccaaggauuacuggaguuggggaaugggagccugugagccgagaagcugggaggugagggucgggaaguggggagcugagaagugagauucuguaacgggcacaacuauuagggacaucaaggucuggggcugauguuauaccuguaaagcugauguggggcagagucaaggucaaggaaggagagcagccaggagguugcagggaucaugggggaggauguugaaauugacaagugggccgagcgcgguggcucacgccuguagucccagcacuuugggaggcugaggugggcggaucacgaggucaggagaucgagaccauccuggcuaacacggugaaaccccaucucuacuaaaaauacaaaaaaaauuagccgggcgugguggcggacaccuguagucccagcugcuggggaggcugaggaaggagaauggcaugaacccgggaggcagaccuugcagugagccgagauggcgccacugcacuccagccugggugacagagcgagacuccaucucaaaaaaaaaaaaaaaaaggaaauugacaagugccggcugggugcgguugcucacuccuauaaucccaauacuuugggaggcugaggcgggcagaucaccugaggucaggaguuaaagaccagccuggccaacauggugaaaccccgucucuacugaaaauacaaaaauuagccgggcaugauggcgcuugccaguaaucccagcuacucgggaggcugaggcaggagaaucacucgaacccgggaggcagagguugcagugagcugagaucugagaucacaccacugcacuccagccaggcaacagagcaagacucggccucaaaaaaaaaaaaaaaaaaaaaaaaaagacuaacuauagaaugcucuggaaaugcaaucuugagauaaggaggaacugacuggaacagccuaggcucuguuccuguccccaucuagaaacagguuguccuuuaaugcauuagcccagcaauuccuguuccccaggguauaaaaccuagagugggccgcuuuccagggucccucaccugccgugcaaguggggcaccugcagaccagauuccauacaccuugggcagccuuccugagccuugggggauuggcucacugucaaucuuaggcuucugcugucccuugcugccuaucuguaaauaaggaaccugcuuuguguaacuuguuaugugaaugaguauucuaccuuaccagacucaggcagguaggaaaagcacauuccuaggugcaaugggcugaagggguaaccagugcacaguggaccugcuuugcagcaaggauuaggcuggagggagagagggagaacuggccaggagcuaaaguucaagaaaggaggagcuacuugaggucagagguagaagccagagaggcagagugaggaggggccuagucagugacaagaugcuccaagguaggguuugagaaggaagagggugaaaggucuggaaguggagaagaagagcaaagugcacacccacguaccuccagacucuggauuccaggggaugaaagaggaaacagccccugaaugcaggggcguuaguguaugugacagcaagcaaguacaggcagaggggagaugaguaagaaccaggggaaggucuggagagguggagccaaaugggaauuagaggcugggcacacuggcucacgccuauaauaccagcacuuuaggaggccuaggcaggaggaucacuugaggucaggaguucaagaccagccuggccaacauggugaaacccaucucuacuaaaaauguaaaaauugucugggcacgguggcucacaccuguaaucccagcacuuugggaggcugaggcaggcggauuaccugaggucgggaguuugagaccagccuaaccaacauggagaaacccugucuguacuaaaaauacaaaauuagcugggugugguggugcaugccuauaaucccagcuacucgggaggcugaggcaggagaaucacuugaaucugggaggcggagguugcagugagccgagauugugccauugcacuguagccugggcaaaaagggcgaaacuccaucucaaaaaaaaaaauacaaaaauacaaaaauuagcugggugugguacacgcgccuguaaucccagcuacucaggaggcugagacauaagaaucacuugaacccgggagguggagguugcagugagcugauauugcaccacugcaguccagccugggcaacagagcaagaucuguucgaaaaaacaaacaaggccgggcaaagcggcuaaugcuuguaaucccagcacuuugggaggccgaggcaggcagaugaguugagguaagcaguuugagccuggccaacauguugaaaccccgucuuuacuaaaaguacaaaaauuagccgggcgugguggcgggcgccuguagucccagcuacucgggaggcugaggcaggagaauggcgugaacccgggaggcguagguugcagugagcagagagaucaugccacugcacuccagccugggcgacagagcaagacuccauaucaaaacaacaacaacaaaaaaggggugggggggggauucaaauguaggagauaaaggggccaaggagccuggggccucuugcagugaccaacgacgccuacuuccuugccgcagccccagcccccuuuaaggcaugagaugcccaaaaaauucacuuagauucauucacuguccccugucuccuacaaugccccagcuuccagagcagcuauauccuuuccuaggucauaaagaccugcagggaugggagggaucugcguguuuaggggguugggggcaggcagugggacccgccucaaccugcaguuaguaccagaggugcccaaaggcugacucagagguuucugaaccugcaggaggguaccuggagggagggggcuccugguggacagcgauuuguuuaccacccaccagacccuuugugcccaguuuaucagggcaagcagcuggagguggguggggcacagugccccaucccaggaggagucagagcccugccuggugaguaccuccccuccaggcuggacacuggggcucaggaacucggugagugcuccagcuggagauucagggacagagcacaugcuggccauuuacugaucucguacuaccuguauuaucauagguacccagggagggaggccuugccaaccccauuucacaagcaagauuaaauaaugccccuaaacugagguuuaccuaaguccagaacuguguauucccuccagcugcaaaguaggaggagccucagggcagaacuagggguaugguggggccaaaaggccucuuuuuuuuuuuuuuuuuuuuuuuuuuuuugagauggagucuugcauuguggcccaggcuggagugcaguggugcucacucuuggcuuacugcaaccucugccuccuggguucaaguaauccucgcaccucagccucccgaauagcugggauuacagguucccaccaccacgcccagcuaguuucugcuuuuuuguuuuguuuuguuuuuguuucugagacugagccucacucugucgcccaggcuggagugcaguagcacgaucucagcucacugcaaccucugccucccagguucaagcaauucucgugccucagccuccugaguagcuggaauuacaggcauguaccaccacacccagcuaauuuuuguauuuuuaguagagaugggguuuugccauguuggccaggccggucucgaacuccugaccucaagugaucugcccaccucggccucccaaagugcugggguuaaaggcaugagccaccaugccuggcucagagggcagaaggccuuugggaacccagacaggaagagguuuaaaacccaaggagguuggcugggcgcaguggcucaggccuguaaucccagcacuuugggaggccggggcaggcagaucacgaggucaggagaucaagaccauccuggccaacauggugaaaccccgucuccacuaaaaauacaaaaauuagcugggcaugguggcgcacaucuguagucccagcuacucgggaggcugaggcaggagaaucgcuugaaccugggaggcggagguugcagugagccgagaucgcgccacugcacuccugccuggugacagugugaaacuccgucucaaaaauaaaauaaaauaaaauaaaauaaaauaaaauaauaaaauuaaaauaaaauaaaauaaacucaaggaggaguggugcccugugcuggacagccauucucugcuuuccucuccagagucuuugagccuaggucagccccugcccucuccccccacccauuuccuggugucccacccacccucccuuggcucugacccguauccaggagcaggcuugcgauggccagguucccgugggacacacuguagugcagggccguguucccguugccauccgccagguucaccacgugcgccagcaguucgggucccaggcgccucaccccuuccagcauccuggccacgggcuccgccugagagcgccgcuggcuggacacucgaaaccacuccugggccacgaggcgcacugcgcccugcaagggacaggggccaagauaacaucggcgaugguccacggcggcgccguggugggggagcuggggaggggcgggacugggaagagacccauuuggcguuuccaggcaaguaaggaaggucacuccucguccagguggggagccaugcgaacccagauggagggcuggggccacaccccuaucggagggcaaacacgggggaaggggguccuuuccuuccagggaagaauuugcgggagaacauggaacggggaaaggcaaugaacgcuugcccuuggggaguccgggaguggggcuggggccgggccuuuuuggggaaaccaaggaaagaucggcgcuguccugggaaggagaucccuucggagagccuggggucaggcgaggugccuggcgggaagggauggaacccggugugcuccccuaagugggcgucagagguccuuggaggcucccacgccacucccuggugcugcgcucccggggcacucacgccgucgcuggcuacuccgcggggccggcucagcugccgcugcagcgcuacgcacgccucccucagacgcgggcucagcucgcaccugcagaggaggccaggagagacucaggauggaucggggacagcgccgaccaggaggagggcagccgccuccucuccaaacaacuagcgagcgccgcucaccuccccugugccaccugcugaggcucugccuccgccucgggcucagggucccggauguccccgccgcugggagggccaggggugcccgagucggaucccccgccgcugucauccccggagcccgaggagcuacccgggggcucggcgccaccguucucgcugucgccaucgcugucgcuggcguccucgcuggaggagcucucguaccugggggcagggugggaggugucugcuaaaccuccccugugggcucguucuggaguccugcgauguggguguggccguucccauuuaacgaugaggaaacugaggauugcccagaccacgcugccaguagaggggcagagcugggguuccaaccccagucuaugucccggcagaagcugccacaggaggggaaaggcgcucacucuccguugaggaccccaacaaacugcaggcucuuggguccggagcuggguugggcaccaggugugccgucucucuucuucaugauggauuugaggaugccuggcggggaugagaugagggcacugaguucgaguccggcgccgaguaagccagggcccagcgacggggucgggacucacccgcgggcgccacggcccugucuccguccauggauccgggcgagcucuccugagucaaggagggcgccucugccggggacucggucugcgcggccuuuucggcacagcuccacggggucugggugguggccucgcguagcugggcccgggcccccgccgcugccuccuccgcagccucgcgggcuuccuccagcucccgcaaccggccccgcagaagcucacucaccccgcgcuggugcuccagacuggcgcgcagcagcucuagcucgcgcucggcggccgcaggcagccccagcagcgccucggucacccacgcguccgccuccacggucucgggggcagccuccacgccggccucccgggucuccggcacggccugggcacccgcuucucgggucucgggcacggccucggcggccaccucccgggucuggggcgucccaucgagacucccgaccuccccgucgaggaccuggagcgcgcccucgcugcgcccugcagccaggccgucugggcugucagcccgggggcuggcccuggcacggccgccgcgcucggagguggccaggcgcucggugagccgccgcagcugggcgagcuuguccgggcgcgucucagccuccccguccggcucgggcugcgcgcgcccggccagcagccgcgccuucucggcgcgcagcgcgcgcaccugcuccugcagcucgggcagcguucgcgccugguccucgagcucgcgcaggcgccgcagcgccgcggccaucugcucgcgcaccagcugcaguugggcagggccgggcgaagcaggggcaagguuaggggcggggcugcugcggccggacccgcgugggcugcgcgggaccccgcggccggggcugggcgcgcgcucgugugucugcgccagcuccagccgccggcuggucucccggagcgugugcucgacgcgcggguugcgcacgggcgcgcgcggcgacagcggcugcaucaggagccccgagggcgcgcccugggagaguaugcccggugcuccaccgucgucacuggccagggacucgcuggauguccaggcgccugggcuacgugcgcccgcgaggccgggccggggcgcgcggggacggcgcgaggucgggggucccggggcgcggcgggcagcggggccacgcuccagcuccucuauguacuugaggaaguccagguccagguggaagccguagggcgucuccaccgaguagggcgagcucgggcugcgugcgcccccggcggcggggaccgggcacaggcgggggccgcccaggucuggaggcacgacgggggcacggggagggcgcaucagaacggggaaacccgggagauacuaaacaaaccgagcgugucccccacccaugcccacgcuucacaccuaucuguacccaaguauuaacucaaucgcuuguuuaaugagcaccuacucugugcuaagcaaguuucuaggcccgggggacacagcagugagcaagacaaacaucccuguccuccuguagaaagcagauaagcauccuuccaaacgaugccuacggcaaugguaauaauaacagggaauaaacggaggaggcccgauuuagcguuugguugccagggaagcuuuccugugaggggacuuuccuguggaguggagcccuggcccggcgugugguucgcgccuguagucgcagcauuuugggaggccggcacaggcggaucaccugaggucaggaguuccagaccagccuggccaacauggugaaacccaguaucugcuaaaaauacgaaaauuagcugggcgguaguggcgcgcgccuguaaucccagcuacuccggaagcugaggcaggagaaucacuugauccugguaggcggaguuugaggugagccgagaucgcaccaaugcacuccagccugggcgacagaagagaaccucucaaaaaaaaaaaaaaguagcccuggccgggcgcaguggcucacgccucuaucucaacacuuugggaggccgaggcggguggaucgcuagagcuuaggaguucgagacaaaccugggcaacaaagugagaccccaucuccaaaaauauauauauacacauauacauauauauacauagcugugcauaauggugagcuacucaggaggcugaggugggaggaucacuugagccugggaggcagagguugcagugagccgagauugcaccacugcacuccagacugggugacagagugagacccugucucaaaaaaaaaaaaaaaaagguuggcgaggggaagcccugcacgaugaggaggaagcagcugggaaaagguuucuagaagaaaacagcccauggaaauacccugggguaggagggaggagggucagcuggagucacagcgagauggagaccagggugucccgagcagaguaaagaaggcagggggaagaggaauggacgcacaagggccacacuucccugguuugagggcuaccugggguggcaggggguauaguccacuugcgauuagugccauaggugggguguuuuuuguuuuguuuuuuucuuuuuuuugagacggagucuugcucuguugcccagacuggagugcuguagugcgaucuuggcucauugcagccucugccucccagguuccagcaauucuccugccucagccuccugaguagcugggacuacaggcacgcgccaccaugccuggcuaauuuuuuuuuuuuuuuuuuuuuugagacgcagucucgcucugucgcccaggcuggagugcaguggcacaaucucugcucacugcaagcuccgccucccggguucaagccauucuccugccucagccucccgaguagcugggacuacaggggcaccaccaugcccggcuaauuuuuuguauuuuuaguagagaugggauuucaccguguuagccaggauggucuugaccuccugaccuugugaucugcccgccucggccucccaaagugcugggauuacaggcaugagucaccacaccgagccgugccuggcuaauuuuuguauuuuuaguagagacaggguuucaccauguugcccaggcuggucucaaacuccugaucucaagugauccgcccaccguggccucccaaagugcugggauuacaggcaugagccaccgcacccggccaugauugaugccauaggugguuuaaagcaggcucaugacauuggagaggacugcacucuagggcuguaggcugcguccacacacaagggcaucaagcguuucucugugcaugcgcacacacacacacaucucucuuuuugcacacucaccgggcagguucugauucagggcaaacuuggccauguuuccugcagcagcugucagaggcacccugcaaaaggggugaagguggggcugggcgcugucccucuggcuggagccucuggggccugccuuugagucuaagcaaacaggacccaagagcucuccuccacccagccaccucccuccacacauggccucuccuuccucuucccuaaagaaaccuugaaacuuuuuuuuuuuuuuuuuuuuugggacagagucucgcucugucacccaggcuggagugcaaugccacaaucucggcucauugcagccucccccucccggguucaagugaaucuccugccucagccucccaaguggcugggauuacaggugcccaccaccacgccuggcuaauuuuuguauuuuugguagagaugagguuucaccauguuggccaggcuggucucgaacuccugaccucaaguuauccgccugccucgaccucccaaaguacugggauuauaggcaugagccaccgugccuagccgaccuugaaacuuuggauggaaugaaugauccccaggugucagaugucagccugcugggcaggaggaagcaggaaagacaucaagcaaaaagaagaaggugaccaagaaaacaaggguagcugggaguuggggaggcauuccagaccugcuggguuuucugauaaucucuggggaaaaucagaaauggacgcucuauguaguggacuaugagccuuuaggaaagaaagaccagaguuggaagcccuucacaggaucauuaaaaacucaucuaggcugggcgcgguggcucacgccuguaaucccagcacuuugggaggccgaggagggcggaucaugaggucaggagaucgagaccauccugguuaacacggugaaaccccaucucuacuaaaaauauaaaaaaguagccgggcgugguggcaggcgccuguagucccagcuacucgggaggcugaggcaggagaauggcgugaacccgggaggcggagcuugcagugagcugagguggcgccacugcacuucagccuggcaacagagcgagauuccgucucaaaaaaaaaaaaaaaaaaaaaaaaaaggauguaauugugcauccaaauuuuuaccaaggucaguugugaaacucuugcaggaaugauggggaauugcgggcuggaugcaccaaagauccaaaucaacaaaucaacggauacuugucucccuggaaugucgcuagcggagugucacaggcuugauccuuggcuuguaagaguuuguaaugcaaacacaaaacaccuggguugucagagcugugacuauucauggggcugccugggaaagugacuguuuggaugacaugauggaggcuguaagaaagugaggaagauugggccacauauaauaaugugauauuuaacaaggacaaauauugaauccagaacuuugguucaaaaagcacagggugaaaucucagcacucugggaagccaaagcagaaggaucgcuugagccuaggagucaagacccaccugcgcaacauagcgagacccuaucucuuuuuguuuuuuuuuuuuuuugagacagaauuucccucuuguugcccaggcuagagugcaguggcacaaucuuggcucacugcaaccucugccuccuggguucaagugauucuccugccucagccuccugaguagcugggauuacagccacugcuacuauaccuggcuaauuuuuuguauuuuuaguagagauaggguuucaucauguuggccaggcuggucucgaacuccugaccucaggugauccacccaccucggcaucccaaagugcugggauuacaggcaugagccaaggugccuggccacuaucucuuuuguuuguuuguuuuuaaauagugaaaccaccaagcacaguggcucacaagccauugcucuccagccugggcaacaagagcgaagcucugucucuaaauaaauaaauaaaauagcgaaaccccaucucuacaaaaaacacaaaaauuagcuggauguguuggcaugcaccuguagucccagcuacucaagaagcugaggcaggaguaucucuugaguccaggagaugcaggcugcagugaguuaugaucaugccacugcauuccagccugguugacagagcaagaccuugucucaaaaaaaaaaaaaaaaaaaaagaaaagaaaagaaaagaaaagcacaggaacauggagugggaaagaugggcuuuggaaagcccacauggaaaaccuucagggaggggaaagugccuacggugugcccuuccugauuaaaugucaucgccauagcuggacacaauggugcaugccuguagucccagcuacucaggaggcugaggcaggagaaucgcuugaaccugggaggcagagguugcagugagcugagaucaugccacugcacuccagccugggggacagagccagacuccgucucaaaaaaaaaaaaccauauauauauauauauacacacacacacacacacacacacacacagcccccauacaacacuuugcauacugcaaaguaguauuauuauucauauuuuacagauggagaaacugaggcacagaacaauuaaaucaguugccugugggaagcacccucagauugggcucugcccaucugcggaacccuugucagcaggucccugccacagcuucugacugcccuuuaccuguccaguccuccacugacaggcaucugccaaacccacuucauccucucccugggccacggcccgucugugcuaaccacauggcaacacucccagccaccccuucuggcuucucgaaucccugggaccaccugugugccugaugcuaugaagcacugagcacccaccagcccuccugacucauuacccuacuccaccgcuggggaaaccguaacuccauuucccacuucugucuggccgaggucccugaccucucccuucccacuccaaggccaggcagggggccucuuccaguccccaagcagcuguuucccgucccuucacaccagcugcaagggguggaucaacaggccagcgggucaucgcagaggacagccaaugccguucaucacuuguuuucaggaaauugccagggaagaacuggguuguggaaaaaguccagaucaaggguuggggggucugggucuacuucucacacagcuggccguaugacgcaauggggucagcguccuccuccggugaccuggucacacccaaaucccaggcccugggaucucagaagacagcugugggccauuccuaagaccuaaacuagcugaagcaguuggauccagaggcugggcuaagaaaggaauggaucccuccagaaugucaaauaauaacaacgcuuuugauauuuacuaugggccagccucuagucuaaggaauuuauggauauuuacuuuuuuuuuuuuuuuuuuuagaggcaaugucucgcucacucugucacccaggcuggagucaguggcucgaucauagcucacuguggccuugaaccccugagcucaagugauccgccucagccucacaaauagcugagacuacaggaauggaccucuacaccuggcuaauucaggcuaauauuuuaaauuuuuugguuuuuuguuuuagauggagucaugcucugucgcccaggcuggagugcaguggcacaaucucagcucacugcaaucuccgccucccggguucaagugauucuccugccucagccucccaagcagcugggauuacaggugugcaccaccaugccuggcuaauuuuuguauuuuuaguagagacggaguuucaccauguuggccaggcuggucucaaaccaggcgugagccgugcccggccuaauuuuauuuuuuguagauacaggugucuugcuauauugcccaggcuggccuccaacuccugggcucaagcaaucuucccaguucagccucccagagugcugggauuacaagcaugagcuacugcaccugaccuugacuuauuuuuuaaaauccuagcuaaauccacugagguuggauuuccuaugaucauugucccuuccccuauuguacagauggagaaacugagacacagaacaguuuaguguccugccuggguccugucauaaacaggcagaggcagguuuuaaacccaggcaggucuuccagaguccuugcuuuggccacuacacuugaaugcuuucuuuuauuuuuauuuuugagacggagucucugucacccaggcuggagugcaguggcaggaucucggcucacugcaaccucugagcccaggguucaagcgacucuccugccucagcauccugaguagcugggauuacaggcacuugccaccacagcuggcuaauuuuugaauuuuuaguagagacggguuucaucauguuggucagucuggucucaaacuccugaccucaagagaucagcccuacuugaccucccaaagugcugggauaacaggcaugaaccaccaaggagccucagggggcuugucccucccagccuacaccugugucagacucugauugggggcggaggugcccaccaccucugcggcuucaggggcuggggccucacuaaguggggcguuuagcugccuucccucuccuccgcucccugcccugacugucacagcuagauccggauucugugccugagacccccucauuaggccgucagagccgacgccacacgcccccucucccgccccagggacuauuuugggacgcagagcugugaucaccaaaccggaguggugggggccacggcaggccagugaggaucccaguccuggggagagggcgccuuccaggaggcccugaguacuggcagccccugaugucugcugggacucucagacucuugaggugggugggugggggaccgguggcggcaggaagguggguguuaaagucaucaucacccguccacccccaggucguccuagccgcacagagacagagcaguuuccuacaggaagcgccgccgggcgguuccauccgcuacccauugucugcggguccgggggccgugcgucccuccccaaaacaccauuuccgugacacgcucccacacccagcccagcgcgaggggcuggcugggguccccaggccgucccgggaaagggucccagggccgguuguggcauuagggagcgaacgagccccgcagugagcucccgaagggcgagaggggggcaagcccacgccuccagagccccccacucugcucgcuacccaccugggacuuccaaugugggaggggucccggccagaggacacgacgcccgccccgucgcagcgggcagagcccucaguggggcuggaaacgcagcgcagcgccgggucccggugcguccccgaauccacccacccaggggucccccauccguguccccgcaagcuggcaauuuaccugaagccgcagccccagccgcgcccgcacccgagcccgcccccucgaaguccggggacugauuaucaaggcc

SEQ ID NO: 18289 - RNA, 1188 nt, Homo sapiens
aaugagaaccuguacugcagguguuuccuuaggaagaccaauuuugggaaaguugagguucuugaaauuaaaucccuuacaucuuccaagucccaguccucgcggagaguuuuuauguuccccauuuugaaagcuguagacuuugacgacuggagagaagugaugugggauuguucaacggacggguguuugcgauucuaggacucagcguuagggaucuaauaagcucugugacccuaguuaaguggcaagaugcccaccacuuguggaaaugggaaucuuagcgauugggacccuguuaaucuuucugguuuccucauaagcucaccucuggacccagccuugccuccacgagucccuccagccucccuaaacacaacgagguggguaucaaaucuguuucuucauccuucauucuuuuuuccccucuccccgaagaggaggaggaggagacccaaaguauuuuaugagccucauuucgccucacagcagcccucgcagcggcaauuugcacaaacucuccuccaagccccaccccaucaucgcccauccgcagacccuaggccucccacgacaaagcacggccaccuggucagcacagacggcccuucgaggacccccucuggagaagaaccauucaggucccaacggucuggcuggucauuaguucuguggugaagcuugaaaagcaaaucagcaacaauaguaauaacaauaacacuuuuauggcgcguugugcucauuuguacgcauguguuauaacgaucgcgggacgcagcaccuggcaguagaaacagcugcuggacagcggcaaggagcgcgccgcccuugcaggggaaggggcugggucagccgaauaagccguggaaaugggaaccugggggacaggaaagcagggccagauagcuugccaauagcccaacugaaagaaaagguuuuacuucccuuuuaagagacuucugcccuucccugaaacucugcacagcuuuggaaagcccaauuccuaauccacccuguucgguuccccugccccuccuuggaaacgaggcucgguccucccuacgcgcuacucuccggcgguugggccccaggcaggaaguuucugauuggcggagucguagaagcaccgggugaaaagagcuccacuggcugcgcaccggaguccgggcguagccagugccguacggc

SEQ ID NO: 18290 - RNA, 26377 nt, Homo sapiens
auucagguaguguuuugguuuauuaucuuaguguugucacagugauagaaacccccagagugggaagaagagcuccugcgaggaccuacauuuugccauuccccucugcccuggggcucagagccuugaagccuuugcuuggcccuugcauguuaggauauggccaagaaucagaaacugaugcguuuuuccagcacuaccugugugcugcacucauggaaggugggaagcuauacacagguauccaacuugguuauaagacaccaguucccacagggcuggauuucucagcugucugguaaaccaguggcacuucacugccccaggguggcuggcucccuuucugaauuucugucucaaugugauauaauugccaccauucaggauggcuacccacaucugguaugaacaccaugacuucuguaagccaacggggcuuccuccucagaacagugcccgugcaaucuuccucccuguggccuugauccugggaaaggagcccccuccucccucacucggaggaguuccugaggcagacgggccacuggugacgccagguguagcaguagaggaccuucgccgcugccgcaggaggaaaucgugugaagcuccauccauggcguagaauacauuagccgaggcugggauagucagcucugaagguucaggggauggauguaaagcacacacacaguuguuccccccacagccgcccagauguggaaguacuccacucuccucccgagucugccuuucccucauggccucugaccucgcuccccugguagcagcuguaccagcucauacucugaagccacugcagagucacgauuguuuuucuuaaggacacgacugaugacacuuggagccuuguccuggcuugucaccuggcagaacaggagaccaaaagagcaaucaaucagccaugauuucccauccuucuacccucagccacugaacccaaccacaaaauguuacuuguguccaaggcuuuaaaaugaacaggaaaacccaauaugguggcuuccuauaccccauaagccagcccacauggugcccagugaaacagagcugcuucccuguggggaaacugcuguugauucugaaauuuuaacacggcgaccaaaaguuuaagguguagcaacuaaugcaaaauagccaucaaaauaaaacaaauuucagcuucuauugaagacuagaguuuagaagauaaaauuaaaaauaaaacauaacugccaaaaccaaaggucaaaauuaaaacuacauucaauuccauuuggcugcccaaaccucagacaacauuuauaguccaacaagacaccauccuucaccccaacuccaucccaaggcucccucaccaaaaugcucuuauagacacugccaucuucccccaacuccaucuggacucggaugauacggcaaucagaggccccuggcccagaucccucucccccauauccaguccccccggaggccucuucugcacccccacucagcggggagccacaggaggcugagcggcggugaccucgagaaggccuaggggaggaggcugguggggagagguggcuggggucagcuggacugugcagggauggacugcuuuccaaggcagagucuagugacgagacagauggccacuucaugugcuaggaacaaacaacaugggacuggcaugaaggcagggagguuuaaggaagaaacauuuacagagugagggucagcgucaaggucagagucaggagcagagcucaccugggccagccgagucagcagaggagcaggaguuguaggcgccucaucucccccaguacugggccggucacaggacacaagcgggguagggaccccaacagagcccaaaacccugcaguggcaggagauugggaggaucagagaaaaguggaagucccaagaaaccaccccccagccagugaaucucucacucuguccacugcgagaugaccaauguuggccgaagcacccguggggcaggagggucacuggaaccagguggcuccaccucacaggauacacgauggcuggguuaggggggcaauaggcagagcucaggacaugacaccaaucccccacaccuggccagaacccuggagucccaaccucacccgccagucaccucugagccucugucaguggccggagccccuguagccaccucuggauaucauggucagguuggagguuauagccacgacauucauucuggagccgucgcaacucagaaaggacugcaaacuccugggaaggagcccucaaacugcaggagccaaaacucagggaccccugacuuuucccccuccccuuccuggaacauggauagggaaguccagcauccagcccagacacuccgcucaccuuccuccgcuugucaaaauugauguauccauucugcgaggaaaauggggauggggugaaaguuccaacccuaccuuccggccacagagagagaauauccccucucuuaaacacacacagccacauccaacucacaaccacuucccuccagccucucugacucuucgaucccucccugccuuccuccucaaucuaucauggccuaagcacuccacuugacccuuuaaauugaauuucucagguagacaacgagucugcuuugcagaugagaggacuggauaguauccaauucgacaggauuccuuauccagagaggauaaggaacuuguccaaggucucaguauuuguuuauuuaacaaacucuagcaauagagcaggagcccaucacaaaaccuagaugugcuuacguuucaggcacguucuaagcacuugacaaauacaaauucauuuaacccuuauaacagaucaauguagaugcuauuucuaguuucccauuuacagaucacugaggcgacuuggcacagaaacagaucuggcucugucccacacucagcuauuugugccuuacagccccuugcaaggggcgggggggucuguccgacccugcagcccacuuguuacaucauugcaaugacacacacacacaccacugaccuccaacucauccuuggaggcugcauccagcaucacaagguccuucaggaaggugccaagguaugggaccacacccugaagucaggggucagggucagaagugccugccauugacgugagggcccuccaucccuccgcacuugcccuccucauugccucagagaacagauuucauucuccucaccccucugugccucccuuacccauccuucaggcugcucccccaaaacauacuccucaccccuucauaaucaccacccccacgcccaccaccccgcuagucacucaccccaccccgggagccagaccucggggccuucuuggaguguggcuccagaggagacugcagcuucaccuccugguggugacaaaauaaaagagacaugggggagcaguagggaacaaggagaggugggaaugccacaaaccaggcucucaccugcacgagcagcucccgacucugggaauaauuauccuccucggagaaaaucuggcagaggcuggaaaagacucugaggcugucccuggggaagggagaaaaguggcccugaggacaggccuggcucugucacccccucuuccccgccuucugaggaacccccaccccaguccaaugccucagccuccgcaccugguugcuuccccccaggcugcccgaagccuguggauggggcuggacugcagggcugacaccacggcauaaacugaagagaaguuucggagcagccggcacuccugugggggucaaagaagagagcuaaggcuaugggaggccucuccauuccauggccacaaaccguagggcaaucuucucucucaccucugccacgcggauccacuucuccaggagccgggcccucugugggggacggaguggccguauggucaccuccccaggucccucuccaguggaaguagcccccaggacagaacuaaccacugccccugccaccuuguuaaacugugugacaguagcucggacagaugggcagaggugagaauguccuggccggucucugugaccccacaggccucccaggcacugagaggggaucaaauugagaaaaaguuccugcaggguagaggucagagguuaaaguucauagucaagugaggucagccuuccaauaucagggaucugaggaucucagguggccaaggaaccagaggggcacaggguuugaaggguaacgaccaaagggaaaaggggagaaucaaaaugguagguggaggaggcuaggagcuggaucaggaagggguggaagcaaggaaaggaucuggagucaaggagagguuaguaaggggucagggggcauaggggccagaggucagggucucaccgcaucuagcagggucagcuguucggccaaguggucagcgaggaacaccaggacauccguggggucagcagggggaucgccggggagggccaggggcuuaggaaggucgggggccuggggguccacccgggaccggagauugcggaugaggucagcgcugccccccccaacacccuucccugcugcauacccugucugaaguaagaagcucucaagccggucaagcugacccuuggccucagagccaaaauccucagggugagaggccagccagguugacaguacagagauggcuacccugggagaagggaaucagccaagggugagagguaaagcugcagccugggcagaggggacugugagauuaagaaccaggggucacucacucuguuguccucucuaguucgucgguaggaugagauucaagggcuuccagccugagggggagaagaggaucuaucuguccauuuuucccaaacccucaguggcuuugacuauuuuggugggauguugcggcuuuaggaaauccgggcagauacuccacuacccugcgucccuuaugacucugaccugucagccauaagcccuagcaaggcaggcguggaggugaaggcccgguggguagccaggaaggcugacaugaagcucacaucagucccugauguccggguauccaguaggugucugaccagggccuccagagugccagcucggagccgucgggaggaacgugggggaggcauagggaccuggagaacacagagagaugaucgcuaacccuuucucccacucugcaccuagauuucugaggacaaucccagacccaggagauguuccagacucauuuuucugauauucagagagggcaagagucuuggccuaugucacacagcagaguccaggacuccagaacuccaaccuagcacucuggccagaaagucagccagaggaaggaaaacugggaaugaagagucagaggugagaagcuaaagucaugaucucaccaagggaucaagaggucgauauuggcggcuugugacgguaaacacggcaccauccuccuccucaucccagacggacacaggggccuggaggagcaaggaaggggaagucagacaguuccacaccaccccccauugcccucagccuucaccccaggcccugcuccucccucuguaccccucaccugugguggcagggcauaguaccagcgagugcgaggaaggguugggggagcuggugaccccaggucucccccacuggggcccagacagccccaccccagccgccucagggccccgguggagucgaaggggcugcaguggaggcguggauggaguacaggaauucugauccuggagacccccaaagccccuucuccccagagcugaacccacacacgacagagaagcaggguacaaagggcaggagagggaagcgagaggcagcaagccagaggcagcgacuagggguagcugaaaccucaguccaggcacugccgcaugccccgccccucccggccaaggacuauaccagcccagagaauuagucuuuuucaggaccccuuucacccuggucccucggguagcgccuccacuaucucagcccuaagggacccccgaagguagcagcuccaaucccaguacaggaaggaaaaggggaagugggaugauaggggguugggggcgguagacucagagagucacguggccccagccccucccccgaccgaucccgaaaaaccagcccugccagucaaccugcccucaccuaggaucuggaccuaggaguuuagggccucggggccccaaauccaaauucuggccccuccugaggcccgaaauccugcuccuggccaccaccauuaaucccuaaugaaaacagaugaccacucucuacccacccuaggaucuuuccuccaggucccagaaccguggcuucccggccucuacccaggaccggggcggggcgggggggcggggggaagggggagagagggaaggaggggucacgaaaucugaggguucccuccccaaucccagagucagaggagcugguuacuguggaaacaaaccccuccccgccaaacaaaaacaaggagggagacagggaccaagacacgacugcucagagagguaggcacacucaggcaggcagagguggagggccaaagacccgcagggacaggacagccagccagaaguuccaggcaggaacagggcagguuccugcgggcagguccugagucacacugacagagaaccacggagacgccaggacuccccgcagcagagaaacgggccgacacccagggaggcgcgagaauaacugaggcaaggaggaggagauguagggacccagagacaagagaaaaguggagacuucagaaauacauacgcccccuaccucccaccacccgcgucucaccucuucuucuuccuccuccucuuccuccugccccccgcccacgaccaggccaccugggcccccacccucuucggggucccggcuucggaagcugcucaguacgacucccccgggggggcucguguccaaaagcagccgcaggggccgcgggagcauggccgagugaaggaaucagcggggucgggccaugggggcgccuggggagagacggggugggguggggguggagagucaggcaggcgcgggggaaccgggcagggaagggacgugggugggugucaagaagaccggaagggaguucugcaggaagguugggggagggggcaacagaaggguggaauaggggggcccuuggugcuguuggggaaggaggaggucacgaguacggggacgcgcagggugcucaggcucugaccugcucgggaggggugggggcagcguggguccugagccgcuguugccgucggucuccggccccggaccgaguccccuccccggcuuuuccguacccccuugaacccccccgccgggcuccugggcccucccgcccuuuccgcucccccccgcguccgcccgcuccgagagcaggagccaaaaggggaaggaagugaggacaggagccagggccgcggacuaggggagcgcuggacgcucagggaccaggacccaggcgcccgaguccccagcuccacuguccuccgccucuacacucggggauucuggagaccacgucgacccgcaaugaacuggaauaaagauuccagucuccagccccugggggaaggcaggagcagaauuugacauucccuuccccaacaauaacacggcuaaaacucccgcgggaagcguuucaggcggagagagagccggucacuccauccccacgggauuacccucccuaccacaacccacgaauguagcugaccgaaaucccggccggguuuuccgaagggcccucgauucccgcccccucggcagggggcggggcaggaagcagccacauccgguuccagauucggcucucagaggcuuccggcgccgagaccgagauccccgucggcucgguguauccucgcugguggaguacccucugcuugagcgcaucucaugcgccaguaguggcgcccgccccgaacggugucgacggggcguucucugagcgguucagggucacuggaagggaccagaggugauuggaauauucauugagcuuggaaagggguuggaaugagagaaccguuuggaagcacuggaauacagcuuuauuccuacacgauuagacccguuaccccgugggucuggccgaccguccugacucggagaucccugagcugcgccgccgcuuccuucgucaacauccagcagcuacuugaugagcgcccuccagugggccuuaggucccuaugccggcgcgggguuacagcaguggacagacaggccagucccuguccucgaggagcccaugauccgcggggagacaggcauuuaacgacgacucacacgaucacuuaaauacaacuguggugaaccgcacaagagggacgcgcggcggucugcggggaaugacgaggccgaccucgucugcgacccagggagggcaaggguggaccaggcaaagggaacagaggacugggaccuggaggugggcgggaggcguuugguucauuggaggaaaggaauagcccugugugugaugagcauugagaggaggucuggcgagcaccaucuagggcugaagaacuaggcaguggcuccagcgcggggcggugggggggacaagugagccagggcaagaagaauggauuuggcccuagaguacggguucuccaaauguaaccucggcccuacagaucucugagacuaugucaggggguuugugagauuuuauaacaaaauuaagauguuaguacaauaucguguuucgccgccgggcgcgguggcucacgccuguaaucccagcacuuugggaggccgaggcgggcagaucacaaggucaggagaucgagaccauccuggcuaacacggugaaaccccgucucuacuaaaaacacaaaaaguuagccgggcgugguggcgggccccuguagucccagcuacucgggaagcugaggcaggagaauggcgugaacccgggaggcggagcgugccgugagccgagaucgugccacugcacuccagccugggcaacagagcgagacucugucucagaaaaaaagaaagauuauuugcagccgggcgcgguggcucacgcggguaaucccaauacuuugggaggccgaggcgggcggaucaccagguuaggagaucgagaccauccuggcuaacacggugaaaccccgucucuacuaaaaaauacaaaauauuagccaggcaugguggaggacgccuguaguccgagcuacuugggaggcugaggcaggagaauggcgugaacccgagaggcggagcuugcagugagccgagaucgcgccacugcacuccagccugggcgacagagcgagacuccgucucaaaaaaaaaaaaaaaaaaguuuuuugccuucuucauucuauaaguguacaguggaguuuuucagaagcuacaugauauguauugacaccaugguucccacgaugaauagaaugugugccuauguauucucguguuuuaaauuuuucucacuuuuaaguucuaguaccauaaauauugauagcuauaacccacauacccaaaagcuuuuugggguccuugaugauuuuuaagagguccugagagaaaaaaauuuugagaaccacuguccuagagcuccaagaaggugaaugccauaagauguguguuuuuuaaaaaagcauuucucgggccuggugugguggcucacgccuguaaucccagcacuuugggaggcugaggugggcagaucaccugaggucaggaauucaagaccagccuggccaacauggugaaaccccgucucuacuaaaaauacaaaaauucacugggugugguggcaugugccuguaaucccagcuacuccggaggcugaagccacagaauugcuugaacccaggaggcggagguugcaguaagccaagaucaugccacugcacugcagccugggcggaagagugagacuccgucucaaaaaaaaaaaaaaaagaaaaauuaucccuuauauaagugaaagaaaaaaaaaaaagcauuccagccacucaguggagagagauuggagggauuaggagcagaugauaggguauuauuuuagggagcuacuacagaagcuugggccagagaugaugguggcuuccacaggauggcagugagugcccucacucugcuuucuggaagagaggaagguggugaggaauucaggauauuaaaaggcaguugagguguacauggucaguuuagagacauauaaacuaucaugggcacagaugaugggagaaggaugaggcuaauauuuucugcccuccagacacugcugagugcuguaucuccugcaucuucuuaaggagauacacugucuuccuuaauccuccuaaaaguccucucaggcuccgcuguccaauaugacagccaccacccacauuaggcuauugagcauuugauauguggcuaguccgaauugagaugugcugacuauuuaaaauaaacaccuguguuugaauacuuaaggugagaaaagggcugcaauuuauuuucuuuucuuucuuuuuuuuuuuuuuuuuuugagacagggucucacuuugucacccaggcuggaguacagugggacaaccuuagcucauugcagccucacccucccagauucaagcgauccuucugccacagcuccccaaguagcugggacuauagcugugugccaccaugcccagcuaauuuguuuuguuuuguuuuguuuuguuuuuugagacagagccucacucuguugcccaggcuggagugcaguggugcgaucucggcucacugcaaccuccaccucccagguucaagcaauucuccugccucagccuccugaguagcugagauuacaggugugcaccaccaugcccggcuaauuuuucuguauuuuuaguagagacgggguuucaccauguuggccaggcuggucuugaacuccugaccucaggugauccgcccuccucagccucccaaagugcuaggauuacaggcgugaaccaacgcaccuggccaagacuguaauuucuuuuucuuuuuuuuuuguuguugagacgaaguuuuccuuuugucacccaggcuggagugcaauggugugaucucagcucacugcaaccucugccucccagguucaagcgauucuccugccccagucucccgaguagcugggauuacaggugccgucacaucuggcuaauuuuuuguauuuuuaguagagaugggguuucaucauguuggcuaagcuggucuugaacuccugaccucaggugauccucccgccucggccucccaaagugcagggauuacaggcaugagccaucgcacccggccuguaauuucuuauauuguuuacauguugcaauaauauuuuggauguacagguugagcaucgccgauccaaaacucuaaaaucugaaauguuccaaaaccugaaauuuuuuuagugccaacaugaugccacaaguggaaaaucccacagcugcccucaugugaugggucacauauauuauuaaaaauauuguggucgggugcagcgguucacaccuguaaucccaacgcuuugggaggccaaggcagcgggcggaucaccugaggucgggaguucgagaccagccugaccaacauggugaaaccccgucucuacuaaaaauacaaaaauuagccaggcgugguggugggugccuguaaucccaacuacucgggaggcuaaggcaggagaaucgcuugaaccugggagguggagguugcagugagccgagaucgcaccauugcaccccagccugggcgacagagacucugucucaaaaaaaaagagaaggaaaaaaaucuucaggccauguguauaagguguauaggaaacauaaaugauuucuguguuuagauuugggucugaucccaaagauauuaaauauaugcaaauauuccaaagucugaaaaaauccaacauccaaaaacacuucugacccaagcauuucagauaagggaccagaauuauuagauuaaauaagguauauuauuaaguuaauuuuaccuguuucugcuuauuuuuuuaaugugaguacuagaguauuuaaauuuacauauguggcuugcauuaucuuucuauuggacagcacugccuaaguaacuuuuuaaaaucccuacacccaaggaaacauauagauuaaguagcaugcucaaagaguccuacaguuaggauauagugccagguuuuaacccagaucagugugaauuccaagccuagguucugccuaccacaccagcagccucccuccauggguuuugagauaggaugaggagauaaagugacaagggaaagauacagagagguggagcacuguaccuucuuugaauccuugcagguggacagguagacagcuguggggaaagauugagaagggaugggaugcuggagugguagagguggagggcagagggaugggugucaggcucuugggaguagguggggaaaguccaccaaccucaggucauggucaggguagggcugacacuuaccagcccagcccagugccuugaagagcccaagcagaagaaaggcagacaggaaaaggccuacgcuguccucaagggagggcccugaaagaccuggcaggcagaaggggugagagugagcuccugucuuccugggugcuggcucagauuccgcagagcucccagcucuuaccugcuaccuccagggugaccucagcgcugcgccccgaggcaggcaggcugggauggugaauucgacaggcauagcgugccccaugcugcucaguggugacugggggcggcugcaagugcccagagaggcugacagagccaucggaaugguggcgcagggccgagagccaccucugccccucggccuucugagagcggcccccugggccaccccggaguucccacuccaccuccaggcccccagaaggguagaagugggacacaaggcagagcaauuccgggggugccuccccuggggcggcccgugcaaggguugcuggcaucagggacacuuugggggguucuggggaaagaggacgaaaugagcauagggaaaucaguccauacuguccucccuaagagacccucaguuugccugcuggcuuccucagaacuaaagaagguuagguuucuucuccugaaauagggaacccacugucucuccauuggugcgucacagaaauacccaugucaaagccccucaaauuuccaggaaacuucuagccucccauuaccccucuaacucccaggaaccucuuucuaucucuacuuacuugcccaggcacccucuuauccaucaucccucccccuauuacgguccccacaauccagugcccacccucuaccccuggagaccucugucccccaacucacuguacacagcaagcuccagggugaccuguccuugcagguauggcagguguaugguggccagauaggugcccuccugaaaggguugaacuguaggcagccagaaggucccauuuccgguccaugggccccauggcucaucaucaucccaagcagcaaaugccacggccccuucuugggcugcuggcaucuggccauucagcccaggaguugcagccaggagcagaugucccuuacccaggugcuggcgucgccacucuagcccaaagggagggggacccggagccagagaugaggcggccucggagguggggggcauguaggcaaagcucaaguccagcagagcaucuugucccagucucacucgaggggcaggggugugggugaggacagucaguaccacugaggaagacagggagaugagggguugggaggggcaugagggagagaaagaaggagaaaaaaauagagaaaugcaguuauuggggagggcuaaacugcaguuuacccaccccucagaggacaccuuuucugauacucaccauuuccuagcccucccugcaaacuccuuuugcucugcgacuggguggcaccuaguguggcugagggugagcagagaggucuagggguggugaguaggggcaaugaggggguauggccuuugaagccuacucugaacacauagcacacucuagcucgggggacugcagaauccgaggccacuucugacacaaccugaaccacucuaucuccaagcaccacccuugaggaaccaggccuuucuugauuacaggcgaagacaaugauugagccaugacugucagucuuguggugcuguacagaauauuuacugacucuagaagguuccagcucuagccuagaccugagcacagaccucuaugcucuacugaagcaguacagugcaguggcuaagugccuggagccuggcugaccggguucaaauccccucugcagcuuauuuauauggccuugggccacuuccuuuuuccauggcucagcuuccuaaucucuaaaauuaaaaguugaugauaauaauaguaccuacuucaugagguuguugugaugguuaaaucauuaauaccucuugcuacucaagucuauucaguucccaauuuuagauaacagagacaccuacccaugaagggugcuuacaacacugucuggaacacaguaagucuacacguguuugcuauaguuacaccuaacuuagcauaccccaagucaacagcaucucugcaacauuccccacccugcuccaaugcccaucuucccugucuuugaugaaugaucaccaagcccgccagacacuaaaagcaaacccuuggaguuacucagacucauuuauucauucagcaacuauugagcacugaagauguucaagguauccugguagaagacagaauggugaacaagacaagcagucccugcucucaaauugccuauaguccaaugacagacaagcaaauugucaaaaauaaugugcuaugugcuauccccaccaggaccuaacagaucucacaucuguuuccaauuuagguucucaucaauguacguuuagacaauuacaacagcccuccugucuggucucccuauucucagucucuccuucaacuccuucuucacacuguagccaaacaaagugacuacaagucugaucccaucaccuaccuguuuaaaaaucccaaauaugggccagacgcagugguucaugccuauaaucccagcacuuugggaggacgaggcggguggaucaccugaguucgggaguuugaaaccagccugaccaacauggugaaaccccgucucuacuaaaaauacaaaauuagccuggugugguggcacaugccuguaaucccagcuacucgggagaccgaggcaguagaauugcuugaacccgggaagcagagguugcggugagccgagauugugccauugcacuccagccugggcaauaagagggaaaccccguuucaaaaaaaaaaaaaaaaaucccaaauacggccaggcgugguggcucacaccuguaaucccaacacuuugguagccugaggcggguggauuaccugaggucaggaguucaagaccagccuggccaacauggcaaaacccugucucuacuaaaaauacaaaaauuagccaggugugggggcaggcaccuguaguccuagcuacuugggaggcugaggcagaagaaucacuugaaccugggagguagagguugccguaagcugaaaucaugccacuacacuccagccugggcaacagagugagacuccgucucaaaacuaaauaaauaaauaaaauaaaaaucccaaauaccuaggaagucagcugauaaaggcauaggcugaagcuauauggccuggguucaauuucuagcccugcuucuuuuuuuuuuuuuuuuuuuuuuuuuugagauagaguuuugcucgucaccuaggcuagaguauaguggugugaucuuggcucacugcaaccucugccucccagguucaagugagucuccugccucagccuccugaguagcugggauuacaggcguccacaaccgugcccagcuaauuuuuguauuuuugguagagaugggguuucaccauguugcccaggcuggucuugaacucccgaccucaggugauccaccugcuuuggucucccaaagugcugggauuacaggcaugagccaccacgccuggccucuagcucugcuucuuacacacuguguguccuugggcaaauuauuuaacugguuuguguccuauauuuauccauaugcaauacagggauaauauuaaaaccuacaaccuaugguuguugagaggaauaagugagauuaugcauauaaagugcuuagaacagggccuggcauauagaaaauacuugauaaauguuagcuguuacuauuuucauuaccuucaucacuaucauggacuugcugguuaacuuggaaaaaucauuuaaccuguauuuuccucacuaguccaaagaucugaccuuugccuaucuuuuaaaagaaucaaguaaaauaacaggcuuuuuccgggcaugguggcuaacacauguaaucccagcacuuugggaggcugaggcgaguggauuaccugaggucaggaguucgagagcagccuggccaacauggugaaaccccaucucuacuaaaaauacaaaaaaaaaaaaaaaaaaaauuagcggggcgugguugugggugccugugaucccaucaacuugggaggcugaggcaggagaauugcuugaacccaggaggcagagguugcagugagccaagaucaccccauugcacuccagcaugggugacaagagugaaacuccgucucaaaaaauaaauauguacauaauaaaaacaggcuuuuuagaauaacacgcccuccaaaagaacuucugaugguucgcucucaccuacagaacaaagcccagcuuucaagguauuugaacauucagccccuaacccacccuuccaggcuucuccugcacccuacaaaccagccacauagaaccccuuucuugugccuaguagaaguggucaucauuggucaucucuuugcuuuggucaugaggucccuucaguuuacauugucuuucccauuuucucccaaacaucuaucaagcuuguccaaccuccagcccagggaccacaugcagccaaggacggcuuggaauacagcccgacacaaauucauaaacuuucuuaaaacauuaugagauuuuuucacauuuuuuuuuuuuagcuuaucagccaucguuaguguucguauauuuuaugcauggcccaagacaauucuucucccaguguggcucagggaagccaaaagauuggagaccccugaucuaaauacuccauguacaugaaggucacuuucacugcuguuucuucccagaaaugucuagguccuucagguagaaguaaucuuuuucuucuuguaauuauuuuuauguucuuuuuaauccuagcuucugaggccuauaagguuaaacuguucucaucuucauggaauuguucaguagaguaaaaacaguaugcaauuucacuuaguuugucaaaauccagaaacauacuuuugaauuguuaaaaaaaaaaaaaaagauccacaggcugggcacaguggcucacgccuguaaucccagcacuuugggaggccgaggccgguggaucaccugagguugggaguuugagaccagacuggagaaaccccgucucuacuaaaaauacagaauuauccgggcaugguggcacacgccuguaaucacagcugcuugggaagcugaggcaggagaaucacuugaaccugggaggcggagguuguggugagccgagaucaugccauugcccuccagacugggcaacaagagcaaaacuugaucucaaaaaaaaaaauccauagaauuaauaaacaaaaccuggcugggcaggguggcucagacuuguaaucccaguaccuugggaggcugaggugggaggaucacuugaacccagcaguuugagaccagccugggcaacauagcaagaccccaucucuauuuaaaagaaaaaauuuaaaaaaauaauaaacaagaccuaaagguuuuacaguuuaacucuuuuuuuuuuuuuuuuuuuuuuggagacagggucucacucugucacccaucaaaggugcaauccucccaacacagccucccgaguagcugggaccauagguacaugccacgacacccaaccuuuuuuuuuuuuuuuuuuuuuuugagacaguuucacgcuuguugcccaggcuggagugcaguggcaugaucuuggcucacugcaaccuccgccucccagguucaagcaauucucuugccucagccuuccgaguagcugggauuacaggcaugcaccaccaugccuggcuaauuuuguauuuuuaguacagacgggguuucuccauguuggucaggcuggucuugaacuuucgaccucaggugaucugcccaccucggccucccaaagugcugggauuacaggcaugagccacugcgcccagcauuuuuuuaauuuuuaguagagacaaggucugguuauguugcccaggcuggucuugaacuccugagugcaaaugauccucccaccuagaccucccaaagugcuggaaguacaggcgugagucaccucaccugacuccauaauauuuuaaaagaauggugagaauuaaacacuauacacacaaaguauauuaagaaaguauaggccuggcgugguggcucacgccuguaaucccagcaauuugggaggcugagguggguggaucaccugaggucaggaguucaagaccagccuggcuaacaugaccaaacccugucuccacuaaaaauacaaaaauuagcugggccugguggugggcgccuguagucucagcuacuugggaggcugagacaggagaauuacuugaacucaggaggcagaaguugaaaugagcagagaucacaccauugcacuccagccugggcaacagggugagacucugucucaaaaaaaaaaaaaaaaaaaaaaaaguauauuuggggccaggcagcucacacguguaaucccagcaguuucggaggccaaggugggcagaucaauugagcccaggaguccaagaccagccugggcaaccugacaaaaacccaucuccacaaaaaaaauacaaaaauuagcugggcaugguggcacaugccuguggucucagcuacucaggagacugaggcacgaggaucacuugagccacggagguggagguugcagugagcugagaucaugccacugcucuccagccugcacugcacuccagccugggcgacagagggagacccugucucaaauaaauaaauaaauaagcauauuugucaauaaacauuuaaaaauauuugauaagacaaguauaaauguauauuagcaaaaucaugaaugaucuuggacccuggagagauuucauuucuaauuuuacaucaguacaacagcuuucauuuucuuaaaucccugaucaagcagaaaugcuugaaaagaaagagcacagcaggccgggcgugguggcucaugccuguaaucccagcacuuuggaaggccaagguggguggaucaccuuaggucaggaguucaagaccauccuggccaacauggugaaaccugucuccaauaaaaauacaaaaauuaggugggcgugguggcacaagccuguaaucccagcuacuggggaggcuaaggcacaagaauugcuugaacaugggagacggagguugcagugagccaagaucaugccacugcaacugcacucuagccugggcaauaagagggagacuccgucucaaaaauaaauaaauaaauaaauagcaggcaggcgcaguggcucacgcuuguaaucccagcacuucgggaggcgaggugggaggaucaccugaaguugggaguucgagaccagccuuaccaacauggagaaaccucaucucuacuaaaaauacaaaauuagcugggugugguggcaggcaccuguaaucccagcuacucgggaggcugaggcaggagaauugcuugaaccagggaggcggagguuccggugagcgugagaucacgccauugcacuccagccugggcaacaagagcaaaacucugucucaaaaauaaauaaauaaauaaaauaaaaauaaauaaauagcacagcaccuugcuuugaccccaguuguuugugaaauacagacaaucuuaccacccgggcacuuccagggcucccugucugcauguccuucacuuucuacuuuacauuaggauuauccguggcaaauacgcccagaaccuccuggagagcagagucuacaucagaucaucuuugugacccuuaagggcacccagggccaccccagagauucugauuuaaucggccaagcuaagcaugggauugaaucagguuucaguauauuuuagaaaccuccaacaguguggacugagaacugcugaguccuaacucauucuuggugcuaaaaaguauuuauugaaucaauggauaaauuaacacagugccaucucuugauagucacaacaagaaaagcagcugggaaauaguauccacauuuuacaguuggaaaaacaaacucagaaagcaaagaccauucucaucaucaccucgguggagccaguagcccuaggaaauauuccaccccaccagagagagcuacugucuacacaagagcaguguuccucagcuucugccagggugggggcuugagacuaagaauggagguauaggcagaggugaggguuucagcguggguuucaagucugucucccugguucuguggguaauucucaggaggguggagggaagggagggugcagggauugguugggguugcccuguccaucgggcugugucgcugacauaaaauccagauagaaaagcuaagaacucuaccgguauucuaccccggaauaccccgccuccgcugccaggagggagagcucccagauauccaggucagacucuccucauucuugaauuaucugcacagucccucccacgucccagccuagaaaagcuucugacuccugggccucaaacugcaaugcaccuuucagugcaauaggagcuauccaaucuccagccgcguccauccgcccacucgagcccaccuguuugcggaccacagagcggcagcacaucccuacacggggcugucaggcaaggucaacgcgcuagagugcaagagccuuugcuuugcggauugccgcagcgccgggugugggcgcagguggggauagagugcuggguuuugaaagagugacccgcaaagcugagggugcagagcaagacacagaucugggaagagcagagaaaaaacgcuccugcuucugaaccccucccaccucgcaucaccugacaagucucucaaggucuggugucgggaaaccccaccucuucaaagccccgcccuucgaaacaccagaaaguaaccccccugcccggcccugcuuucccccuacccccugccaagcugcaguuuuuuuuuuguuuuuuuuuuuuaacugggugagggcuagaaggagcgguagagauugauucauucuagccaaaccaccucucuuaacaaaaaaaggaaacugaaccccgauuggcgaaaugucuugcucaaguccauaaagcgagaccaccggcugaucuggacccuuagaaucuacccacccuucuccaccuccccuccccagcuaccuguugccauggugaugagaacaggcuccugcugaggcucuggcuguggucgcaagaggcuggagaggcugaggacugggcuggauaugcugaccaucagccaagccccauccagggcccgcgggcaguucugcgcgggggucaggccgcuggcccauuucgcagaggcggggagaggcacgaagcggcucaucucgcaguguggugcgggggcgccccggggauaccgccugaaggcagccuggagggcgcccgcggggucugaguguagagaaggaaguugcagcuguagagucaccgccgggaaaggggcuggaagggcagcguucggggaacuucaaaugcacagacuaccccguagugagacucacuuuacaaaggggaagcugaggccugaggucacugccggaucuaaagaggaggggguuucgguggaggcgacagagguaggggggcggcgagucccuagagacucaccguguacacugagauagagcucagggucgagguccggccggggcggcgguucccccggucccuggcgcaacagcagugcaccgggucucuuggccaggcccuuuccgcucgcauccuccacgaaccaacacucgaucaccgcggguccugcugagacggcggucgccaggccuggcguauagggacgcgagugaggagcgguuuguaugucuggugaccugccccacucccacccuggcaucggcuccaguggggccaccucccuccgcuucccucuaguucuugggcgaugagucgcgggguucgcucacccaaagccacagcgaggagcagagacagggacuucauggcgcugcgaccuccucagccaugaagccuccucuuccuccuuucacuuucacuuuccuccaaagggcggcaugaggggcgguggaaauccccgcucugguuaggugaaggugccugggggaccgguguuuccccacuggccaggcagggacccggguagauccucuccaguucucaccaggacaccccagccuuaccgcgcccuccuggacuacccagcagccccgaguucgagcccuccccaaccccaggcccucccccgccccccaacuccugugugugcucuccaacauccacuugcccgaaaaccauuacuccggcuucccccuaucugugccgcguccccagcaaacacacggguuaucgggaagccaaguaaaugaccaauaaauauuuuaaucacuguuaaaaaaaauaaaaaccuuguacuccuacgacuuacucccuccuugucuccacccacuccuccaugagaaccgaguugggaauuuccacgggaagucggggguggcggggagagacaggguagaaauaaagagcgcauccuugagaggggguagguucuaggacaaggguggggcucaaaggccuugucuccacgacaacacaaacacagacuucaggcacagacuacaaccaccugaccccugacccugugacugcaggauguucaacacgcccccucucccucccuccaugugcaaucuacucuguggagcaggggcuucaguguacccaucagagggaaaggaaggguuuaguucuggaaauaccuugggggggagggguugaguaguagaaugggcgggcgauggugaaacugugguuccccuuccagaauauauacaaguccacagagauaaaggaagacaguaaguguggugggagaucacccgggggccacagcgcccuugcaucgugcuccuuauucccuuucccgaaagcuaccccaccccaguagccugccccuucaguuugcuccuccaccuccaccgaagcccaucuccaccuuguggacucuggguggggaccagacacgucugcuggacgggggcguggccgcacucgcuucgucgccgcugcccccgcccacuccgggagacucucucuuggacggcaaggauggccccgugggagucccaggcccagguacggccccgaccccgcccaggcggugccggcgcucacaguguccucgguggcgcaugaagcugucucgccacaugaacuucuuggcgcagacuccgcacucguagggcuugagaccugugugcgucuucaugugcucagucagauggugcuucaucuugaacuuuuuguugcacacggggcagucaaacggccgcagauugaggugcauguucacgugccggucccgcaugcucuugugggagaaggccuucccacaauggcacagaaagaucuuauucccguccccacugccagucccuccagggaccccaccaacgcuacccggcacacccaggcuccccaccgacgugccccccacggucacugccccguguucugcuugguucccuggugguuggccaggagccugugaggaugaggaugaagacgacgacgggaagaccaggaucugguugcccugcauguccaagggaaggagcggucgaggagggugggagggggcauaggaagagggaguuggccccccugagucaucaagaccugccacaggacccccacccucauaugggccaaagucauuggaggacucacagaaguugaccugcuccucccccuugucugggggcucacucaggguacggacaucacuuaugcugaggguagccucaggcccuccccccacuggaacccuggagcuacccccuaguucuucaucuucaucauccucacaggucaacaccagaucuuccuccuccucuuccuccuccagaucugggucuuggggaaccagggguguuggcgcugggcaauuaccaccucgcuucacguauacccaguguuucuguggcaugaugcuaggggguguguaggugggucuccggagcccagccccaggaaccacugccccccucccauccccaccaucaucgcacagcucaucugccuccagcagcagcuuuccagauguggccccuccacugccaacgacaggggcugggaauacagggccaccuccucgacgcuccccacugcccacugcagaagcugcaaaugccucuugggaggaagaugagaaaucaguggacucccuggggcugaaguaguugcugcugcugggagauugauucucacuggcccggcuggaggcaugggagcgcgcagagcccaugguagcaggggccacagugcccccacucccggauggcaccccagcaccagggacagugacagagguggcugcagcaguagugaugguggugguagcugaggcccggccuucucggaguaguucagugcacuuguccacaaugugccacauuuggagcacagaccccacuguaaggaaguugacaaugucagcagcagccaugcugaggcggccaguguaagcggaggcuaggacagucucaaaggcgccuggguccaugacacugggcagcgagauggaggucaugccuuugaguaggaccugaucauggaaguaaggggaggaggcagccaggacagcccgaugagcccggaacucccggcccugcacucugauagauacaucgcagagcuggcccugcagacgcugcugauugagggacuccaagagggcacuggucaccucagggaaggacacauguaccacugcagcugcuggcagggguagugggggcggagccagcgacagcggcaggggaagugcugccccacugggagacagaggagauggcuccauguuguggagggaggggauacccccccagccacaggaacaaagaaaggaggagggcggccgggggggucucugggaagaaaaagagaaaagaauaaugauaacaucucauaacgacacagcccguuacaacucaaaaauauguucacgcucauuaucuguguaacuccccacaacagugagguagguauuccucucaaccccauuugacagaugaggaaacuaaagcucagaaagauuaagagauuauccaaggucacacagcaaguggcagcgccagcaaacacagguaucugacaaaucuugugcccuuuccuuggagguuagagaaauaaggugcucuuaggggcuggaguggcuuccuucggaauuauacccuauuuccgacuuaccugagagccugacauuccaaaaucuaccuuuuugguguuuugcacccacuuuuugggagggggcagggcagcucugcuacugaaaaccaacgcuugcuccaucuccccucaggcuaugccccccaagcucucucgccgaccacgcccccuuucgccccagcuucucuagccccgccccuuuccaggcccacccccccgugccccgcccacuaucgggccuuucgaccccgccccuugucuaccuccgcccacaacggaccccgcccccccccgcuccgccccaagcgcuaccucggccucuucucccacccggaaggcgccccccaaccucgcgcguccccgcuuaccgggccgcgcgcccccgggccccccccgccccucacucggcggccagagcagcaaccugggccccucccgccgccaucuugcgccgacucccuccgcccuccgccuccgcuccgccucccgccccuccgccuuuaaaggcacagccgggcaccccgcccgugccgcugggcaauacucggccgacucggccacuuugccuuuaaagaaacaucgccacauuccaccuuaaaagaucagguccccuccuccgcugggagcucaggacuugguucggccgaagcauuuauuccccuuuaaagcuauaagccugccuuuucccauuggcgauggguccagguaucguuccccaggcuccgccucugagcugugaccauuagcugg

SEQ ID NO: 18291 - RNA, 1232 nt, Homo sapiens
aguacaagguuuuuauuuuuuuuaacagugauuaaaauauuuauuggucauuuacuuggcuucccgauaacccguguguuugcuggggacgcggcacagauagggggaagccggaguaaugguuuucgggcaaguggauguuggagagcacacacaggaguuggggggcgggggagggccugggguuggggagggcucgaacucggggcugcuggguaguccaggagggcgcgguaaggcugggguguccuggugagaacuggagaggaucuacccgggucccugccuggccaguggggaaacaccggucccccaggcaccuucaccuaaccagagcggggauuuccaccgccccucaugccgcccuuuggaggaaagugaaagugaaaggaggaagaggaggcuucauggcugaggaggucgcagcgccaugaagucccugucucugcuccucgcuguggcuuugggugagcgaaccccgcgacucaucgcccaagaacuagagggaagcggagggagguggccccacuggagccgaugccagggugggaguggggcaggucaccagacauacaaaccgcuccucacucgcgucccuauacgccaggccuggcgaccgccgucucagcaggacccgcggugaucgaguguugguucguggaggaugcgagcggaaagggccuggccaagagacccggugcacugcuguugcgccagggaccgggggaaccgccgccccggccggaccucgacccugagcucuaucucaguguacacggugagucucuagggacucgccgccccccuaccucugucgccuccaccgaaacccccuccucuuuagauccggcagugaccucaggccucagcuuccccuuuguaaagugagucucacuacgggguagucugugcauuugaaguuccccgaacgcugcccuuccagccccuuucccggcggugacucuacagcugcaacuuccuucucuacacucagaccccgcgggcgcccuccaggcugccuucaggcgguauccccggggcgcccccgcaccacacugcgagaugagccgcuucgugccucuccccgccucugcgaaaugggccagcggccugacccccgcgcagaacugcccgcgggcccuggauggggcuuggcugauggucagcauauccagcccaguccucagccucuccagccucuugcgaccacagccagagccucagcaggagcc

SEQ ID NO: 18292 - RNA, 1232 nt, Homo sapiens
ggcuccugcugaggcucuggcuguggucgcaagaggcuggagaggcugaggacugggcuggauaugcugaccaucagccaagccccauccagggcccgcgggcaguucugcgcgggggucaggccgcuggcccauuucgcagaggcggggagaggcacgaagcggcucaucucgcaguguggugcgggggcgccccggggauaccgccugaaggcagccuggagggcgcccgcggggucugaguguagagaaggaaguugcagcuguagagucaccgccgggaaaggggcuggaagggcagcguucggggaacuucaaaugcacagacuaccccguagugagacucacuuuacaaaggggaagcugaggccugaggucacugccggaucuaaagaggaggggguuucgguggaggcgacagagguaggggggcggcgagucccuagagacucaccguguacacugagauagagcucagggucgagguccggccggggcggcgguucccccggucccuggcgcaacagcagugcaccgggucucuuggccaggcccuuuccgcucgcauccuccacgaaccaacacucgaucaccgcggguccugcugagacggcggucgccaggccuggcguauagggacgcgagugaggagcgguuuguaugucuggugaccugccccacucccacccuggcaucggcuccaguggggccaccucccuccgcuucccucuaguucuugggcgaugagucgcgggguucgcucacccaaagccacagcgaggagcagagacagggacuucauggcgcugcgaccuccucagccaugaagccuccucuuccuccuuucacuuucacuuuccuccaaagggcggcaugaggggcgguggaaauccccgcucugguuaggugaaggugccugggggaccgguguuuccccacuggccaggcagggacccggguagauccucuccaguucucaccaggacaccccagccuuaccgcgcccuccuggacuacccagcagccccgaguucgagcccuccccaaccccaggcccucccccgccccccaacuccugugugugcucuccaacauccacuugcccgaaaaccauuacuccggcuucccccuaucugugccgcguccccagcaaacacacggguuaucgggaagccaaguaaaugaccaauaaauauuuuaaucacuguuaaaaaaaauaaaaaccuuguacu

SEQ ID NO: 18293 - RNA, 1468 nt, Homo sapiens
cuuguuuacuuccggguuuauuacuacugaaggaagaacgugaguagguuaggauuucgguugagaggcuuggggucuugcguuucgcccaccaucuccuggggacaggguggagucgauauccgggacgggggggagguugcggugccccucagggcuaccucucaagagugcuaucauuuccgcaggccagaucagaaaagggagcucagguaccuuccagagagugagacccagcgcccuugucucgcacccaguaggcuuucauccccgccauggcggagcugauccagaagaagcuacagggagaaguggagaaauaucaacagcuacagaaggguaagggaacagggucgguauggucucgcccaaugcacuuacaacccaaagccauuaccgagauaagguuuguugccccaucugggcccucgcgugcagagacuuccccgccucagucucaguacucuucccuguucacucacccgcugcccccauccuuuucugcuuccucagauccauauccaccugacuaggauuguggggauagguggcacauuugauguuucuaaauugccuuuccucucauccccagacuuaaguaaauccaugucggggaggcagaaacuugaagcacaacuaacagaaaauaauaucgugaaagaggugagggacugggauuuguggggcgaggagggaccuguacuagccaugguucugaucacauaugucccaucccuccaucaggaacuggcccugcuggauggguccaacguggucuuuaaacuucuggguccggugcuagucaaacaggagcugggggaggcucgggccacaguagggaagaggcuggacuauaucacagcugaaaugugaguuuuuauuccaccaccgugugcugcacccugugaugcaagugaaccauuggaguagagguguugaaccauugcagaacagcucuccauaguggccccuaguccuccaguuccuccaacccuuuccuucccuuuuaaccccccuucuucucccuccccuggaucucaaguuuuccaccuaucucuuucuugcguuuagcacucuccauagugaguccuacuaauuucucccuuucugcuugucucccuugucucuccuuaguaagcgauacgaaucccagcuucgggaucuugagcggcagucagagcaacagagggagacccuugcucagcugcagcaggaguuccagcgggcccaggcagcaaaggcaggggcuccuggcaaggccugaccccaugguggggggaggggaggggaggggagggaaugaggcagcucuaggaucuauacuguagcuaauaaaauguaaaaacaccuggcucuguuuccugaccaggcacuucugucauauccccacagccccuuccaccuuaacacacaccaccuguauuacccccucagguucaaacucuugcacuuggaaucucuuuguggc

SEQ ID NO: 18294 - RNA, 1684 nt, Homo sapiens
ggggaggggccgugagugccgcagucggccagccauggagcggagcuugcuggcggcgaggccgcggcgacaagguagccacccccgcagcaugccucgaccgcgguccgcagcugcaccgccucuccccgccccccagggugcgcuggucccggucgcgcgcucagaccuccgcaucccgggcguggucgguuaaguccccggccgugacccaggcccggggagcuagucuccgcccuucgcucuuacggauccccucggaguacgccgcaccaugcagcucaggcucuuccggcgccuccuucucgccgcuuugcugcuggugaucgucuggacccucuucgggccuucgggguugggggaggagcugcugagccucucacuagccucccugcucccagcccccgccucaccggggccgccccuggcccugccccgccucuugauccccaaccaggaagcuugcaguggucccggggccccucccuuccugcucauccuggugugcacggcuccggagaaccugaaccagagaaacgccauucgggcuucguggggcgggcugcgcgaggcccgggggcucaggguacagacgcuauucuugcugggagagccgaacgcacagcaccccgugugggguucccaggggagugaccuggccucggagucagcagcccagggggauaucuugcaggccgccuuccaggacuccuaccgcaaccucacccuaaagacccucagcgggcugaacugggcugagaaacacugccccauggcccgauacguccucaagacggacgaugauguguaugucaacgucccugaacugguaucagagcuggucuugcgagggggccguugggggcaaugggagagaagcacggaaccccagagagaggcugagcaggaaggaggccagguuuugcacagcgaggaagugccucuucuguacuugggccgggugcacuggcgcgugaaccccucucggacaccggggggcaggcaccgcguaucagaggagcaguggccucacaccuggggccccuuuccacccuaugccucaggcacgggguaugugcugucagcgucugcugugcagcucauucucaagguggccagccgggcaccccuucucccauuagaggaugucuuuguggggguaagugcccgacgaggaggccucgccccaacacagugugucaagcuggcuggugccacccacuacccgcuagaccggugcugcuaugggaaauuccugcugacgucccacaggcuggaccccuggaagaugcaggaagccuggaagcugguggguggcucugacggggaaaggacugcgcccuuuugcuccugguuccagggaguccugggcauccugcggugucgagcaauagccuggcuucagagcugagagugccuggggccacaggaaaggcaggaacaggaccuucucucucccaggcccaacgcaggggcccucacuggcugcagcugaucuguuuccuuauaccagauccucagucucacuaaagacagcgauaugggagacacccaggggccuggcccgccagcccaaaagauggucaucgggaagagaaaaagaaaaaaaugcugcaguuguucucucaagcuagggcagaagaggggugucaagcuccucaauaaacuugucuccacuucuucg

SEQ ID NO: 18295 - RNA, 4273 nt, Homo sapiens
ccccugauaaacagacacacagaacugcagguuucaaagaggaaaaaagcacguuuguuguugguaggcgggcgugaaugggaggguucuucaccuucuccaacaccucguauagaugggacguugcagggcaauagaaaaggcagcagaugggggcguguuuugccccacucuguacaauauagaagaaucucauauagauacuuuguauaaaagccacguguccucauuuguguccucuuauuggcuggcugggcuggggguacugggggacaaagaagcuggggugauagaccaggacacagggauaccccaugguccccuuccucuggcuguccccugguggggucacuuuggauccuuggugggagcauagcacagcuccaguggccgggacaccuuccagaauuucucauucaccagcuccagggucagcgagccauucaacgucugaggaggggguaaaagggagagaggggaaaagagagaggaaaguuggagaagauggaaaaggaaaugaaugagaggcaaaaggugaccaagggaggaggaaagaaaaaaggaauaauaaaagcgauaaggcaaaaaaggacauggaugaugggaaaggagaggggacauagaaagagauagaggauguauaggggaagagugcugaugaguuagaccaggcucaugguucuauguggcccagaccacccucccuccucuccccucuucuaccacugcccucagaagcucucaccgugaacgccccgccuccaggugcgauguagaugguguacugcuuuucacugacgcccuccaggcugggcaaagcaggcuccucaggaccgucaccuccuccggcacccccacccuccccgccacacccaucagguccuccggugucagaggcgcccccuccaggcccuccuggcuccccugcuuccugcuguugccuccgcucgagggcaaugcgcagggccaaguacuuggagaggugguccacuguggcauucccaguugucuucacauaccuggaaugggagggaggacaggcuuagagccagagcgccucagaugaggacuggagguaggggcuuuccaaaauggauucuggguuggggugguauuuuggguuugggcaaagcccacuucugauggaaaucuaggugaucuuugguuucucaguggcuggggaaagacagggcuccucaccucgucuggcaguauucucccuucuccacgagcaggggguggggccggaacacgagcucaauuucuccaccuggcucuggggggcugggggccccaggagggcuuggggggcccagcguucccccucccagagucccuccccggucaccagagucuuccgaaccggcacccccacccaccccaccagugccgccucccccugucccuacacugcuccccccugcgcccccuccacggggucgcuugggagcagggccuggggcagagucaggggcggagucugagcucacaucuucuccauccccuucucccuccccgggcucuccuucccccccacucaucguuguggucugaucugacccugguaucggccgccucacacgcugggcccuguagaagcaagugguuaagguuagaaggcauccaggauaaagggcuuagacuuuaaacuucagagaauuaagagauaagaaaaauccuaaugacgauaccuaauauuuauuaaacacaaugugcuaagcacucaguauacuaaguguuuugcaccaauccccuuaccuaauacaaugaauccuaugacacagguaauuauauuaccucuauuuuauggcugaggaaacugaggcuuagagagguuaaguaacuuguuagugaucauaggcugucaccucucaaagugcgguagcagcauacacauccccugugagcuugugaaaugcagacucucgggcccaacucuagaccuacugaaucacaguuugcaucugaagaucuacagguaaucuggauacacaugaaagacugagagaugcuggccuaggaggugauuuaacuuccagcaguaugaauccggggcuuauucucaaaaucgcucuacuguucuaacuucuagaaagucaugggguaaacuacauuuuuccuuuuuuuuuuuuugugacagggccuuguucugucgcccagcaggcuggagugcagugugcaguggugugaucaugguucacugcaacauccacuuucuucccaggcucaagugauccuauuaccucagccucccaagaagguaggacuacaggcaugugccaccaugcccagcuaaauguuuaauuuguuguagagaugagauuucccuauguuauucaagguggucucaaacuccugggcucaagugauccucccauccucaccucccaaagugcugggauuacagaugugagucacugugcccagcccuauauuuuucuuaagaagagcagggccaguuguuuacuaagaaacugcaauuuacacccaugauuuccagcccuaaugaucagucuguggucagcuccuaggaugcugaggcuuagaagcuagcaggcaacaaggacugacccacggacccaucccaucaguucugcuucucuccugacccucacaccugugcauggccugcaugcguagccccuccucaaugcuggagcucaaugccugcugguugugcaggcggcucaggcggauaagcacucggucuugaugggccucguauuccucccggcuaggauagaucuuagagaucagggcaucaaaguuggggucuggccguagggaucgcuuggacaccagcuucuuucggcagguaggacacuccuuguuccugggguaggagaagggaagcccugaguggucagucaagggaacugaagccuaggcugaaccaagaccagugagagggcccuaacuuuguaccccuucaucucaucucaaacaugucucuccuauuacccgcuccguagggcugugacaaugcagucagagcagaaucuguggaggcacuccuugguggucaucguauucuucagcauguccaggcagauagggcacaugaguucugaaugcagugaccgaggggaaacagcaaucucugugccauccauuauggcuuccugaaggcaucagugaguagaaaggugguguggguuagagggaaagggguuuuagaaacagcagcccauaaaauaagaauuuugagaaauacagugagaagacccauguuggucucuauaggagacaagaauucugagaaagagaaggacugaugacuuggagcaaauggagaaaagacagacuuuaguguccauuaacuaagaguaggagcuuuggaauaggaggaucugagguggcuaaguggccuaggagugaagauggcacaaaucugugguugggaaaaacuauucaacaaaauuuuuuaaaguccuggugcuaccuguauuagaaccccauagggugccuguuaaaaauucagauucugagaacccaauucacuacugaaucagaauguuggggggcaugaagcucugcuuuuaauaaacucccaaagugagucuuaugugcacugacuuaugacacugaaugaggaacagggaagguaauuuuuguguuugugaucuuucaaaugaagauaauaauacuuguuccaccucucuggcagggcuguuuugaggauuaaaugagcuaaaugcgaaagugcuuuggaaagauuaaggugauucaaagguagggccaggcaaggcagaauagagcaaauuacggaaaagaagcugugugaugcggucuguggauauaaggguuugggggaggggguaagccugaaagggagaaugccugucaccugcgggguccggugcagcucauacagacucaguucccacguuuugcuggcauucugggcauucgccggcgucgucauggugaccgggcgcagaccccccaccagggcuccacagccgaggagaaggcgaagaaggcuggggguggggggaaggggaggagggcgucaggggggccgccccucgcguagaccccgccccuccagaagcgccccucuccgcccccgcucccgcccccgcgccggcacugccccucacccagcuccagccguucgcgcucccgccgccgccgcgccucucccuaggcccgggcuccugggccaaguucgcucgguccgcaaccgcugcucagacagcagcucccgccaccgccgccgccauggcccgggcgcuggggcccuacgucacuuccgccugcuccuccgcua

SEQ ID NO: 18296 - RNA, 3200 nt, Homo sapiens
gugaaauggcucauucacaaaguaacacacaaugggccaaauggagcaagacacaccugugugggccccaggauggcugccaauccccagcaccacaugccucaccccuggaagaacuggccaaggccuggaaaggacacagugcaaacaccaccaaagcauuuagugcugccagccagagcuuuggguagagcaagaauguguguguguguugaaugggaagggaagcuaguagguguccaacaaacccugccaugaauacuggggccaaaaaagaggggacccguaggacagauguugaucccacucaaagucagcacagcgggaugcacuuaaagggcacugagcacgcaggggcugucacaaacccaugaggaucugcagggugucucccacaagucauuucucucagaaggaucauuaccuaaaauagcagaaaacauacgaucgagguugcucaauuucaauaugcugggauccuaucucugagugcccaccucccccaaaaccucacucucucaccccaccucugcuucuuuucucccugcccauuucuuuucugacuucuuuccccacaacagaaucucugauucuccacccacguccuguucagagucauccacuuuccucccccaccccccagacucccggggccucugcaccuggggacacuggacacauaugugcccaugaugaugaggacggugcccacgaggaagcccaccaggccgauggccaggcccagggcacagaccagggucuccauggcaucuggugguggaauaggcaccuggagcucuaggagagaaaggaaggaguuggugguauaugaaaggauucuagaguaaaggaaaccuggggccaggagggugcauggggagggggcuccguaccccaaugccugaggaguggcgcauccaggccccagugcuccaccuggcagucauagacguccucggcugagggcacgaagggcagguaguggaacuugcggaacaaauggucaggcugggaauagaagcuggucugggccacucccucagugacaguuuggccguugcgcagccaggugauauugaucacaggggggaagauguuguccacgaugcagaugaggauguugggcuggcccagcuccacccgagacuuggggagcacggucacccguggaggcacuaggaggaacaggcccugaguccacaggcucaucccucaccccagggccuuacuaggacugggauuaagggacguucccccuuuguagccaucugugggcaggggaugcucugggguauccacuggggcaggagaggaggaaaacagagggagaggagacuggggagggaguggggacgccaggagcuccuauauuugacuggucccugggcgggaguccgggugagaggugucauuccucaaggagaggggugccaaaggggucugggaagaccuggagccuccugggaaagaaaggaacagggcaugacaggcgcgggcgcugagagcgcgccccagagugaugggagccuaggaacugggaggaaguuucucuggaccuucccgccugacugggugggcagagggagggccgguaccguugauggcucugcugcgguuggagcgcuccaccaggauguccagaugggcuuugauugcggcgaugccggccagcccgcccugcgggucaaagcgggcaaagucaccaaacucaggcagacgccacacggccucgcuuuucuucagguccacagagaacagcuguuccucaucaaauucaugggugaacuggcccgaggcgccguaagacugguagaaggcggguccguaggagcccauguggucagcuguguuuggcgaguucagggucaaggagagagaaaaaaaugugucugucucauccacaauaugugauuguugagucccugagccugggccccguccuggguucuguguggggacagaguccuguucugacacugggcuggcccugggagagagaaagggagagagaacaggaagaaagaggcucaucccagcacacugcagucggcacagagacagugcagucuggcauaucaggaugggaagaggagggacugccuaaaaucaugcuugggguuccagaauuuaaaucuuggcuguggucaucugcccuggcuguguugucaggcccuguguugugagcuggugggacugugggggugggaugaggaggaaugauuaaggacaggagaguauggagcuuugcacagagaugcagugcaggugggugugaggggaaacaggccacggcuggcagggguaagaauuaagguuagugacccagagaccaaggggauagggagaggcaacucaaggcauuacaaagagcacuggacgaggagucagaagucaagguucaugucccaauuccuccaucucagagcauuaugacugaguguggcucuuccauaacuguugucuaguuuucuggaaguuagggauuaaguuuuaauucuuguagaacucuaugaaguuguuugagcaacaguuauugaggaacuagcaugcacccagcacaauggggggccagggaaauaaaagaaaaaaaagaugaaccaucuguagacccgcaccccagcucaugucucccgaagaacaaagacagguaaauaguuaacuaccggcaugggcauaaauacugcaacagaacuggacuugaucgggcacauucccggccaggggugguagagaaaucagggugcuugcuggcaucuguuggguggagguuugggucucaggaaggaggaaggaaugaggagaaaucugaacgucagcaaaggcugacuggggcaccugcgcagcugaccgagcugcaucuucauuuagguccagaguggaugugacagagaugagggggauugggugucucuuggugaaggaaguugcccauaaaccagagagcgagaggaacaagcauccuccaugccaccuccucauguaacccaacuccguaaaucucugcuccccgccgcacccuccucgcccucgcacucacccuugguggccccugccuccugcgggcucaggagggucaucaggguguggaaccccaggaccagcccugcucugagggccauuacacucuggugcuuuaaucaaaucagucucaguccguguggugaggacaggaacaaggcggagguaaagaagaagaaaac

SEQ ID NO: 18297 - RNA, 1854 nt, Homo sapiens
cagacugaaagaauuuaauauagagaauugguuacaaagguguuaaaagggcaagaaguacaaaaaaaaaaaaaaaaggagaguccuagaaauguacauuuuaaaaaaagauugcuaucuggaaaucagaagcugccaucaucccugagcuggaaucuguaaaucuacucauugccuugugagagacacugucauagucaguuccaaucuacuagaaaggugccaccuccuucaaggcuagaauccuugagaagguacuucugcucaggaggcuggaguccugagucucccauucuuccugcugcuacagcuacagccaauagcuaccagcuauugccagccaccgacacuguuuagaggcugaagcaggaugcuucucaguuucucuugccuucugaucucccaucagugccuccuacuggcagaaucaaaaaggaagccagauguccaggaaggcugggaaauacacaccuggcugacuccuaagcuaagcaguucaaaacacaguagaggagggugugugugucacugagacaaagauaauaacgaguacacugaaauacccugguuuguaagaaucugguggcacgaggaccauccagagcacuaagaaaagaccaagguagaagcagaucagagaaauaaaaaagaggugugccaugaaggagggcaaggucagcauuuuuaaaugcuacucaaaagucaagaaaggauugaaaaguguccuuagauuuggugauuaugagauggcugacaaauuuauugagagcaguuucaguguuguagugggagucaacuccagauuguggugggcugagaaguaagugggaggugaggaagaaacugucaguguacaugcuucaaguuuguuagacaaaagaaagagaaagacagaaggggugggggaagaggcagugagaaagcucuaauguggcaaucaaguaaucugagaaauuaauauaugugaauauuguccaacaguguuucugaggcuuucaaaauucauaccuuccaccuuuuuuuuuuuuuuuuuuaagacaaaguuuccccuguugcccagacuggagugcaguggcuacuuacaggugcaaucauaacucacuccagucuugaacccccgaguucaagcgauccucccgccucaguagcuggggacuauaggcacaugccacugugccuggcuucauauccucuuuugauaaacaaguaauagcagcaguaauagccaaaaacaaaaacaacucuaugaccuccuagauauucuggaacagcaauguguauauaugugugugugucugugugguggaggcagggugccagggaaggacuaggguuuggaaaucaugguaacccuccagaaaacaaaagaacauuucccaguaucccaacauuuaugcacuaacccaucagcgguucuggcaguggggagauucaggccccuggacaguagaaaagaaguuuaugagacuaccaguggggagacauaugggacacagccaccuagaguccuaaaccagggguuagcaaacuuuuucuguaaagggccagauggcaaauauuuuagacauugugggcuaucagaucucugucaugaguacucaacuguggcacgaaagccuccaugcacaauauguaaaugaaggagaguggcuguguuccuaguuuccuccuagcuuuuccucccacuucuugagcaucuccuucucagucuccuucauagacuccuuccuuucagcuacucuuuaaauacugguguucccuggaguuuuuguccucaacccucuuuuuauuuauggacacuaaaauucaaauuucauguaauuuucaugugucacgaaauauucuucauuugcu

SEQ ID NO: 18298 - RNA, 13902 nt, Homo sapiens
uagcuucccguugacgcuuccagcuaagagucaaagcacccgcuuuuuccaccagccucgcgugccuguucccuucacggacacucuagacgaccccccucagaaaagaaauacucuaugcucauugcggguugcaagcgcuggcugcuacaggcgaccucccugcgcucccguuggucucugcauucacuucuccgcgcgcgcuuccaggguccccuggccgcugcaucuccuccaccccucugccaacccucaagcccagacccauuaccccgguguggacuucucccgcccgggguaaguccccgguuggugcucccgcccgcagcaucccugcaaggcaccgcucuccucgccgccuggggcacugguuuccaaccugggacagcgcacaacgcgcagccgacagccccgccccuucgcggcgccgccaggaggcgccugggugcugcggggcugcuuugcgcgcggcgcuaacguguguagggcagaucugccccgagacaagugacgaggcagccccgcccugaggcuggggugggaaaacuggugcaaguggaaaggcaggaggcagggagaggcgagaagggugugcgugauggagaaaauugggcaccagggcugcucccgagauucucagaucugauuuccacgcuugcuaccaaaauagucugggcaggccacuuuuggaaguaggcguuaucuagugagcaggcggccgcuuucgauuucgcuuuccccuaaauggcugagcuucucgccagcgcaggaucagccuguuccugggacuuuccgagagccccgcccucguucccucccccagccgccaguaggggaggacucggcgguacccggagcuucaggccccaccggggcgcggagagucccaggcccggccgggaccgggacggcguccgagugccaauggcuagcucuaggugucccgcuccccgcgggugccgcugccuccccggagcuucucucgcauggcuggggacaguacugcuacuucucgccgacugggugcugcuccggaccgcgcugccccgcauauucucccugcuggugcccaccgcgcugccacugcuccgggucugggcggugggccugagccgcugggccgugcucuggcugggggccugcgggguccucagggcaacgguuggcuccaagagcgaaaacgcaggugcccagggcuggcuggcugcuuugaagccauuagcugcggcacugggcuuggcccugccgggacuugccuuguuccgagagcugaucucauggggagcccccggguccgcggauagcaccaggcuacugcacuggggaagucacccuaccgccuucguugucaguuaugcagcggcacugcccgcagcagcccuguggcacaaacucgggagccucugggugcccggcggucagggcggcucuggaaacccugugcgucggcuucuaggcugccugggcucggagacgcgccgccucucgcuguuccugguccuggugguccucuccucucuugguaaggggaacgcagggcaagaggggaggacacaaggggacugggacaggaaucaaagguaauugucaguaagguagaguagcguggguucugggaaauguggagcaggagaaggacuccuagcgugggucuuggaacaccacuucgguguagaagaaacggcacuggacuggcgggggccagagguucugggcuccauugcugaccgggucuugauucuuugggccacgccggaagcggggaaauccuuugcucuggggccgaagggcggggcauccucaucucuaacaggaggcuuuucuacuucaugaucuccagccuuccuaauaaaauccugaaaguucugguagagcaaccacaggguagugaguuccagggcagccuauuuagguucgggauugagacgucaguguuuccuuucugcugaugcccuccaggauaauggugagggggaggaggcgugguggggccagucugacuggaacugaccuacuuagacuuaauauuugugcgugaccucucuucucuuucuccaggggagauggccauuccauucuuuacgggccgccucacugacuggauucuacaagauggcucagccgauaccuucacucgaaacuuaacucucauguccauucucaccauagccaggucugggggcugaaaauggggcacccugcaaaugagggaguuggaaguuggggcugcuguccgaaaugcacuuauauggggauaccugggaccuucagucuguucccugaacacacccugauccccuuuuuuuccggguucuuuauagugcagugcuggaguucgugggugacgggaucuauaacaacaccaugggccacgugcacagccacuugcagggagagguguuuggggcuguccugcgccaggagacggaguuuuuccaacagaaccagacagguuucuccugaaacucuuucauuauacgccauguacuguucauauccucauacaucugcuuugaucuccccccuccccgcucucucucucucacacacacauacacacauuguuccuucucauucuugauauacccucucccugucucucucucucugucucugucucucucucucucucucucacacacacacacacacaauuguuuuucucauucuugauauaccucaggagcaaaauauuguccuccuuaccuuaagaaaaaccuagaguuuucaucuagcauuuucuuauaaaucuauuccuauguauccuuagauagaaaccauagaauuucaaaccuggaaauuuugagcucauagagaccaacugccucaucugacagagaaggaaacugaggccaagacccuaaaugcugaaacugcacaguuacauauggcuagagacacacuugggguuagaacccuggucucuugagugcuccacagacuucggcaugcuuucuagcagcacuagaagcuguacaguuacauauggcuagagauagaccugggguuagaacccuagucccagugagugcuccacagacuuuggcaugcuuccuagcagcacccuccuccuccaucucuguuaugugaccaguuuaagcucuuccugccuguguguauagcaugggacauacagguucucuagggaacagaaagcuuucaggaaaauggaaauucacaugugcauuaaugacuuuauaauuaaaaugaaggucaggccuuuccucuuuaacacucaucuucccugcacugagauuugcagaccucuggagaacccuaaccuuguuuccugcagccuccuuagaaccccauguugacaccccugacccuggcauccuggcucauuguuaguucgucucaucacuuggaaccugucugauucaccucacucucuucuccccaacccugcagguaacaucaugucucggguaacagaggacacguccacccugagugauucucugagugagaaucugagcuuauuucugugguaccuggugcgaggccuaugucucuuggggaucaugcucuggggaucagugucccucaccauggucacccugaucacccugccucugcuuuuccuucugcccaagaaggugggaaaaugguaccagguauguucauggaguuggcccgcucuacacagacccucaucucccagacuuggcagacucaguuccucucacauugcuuucaguccagcuuuccuggcacccuuacugauucuccaucuucauggaacacccugucccugugguccauguucccagguugcucaacauuaaccuccauacucucugggucuucuuuucuagcuucuccccacaaucugucuuuaagaauuugauccccaacccguucugagucauuuuccucuuccucguauuucuuuagcauccaaggggcauagcugugucucuuucucuuuucuccuuuuccucugucucuucucaccuuuaauuuccaaauagguaacucagguauuagugucccugaugguuugccaacccgugugacaucucuuguccauguauccacaguugcuggaagugcaggugcgggaaucucuggcaaaguccagccagguggccauugaggcucugucggccaugccuacaguucgaagcuuugccaacgaggagggcgaagcccagaaguuuagggaaaagcugcaagaaauaaagacacucaaccagaaggaggcuguggccuaugcagucaacuccuggaccacuagugugagcaccugaagaugaauacccauucccuuguccuuaagaugccgugacuccauucccauuccuaugacccugcucccacuccuccuuuacugggaaaugguugguucaguauuuucguccuagcaaccugaggcucaaugacucuacucagugucccuagcccccucccucucuuuaaagaugcuagguggcuuccuuucaguaugguacauaaaauccacccaaccauguggauuggagagaugcgugucuuccaguccuagggccuuccuuugccucucaggggaagugcagggcgccauaaauucuugcaccugggacugcuucaugcugguaccuuguagauuuguuagugagagugaugggaauaguggaagccagggaugagggacaucugugaugcacuggaaagagagcuacgccagugauccgaagauccuggcuugaugaugcaauuuacuugucuugugaucaugacaacaaauuuaccuucucugagacuguuuccucuuuauuuauuuauuuguuuguuuguuuguuuauuuuuacuuauuauuauuauuuuugagcuggagucucgcuuugucgcccaggcuggagugcaguggcgcgaucugggcucacugcaagcuccgccucccggguucacgccguucucccgccucagccuccugaguagcugggacuacaggcacccgccaccacgcccggcuaauuuuuuuuuuuuuuuuguauuuuuaguagagacgagguuucuccguguuagccaggauggucucaaucuccugaccuugugauccgcccacuucggccucccaaagugcuggaauugcaggcaugagccacugcgcccgacugguuguuuccucauuuuucaaaaauggagugauauaaccuucuuuauaaggcucuucauguauuagcugacaucacaugaaugaaagccuuuugugaagaguaaaaugcuccccagacaaggugauaguggugaugguggugaagauaacugugacuugcaugaugugcauugagucagacuccauggggucucugguucauucuccugucugccuauugagccugccgaugucacuuaggagacagggacuugauauuuccuucagguuaaugacugcgguucuuuguguccccuccagauuucucuaccucagucccuuuuuuuguggucucuuuauagauuucagguaugcugcugaaagugggaauccucuacauuggugggcagcuggugaccaguggggcuguaagcagugggaaccuugucacauuuguucucuaccagaugcaguucacccaggcuguggaggugaggucccuccaccuucacuccccagugugauuccuuccucuggcccagcaccaucugugugauguccuuccauucuuuacccuucuugcuucacauaaugcuggcaagcagacuaccucacuuucacuauucuuaccucccucuagguacugcucuccaucuaccccagaguacagaaggcugugggcuccucagagaaaauauuugaguaccuggaccgcaccccucgcugcccacccaguggucuguugacucccuuacacuuggagggccuuguccaguuccaagaugucuccuuugccuacccaaaccgcccagaugucuuagugcuacagguacaaccuaccacucccuguauuccacuggccccaacugcaauucugccauccuaaauuuucuuccugccuucagccugcuuacugccaagcauauauccucccuaacccuuuaaaggcaaugguaggcaucaucuguuccauaaaucuuccccaaacucaagaacccaguuugggcuuccaaagagaaugagagaagagguuucgaagagagugcucucacguuccaaggaauugcugcagcaaaaucugugucuucggucuuccaucuuuccuuuuccuuuguaauuuggaaugugauuuuucccuuuccuggugguaucugacaucaaguguguggcauaguggugcugggucucugcccuugucuuugccgcuucuucuaucucuacuccuuggggaggcaucacccagaaaucugugcaugugggaggguaggaguuucuauauuucccuguuuuucuucugggguaagacaucaugcuauguaacaaggcaaugacacucucaagguuagaggccuugguagccucuuaucgugugcuucucuggccucuaggggcugacauucacccuacgcccuggcgaggugacggcgcuggugggacccaaugggucugggaagagcacaguggcugcccugcugcagaaucuguaccagcccaccgggggacagcugcuguuggaugggaagccccuuccccaauaugagcaccgcuaccugcacaggcagguauggaagcagguggcuugaaggagggcagggagcaucaaauacgaagagcauucuuacugagcacucugaaagagggguuagggaaugauaagagaccuuggguggagauggugguguagucaggagggagguaguaugauuuugugacauguucucaauaaagauuuugagucuucgaucucuagauaaccauacucccaugugccuuguucuaugacucuucaucauauuucaucucagguggcugcagugggacaagagccacagguauuuggaagaagucuucaagaaaauauugccuauggccugacccagaagccaacuauggaggaaaucacagcugcugcaguaaagucuggggcccauaguuucaucucuggacucccucagggcuaugacacagguacucucuccacucaucucaccacccagccaucuuuaccuuugcugaaaccccaguagucuugccuuuauccuucaguuccuccuuacucauggacaucaauuugaaguuguaagaucaugcuccuauggcuucuucauccugacauccucaggauucuguucaucuucccagaaucuccccuauccagcuacaaccgucagaucuuggugugugugagugcgugaaugcaugagugugucugugugcauguacaugcgugcacacauguggcuauaccguucucaucuuggcccuuugcucugcagagguagacgaggcugggagccagcugucagggggucagcgacaggcaguggcguuggcccgagcauugauccggaaaccguguguacuuauccuggaugaugccaccagugcccuggaugcaaacagccaguuacaggugaggcagucaucuucuuaauggcuauaucccacccaaucuugcuucuuuuauacaucuucuguuaguuuuacuaacaucauaauuauacaaaccaguccuugcaguucucaguucccaaauccaguuccauuggaugccuccccaaggaguagagauagaagacgaggcaaagacaccuagaaucaguuaaaagagacuaucuacaaacuacagacugaauuucuuucuuucuuuccuuuuuuuuuuuuaagacagugucucacucaguugcccaggcuggagcgcaguggcacaaucuuggcucacugcagcuucaaccugcugggcucaagcgauucuccccucagccucccgaguagcugggacuacagguguacaccacuaugccugguugacuuuuauauuuuuaguagagauggguuucaccauguugcccaggcuggccuugaauuccugagcucagguaaucugccccccucagccucccaaagggcugggguuauaggugugagccacugcgcccaguccuauagacugaauuucuaaagcgaaacauaaggaaaagaccauccucauaauaucguuuauuuaaaaaaauuauuuuuuguacagacagcgucccgcuauguugcccaggcuggccuugaacuccugggcccaagugauccucccuccuugaccucccaaagugcuaggauuauaggcaugagccaccgggcccagcccauccuaaucauauuaauauuaauuaagcuagucuguuuacaugcacugucacucauuuauucauuaggaauccuucugagcuaggcauuuaucaucauucuacagaugacaaaauggagguuaaaagagguugaauaagcugcucauauagaggucauauagcuuuugaguggcgcagccuugacccaaauucaggucugccugacuugaaugcucaucucuuuacuacuaaguuauauuuccuuaaaaucgaauauaaaaaugccaaguccauggguagagaagaggacuauucaauagucuuuauucuucugucacguguuucacccuaggguucucauuuuuauccuacuuuugcacccuucauguaaaacaguccuuaaugaaacaaaggguuugcggagaaguacucagaaugggaaacguugguguccuugggguuguuagcagagccagcagugauccugugaggucagucccagcccuggaaacacaggugucucccugggcugaggguaguccccggcucugacgguccgaugucuuuccucagguggagcagcuccuguacgaaagcccugagcgguacucccgcucagugcuucucaucacccagcaccucagccugguggagcaggcugaccacauccucuuucuggaaggaggcgcuauccgggaggggggaacccaccagcagcucauggagaaaaaggggugcuacugggccauggugcaggcuccugcagaugcuccagaaugaaagccuucucagaccugcgcacuccaucucccucccuuuucuucucucugugguggagaaccacagcugcagaguaggcagcugccuccaggaugaguuacuugaaauuugccuugaguguguuaccuccuuuccaagcuccucgugauaaugcagacuuccuggaguacaaacacaggauuuguaauuccuuacuguaacggaguuuagagccagggcugaugcuuugguguggccagcacucugaaacugagaaauguucagaauguacggaaagaugaucagcuauuuucaacauaacugaaggcauaugcuggcccauaaacacccuguagguucuugauauuuauaauaaaauugguguuuuguacugugguuucuuauguuuccggcacaccaaacggcccacugccuuuugcagcgcacuuuucagcugcggaugucuccucuuuuaucauccucaauguuuuacccccuaacugcaucaccuuuucccuuaagcuuuuuaauuccuaugaggccccuuccacuuccccuauccccuuaggcccacccccaagaaugugcaagaccccagccacagggcccaucagggcacuagcggccgcagcucagagccguggccucuccgaaguggcagauggggcgggcgcggccagagcaagugccaggcgggaacagagggacugggcgcgccucacaacucaccaccucgcccgcugguccuuccuggcucgccuggcucugaagcugcaccuggaggggaaaccucagaacaguaggcgggauugccuaguaaauaucucccauucagggaggcccaggucgugugacgucgacaguugcuggguagaugaggccaacacagguugcaagaagaggcgggguuuagaggcgugaaacuccgcagugcucagccaagcagggagcaacgcuaggaagggcgggcagaaagggcacgcucuugugggugacuacagguuaggagaccguugaaccuggaggggcccuaggauggaccccguggaaagauucagagacugcgcccucucccuggcgccgccuuccccuacacgcggcggguauauucuguugcaguuggcccaggaccuguuuccaagacucugcccccucgcacuuccgucccuccugguuuuguaaagugaugcucauaggaacccccaccccgcgugacacuacucccagcuccuggcugacuucuagucuucugguugaagcugcgccuuuagaugacacgacccuacccaccccuguuuccagcggaugcccgggccuggagguaccucuuacuguaacccaucgccaagugggcuuuugaaggcgccuguuccuuucucgcuuucuucggaagacccuugacccaucauucccccgacccccauaacgggagagcagagaagccgguccccagugugaugguccugguccaggcacuaacuguccuuuucucggaaaaggcagggggauguggaaaagagucuuguucccuccccuucgaucuguggcuuucgcuuucacuuccuccuccgagagcggacagaucucugggugcugggcggucauggcgcuacuagauguaugcggagccccccgagggcagcggccggaaucggcucucccgguugcgggaagcgggcgucgcucggacccaggacacuacaguuucucuaugcgaucuccagagcucgcuuuaccccggggaaugcaggucggggcaguagggaagccccuagggaugcagggaggcgggcgcugaggaguggagggucgccugagaggaggaggcgagagcgggagcgcgggguacagggucggggguagccuucagucccggagagcgccagacccaaagaagaggccacauggggauggggccugagaggaggaagugcaaguuaggacaaagaguuacaggugaggugggggcucccaaaggaagacaagagaacuuuccugcccuuguccacacacaaaugguggagccuuuuucaugggguuaucacaugauauaggagguguguggugucuugggaaaccuaugaaauuugccugcuggccuccucucagcaacucacuguugcgcgacuuagaacaagucacuuagucuaggucccaagccccucuucuguaaagugaggauacuguuacuaaacguguuuugugaggguugaaugcuuuaugcauggaagaaacccuuuaagucacucucaaaauuuuuuaguaaugguaacaugugcuugcuuucauuucuguugugcuggaaaauggaaaagguugauacuggcaugccucuucuuuuccuucucccaagccauuuccuucuagagauugguuauuaacuguuucauuuauugaugguuagaucauuucugcauaucuccucacccucauacucccuaaaaccuuuuccuggagccucuuacuacagaauuuuucauugccuuucucaaccucuuuucucuuaucagcccacagaauucuuccagucccuggguggggacggagaaaggaacguucagauugagauggcccauggcaccaccacgcucgccuucaaguuccagcauggagugauugcagcaguggauucucgggccucagcuggguccuacauuagugaguguauacgcuccagcaggcagaaucuggggagcugggcucuccuuuccacaggaggccaacucugcaacaaaguggaaguggauauugauuuaggacacacugggggaucuauggggucaucccuucucucccaaagcuccaucuucuuccaggugccuuacgggugaacaaggugauugagauuaacccuuaccugcuuggcaccaugucuggcugugcagcagacugucaguacugggagcgccugcuggccaaggaaugcagguaagcgaggccucucaucuuccuuucuuagccuagugguuaaucccuggaucucucagaucauugcuccuuacucuuguccuaugugguccaucuuagugcuaauaguauauuucacaaaacagcuuuuuggugauaagacccuucucccaaaucucagccugugcuccacucauaagccagauaguacgucagguauuuagcacugacacauccacccuggcgggacaguaucauuuacuaggcugccuuuguauguuucagauacuuuaaauuccaaaucuuucucugaucuuuagauccuacaaaauaauuccuuuccaaugcuuaucucuuuaaucauuuccugccccaucaaguuggaaagagcuaaccucucuuuccucacuccaccuuguccucacccaggcuguacuaucugcgaaauggagaacguauuucagugucggcagccuccaagcugcuguccaacaugaugugccaguaccggggcaugggccucucuaugggcaguaugaucuguggcugggauaagaaggugggugcucuccauucuucauguucccccaccauguucccuauggaugacagaucuguuucccaucauauacuccuacucccucccugacaagaugcauggcauauagagugcuugguuauagaacuguuucaguauauccauggacuauuuauuggcccagauaugaaucauugcauguguuuuguaagcuugucccuuuuguuaaacaguugauuucaaguuuguuuuuccuuuuucauuucuaaaguucgaugacuuuaccaaagugguuuccuaauuccaauguucuugugguaauauuaauucuuuuguucacuuuuuaugucucauauuugaacccccauguuaccaacaucuuccucuccaauuucagccugaaaucuuucaucuuauaggguccuggacucuacuacguggaugaacaugggacucggcucucaggaaauauguucuccacggguagugggaacacuuaugccuacggggucauggacaguggcuaucggccuaaucuuagcccugaagaggccuaugaccuuggccgcagggcuauugcuuaugccacucacagagacagcuauucuggaggcguugucaauaguaagagaccaaugcucccaccaccaugccugggaggagucggcgggugguggggggggugauuuaagauugagaaaccagccuggccaacauggcgaaaccccgucucuacuaaaacuacaaaaauuagccggacguggugacgggugccuguagucccagcuacuugggaggcugaggcaggagaaucacuugaaccugggagguggagcuugcagugagccaagauggcgccacugcauuccagucugggccacagagugagacuccuucucaaaagaaaaaaaagaaaaugauugagagacucaaaggagggagaguaguagggaggaaauuuucagagucagaagaagggcauuaaaggcccagucauaugguuuuaagcuugcgcaugugucuuguugcugccuucaacauaacaucagugacaggaacuugcugaggugaaaggugacuccauguucuuuucucauuuguccacaguguaccacaugaaggaagaugguugggugaaaguagaaaguacagaugucagugaccugcugcaccaguaccgggaagccaaucaauaaugguggugguggcagcugggcaggucuccucugggaggucuuggccgacucagggaccuaagccacguuaaguccaaggagaagaagaggccuagccugagccaaagagagaguacgggcucagcagccagaggaggccggugaagugcaucuucugcguguucucuauuugaacaagcauuucccccagggaaguuucugggugccccacuaaguagaauaaagaaaaacgguuauaaauaccucugucuuguggcugaaugggguugggccugugguuguuggguggggcagaaagua

SEQ ID NO: 18299 - RNA, 4048 nt, Homo sapiens
uacuaaggagcaaagucgguauuguaggguuccauguuuuuacgcaaagucucucucccuuaggcccugcagaguccuaaguugugggguuacuuuaguggcaggaaaguguuuuugacuacuuuuucucaucccagcaggucucugaggcugugguugcuacagggucaccacgagcuuggcuuacuugucucauccuucccuugccugguaucauuuucucaguucucccaaaagccaugucccggcccuugcucaucaccuucaccccagccacugaccccagcgaccucuggaaggaugggcagcagcagccacagcccgagaagccagaguccacccuggauggggcugcagcccgagcuuucuaugaggcccugauuggggaugagagcagcgcuccugacucccagagaucucagacugaaccugccagagaaagaaagagaaagaaaagaagaauaaugaaggcaccagcagcagaagcaguggcagaaggagcaucaggaagacauggacaagggagaucccuugaggcugaggauaagaugacucaccggauacugagggcagcccaggagggggaccugccagaacuuaggagacugcuggaaccgcaugaggcaggaggagcuggggggaauaucaacgcccgggaugccuucugguggaccccacugaugugugcugcucgagcgggccagggggcagcugugagcuaucuccugggccguggggcugccugggugggggucugugagcugaguggcagggaugcggcucagcucgcugaagaagcuggcuucccugagguagcccgcauggucagggagagccauggagagacaaggagcccggaaaaccgguaaggggaaacuuuagcucagacccaugucucauuguguucugccucucccagccacaccacaccagacgccccagcacagugcugaagaguucuuuccuuauccucauguguagguugacaggguaguauagucaagugguuauaaacaugagcucccuggauuuaaagccugauuccacuuacuugggcaaacaaccuaaugucuacauguuccaguuuucucaucuuagaaauggggguaguaagaauuguuguuaggauucaauggguuaauauauguaaaaugcuagaauagugcaugccgcauaguaugcaauacaugaauguuagcuauagucauuaugacuaaugucccuccccuugcccaagaguuugcuaggucugguuaccauuuuuuucuuucaacuauucugcucuggaucccacaaugguuuaaagaaauuuguuuuuaagacaagucaagugcaguagugagaaggaggggaaaaguggaguaaggaguuugaucuguaacugagugaacaauuaauucagauaacucaccaccaccuuuggaccagccuggaucccucacuguuaaguaggaaggaaggcaauuugucccuuuuuuuuuuuuuuuuuuuuuugagacaaagucucacucaucucacucugucgcccaggcuggugugcaauggugugauuucagcucacugcaaccuccgcuuccugggcucaagcauauuuuuuguagaaagcaggcuuugccgggacaugguggcaugugccuguaaucccggcuacuugggaggcugaggcaggagaaucgcuaagguggaaguugcagugagccaggaucauggcacugcacuccaaccugggcagcagagcaagacuccaucucaaaaaaaaaaaaaaaaaaagcaggcguugccauuuugcccaggcuggucucaaacuccugagcucaaagccaucugcccgccucugccucccaaaguguugggauuacaggcgugagccacuaugccuagcuggcaauuuguuccuuagcagaaaagcugaaaagauccuauucuacccugccagcccccucugaggccucaacucuuccccuuuuccuuccccugcccuuaaugcuuuuucuucuuucucugcaggucuccuacucccucccuccaguacugcgagaacugugacacccacuuccaagauuccaaccaccgcacauccacugcucaccugcugucacugucgcaggguccucagccucccaaccuuccacuuggggugcccaucuccagcccgggcuucaaacugcugcugagggggggcugggagccaggaauggggcugggaccccggggugagggccgugccaaucccauccccacuguccucaagagggaccaggaaggacuaggcuacagaucagcaccccagccccgagugacacauuucccagcuugggauacccgagcuguggcugggagggagagacccccucggguggccacacugagcuggagggaggagagaaggagggaggagaaagacagggcuugggagcgggaucuaaggacuuacaugaaccucgaguucugacuuugguaaagucugacccuagucugcugcugaagucugaacuugggccucugaccugggcccuuugacuuccccuuccugggaucugcucagaugcagauccugaaguuuuuggucaauaggcucugucuucgugagagacgggcugagagucagaaauaaaucaaccauuugugguuuauucacuuuucuggaagcuauuuugaggaagccaaacagaagccugggagccacaugcaagucccaccugagucagaaggggcagccucuccagguggcaugauaaggucaccucccugccaaucuggguucacuuucaggucccagacccuccugggagucccccaccuauucuuucaaccccccuggaccaagaauugcccagcuucgugcaagucucacuucccccaggaggaguucccugacuacagccaauucacugauuucacaaacauaaguccauauacuaugugccaagaauacagguaaagacauucccaacccucaaagaguucacagcuggagagggaaagugccauguuaucaauuuuuuucuuuuuuuuuugagaugcaguuucgcucucauugcccaggcuggagugcaauggcaugaucucggcucaccacaaccucugccccccgaguucaagggauucuccugccucagccuccccaguagcugggauuacaggcaugccccaccacgcccagcuaauuuuguauuuuuaguagagacgggguuucuccauguuggccaagcuggucuugaacucccgaccucaggugauccgccggccucggcuucccaaagugcugggguugcaggcaugagccaccacucccggcccauguuaucaaauauuauaaugcagggugauaagggaagucaaggccucuagagaugagaauggguaggguuuugcuggaagaggccagugugauaggaaggcccacgauuaucaagcuuguacacuuaguugaacugggaccagaacucuagcccccaaaucuaaacuuuaaacuucuuuguuccacccauuugucuacacuuuucuuucccacacuuccccacucucccaccacccacccccuugucuugcucaugccgggugguaggcacaagaagagcucacuguugugaaauccaggaauucaaauuugcagacgggcaggggagggcuguucaagucgcaagacuccucauuuuuucuuuucugggaaagccuuucaugaagucuuggaugcgaaauggaggaguggugggggauguggaaaagaacccaggggcagggggcuguagggggcgaccgaguuuagggaagcaugagaaacccgggaaaauggggagcuggguuuauauuaagguccugguccuugcuaaucucgguuuggcgguccggcgcgcacagacagcgcgggguauacgggggcggucuauucgcaggguccgccccaugagcugcggcaccgcccccgcggguccuuccaguccuggugcagcugcuuccgggcuucgcggcucccggcggcuccccaaggccgcggccccgacgcugggcccgggagcgguccccgcgcacagcgcccggacgcgua

SEQ ID NO: 18300 - RNA, 1472 nt, Homo sapiens
ucaccaacaccuccaagcugucaggcuccuccacagcgguacugguacuaucauuaggcuccauggccgacaggucucuaaagaagaacgaaggaaggaaggcccgcuguugcccagaccagaguguacccgaaagacucccuagcauuaaucccugccccaauaccuaaaaaguuucuccugcacacacacacauucacaccuguccccaucccccuucugauuccggggcacagggagagaaacacaaagggcaggagaucgacggcuuagggagcuggaggacgagaggugggaggggcuccacgacgccaaucacaauaagcagggagccagucagauuaggaaggaagcacgagaccagagacuagugucaucaccggucacggcaggacaagcgccccagaggucggaaaauccugggacaacgcgaaagcgguggucgccccacacucugcggagaaagugguuucgcgcacgcgcgccacgcccaucgaacccuccuaacucacuauagacccgaaacggcacucacggggcgacagaccugcuagcugacugcccgcgucuacugccuucccacgguguuccagcagaacggcacaacuaacccacagccaaacacacacacacacacacacacacacacacacacacacacccaccaccccgcggcuccgcccccgacuuccccacggaccgucacuuccggucucccccaaaccugccaccgacggccacuuccguuuccccgauaguauuuggggaucucgaagcgauacuuccggcuccccccagguccccaagcuuuacuuuuguggggcacgacgagaaaguccgcagccccaaacagugaguuucugagggcgagucgggccggggccggccuaggugggagggagccgagcaccccgaggagccgccaccgcugucgcccgggggaccguacuacgccugcgugcgucgcacuacggaugcguggacacuuaagcaucgccccacccccuccccccucuggcggcguucacgucugugcgcgcgcuugagcgcuagaagauugagguggcuaccguaaaugccugaaaaacagucaccagcugggacucuaccacugccucgagaggggcuauggacggucguauggaccuuggacuuuggagaugggggauuaugccacauucaucuauguuuaaaucuuggcaggcugauaauuucaggcggcacuguccuagccagcuaaaacucuucuccacccuauugcccucgcugcgcccuuucuucugugccuccggaaguuacucuuucaguaggcguuugggggcggcacuggucaauuuuguucucgguugcuugguugggcuagauuucgguucugccgggugggcguuuuaagggcugugggcgucacauucgucgguguguggccaaggggacaugacacguuuuaggaaaaguaaacgugcuacuaaguu

SEQ ID NO: 18301 - RNA, 17080 nt, Homo sapiens
aguuuuuuuuuuuaaauccuuuuauuacucuuuuuuaacaaacagccccagggacaggggaccaggggaagggggaggaggggaagugaggccccagccccagaaccccuccccgcccaccccuuucccccuuauauauuuauaaucuauauacaagccccggggguagggggcaagaggaacucccucagcggggugggggcaacccaggcuccuuguccccucgggacccaggcuccucugcccgucgggagggcccuucucgagguggcggcccuguccgcucccaaggcuuagguauccagcgcagggcaucugguggggaggccuaggggacaggcauguguuaaacagugagucacagugagaggucagcgaugagacggaaggacaggaaaucagguggcaacucgaauuuagaguuggggccacaaggguuucuccuucaccugcugguaaaggucgacgcgcugggugcggaagacuccacuguagguggaaggcguggccuugagacgggaauugaggccagagaaggaccuaagggaagaagggcgucuaaggcaagccuaggauccagacccugguuccaaaguaaggaagcacuuggaaaguccacaucccuauuccguuucaccuuccaguugggggaguccgugaugauccaggucccccaagguugcugcucaguuuuugauaauccuggaacggcuuuaguuccacuggaugcagcugaggggaaaaaaaucaugagcugccuaccuugaaauacagaaucccuacucccaagucuuggcgcucccuagccccucaguuccuguaccuuaccucugcucgccccaagcuagcggggaagggccuggcaggugaaggcagcacccgaguagcaggagcaggugggggccgcacagccaggcuggggggcugcagagcagggcccacagguaacagagaaaggggagguggggcaggagguggugcuggcggcagggagccaaaguucaccacaggcagcugugagucuaccauggguagaagcaucuguaacaagaaauuugggugugcauguugggggcagggaggaaugucagaaaaccagggaaaaucaaagccagcaacuggacagagaaaucaaaugaaggggaagugugaagauacaauauaccugcugggcaggagccccugaagggagaaagccacuuuggccaccaggcugcagaggaguagaauaaaaauccgaaggggauggcagauccuggcguaccugucgggaaacagggagaaauauaucaacccccacaaaaucauucucccuacccuaucccccaauaucuaauaccugccccccucuuaccugaagcaacgaugugucaggcaaaggacuggggcagaaagccggagaguagaggaaggaagguggaggguagagaacuccuccagccggcaacuuccccagcucuguagcuugcauuguggagaaauccagaaacuggcccuugagagcuaacccagagagcagugcugagggaggggcugggccgggggguagguauaggggcugugaucugaaaauaaauuguggggagaaaagcuguuaggaagccagaguccuagcaaugccuuaaguccacuagcuucuaguacccuagaacugugucuuccccuucccucuccccgaaacacaucuccaaguacuucugugauccacaggcaucgagucuuaccuguaagggugcagugagggugucccagggcggaagccuccacuguuuggauguaauugagaguccauggcucccccagagaucugcaggagaggagcacgguugaaacagcuuuaguaucuguggucaagaaaaaagaucaccaucccacccauagaagcaaaaaguagggagaaaaaugaugugacaaagugguaucucacaacucugcaacguagaaaggcuugauuauaaauacauaccaggcagaaaaaaauuauuauucacugaaggggucaugcaaugggaagcggggccuaccugagaacuggaaggcccagcacugccauagaaaaccucaggauacaggcgcuggccugaggagcugggcuccgggacacagugcccagaauccagguucuuggauuguggcucagcagaggcagcagcacugggaagcagcucccagucucgugauacaggaauggccugggaaggagaggccucguggagagggaugucuggcauccuggacgcccuggucacucccagcaaucuuccccagaaaucuugggccuuuccaccaaacucuuacucccacuuaccucagugacugaugcuguuagcuccuucucugcuuucaagcugucuccuaccacuaggcguaagucugaguccugugaucacaagaaggcaggagacauugucccgugacagacauguguccucuaugucccaccuuuaguccuucccuucucuccacccaacucaggauacccagauccagcccacacagaccuugucacuagugccaaacuggacugggggaccaggucgaugggauggccgaauggggccaggcucugugccucggucuguacgcugugaucguucugugccaauggggccagggggcagaggcugcucccggggcagcuccuggauugggcacacaguaaagugcauugggggagggaaagggaaauccaaauuggaaugcccagaacacacacgcagagagaaaaagcagaaaaagguagggccaaagucagauuccuggaaacauuccccuuauccuuuuuuggucuuuuaccuuucuguccccaucguggggggcaggugguggucuccuaggagguucagagccagguggacccucacaaggaacagcauucaggggugaggagccuccaggccucuuggggggucccucugcugcccccuugaguccuccaucaggggaacuucgcuggcugcagggaccugaugacaccugagaauccccacucagguccaccccacugucagacugacucaucugagaggaguggagaaggagcuaguuaagucaggguagaaagcaccccaauaccugacugaugcacacauacaaacugcagaaaggggacagccaagugagagaacagcuccagacucaacccagagcaggugggggguaugaccagugcucaaaaaagucccagcucagacacacccucccacccucacucacuucugugccagccacauccucaaaaggacucaggggcuccauccaaggcuccauggagcugggccgguaacucuuucggcuaguggcuggagaagggagcaccaaccagaagagaagugaggagaugacaguucagaagccccucucauucuuaacccuucuaccauaguccuuucacucagcuuuacucaccaguauguaaacgguuccagaugugaggggucagggccucugugccuguaucucuggacucugccugagggccugggcccucaggcuuagagcccaagaauccagagcuaugaggagguggcaaagauuccuacagaugagaagggccagaagcaaaacaugaauugggugggaauugggaauuauaggaagccaggacagaguggggugacacaggguguggggacaacaagggagacacaugggagacuaauacugagaauucuggaguaaaaacacagugaaagaaacaggaaagaaaacagagaaaacauaacccagaagaauuuucacgaguaagagugcagugaagcacaaucucaaacccaucccuuaccuccuguagcagcucugguuuucugggaggccgcucccgacguuuagggggaaagggacuaaccccggcagagucccgaggagucccacccaccccucucaccauuggccccggcuccucaaagugggggucugggaaagagaaaaagggucagcaucugccuggcucugccacugacccuaacuuuuccucucuacuccaccucccaauucuucuacccuugcucccugcagaaacgcacccagcagcagggucccuaggccagguucuccacccgcucccuccagcacuugaccuucucuggggauggagauauucccacccauaaccccuccagcuuaccagaacugaggccgcuguugacccucuggggcucguaucggguugggggccuaggagaggggcccugaggggcuuggggaagcccaggcuugugccuuggaugacccccuggugcaguuacacucccuugacggcuacuaagcugggccagagccuguuggaugccagcaggguugcuguggauaacuugguccaggcggaagacagcagaacugcugggaggugggggaggcaggggaagccccgggggacgcuccucuggaggacgacuggagaaaacagagcauuagcuccaguauccacuaaaucguuacuuuuucccacaaguuauguuucccaacuucugcuuacaaccuauucucuucccuauuaaaguccagguguuuuugaguccuucuaaggauuccuaugcauacagaugcacagacuggaaagcaaagaaccagcaaugaauacauagguggguguucuugacucuaacacccuaccaaccgcuuuccaguugccuuagccagacauggaaauccuacugacauucuagagcccauggccccucaggccacaaucuccacuccacccaaacuuaucuuucccucaggcuuuuucccccuccuccaauuuuuaaaccacaauaaauuuguuuguuccuacccaccuucgguucuugggagagggccagcuccucuugucgccucguccuggcccgguccuuccuccaggacccccaccgccuccuccacugcugcugccacugcugccagccuugcccccugggccagggcgccgauucugccguuccaugccuggccgcugacuugagaagcuccguuuacucaaauccuuggcucucuggcucagaucuccgcgggacauggcugaaauaccugguacggcuccaccuccaccucccccaggaguucccacagccuugggugucagcaguacuggugggggugccucuuuguccccucggcgcucacuggugaagucacugcucucugaugcagucucccauuccucauuggcuuggucugaguucugguuugacagaucaggagacuuggcagcugcccggcgaggugcuggggccacugugacuguugugagggccuccucagguccaggagcggaggcuggaaggguuagggagggcuugcccucagacccccuugcggcauucucccguuccugcuucagccuccggaaacgaggcgguuuauccugcugcugagcccucccaugucgccuccuucggggucgcuccccaucuuccaugcccacauugcuaccuccauugcugccuccgcgcgccacaggggacagaggcccugggaucaacuucucuuucaaaggcuccuuacuugguggcaaagggccugugggagguuucuugggagccagagacuuggcuggagggcuccagccugggcaaacuugaggagggggccucccuccuccucggccccggcgagauggcaccccucugggagugaagacucgcccaccccgggcagugaagcgggcuggggcuggugaagguggggcuccugguggugggggagcgagagggaccugggugaguguucccuccuugggugugggagccuccuugucugaaggagccagaucacucucaugggucucgcugccuguuucugagccccgcugccggcgccgcuuggggauuuccucauacucugaacccucgcuccgugucucgcuggcagugcggccucggggagcaggagggugguuuggucccccugucccaccuccacgcccaucaucuccucgaaacucucgguaacugcggaauucccggcuucgggcuccccgcccucgucccccauaggucccccgaaaaccccucccucuggcaaaauacucgccucggccccgaccccggcaagagguaggacccacucuuucauacgaauagucccuccgaagccuuggggcaggggaaagauuuccauuggguggggucuccuuggggcccccuagcuuccccuugguuaucuugagugggucuggcuuuggggguuuggggguuucaucccccuguucgaggggcuugggaggcagcucuucuacuuuuguaggugguggagguuucuuuauaggcccagcccggcgggguggggccccuggcuccucuggagggauuccacgacgacugcucccuggacgagggccccagcgggucucugugcgacucucucugcguggugguggggggcccuggccuccacucccgacuccgcgggcaggcuuucggccugcuucuggccccgucagcugugcagucuccuccuuagggggcuccuucuugggugguggaguuuguaucuuggccacuucaucacugccugggggccaggggaguggacggggcccugguuccuccagaggaaagcgagagauugggggcccaggggcuccauucucaggaaagccuggauaacuggccagauaggguggugggggagguacuggaggagucucgcuccugaagagacagacagaaagaauggaaauaaguaucucaggaaaaccagaacuaggugggaaaagaacacuuuauuaugaugcagacucucuuuuacuauuuuucuguuuguuuuggcagagauggcauccaguugccgaggcuagucucgaacugcugggcucaagcaaucuucuugccucagccucccaaaaugcugggauuacaggcaugagccacuccauccagccucuccuuucccguucaucccuaucccuaccacuaacccaaaguaccuuucucccaggccuagauccuuucacugugaacucacccauuucucaugaccaagacucaccucauccccuugucauccucauccgcagccuggcgcagaggugagguaagugggcgggguucagcggguguggcggugaagacaucuccuacccaggccaacuuuggauccaccgguggagugccccguucccguaacauagcaggugcaugacggucaaauggcucugagcuugagcccccacugucugaacgcucucggggaacuaggccugaagaaaccaaagaaaaagaaaaauaauccuauucaugucacaagcccuccagcccaaaaagcaucuccccucgcggucaagucagcucuuccaucucuuguucccaguagguccgggccuugccugcucuuauauaacaagguuauccacucagauucccuacaagagaaucaacccaccccaaauaaauccuggcaaaugaaggaccacugcuucuuucauucauucauucauuuuugagauggaguugugcuauucauucauucauuuuugagacggaguuucgcucguugccuaagcuggagugcgauggcacaaucucggcucacuacaaccuccaccuccuggguucaagcguuucuccugccucagucucccgaguagcugggacuacaggcgagcgccaccacgccggcuacuuuuuuguauuuuuaguagaaaugggguuuuaccacguuagccaugguggucucgaacuccugaacucaguugaucugcccaccucggccucccuaagugcugggauuacaggcgugagccacaaugccuggccaaccacugcuuauuucuuaacuaagcccauuuuugcaacagagcuaucucagcagugccaagcauaugcccuucccucaucacuaugaugggcaaaaccuaucguaccagagucacaguaagacccuaauauccaaugccuaagacugaggggacuuuccuguuucucacuccucccaugcccccuuaccagagggaugcacaccaggaggguagaagucuagagggggacgacccuggaggagccggggguccacauaaggaggaaucaucauccaucggggaucaaaguucauugggggcaugggugggggccggcccagagcaccuggguacagggccuuggggggcggggguggagccuguggagcuggcacagcccccagggucacaggcugugguggugaugggggcacugggguaggaggggcagagcccuguugaugcugcugccacuggugcugcugcugcugcuucaggagcugcuccuaggaaaggaggaaagacaagaugagagaggcucaaagcacacauggacaaaggaaucagcaaagaaaaaacuuggacuaggggaaauuggcgugacaauggagacaacuggacaaagaagcaaagggacccagaagguaacuuaugaagagaauuagggaccgaagccaggaagaaaagcagcccuuagaggguaaacaacuugauuucaccugcugcugccgcuggaaacgaggaggcaacgacuucugauauuugggguagcccaagcccugacuagggggcuggcgggugggaccaaucccaucacccuuggguuccaccuuuggaacugggggugugguaggaggaggaaccucuucuggugguucaggacccucuuuugagggcaguugugguuccacugcaucggaaaaaacacaacagagugaucuaguccaacaauagacacuccaugaacaccccaggaaucucacgucucaucucuagcucccuuaagacuaaaauauucuauucaacaucuauucuauugaagccccucccauuuaagacccauuaaagcacuucauggccucucaugagccuauggugguggcauuaacuuucuaugaaaccauuagaacaacaguacuuucuucagucuuggccuauaggaaauaguuuucauuuuuauuuauguauuucuugugagacaggauuuuuuuuugagacagagucuugcucugucacccaggcuggagugcaauggcauggucuuggcucacagaaaucucugccucccggguuaaagcgauucuacuaccucagccucccaagcagcugggacuacaagcacaugccaccacacuuggcuaauuuuuguauuuuuaguagagacggguuucacuauguuggccaggcugaucuugaacuccugaccucauguucugcccgccucggccucccagagugcugggauuacaagugugagccaccaugccuggccgacagggucuugcuuuguugcccaggcuggucucaaacucccuaggcucaagcgauccuccaccccaagccucccuaaguguugggauuauaggcgugagcuacaguacucugccaagaaaugguauuagacuacaaccuaagauuccagacaaaaccuucccuccuucagauauacaaaugauagaacacuaucacugauaguccaauaaaccaaaacaacugccuucuacuucauuuauccccagccuuaccacccugcaccuuuaagcaccuugaagcagugaucugacaucugguaguaccuauccccaucuccauaccugggcuggcuucgaagcugccacugcuggugcuacugguacugccaccaccacucaccagagugggagccgcagccacaccuggaguaggaguagauugggcaggaggggccugugcuggcucuucagguucugucucugguguuggggcugaugcuggagguggagcuggaggugcagggaguucuuuagggacugcaggugguggagcugggguagaaggggcagcagguggggcagcaggcucugcuuugagccgcuugucaggugccccaaacuuuucaucgagucgcuugagcuucucagcacaggcugcccggcgcucuucuugcaugcgccgcuccucuucuucucgccgucgccgggcccgcuccacugccagggaaaucucagaugacgacugcuuucgucgcugccgccaugccucauccucaucuucaggugcugggggcuugcagggaggacccccacgauccugucaauuggcaagacccagcagggccaggggaaucaguuacuaugcuuucuaucaucucuuuuacaacaaaucaacugucgcuacuugcaggaugcaacgacccaggcuuugggguugaucucucuggguggugacaaacucauuauccuggucuucuuugagaccacgucuugcuauguugcccaggcuggucuugaacuugggcucaagugauccuucugcuucagccugcugaguagcuuggacuacugaugcauacuaacagauccagcuaucuagccacccuagucuuuuuauuuuucuguucccucucuccuuccgaaacccaaacacccagggcuccuuuuucuucuuuccucauuagcaucccaguuucucacuucuuacccagacuccccuauuaccaaagauauuuaaaagcuucccaggauguucugcagccuggcacuucacacagcccauuuuuagcaccccccuuccucuauaucacaaccgcuucaauuacucagcugacaccaauuucccacagcugacccucucaaucccuuauuggagacacucacuggguaguccccaggggggccccaguucccggcggggccccggugagguggggguaggggaggcuuuggggcaggaggucccggcucugucucuggaggccgagagguuucugcccaggccgucuuaggagugggcgguucgcuguugggggaguugcccuuuuugccaucugcuucagggggccguuccucaccagaagcugauugggaaucccugcugugagcagaucaacagugaaauuaaaaucagcugcaacuaauauacuccucuaagaguauauuaccaaaauacaaaccaagacccccuccucuucuccccugauggcccuaacucacuggcccucagcacccuccucaucagagucucgcccaucuuccucaucgcugaacuugagcuuuucaguguagucaaccucuucaugggccccugaggggaaauaugaguauuaguaacccaagcauucugcccuccaaucuugggagguagucuggaacuauguaacaagauggacuaccaaugccaauauccuucccuccgaagucuagauccaccaaugaagucuugucauucuuacuccucucaccacuuugcaaggacuugguauuccccauccauccuccccuacucuuuuuuuuuuuuccuuuuaaaagucucgcucuguugcccaggauggaguucaguggcacgaucauagcucacugugaccuccaacuccugggcucaacugauccucccaccacaaccuccagaguagcugggaccacagaugcacaguccacacccaacuaaaaaauuuuuuuuuuuuuguagagguggggggucuugcuguguugcccaggcuggucuugaacuccuggcuucaagcgauccucucaccuaacacucccaaagcacugggauuacagaugugagccauugggccuggucuuccuacacuucaaugucugccuuucacccacauaacccuguauuuuuuuuuccucauuagguuuugccuuucaagauccaaauucuugacccuuaauauccacuuaccugcccaaccaucaucauucuccugauccaacugaucaaacucuuugagauuauccucuuugagaauagagggacgacccacaggcucuacuaagcgcauugguggcccugagccucgggggcccgccacacggggaaaacggcuguacacaaaaaagaaaaugaaauauggcauguuguauaaccacaugcgagacugauccuagacugagccuccuggcuagaaaaccaucuccucccccaauaagcuuccccugcccccagccacaaacccagaccuggauugcucaccugggcccaucaggagugggguaucgguaaggccccugggguccauagggcggagggaacgggagauaugggggauacaucuguaaaaggguccaacaguagcugcucagagggacagucauauacccuucuagcuccuuaagccugcuaucaaucauccucccacccucccuucuaucucauaggucaaagacuaaguccugauuccuagcucuccagcuuccaguguaaucguuccaagacaagacaccaagacucacgaaaggcggcaucauuccgcgguagggagggaacuggggugggccugaaggcuguagcccaccccggggaucaugaccaugaugaaguuuggaguccgggcccuccagcucaucagggccacgcccaccuccgucccuccaaguuguagaaucuguauuuuggaaaagguagagagagguaucaaugauuggaggacaagugaacacagcugaaagugauggggaggaaggugaauaagccagcaccuagcucugagaugcaauagguaaugucuuggccaaaaggcagccacucacuuugggggcggaggcuugguccgggcccagacgacuguucggcagacucccuuuccuuggcagccuuguccuggucgccagccgccugcagggucggaaauuccucucgagagaaucgugacaguaggcuugaugcccuuccaccuauuaggauggggaugcagaacaggagacagaagacauuuccugaggacaugcuauaaaaguggaagacucuggcugggcgcgguggcucacgccuguaaucccagcacucugggaggcugaggcgggcggaucacgaggucaagagaucgagaccauccuggccaacaugugaaaccccaucucuacuaaaaacacacaaaaaauuagcuggguguguuggcgugugccuguagucccgcuacucuggaggcugaggcaggaaaaucgcuugaacccaggaggcagagguugcagugagccgagauugcgccacugcacuccagccugggugacagaaugagacuccgucucaaaaaaaaaaaaaguggaaggcucugacagguaccagaccaucagguuucccgccuucaaacucaccccccuacagaauaacugcuuauuccccaaggaggucaguucuggcaccacuacacuccaucauauaagacugagacuuaaacuugcucaugugccuccaugaaacugaauaugggugguccuugauuuagccaaagaggaccaaggucacuuggcugaaaauacagugcaggguucaugcaucccauggugcccagacacagcuccccaauuaagugcugcacucaccaucuccaugugcuccaugggugacgcuggcuugugcccaggacuuuaccccgcuuggaaccaaaggaguguucuggggaaguguucagaaagaugauaaaugauguggguggggcagcuaugaaccauucuuccuccccaccccuccaguucuccagguaccucgggggcugcugggggucguuucggcugguuggaggcaggcgucugugaagccggcaguggcugcgauuccggcggcugagcgguugaggcaucggaacugaggggacagaaugggaagguuauucacaccugagaugccucccugacuucuccaacugguggagacucaggacugaaaucaugcccauugcuaccauuuacaaauauaaggacaaauuaauuuugucauccuuuguaggcuguugucuauuuuuucaugcucucucuccaagacaaaaagcuaaaguuuaguaccauuccuuagucauuuaacaaggaaccugcaauagguaagaaagggaccucuucgucucuggcucagacguggcuggacuaaaccaagccccaaugcucccugaaguucaaguuaaaauacccaucacucuaggucccccaagccucugucuaccucuuggggucggacugcuccuguuugcuugcccauccuguuccgucuuuuggcacuagugagacauuggggucauugccuuuguucucggcuuucaggcuuggaagguuggcuggagguggcauacgccgggcaauggcaacuuucccgagacucugcaggccauggcgaggggcaacuggagaacaagacggagagagggucgaaaaugccucaugugggagaucugauggccuccuauccugggacacauuuauacauguugaauauuuuauuaccuacuuccuccaaacuucucuuagaagggauuccuuccccugcccuuaauaaucucugaaaucgcgcugauugugguggcucacacuuugcaaucccagcacuuuggcaggccgaggcaggcggaucaccugaggucaggaguucaagaccagcuugaccaaaauggagaaacccugucucuacuaaaaacacaaaauuagccgggugugguggcgcaugccuguaaucccagcuacucaggaggcugaggcaggauaaucgcuuaaacccaggagguggagguugugguaagucaagaucacaccauugcacuccagccugggcaacaggagcuaaacuuggucucaaaaaaaaaaaaaaaaaaaaaaaaaucuaugaaaucccuaucaagaaggcugagauauguaacauucaauacuuuuaugugagauugguugaucaugagccugcaagaagcaagcuggccucaaaguuucccaaauccacauuuauuuuccuccaauucuuacguguccaaagacagggaaccacagacacgccuuuguaggaggauaacugguguucacccagagcccacacccccuuuaaaggacccaguguaaaguugggaaaucuccucuagucuuuugguauuucuacuacagccacuucccuuuaaagagcucuaaaacguaugccccaugcaugccuagcuuucaaccaucagaagcaucuuugcaggacucucaccagcggguuucuggaucucuaaggacuugcccuuauacguaucaaacagguugagcgaggaauacuucuuuccauccuuucccuuggcagucggccccgagcgaucggacauugcgcuggaagcucauugaguauguuggguccugcaggcaccucccccaaaacgugccagagccugugggccagacagcaagugucucagucucuguccccuguacagaccauaacagaaacuuaaaaacuccauugcauuaucauuagggacucagauaugaggcccucuggugucuuuuccuccagucuauguaaacugcccacucuucucaagcaaccaugaucuacuuagcucccucauagcucaaaugccauguucccuccuuucccccagacaccuuugucaaggaaaucuaaguaaaaauccagcauccuccuaguauaaacacucugcccuuugugccugucuacaaagaguaauucccuacaaguaauaaucucuucucucuccaccaaaaucguuucagagacuuacaacaggacaaauucaagcaagagaaaacuaaaaaagaagcauacaauuccaucagagaagaagaaacaacacuuuagauucccuguuuauuggacacaagcucccuaaucaugcccccagggcccuguaccccaggcucccagcccagcagccucguguccaucugggaagguuugcaggaagguaugcugggaguuuaaggauuuuaugagcuugcucagccggaauggggguugguaccagagaaauccucauagaacaacuagggcuguacauacucccaggcuauaggaaccucaaguauuugaaauaucccaucuuuuccuaaacuugcuccuguauuggcuccuggaaaaaaucgccuccagaugaaauacuguuuuaccauaugaagaacugagaaaaagcauuauggagccaccuuagcacccuguaaccaugggccagaaaacagagggccaaggccagagccaucuucguuuuccuauccucauuaaaaauguccaucaccaguguuucuuuacucgauaccuccagcucccuaagcaagccggacgacaggucucucaguccauuccagagugaccaggcauucguuuauggacgggaacaguguaaagagaugagaaauaguggggaagaaagcagggaaauccagacaggcccagaaugaaagcuaaaauuggggagaaagaacuuuaugacaagcuagagauaagauggauguugcuucguagguguuugaggaggccaaucugugaagauaaauauaugaagggaaaacgaauacaagagucauguagcgaauagaccaaaacuaacagaaaauaaugaauacgaaagcagguggaaaauauauggaaacaggaauggcaaaaaaaaaaaggauguagacaacgaaguaagggggcagaggcccaagaagaaaaacgggguugggggagaaaggagacgaggaacaggaaaaaugaaaaagcagacauagggcgacugagcaacauagaaagcaaagaugcugggauaaaagcaggauucuagagugggaguggcucgacacgaagaggggcguccagaggggggaacacagcgcuggaugauaggaggggguccaauauggaggaaaagcgcccuuccgagagaaccgucgggcgcggcccaccaccacggggcggcagccggggagggggcccacaaaugggggugaaaagccaggagcgcagcggaggguagggaguuacggacccaggcgcaggggucacccccugaagccaagacggugggugguuaggggcagacuacggauccugaaugaacugccggaggugcgggucccggaguagagguaccggagggggaggggcaagcaggcccggcagcaggaggacaaaauggcggcggcuaauggcagcuucuccuccccccggcccaccaccgccgccgccgccgccaccgccaccgccaccaccucucccgcgccggaaaagggcgucagcgcacgguucacccagacucaccuggccgggugcgcggggauccgggacccgggccuaggggcuccccgggacgggauggcgguggggcgggggaggauggcggcggauggcgccggguucggcuccucccgucucccucgcucacuccgcggcugagccccgacuaacggcccauccgggcaaccg

SEQ ID NO: 18302 - RNA, 6355 nt, Homo sapiens
aagugugucuaucuacugugucccaggcuucuuuauuuaagaaaaaagugauacaugaugugggauuaaaaucaagagcaucauugaacuucaccuucccuccaaccaguugccccaaacuccccugcccccacccuuuguguucccaauuccuuccuuagugaaugaagaacuuaaucccaaaaacccuggcacaaacuccagguuuucuuucccuagcuccuccccucccccugucccccauuccuagaagggcaggcaccucaguuugaaugcaugggagagcccagaguggugacggagacagggggaaaggcuucccccucagggaaagggaccgaggaguacagugcagugaagugagggcucccauagccugggguaccaaaauggggcccuggggccagaggaaaggacacuggucccccugagaaaggagacccagcagccucaaaauccucucguugugcauagucgcugcuugaucgcuugcccuucuggcgccgguuacagaaccacacucggaccaccugcaagugaaugacagaaaggagaaugacauuagacaaugagcugagacgggccugacucugcuuggacauucuauccaaagccaacagcccuagagcaguuagaggaggacauuagagaaugagcugagacaggccugacugcuuggacauucuguccaaagccaacagcccuagagcaguuggaggagccagagcuagggaaagcgagguggugacaggggaaagagauggagcccgcagagagacauggcacucacauccuucucgagcccaagcugcugggcgauguggcugaucugcugcaguguggguuucgggcacugcaggaacaaauucuccagguugccucucacucgguucucgauacugguucgcuuucucuuucgggccugcacgaggguuucugcuuugcauaucugugcaggugggaagggggugacaagggcaagcuuuggacuugcugaguaacagcaucacaggggucugugacuagaugugucagcagagccaggugguggugugaaaaggcaggauccuggaaggguuggcucuggaccuuaucccagcagaacugaggaauuucacuccaucccacugagaaccacugcaccaaagacggagagcuacgagccagugauggaagcaauggaaauuaggccaagaaagggaagguccccggguaucccccucccacccuuaccuccugaagauuuucauuguugucagcuuccuccacccacuucugcagcaagggccgcagcuuacacauguucuugaagcuaagcugcagagccucaaagcggcagauggucguuuggcugaauaccuucccugggggaggccagucaaaagagaagcaaagugagggagcacgcagggcccuugugacccugagauccaagcuuaccaccucuucccagagggagcucaaagcaucuucucccucucccuacuccucuucaugggugaggguagucugccccugccccuccccacuagguucagggauacuccuuagaggggagaugcggucagaaucugcagaggggaacccaccaaauagaacccccagggugagccccacaucggccuguguauaucccagggugauccucuucugcuucaggagcuuggcaaauugcucgaguucuuucugcagagcuuugauguccugggacuggauuuuaaaaggcagaagacuuguaagaacauaaacacaccaguuaucaaucuccccuuuccauucgggauucaagaaccuacguguggccccaaggaauagucuguagaagugccucugccuuccaagcugcccaccuaacuucuagaaauaaccuacccacaaaugucauucacccauucccuguucacugacucaugcauguaacaaaggacuacucuucccccagaaacuggcacauccaagggaugcagagcaucgugaaaggacagaaagagagacccuggccucgagaacaccugucagguuaugaagguuagaaguucuuugcugggcgcgguggcucacgccuauaauuccagcacuuugggaggccgaggugggcagaucacgaggucaggaguucaagaccagcauggccaacauggugaaaccccgucucuacuaaaaacacaaaaauuagcugggcacgguggcacgcaccuguaaucccagcuacucaggaggcugaggcaggagaaucacuugaacccgggaggcggagguugcagugagcugagaucacgccacugcacuccagccugggugacagagcaagacucugucucaaagaaaaaaaaaaaagaagauaguucauuuaauaccugcaaaauucucucacucaaguaucacccccaguuuaaggauguuuugagauuagagaaauagauaagcugcuaaguucuggguuaauuaaaaaggaagagcaucaugucucagaagcuaaauucaguauauacucuccccagcuugcuuugagggucccacaaacuauaacauggcaugcauacacacaaacacagcaaaaaaguaacaggugucauaagaauggauaaagugcuuuguguguacuuacucauuuuuuaaauugauuaucccucaucuuuacuguaucuuuuucacuauagaggcauccuaauugauuuuuaaauucaagagauuuaucgagcaccuucuauaagccagcggcuauacaaaguggacaaagagcccugacauccagcaugacagaagugcuauuuggcacuuguucuucaaguugcccacuuggaucucuuccaagugcacuuuccuuuuuucccugcccuauaacuuuuuaauaauaaacuuccacuccugcucugaaaaauaaaaaaguaaauaaaauaaaaaauggccaggcacaguggcucaugucuguaaauccuagcacuuugggaggccaaggugggcagacugcuugagcccaagaguuagaaagcagccuggguaacauagugagacccgugccgccccuucucccaccccugcugccucuauuuaaaauauauauauauauuauggaaaaaaguaaagcagucugggcgcaguggucaugccuguaaucccuucacuuugggaggccaagguggguagaucacuugaggucaggaguucaagacuagccuggucaacauagugagacucugucucuacuaaaaauacaaaaauuagcugggcaucauggcgcuccccuauaaucccagcuacucaggaggcugaggcaggagaauugcuugaaccuaggagguggaguuugcagugagccaagaucgcaccacugcacuccagccugagggacagagugagacuccaucucaaaaauuaaaaaaaaaauaaagcagucuauaggaguaggguaaaggagggaaggagauuauggaggagggugacacuuuuaaagacagagaaggugauuguuugagcaaaggacaagagucuaauguggcaaggcccugaagugggccuuccagagcccaaagcuggucugguggcuagguagauccuguugcagacauagugacuuuguuuuaguccaagcgaaaugaucucucacccuuuuucuccccaccaagacggaaucucguucuaucgcccaggcuggagugcuguggcgugaucuuggcucacugcaaucuccgccuucuggguucaagcuauucugccucagccgccugaguagcugggacuacaggcacccaccaccaugcccggcuaauuuuuguauuuuuaguagauaugggguuucaccauguuggccaggcuggucaggagaccucaagugaucuguccaccuuggccucccaaagugcugggauuacaggugugaaccaccgcaccuagccucaccuuuuuuuuuuuuuuuuuugagaguuucgcuuuuguugccuaggcuggagugcacuggcgcgaucucggcucaccgcaaccuccaucucccagguucaagcgauucuccugccucagcuuccugaguagcugagauuacaggcaugcgucaccacgcccagcuaauuuuguauuuuuaguagagaugggguuucgccauguuggucaggcuggacucgaacucccgaccucaggugauucgccugccucggccucccaaagugccuggccacaccuuuuaaaacacugacucuaguugacguguuggccacagacaguagggaggaagcaguauaauuugagaagcuacugcgguaaucccagcagagaugaugguggcugaggccaggguuagguugugauugauucaggauguuucuuaaggauaggauguaggacaugaaagaaacugaggaugacuggguuuggccuugagcaacugggugaucaggguggagcaguucagggagccaucacaagagacagaaaacgcgguagucaucuggugucuaaauggcauuuaagccuugagggugggugagaggaaggaaggguagauagagcagagguugaaggacugagcccuggggcaugccauaugaggcugccggcagacagaggugcacagcuagugagaaaaaaacaaggccuuuuuguaguucugaagccucaaggaaguguuucaauggugcuugaucauaucaauuucaaauaggcuguuuucauccccaacuucugcucagccaauaacucaaacugauaaaugcccucugcuaucuuggauuuuccaaauucuguuuugggguuuuggaauaaacacugguccaaauccucgcuucaucauuuagcaguuaaaacccguuaaauaggauaauaauaccucccccuaggagauuuugugcugguuaaugagauaaugauguauaaacggagcacacagccaggcacuuaggaaguggaccacaauugccagccauuaucauucaaggcucagcagugaccuccugcgaagagguuggggcuucucggucacuccagaaaccagucacaccuuucugugaggucucaaggcuuaguauuuaaucucuaauugcuuacacuugucgccuugaaggacuggaagauacaucuuuaauaguccucagcagggcuggaugccuucaaucccgcagcagcucuauauuugcaaauggccuggagaaaucucucaccauuuuucuuguuuacaacuuuggaacugaggcugaagucaaucaaaauccagcuuucuacaaggggugccagggugugcaccuuaacacaguggccagucauuggccugaggcagagauccggggaagacaagcccuauacuugacuggagguaaacccagcucacaacgcgcacacacacagcccaaacaggagauccuaucagaaacgagucacacccuagacuuucaggaacaauaauccuggaaugagcacuguuuuuacccucaggcuaugcuuaacccuaaggccaaaaucuugggucugauaagggucaaauuuucaagcaggacuaagggugggaaaaggggcucaaaccaaccccaagcugggucuggugcugggccaguaaugagugaccagacccugggcaggccuaggagaugugagagacccugacaagggcugggccagagcaaaggccagccugggccagcuuccgacucucccaggcugcucugcccucaccggcaguugucucuucgaaauccagcuuccacuucccaccuggccccugccugccagggcugccagcaguugauacacaccccucccuggccagggcagcugacccugccugcuccucuccugggugccaggucugggcagcugcaggugaccacuuccccaucaggcugcccugucaugaccaccuccccacaccccaaccccgucgaagcucacuugccuccuccggguuuugcuccagcuucuccuucuccagcuucacggcaccaggggugacggugcagggcuccggggaggccccaucggaguugcucuccaccccgacuccugcuucgcccucaggcugagaggucuccaagccgccuuggggcacuagccccacuccaaccuggggcccacaguacgccauccccccacagaacucauacggcggggggcaugggggaaucccccacaccucagagccuggcccaacccccggcccgauuccuggcccuccaggagggccuuggaagcuuagccagguccgaggaucaacccagcccggcuccggccccccuggcccaucaccuccaccaccuggagggggcgagaaggcgaaauccgaagccaggugucccgccauggggaaggaaggcgccccaagccgggggccuggugaaaugagggcuugcgaagggacuacucaaccccucuc

SEQ ID NO: 18303 - RNA, 15886 nt, Homo sapiens
ccuccucccaacagagugaaauaggacuuuagggcgcccgccuugcgcaggcgcggucaggggcagaggcggggccgggagcgaggcguaggggguguggccaaagcgcaguagggggcucucgcgguugguaagggacguucgggaagagucgguugggggcgggaaggggcugagcggggguccugggaggguucaagggguccaaaggggaaggggguacaggggccaggugaagggacagaugaagagaucagaacagccuuagagcucacgggcuaacugggugaagccucggguaucuaggggagcaguggugggagaguagagccggcuagcguacagggggcgagggcaggcuauugagagaugggggugagggucaggaccagaauaauuccuucagaaaaagguagauuagguuguaaaaagggacgggaguagggaucccagauucggguaaaaaauagauuaaugagggugggagggugggaggaagaucuuaaagugcccacuauguguuaggacucgagaaagaggaggcgggcagcaggcauggaagcuaaggggauaguagagagaagcugagagaacagccgcaggaaagauuugaauaagaugucaggacgcuggcuuuucugccuggggaucuaggcggccuggauucccaaggucuuggggagggucuagcccugcauguggccacauucagcuggggccaggccuugggccagcacuuuaacagggaaggacccaagagucauggccugcuggugucuggaugggcuucccucaggccuugcugagccauggagagaacucuggagauggcgcucaagaccccugcacuguguaccuccuuucucaccucuggccaggagcagcagggaccauagaaacuuaaggaggaggguagaggcacugcccagaauccugaaaguaugaguaaagccucagagccccucucagucugucucuuucaguaaauucucuccacuugauaguugcuuggguuccaugaggaaccagguugagacaagcaagugaauuugggguaucuccuacuuuggggaaguaggaaaagagcuaagcaucggguggaccuggcuauaauucaaggauuaugacuuuguuauuguaggggcuuucucuuuggaagguggccugaaaauugaauuggagugucuuuguuucuccucuuguccaggggaacauagauggcuggagacagaaucuagagccuucaaauaauguggagauguuuccaccuucaggucagugggaccagacaaggggaguggugguugucucugccugggaaacugaccaucuuuguuuuuguaauucuucagguuccacugggcugauuccccccucccacuuucaagcucggccccuuucaacucugccaagaauggcucccaccuggcucucagacauuccccugguccaacccccaggccaucaagaugucucagagaggcggcuagacacccagagaccucaagugaccaugugggaacgggauguuuccagugacaggcaggagccagggcggagaggcagguagggauccauccacgccguuuucucaggcuugcuugcuagugacccuuccucacuggaauaaacuccuuacccuauuucggcccuaguuuccagaacguacucauuuuuauguaagcaauuaguuccuacagugcauaaauaauaaagcagugugcuaagugcuagggaugaggauaacaauagugaauaagacaaauccugacuuaaauuuguaauuaauaaggaaucuaaaauccuaagaggggagauagauugaccaccagcugaugguaaagcaugguaugaggcaagaugaagaagugcaaacuagagguagagacccagcacuguggcaguguggguucauucugauggaagaaagccuuuacagaggacaugcugugggagcuggccaugcugucguauuaucuguaaacauucuuauucuuguuucaugugucuuuucccagauguacugggauaucauucugccauuuugcuccagaauaggauuacauuagaagaagcagcaugaugaagaaggaauacuagacugggugucaggagacagagacucuauuucuaguuuggcuaccagcuagaggacauuuggcaagucacuuaauuucccuagccuacagaucgcugcuacuaaagaaagaaagaaagagcgagccagauauggcggcucacaccuauaauccuagcacuuugggagcugaggcaggaggaucacuugagcccaggaguucaugaccagcgugggcaacaaagcgagacuccgucuccacagaaaauaauuagcuggcugugguggcaugcauuuguaguccuagcuacucaggaggcuaaggugguaggaccccuugagcucagaaguugaagacugcagugaccuaugauccagccacugcauugaggccugggugacacagugauacccugucucuaaaaacgacaacaacaacaaucucuuauaguccugggucucagagagcugccucaggagccauguuccaagcuggauuaaacuucacgugacauugguagacgauuucucuaaaggcuggcacuguguuauuuauguacuguucucucagacuccucauaaaguauaccuaacacucaauaaaugccuuuuuuuugagauggagucucacucugucgcccaggcuggagugcacuggggagaucuuggcucacugcaagcucugccucccagguugacgccauucuccugccucagccucccaagcagcugggacuacaggcaccugccaccaugcccagcuaguuuuuuauauuuuuaguagagaugggguuucaccguguuaaccaggaugaucucgaucuccugaccucgugauccgcccgccucggccucccaaagugcugggauuacaggcaugagccaccgcgcccagccaauaaaugccuuuuaacuagcaccuggccucaccauauugauacuggaagcuuacgaccucucuaugcccauuccucccucaaacuucuugcccuuaaauuagaauugagaagucccuguguguucuuccaaccuuuccacuuaaaauguguggccuaaaaauaaaaaaauaaauaagacaaaaaaaccaccaaaaaacaaaaagaauguguggccuaaugauauacacauuugauguugaauccuccuguauguagcucucucuagggagaucauguuccacgaucucagccagacuuuagguccugugaguccaggcacuggacucaacaugcucaauagggcuuugaugaaugaugaugaugucaaugcagacauccccauaccccagcuucagcacccccuucaccuccccacacggaagcagagggguccucuuuuccuucuccuggcuauguuuaugcccucaacuauccuuccagcacuggagacaagucucaccugcacuaaccugucuuugaagguccugggggcuggaggggucacaggcccugagccagcaggcugaggugaucguucggcagcugcaagagcugcggcggcuggaggaggagguccggcuccugcgggagaccucgcugcagcagaagaugaggcuagaggcccaggccauggagcuagaggcucuggcacgggcggagaaggccggccgagcugaggcugagggccugcgugcugcuuuggcuggggcugagguuguccggaagaacuuggaagaggggagccagcgggagcuggaagagguucagaggcugcaccaagagcaggugaaugcagggguagaaaggauucaaauucauaacggagagcugggcaguagcuuccaagcaaagaacagguauugcagaaaagacccuccaugaguagugaguaguagagugaugagaccuuuggugaaaauaaacacacauggccuagaaagauggagaauuuggguacuuuuaucuuaauucagguugcacuuuucccccaagacucagguggccucccaccacuugaagcccugcuucccuuucuaguaggaaauaguuugccucccuacuuuacuccagguaccaauucaucagggguauuguggagggcagugaggaagguggguauaagggggcuaugguggacugggagagagagauuauucaguccucaaacucaguacuuacucuuugccaucucuaagacucagugaccaaauuagccugaguccugccuucguggauggaacugacagccucgugggggauauacacauccacauuuaauuuaaucauaauuaauugcaaucaggaggaaugccuugaaggagaaggacuagaaagcacuaacuuagucugggguucagggaaggccacuguaaccaguugacaugucaaggaaagaaaccauagcccugggcgcaguggcucacgccuguaaucccagcauuuugggaggccgaagcaggcagaucacaaggucaggaguucaagaccagccuggccaacauggcgaaacccugucucuacuaaaaauacaaaaauucaccaggcgugguggugcgcaccuguaaucccagcuacuugggaggccgaggcaggagaaucacuugaaccugggcaguggagguugcagugagccgagacugugccauugcacuccagccugggcgacagagcaagacucugucucaaaaaauaaaauaaaaaaggaacugggagaaaacaagggagaauuccuuuauaaccuuguagugggcaaggccuuucuaccugugagucaaaauccaaaaucuagaagccauaaaggaaaaaauugauccauugacuuuauaacaugaacauuaggaauagccaaaaagaaaaaaaaaagcuauauuuauagcucagaucacaagaaaaggguaauaucccuaauauaaaaugugugccuagaaauugguaagggaaagaccagcaauccaaucagaaaauggacaaaggagauuuaugaaagaaacuuagaaacaagaagcuaggccaggcacaguggcucaugccuguaaucccagcacuuugggaggccgaggugggcggaucacuugaggccaggaguuaaagaccaaccuggccaacaugaagaacucuacaaaaaaauacaaaaauuagccggguauagucgugggcgccuguaaucccccagcuucuugggaggcugaggcaggagaauugcuugaaccugggagacagagguuacagugagcugacaucacacuccagccugggcagcagagcgagacuaaaaaaacaacaagcuaccguuugugcugaauaggaguuggccagugaagaggcgugugaaguccagugguagcuggaagacacuuggugggacaacaggugaaggcggggacaggaggccagaaggcuggggcacagagaugaggggcacugagugugcugcagagcccagggcccagggcacaaggcuuuggccacuucagaacuugcuacuuucccauaagagcaaugagcaggcugggcacaguggcucauaccuguaauccuagcacuuugggaggccaagguggaaggaucauuugagcccaggaguuugagaccagccugggcaacaaagcgagacccccaucucuauuuuauggaagaaauuagggcugggcaugguugcucacauguguaauccuagcacuuugggaagcugaggcggguggaucacuugaggucaggaguucgagaccagccuggccaacaugguaaaaccucaucucuacuaaaaauacaaaaauuagcugggcgugguggcucaugccuguaaucucagcuacucaggagggugaggcaggagaaucgcuugaaccugggaggcagcguuugcagugagcugagaucgugccauugcacuccagucuaggcaacaaagugaaacuccaucuccaaaaaaacaaacaaaaaaaaauuguuuuuucaaguaauaagcaaccguugaaagguuguuuuuuuuuuuuuuuugagauggagucucgcucugucgcccaggcuggagugcaguggcgcgaucuuggcucacugccagcuccgccucccggguucaagucauucuuccgaguagcugggacuacaggcgcccgccaccacgcccagcuaauuuuuuguauuuuaauagagacgggguuucaccauguuagccaggaugaucucgaucuccugaccuugugauccacccaccucggccucccaaagugcuggaauuacaggaaugagccacugcgcccggccuguugaaagguuuuaagcagggaaauaacaugauuagauuuguauuuuaugucuaaaaaauuuugucauuuaugucccccaaauuaauuuuauuguuguauggagacagggcuagaggaggcagaccaggaagcagggugggcacuuugcccuccuuuccaguccaucccaugacucuugguggcucugacaccccugcaacccuuugaggugccaugagcaaaagacacaaaauuccuccuuuccuggagcuuuccuuccagugugguccgacagauaguaacacauacacauaagcaagauauggucagugcuaagugcucaggaggacgugaacagcugauggggcagaguaggguggggagggacgguauuagagggcccagugaagccacccugaggaggggcuaucgccuggggucuguggagcaaggaggggccgcugucugguucucagcagacuccccguggccggagcggggagcagugggagagccuccagggugagcucaggagguaggcagaggccggguccccuggccugcagguguggagagacaccuggguuuuguugugaaugcugugagaagccacugaggguuuguaaagacuaguuaggagauggucgcuguugcccaggcaaaagaugaggguugguggcaguggagacggagacagagaggugaagauauguuuugggggagaucggacaagaacuccugauggguuguggggcagcugcggagagugaguugccagcucuccauuugcugugcacaguuggcugauugguugggucauucucuaaggucacagaaagugggagugaagggaacaaggaaggccuccauguggggucgagccucugcugagcccccucuucuuuccgcagcuguccucuuugacacaggcucacgaggaggcucuuuccaguuugaccagcaaggcugagggcuuggagaagucucugaguagucuggaaaccagaagagcaggggaagccaaggagcuggccgaggcucagagggaggccgagcugcuucggaagcagcugagguaggugggcggacgccgacgggagcccagcaauuagugaugugguggaucugcagggcgccccacugauggcugucccauucccaccccaacccuagcaagacccaggaagacuuggaggcucaggugacccugguugagaaucuaagaaaauauguuggggaacaagugccuucugagguccacagccagacaugggaacuggagcgacagaagcuucuggaaaccaugcaggugagggugcaggaauguaucugugugcagacuuagggaucagguugggaggcaagcguggcccuuggaggagcguguagagcacagccuccgggagagaaggugguaccuaaggcggcauggaggcccuacagaggggcugcuuuccucugcccgcagcacuugcaggaggaccgggacagccugcaugccaccgcggagcugcugcaggugcgggugcagagccucacacacauccucgcccugcaggaggaggagcugaccaggaagguacagcccaacccccagaccccucacccucagccgcauccugcaucuacuguccccugccucccucccugugggcaggaggggucaaugugccccagaaccugcuuagaucuccuuccugugaacuccucuugcuguagcucauguugcccaggcaggacagaggagaaacaaagaugccaccuccuuccucuccucccccaggagcccacacuuuucucccacuccuucucccucagguucaaccuucagauucccuggagccugaguuuaccaggaagugccagucccugcugaaccgcuggcgggagaagguguuugcccucauggugcagcuaaaggcccaggagcuggaacacagugacucuguuaagcagcugaagggacaggucacugcacucucuuuucucccgguauucccucccagcaccuugcuccuuccaugaagguggcauccauucaaccaguguuuauugagugguugccacaugcugggcacacagcccugaacaaaacuaaaauguggagcuugcauucuagaacagagacacagaacacgcaaguaaacagauaauguuggguaauuauaugugcgauagaaagauugaagccaggugcaguggcucacaccuauaaugcgaucacuuuggucuugaacuccugaccucaggugauucaccugccucagccucccaaagugaugggauuacaggugugagccaccgugcccagucaaguaaugccaacaguuugggagaccgaggcagguggaucacuggaggucaggaguucgagaccagccugggcaacaugugaaaucccgucucuacuaaaaauacaaaaaauuagccggucauaguggcucauuccuguagucccagcuacucuggaggaugaggugggaggaucaccugaggcugggaggucgaggcgaggccacagugaacugugaucccaucacugcacucuagccugggugacaaagcgagaucuuuucucaaaaaaaaagaaaguaguaagaaaaauucaaaagauaaugugacggagagacuguggggugagucagccucagguaggaugcucagagacagccucucugaggaggugacagcaucugaggagaguggcauggucaguuggugggucuuguggggugggucaagggcuauucccaucuuugagugggcacauggaauguggaacauggaacacugggcucagauuccauccucagaaccuaagcuucugucucccugcguggcauucauucuuuuucuuuucuuuuuuuuuuuuuuuuuuuuuugagaaggagucuuguucuugucaccaggcuggagugcaguggccugaucucagcucacugcaaccuccgccucccagguucaagugauucuccugccucagccucccgaguagcugggauuacaggcacaugccaucacgcucagcuaauuuuuguauuuuuaguagagacaggcuuucaccauguuggucaggcugaucuugaaccccugaccucaagugauccaucugccucggccucccaaagugcugggauuacaggugugagccaccgugcugcaacccacccccgucgcccgcccccccuccccccagccccugcauggcauucuuacagagaucucugcaccugccacuuugcuuccagugccccccucaucuuuuagcucuagagggcccugccuagcucucucuccucccccagguggccucacuccaggaaaaagugacaucccagagccaggagcaggccauccugcagcgaucccugcaggacaaagccgcagagguggagguggagcguaugggugccaagguuggugucagccuacuagagacucggggagggcaagggagccccuguuccggggcugcagccaggacuuagggagggacccuguccuuugcugcauccuccccagggccugcaguuggagcugagccgugcucaggaggccaggcgucgguggcagcagcagacagccucagccgaggagcagcugaggcuuguggucaaugcugucagcagguaucagggauggagggguggguggaguaguguuucugccaccucagguuccugggcaccuuguugcugaggauccucaggcaagaggggcuggaaaguggccacuggaggcuacagggcugggcagauuuagcucuaucaauguuccuguguucguuucuuuuccuggggaagccccuucugcauucauaccugauugcuuguuaugaauuucccguugcauguuuggcuggaggugaggccuugcuuccuccugcaguucagucuaguaauggcuugagcuaaauagagcacccgggaggaucuuuacuugcaguauuguucaaggauggagaguguagacacuucaucuuccuuuuuuuuucuaaaauuuuacgggcaauccguuucacuggagaaaaauuuagucuauuuauuuauuuauuuugagacaaagucucgcucugucacccaggcuggagugcaauggcgcaaucuuggcucacugcaaccucaccucccugguucaagugauucuccugccucagccucccgaguagcuggauuacaggcauccuccaccaguguccuccacuacacccggcuaauuuuugcauuuuuaguagggacgggguuucaccauguuggccaggcuggucuugaacuccugaccucaggugauccacccaccucagccucccaaagugcuggaauuauaggugugagccacugcaccuggccuagucuauuuauuuaaagcuauauacuuacuugcuuauuauauacuuaacuugcuuacuauuccaucuaaaauguaagccaguuaguuuccuucuaaaucaauugccagccuuugucucuccuaccaacuuccuaguuguuucauuaccuacaauuguuguaugaccuucagaaaaaccucuaagaaaacagcaaagcuucuuugugcuggugaugacuuccccucagccuuagacacugagguacccaaggcagguaguucuuuuuuuuuuuuuuuuuuuuuuugagacagagucucgcacugucacccaggcuggagugcaauggcacgaucucagcucacugcaaccucugccucccggguucacacgauuuuccugccucagccuccugaguagcugggauuacaggugcacaccaccacacccggcuacuuuuuuguauuuuuaguagagacaggguuucacuguguuggccaggcuggucucaaacuucugaccucgugauccgcccgccucggccucccaaagugcugggauuacaggcuugagccaccgugccuggccggcagguaguucuuagcacagucucuggcuuguaaauguuuauuguuaucgugaggcucuucuugauggguuaauuuagauaaagauaauuuuugguuuagcgaaauuaagaugcaggaugaguccuugcccaucacuuccuucucuuggauuuguaccuuagggacuaauuuagcuuuaaaaauuaugaaaaauuucaaacuugcacggaauuaaacuaguuauaaugaccuaccacccagguucaauccaucgcgggugcccccuaccuccaggagaacagaaagaugcacuguggacaggguuugacuuugguaccaggcgaucacagaaauggucuguguaaugaugcauuugccgaaaguccuccaggcuuaaagcaguccaaacucugauuguugcuggguuuauuagauugucucuagguaauuggagacuuuaauaagggcugugguagguguuggaagcaucuacuggaacaauuuccagaucaaagugaacuuugcugugcugcuggggaugcagcugcaagccuucaucaucauguguuuuucugugggugcagaccuggacucuccugaggaaaccccagcccggccccagacacuccuuggccuccuccuggggccuguuuaagcugcucaguuuucaugagccagguugguccuacuucuggcacagccagcugguaaagcauguggaccugcccgucauuggugcuagaucgacacuccugggcuuggagaggauaacuuuguuuucuuuuguuuuuuugagauggagucucgcucugucacccagucuugagggcaggggugcgaucuuggcucacuggaaccuccaccuccuagguucaagugauucucgugccucagcuucuggaguagcugggauuacaggcaugagccaccaugcccggcuaauuuuuguguuuuuaaguagagagaguuucaccauguuggccaggcuagucuccaauuccugacuucaggugauccgcccgccucggccucccaaagugcugggauuacaggcaggagccacugccccugaucagagaggauaacuuuacucuuugauacacgauagugagcaaaacacaguugugagaaauaagcuuaacagguugcuuaaaaagauagucauuuaaugcauucuuggggcaaggguccuuuagauaauugacggaagcugugcguucuguacuuguauaaugggacaggauuagagggaguugucuauacaaggcacagcaaguccuuugggaaugaggggaggcauggaggaucagugacuugugcccucuccagcucucagaucuggcucgagaccaccauggcuaagguggaaggggcugccgcccagcuucccagccucaacaaccgacucagcuaugcuguccgcaagguccacaccauucggggugcguaggacaacugcgagccacguccugcccccaccccaccagcucggacuuucuucuuccugacccagcucucucugaucccacauccauucaccuuccuccuuucaccaguccuugcaucucuuuuucccuuacucccuguccccacuuucucccaugcaaacuucaucucuuuuucucccugcuuuuuccccuccaggccugauugcucgaaagcuugcccuugcucagcugcgccaggagaggugaaguuugggcacuuugagguggauggggcuuuagggcauuggcugcugggacccccaaaaccaugaggacugaggugggaugggggcuuugggaucaggcagcugggugauuucuucugacucuuucucuuccccgucccagcuguccccuaccaccaccggucacagacgugagccuugaguugcagcaguugcgggaagaacggaaccgccuggaugcagaacugcagcugagugcccgccucauccagcaggaggugggccgggcucgggagcaagguacaccugguugccaggggguggagaggaugaggaaaaacccggugucuagggugcugggagaggccugacccagcacccccuccuuuuaggggaggcagagcggcagcagcugagcaagguggcccagcagcuggagcaggagcugcagcagacccaggagucccuggcuagcuuggggcugcagcuggagguagcacgccagggccagcaggagagcacagaggaggcugccagucugcggcaggagcugacccagcagcaggaacucuacgggcaaggugucgagagggaaaugggugcuucccuuggaggguggggugggaacugcgaaucaaagcuccugcugauaugccccgucugcacuuucaccccagcccugcaagaaaagguggcugaaguggaaacucggcugcgggagcaacucucagacacagagaggaggcugaacgaggcucggagggagcaugccaaggccggugagccuugccaggguggauagggccuuccaggaagaaggaaguguuaagacauaagguuauuauuuuccccucaaaguguguucaaagcuucauuacaggaaguaaugaagguauccaggaguagcacagaugaauuaucacaucgugaacacacccauguagccagcaccagauuaagaaacagcauauggccggucgcgguggcuuaugccuguaauccaagcacuuugggaggccgagguggguguaucaccugaggucaggaguuugaggccagccuggacaacauggcgaaacccugucucgacuaaaaauacaaaaauuagcuaggccugguggugggcaccuguaccccaagcuuacuugugaggcugaugugggaagacuacaugaacccgggaggucgaggcugcagugagccaagauugugccacugcacucaagccugggugauagagaaagaccaugugucaaaaaaagaauuguguaaugaauguaucuucucuaacuaaauauagcaguuaacauuugccacauuuggucucuuaucuauauacacacauauuuguacaucuuuugaaucacuuuaaguuguaaucauuuaauguuuuguuguuguuguuguuugagacagagucuuccucugucaccagcuggagugcaguggcaugaucuuggcucacugugaccucugccucccggguucaagccauucuccuggcucagccucccaaguagcugggauuacaggcgcccaccaccaugcccagcuaguuuuuguauuugcaguagagacgggauuacaccauguuggccaggauggucucgagcuccuaaccucgugauccgcccgccuuggcaucccaaagugcugggauuauaggcgugagccaccacgccuaaguaaguuguaaacauaaguuguucagccgcaucucccaaagccaguaaauucuccuauauagcugcaaucaucacacuuuaagacagugaacacuaauugcacaaaaucuaacccaguucauguucagauuuccccugaggaacuccaggaugguucagggaugaggaagauacuuagguucagauucccaggcuccuagagcaucagcccaccccuccaacuguacagaagagacagauccacagagcagaacagccuccccaagccacagaguuggugacccagcguuuguuccugucuucauggugccuggcugccucuggccugacucacaccugccuccucugugccuuggccucucuguaguggucuccuuacgccagauucagcgcagagccgcccaggaaaaggagcggagccaggaacucaggcgucugcaggaggaggcccggaaggaggaggggcagcgacuggcccggcgcuugcaggagcuagagagggauaagaaccucaugcugguaggagacaggagggcagacaggcagacacuagggcccauccugggcugguuccugggcuagagguguggaaagaggauggugagggaggcucuauccgggcuagguuuaacccucuccuucccaggccaccuugcagcaggaaggucuccucucccguuacaagcagcagcgacuguugacaguucuuccuucccuacuggauaagaagaaaucugugguguccagccccaggccuccagaguguucagcaucugcaccuguagcagcagcagugcccaccagggaguccauaaaaggucuugggccaagcacaaagggacaagggacaaaugcgcgcacuucaggaaucuccucuucagacucucgcaugaugaguguuguucucugcgguccuucgaggcccuuagccucuuuuagcgaugcccagcuuggaccaaagagccuccucucucccauuccucauuuccugugccagcccuguuuccucuguaaccacgagcaccuucccuugucuggugcucaucugcugucuuccuucccagggucccucucuguccugcucgaugaccugcaggaccugagugaagccauuuccaaagaggaagcuguuugucaaggagacaaccuugacagaugcuccagcuccaauccccagaugagcagcuaagcagcugacaguuggagggaaagccagccugggggcugggaggauccuggagaaguggguggggacagaccagcccuuccccauccugggguugcccugggggauaccagcugagucugaauucugcucuaaauaaagacgacuacagaaggagccauuguuuggaaauguuauuucuggg

SEQ ID NO: 18304 - RNA, 1542 nt, Homo sapiens
cagacucagcccaccccagcuuugggggccaguacauagccaugauccucaacuggaagcuccuggggauccugguccuuugccugcacaccagaggugaggugggaacagaggcagggacugcaguuuggggugaugagggauacucaagauggcggaggugaacuggacgcaugggguuggggacaggaauucaggggacgcagaaggugcaucuggcucaccagaaauggcuuucuggacacauugggugggggacauggugcagaaggugcauuuggcucucaccagaaaugguuugcuggcuccauguggcaaagucggucaggauuaacgugggggggacgaguuuccucggagcugggaucuguguuaaggagcugggguccuuguaaagcuggggucugugugccugggggccaagguguaacccacuuuggguugcagguuggccugaggacaaagcuagugggguaccccaaccagggguggauggagcuuauuuggagaagucuggucaguuuaaagugggucaagugaacgguucagauccaucggggguagggguucaugacauuuuaccaucaguuaaguauuuacaaaccuaccgagagcucuuugagagugacuuuuuuggucuguuugugggucaguucaggcugcguccauccagacaggcuccuccuccuggggcuggggcuggguggggcuggggagagaagcccucaccaccucuuaccuuucuccuuccuccuuuacaggcaucucaggcagcgagggccaccccucucacccacccgcagaggaccgagaggaggcaggcuccccaacauugccucagggccccccaguccccggugacccuuggccaggggcacccccucucuuugaagauccuccgccuacccgccccagucgucccuggagagaccugccugaaacuggagucuggcucccugaaccgccuagaacggauccuccucaaccuccccggccugacgacccuuggccggcaggaccccagcccccagaaaaccccuggccuccugccccugagguggacaaccgaccucaggaggagccagaccuagacccaccccgggaagaguacagauaauggaguccccucagccguucuguucccaggcaucuccaggcacccacgcccucuccacccucugauuccccgugaauucuucccaauuuagccugucuccuuaaaccucuuccucauucccucgguuuuauucugaacccguaaggugguguucucaauauuuccuguccccuccugagauccauacuuaguccucacaucgcccguuuuuuccucugacagccuaagccuacucuccuaccucgccuccaggccucggccgcaccuaccucccacccggucuuccugcccgcgcgaucgcuggggcagggcuaugguacuguguucccuucugccaccugguggccggcggcaggaacuaucaguagacagcugcugcuuccaugaaacggaaaaauaaaaaucauguuuucuuaauucugaau

SEQ ID NO: 18305 - RNA, 5411 nt, Homo sapiens
ucugcuuucaguucaacaaauauuuauugucuuccuccucugugggagcagcuggaagguagaagagaaacacagcccgcuuuugaaggaaaaugaggaacacagagaccucuagaggcguaggaagagcaccacccagacucucagaggagacccaggacuccaagaaggcaaaaagucugcaccuaguccccacaguuuacugagccaucuguccaggauccagggacagcagggagccugcuucaaccucugagggugccccagugucucccucacccagggaaucaucugagcacugagggaaguggccacaggaaggggcugagauaagggccuugagaggcaauggguguguuggggacggugaucuaggagggcguggugagcucuguaauggagggugggguggaauugggagcgagagcccaguggcauauuggguggguugacuagaugucgaagaaaggucagugaaaaguggccacuguuuccagaugaugguuugacuuugcuuuauuugguaaaggggaagaggaagguauaacuucuucaggcgucagaggugcucugagagcauuucagggguuucccaguugagaagcugauggggguguuacucaauggaccauuuccacacaguagagggaauuguaagggguggugaucuggcugaggggcacugugguggaaugggaauuuaaacaguaggagagaaucaagagaggagcuuugaaucuaccauuuugagaagaggaaggaggaaggggugauaagagagagucugcaaccuugggguaguggagaaagcagaaccacucuuuugggaaggagggaaacugagcuaacccuaugccugggcacuggacuucucccauaugggauauaguguaugugcuuguuugugcccaaggcaugcacacacacaacaguugacuucuuauggacuguugaguaacucuccuugggguaggaaaacuucagggucagcuagcuggggccccagaggcuucacuugggcuaggauaucccggauggagcggcaggggaucuuuccagcacugcuggagccacagggcuuggcaccagcggagggaucaggauggggagagccaucggggcccccagucagugucaaggaggagacagacaugcaagggugaccagaagagcuggacuugcugccacaaggcugaaggaugauuuugccacuggauugggaacuggagcugcugcugaaggagccggugccugguggggagcaggggcucugggaagcacugccgcagggaugguaggguaaaccggagcugcuggaaaugcuagaacugcuggggacucgagaacuggagggagagcagggucccuuggagcccguggagccgccuccacagagcuggaccccaccaguccccacuggcuggaaugcaauggccgaggaagcugccgacuggcuggggaugaugggguugcuggagaaguauuugcccucagagauggggggcccagcugcaaaggaagggaccccuggagagccuuucacaggguucucuuuggugaaguagcccacaggguagauuuuacccuuacuguaggucaugccuggaaccagauaacugucagaggagccacccaccaccucguagccaccauaggauuugucuacagaggugauugggggacagggcuugccuggaaggccaccauugcuacaggggggaccuugaaccacuccaggggcaccagaaccgugcugguccaccaccaccaccacaggccucugacccccugacacagagugggagcuggggauguaggggccggagugcgagacgaugggcccuccacugcagggagagucggggauguccgaacuacagggacgcugguuggagcugacgcuuuggccacugcuggauaccccaaaggucugggaagaggaagagcuuuguccaggcugggaaggguuuaguauuccgcgguaagaguugucauugguuggcagagcagagccauucccuacuuggaagcugcugcugcugaacugaaagcugcugcugcugcucgaaugagagcugcugcuucccgagugagagccgcuguuucccgagugagagcugcugcuccccagcugggaggaaccggaugcaccuuguagacuagagccagauccggaggaguagcugaccugggaauaccccguuccuggcuuaaaagauccugcagaaccacccugggcaaugcuggauccgcuggagcuaccacuggagccaccaccagagcuucuggcacuggaaauggagcugccagaacugcuggagccacuguagcuacugaaaccgcuggagucacccuucccagugaggcaggggucguuaggggaggugauacgcgugggguccuuacaagggucugagaaggugccaaugcucuuagccaaggucccuguggaggaaagcagugguuaguaagggccaaggaggcuuggcuuccucccucaccuuucugccuuaucucagucaucggccucucggguuucucccaagcagagcgcagggagaguuuagggauggagaaaggaggaagaacuggcuauugucucuaaaggauauugagguggccgaauaaaggcauuucuuuguuugggaagggugggcaaacaccaaccagaaaaauagaaaauuaggugccaaagugaguggccucaaaggaauacauugaauauaagagggggcugggcacaguggcucacgccgguaaucccagcacuuugggaggccgaggugggaggauugcaugcgccccagaguucaagaccagccugggcaacauagaccccgucuguauuuuguuuuuuaauuaaaauuuuuuuuaaaaagaagagggaauggagaaggggcaggaacaaguaggucuaaaagaaaggacccugaagagacagagaauuggggaaacugaggcucugaggaguccaggcguaaauucuuaggggaaaaauccugggccagacagugggaccaaagggaagaagacaaaaggcaaaacaauggagggcugagaaguggagacacauauagaaggagacacuggaaaaagacaaagcugggggcagaggggcugaaauaaaggaaagggcacucgaggacuaagauuuggucaccagcuucuucgugagagcccaggcuggggucaggaauggaaacccuauuuccuaucucagcacuggccaugccaguaaagcugggugggggccaggauguggggucacuaccuguugcuucagaaccugcugguaccagugugucaggacaccgcacccugagccagcccugcucucgcuggcccagcccagggaaccaggacgaaaccccacgaaccuccgaggcuccuggccacaaucagcuucccucucugagcacaccugccucuguccagccccucaucugacuucugcugccuugacuucccucagggauguggagccacaucuuuccuuaucuuuccuuuccuuugcucaaaaccccaggcccaacuuaccccgugguuccuccaugacucuuucaccugcguuccuucugccuucccuagccccuccaggucccacguguuacaaacagagccacauacuagcaaguuacugaaccucucugagcuuuaguuuauacauucagaggggccaaauuuucccugccuucccacagcauuacuaugaagaaaacuaaaugagaucauccaccuggaaguuuuuucuucuucuucuuuuuuuuuuuuuuuuuugugagauggaguuucuuguugcccaggcuaaagugcaauaacacggucucagcucacuguaaccucugccuccuuggugcaagcgauucuccugccucagccucccaaguagcugggaccacaggugcccgccaccacacccagcuaauuuuuuguauuuuuaguagagaggggguuucaccaucuuggccaggcuggucuugaacuccuaaccucaggcgauucaccugccuuggccuccugaaauguugggauuacaggcacaagcuaucaugugcggccagauguuuuagaaaguguaaagcauuauauauuaugaauuauuacugccacucauccugaucccuccaccaacaaccagacugccauccucugugaugucccuguucucuccucagaaagaaauucucugcaugcaccuccacgccgaaccccagcugugccaauucccuucaguccucugcacgaauccaccaugcauugccucucucuuucgcuauucccucagacaccaaccacccacuagaccaugggaaggucgcagaaauuccucaagggcuauaaguacccgguggucaacaacacagguccagggguugcccggccugggguugaaaucuuggcuuugcugccuucuaaugcaugaucuugagcuacuuuccuaacuucucugagccucaguguccucaucuguagaguggaaauagcaaaucuccuuucauaccguucuuguaaugaucaaaagugcuaauauaggccgggugugguggcucaugccuguaaucccagcaccuugggaggcugaggcgagcggaucacuugagucaggaguucaagaccagcuugaccaaaauggugaaacccuguuucuacuaaaaauacaaaaaaaagaaaauuagccagguguggugaugggcaccuguagucccagcuacucuagaggcugaggcaugagagucgcuugaaccugagagguggaaguugcagugagccgagauuacgccacugcacuccagccuuggagacagagugggacuccaucucacaaaaaaaaauaaaaauaaaaguucuaauauauaauccaaaugugcuuaaaacagagucuagcauauaaaaaggcucuaaaaaugauauuauuacuauuaaauguccaaucauuaucuuguagugcucccauaauaaaaaucaccaccaccauuuauauaaaccucuagaauuuccaaaguacauaucacauacauuauuuaauuugagacacacagacuagaguuaggugucauuaaccccacuucagaguuucagaaacuggggcucaggaaguuuaagaaacuuaccugaggcgaccauacagugaggagcaacccccagacucaaaaggcagauuccagagccccugccuguccccuucgcuggguccucucccggagucucccucccgccucccuccuguucccagggcccccagccuccuaccuggcaggaggagaccagccagcagcagugccaucaucccgugcccacccacacgccccauccagggugcccgagacgagcccaucucggacugcacggccuccugacugauggcagcucaaggacacccggguccuuuaugccagagcuggacauucccu

SEQ ID NO: 18306 - RNA, 12099 nt, Homo sapiens
cgcgcggcuccagggccacguuccagggucggguuugguggauuccucagucccugccgccgcggggcgcccugggauagcggcggggccuccuggugagcgcgcgccggggcggccuccgggaagugggagacgcugcggguccugggcccaggccuugggaugggcgggaaggcuuggccgcgccgggcugugggcacugcaggaggccccugugcagguggagaucgccgcggcccuggcgggacuccuugcuggcucuugggcgcgcugaugcccaucaucucccugaguuucugagcccuaucucucaugugucaguggucaccgccgaauccagacacuccggcccuguuccggaagagcccugauauccguggcuccauggcgcugucugucgauaccaugcacucuagcucucaaggaggaaagguuuuguggaagggaauagagacuuggaauaacagaccugugcuaauuagagacaggaaagauggaacaaggggagugacccuucuccacccccauauccuaaugugcucucucucuauccagaacagaucucggccccuuuccaaacacuccugaugccucauuugccucucgccucuuuucgaccaccauuuugggggcugaggcacucacggggccuccccagguuucacuccguuucuacacagucggagccccauggaucucccaucucccggaggaaccgugaagccaaacagaagcgccugcgagagaagcaggcgacucuggaggcugagauagcaggggagagcaagguuaggggucagacagcuuguccuuggguuucugagacuugagaggggcuggaggagaccggcugaaaugcagucugggguauacuggaucccagccucuucugcuuucucuucucagucaccugcagaauccauuaaggccuggaggccuaaggaguuaguauuguaugaaaucccuacgaaacccggugaaaagaaagguaaguagaauaaguaagaaggccuuuucuuucacauauguguugcccauuuggccugccgaaaugcagccugggaacaaguucagugguuaguggagcucuccucugccuucacagaugucucugggccccugccuccugcauacagcccccgauauguugaggcugccugguacccgugguggguacgagagggcuucuucaaaccagaauaucagguuaguaucuggcagggagggguccuaaauugucuccaggacagaguggcccuugaauacaacuggaccucagaguugagcucacauuguagaccuugucuucuuucuggcucuggugucuccaaagauuucucuuggcagguucccccuggccaauucccuccucuccacucuccucuuauuugcaggacaguucuuccuugaaguucuuucuguucuggagacaguagagggugcucuuuccccaauccaauucucucuugccccuuugacuuuuuuucuuccucuaggcccggcugccccaagcuacaggggagaccuuuuccauguguaucccaccucccaaugucacuggcucccugcacauuggccacgcacucacgguggccauacaggaugcccucgugcgcuggugagaggggagugggggcugcuugaguucuuggaagggaaauaggaagggcaggaaugagugaggauaaacauuuaagcucaggggcucacaggagggcauuuuuguugcaggcaccggaugcguggggaucaagugcugugggucccugguucagaucaugcaggaauugcuacacaaguaugucuuuuguuaccuguuccuuuucuugggcaaaagcaauuucuucccccaaagcaaccaagcaaccugacucuguucauuugcccugaauccaacugcaggcugugguggagaaacaacuguggaaggaacggggagugaggagacaugagcugagccgggaggccuuccuuagggagguguggcaguggaaggaggcgugaguaugaugggcaggacucggggggcccagauggcagauuugguuucuugccucccaccacuaucacuccugacuuguaauccuuggcucuucccgacacagcucugacuuccucagagauggaagcucuggagccuguuaacauuugguggaguuucuaagccuuauguguguggauauuauauaugcauuagaauauucguguguguguguguguguguguguauuuauauauauauauauauuuucuuucucuuuacuuaccccaauuucucuugucuaaaucucaccuucuuccacucgcccauucccaccuuucaauucccauggaauuacccucauucuucugggucuguuaucucaugccaucucugugaagcauccuuggauuucccacaauauggcuaucccuccucucuuccuauagaaucuuuugccucuuuuaauaucuuagaaaaccccauacuggguuuguaaguccauuucuauuagccucuagaggcuagaucaaugccauccucacuugauuuuccuccaacaccuggcauugcugggggcaucgcugggccugguacauaggaagugcuugggaaguguuugcugacaaggaucucucugggcacaggaaagguggagagaucugugagcagcugcgagcucugggugccucccuggacugggaucgagaguguuuuaccauggauguugugaguguucugugccuuggucccugugagugaugggcgauguuuagggaucuguguggggcagggaggaagcaaugccugggucccugagcagggugaugggcugagaaguggcucuuagagguggacacucaggucauuccagggcuccucaguggcugugacugaagcuuuugugcggcucuacaaggcgggguugcuguaccggaaccaucagcuugucaacuggucaugugcuuuaagaucagccaucucggacauugaggugaggcggagagagggaagcagguuugugagagcucugaggcagaguggucaaugauuaagagcucagacucuggagccagggugccuggauucaaaucugaugccugccuguuacagcuguguggcuuuuggcaggccguuuagucucuuuaagccucagcuuccucagucuguaaauuagagaugauggaaugcuugcaucguggggguguuguaaaaauuaaaugagaauucacauaggugcuuggcaagauaccuggccauggcuuaagugcucagugaauauuuauuagaagugugacugcacgagcauugggugagggcagagggagguagcucccgaauccuccaaauggcuuuuagauggauugcagggaggcugggcagauggaugaguggcagagugaagccugggcaugagccuugcagaaaggcugcccucugacccagcuuucucggugccuccagguggagaaccggccccugccuggccacacacagcuucgacugccuggcugccccacccccgugucuuuuggccuccuauuuucuguugccuuccccguggauggagagccuggugagcauaguacucugcagggucacccguuuaccuccauuuuuccuguuuucugaagcccauguugggcugcuaggaacccaucaguccaucucucacauguaccuugguaguguucaccucagcgugggcacuuacccagggucuucugggggauguacaaaaagugcauguggucacugcccuuugagaguguggugugauucuucaggagugcgcuacccaggaaagagaucaguucuaagguauguuuuguuuuguuuguuuguuuguuuguuuugagacagagucucacucugucacccaggcugcagugcaauggcacgaucucggcuccugcaaccucugcuucccagguucaagcgauucuccugucucagccuccugaguagcugggauuacaggcgcgugccaccaggccuggcuaauuuuuguauuuuuaguagagacgggguuucaccauguuggucagguuggucucgaacuccugaccucgugaucugcccgccuuggccucccaaagugcugggauuacgggcgugagccacugcaccuggccucuaaggugugguuuuuacgguaaauguucugaagagcucagagaaagggaagacagaugagcuggaauugucaguggaagcuucuuguaggagcuggugcucccccugaggaauguacagcauuugugauuaggacacugagaauccccaguguccucugggcacccagcaagaauucuauuauaguugcuuuaauuaaugcugcccccauuucuuccaugcaaauuaucagggaauucuuuagcaccagagacccucucagaccucuggucaucagcuuaugggaaacccuggguuccuauaaacacugcuccuacuuuuuucuagucacuccugggggccucuuccaccuugacuacucccugccccuuccccuuuccaguucuacugccuuuagcuauguuggcagugagaggugaggaugaugaccagcuguaaguguuuaaauguuuaucuucagaugcagagguugugguaggaaccacaaggccagagacgcugccuggagauguggcuguggccguucauccagacgacucgcgauacacaguaauacccagugcgcuccugcacucuggcccgccccgccaauggccuucucuucucuuggguuuuaaaugguggcucuuucucucuugcuucuacuuccuuuuccugagacuucucucagugguucugauuggacucccuccuccucuuauaguuuuucuguagcucagggguugacaaacuggcccaugguccuaauccagcuugcggccuuuuuuuuugagacagagucucgcucugucaccaaggcuggagggcaguggugugaucuuggcucacugcaaccuccaccuccuggguucaagcaauucuccugccucagccuccugaguagcugggagcguggcaccaugcccggcacgugccaccacacccagcuaauuuuuuguauuuuuacaaaaauuaguaauuaauuuuuuuuaaguaauguaauuuuuaaguaauguuauuuaguagagacggagugucacuguguuagccaggauagucucgaucuccugaccucgugaucugcccaccucggccucccaaagugcugggauuacaggcgugagccgccgcgccuggcugcuugcagccuuuauauuaucuauggcugcuauuauauacccucuccagcucugcugcaguggcauaauagaguaauugugcugagaaugaauuugucucuaggcccaaaagccuaaaauaucuacauucuggccccuuaagaguuugcugaccuugcucuagcuugcuaccuuccacuuucuaccuucuuauuccugggguucucacgccccagcccagacccuuccaacccucacaggugccuguccuugaucccucucccuucccuucagcaucuacacgggcgacagcuucgucaccccuugauggggcagccucuuccccucaucacagacuaugcuguucagccacaugugggcacgggugaguggaagucaggggagggagagaaaguuggggguccuggaggagaggggagggaaccaggaggaagaggaaggugggagugggagauccucauauaggguggucugaguggggaaugggagggaggcacagacagagaaagucgcaggggcuggggcggugcaggugaugaugauacaucuggaaaagcaaaagccaaggucagguucaguacucaccauggcugugcuccccaaggggcagugaaggugacuccagcucacaguccugccgaugcugagaugggggcccgacauggcuugagccccuugaaugucauugcggaggaugggaccaugaccucccucugcggggacuggcugcaggugguaccacccuauguuaccccauccuuugggggcucucugucccccuaauccuccuccuaguuucuuauuucucuagaggccuucagucuuuacucuugccgcuuuuucuccagggucuucaccgguuuguggcccgggaaaagauaaugucugugcugagugaauggggccuguuccggggccuccagaaccaccccaugguacugcccaucugcagguaaccucauuuuaacuccuuuacuaagggcuaccccaaaagggaauguauggagcuuaagggugacaauaggaugggcucugcaccccuccguuagaauacgagcuccgugucgguuuuauucgcuauuguauccucaguaccaagggccuggcauggcauggggucuugugccccugggagaagucacagggccggaagagcaguggacucacccugucucucuuucagccguucuggggaugugauagaauaccugcugaagaaccagugguuuguccgcugccaggaaaugggggcccgagcugccaaggugaggcugcaguguaggaaggacuggggccagggguugggggagcucccugagaauuggaaugaagaaaugggaagcaggagaccuccugcccugaagaccucuccagcugugguaacugagaggaugugugggauggaggcugggcggcccagcaagggcuggcucauauccuuacucaagcccagaaucuuggcaagaggcuugggagguccuuucugaguuuuaaaaugaccucagaggccacucguccuaucuguggaggugcggccgugcaggaagggcaacauugucuaaaguccccuuucucuccaggcuguggagucgggggcccuggagcucagucccuccuuccaccagaagaacuggcagcacugguuuucccauauuggguaaggguaggguaaggggagcucuuguggagauggggaggggggacugacugguuauucuaagacuucacgaauguccucccggcagggacuggugugucucccggcagcugugguggggccaucagauuccagccuaccugguuguagaggaccaugcgcagguggguaggaagaagcacccggagggccgaguguggcacagagcaccuagcccaggagucagagcuccgcagggccaagucccgcuccugccuggucaugugcuucaugcucauagucauguaaccuucugcgcgaucaaggcucccugaaguggcauuucuuuaucucaccccugggggaaccuggccacucuaagaccacaugaggacgugaaaaccaagugacauuuacaccugucagcuguucuuccucacucuccccaaccccuuccuacuuuugcagggagaagaggacuguugggugguugggcggucagaggcugaggccagagagguagcagcggaacugacagggaggccaggggcagagcugacccuggagaggggugagugccugagcuggggagggauguacaggggagcgggggccugggcaucugggccuuugaggggaacagaucccaagauacagaagguagggucaggaaaguugggaauggagccaaaggggacagcccuggucucuggggguggggguuggccuagaaugguggcagcaguggucugagguccuagaagccaagguuccaacuguccccauucuuuuucuguuucccagauccugauguccuagacacaugguuuucuucugcccuguuccccuuuucugcccugggcuggccccaagaggugagguggguugagagggcgaaagugaaggggaaacgauaaggaagggauggcugggcccccacagaggcuugaggggggccuggggccugggccucuuacugcuccucuucccccuagaccccagaccuugcucguuucuacccccugucacuuuuggaaacgggcagcgaccuucugcuguucugggugggccgcauggucauguuggggacccagcucacagggcagcugcccuucagcaagguaagagcccuucagugcccugccgcuuucugugacuccaguguuccccaaaccuuguccucccuucuaaccccuaaugugguccuuuccacguugcugauuccuuuuuccuaauucacuuccuacccuacccccaaaaguauggaggccagagaucccaaggcaccuccaaggaaaccccccucuguugaccccucccugcccccaggugcuucuucaucccaugguucgggacaggcagggccggaagaugagcaagucccuggggaaugugcuggacccaagagacaucaucagugggguggagaugcaggugaggacgaagcacccacuagagggacaagguuugcaggguuugcaggagagaggaaggcaggcugagggaggagugaggccagcaggugugacccuuauagaggcagggccuucgaccugggucgugaauugcccccuuccauccccaggugcugcaggaaaagcugagaagcggaaauuuggacccugcagagcuggccauuguggcugcagcacaggugagucaucgcugccugccccccaccagcucuagcucaccaccucuggcuuccucugcaacccagguccuggcccugcagccacaaaggcaucugccacccuucuucuuccucugguugcagaaaaaggacuuuccucacgggaucccugagugugggacagaugcccugagauucacacucugcucccauggaguucaggguaagccugggcgaggggugucggggugagcagagggcagcgggcaccugugcaggggcagggcaggggcaggacuucuggugcugcugccaccuacaugcagacuaccucgauucuucccuuccagcgggcgacuugcaccugucagucucugagguccagagcugccgacauuucugcaacaagaucuggaaugcucuucgcuuuauccucaaugcuuuaggggagaaauuugugccacagccugcugaggagguaagagaaaacagaggugcuugggaguaggguagucaggugucagagggccaagguggcaucuggaaggaaaggaggcaggggagggggagucaggccauccugcccccucugccugcagcugucucccuccuccccgauggaugccuggauccugagccgccuugcccuggcugcccaggagugugagcggggcuuccucacccgagagcucucgcucgucacucaugcccugcaccacuucuggcuucacaaccucugugacgucuaccuggugagugaggcugggggaggcuugguauucccaugccugcuucuaauuccucuggaaauuuccaaggcagagagcucuggaguuaauaaguucccaauuguccccucaguuaggagaggagaggagacgagggagucucaguuccccucuuccugggacugguuuuggcagugcagcccaggcacuguugccugccugucaccuggggagaggaggaggagggagacuucuagaaaugucugacaagucggugucagaaggcagaggggaauuuuuucagucccuguaguugcugaguuuggcccaugggcaggcugcgugcugagagaggccugggagggacuagcagcggucuuuagaccagggguucucacgcuguccuacguccaaagcaccuggagggcuuguugacgguggaucccccccgcuccacugccaccccagaguggcuccuuuagcagguuggggugggggugggugguguaaugaauauucauuucuugucccaaguggugcugcugcugcuggcuguggaccacugcccuagcucagccuuuuaaaaaccucuguccccuguugauaagcaaaaaacucaaugauuuuuuucccuaaacuacauguuucccuggaaauccugucccuguguacugcagagaauugcuguccuggaguccccuucuuugugcugaguguguccugggacuguggaucauaucagaagugcuaagugcuucugccugucccucucucccaggacccauggccugccccacuggcggguagcaguggcuguagggaggagggcuguggcccuggaccuguccucugaccauuggcuuccucuccaggaggcugugaagcccgugcuguggcacucgccccgcccccuggggcccccucagguccuguucuccugcgcugaccucggccuccgccuccuggccccacugaugcccuuccuggcugaagagcucuggcagaggcugccccccaggccugguugccccccugcccccagcaucucgguugcccccuaccccagcgccugcagcuuggugagucccaagcaccuuggagugggucugugggugaaugggggggagcaccuucugaagggguuugcugcagggggcucaucugcaggaaugguucguacuuuacuguggagcccuggggaagauggauuguuccugcaggguugcugcgaugacccuagggucuugagggacaguauuagcguagugcucaagagcaggacucuguugcuagacugcuauuuuugagcugugugaucgagccucaguuucccgcauguuuaaacuaggaacaguaauaguauauguuaugguugugaugaggguuggauaaguuaguaauaggguguccccaaaaucucagugcagcuuuaauaacuucagaaggauaaaugcuaugaacucacccaaaaauuauuuuaaaauuuaacuauuuaaauuuauacuuauuugguuuugaguuuugacuaauucauuuuaaauucuaauuuauuuuugguuggccauuucaaucacagcaacuaaacaggcaucaaacacugaucaucuaaaaccucuuaaaugacgccucacuuuuugucauguuccuugagauaguggauuuucuguggugcugaggacagaucucauugcccuaaggagaugggguggaugggucgagaagagagccagcaggguugguacugagucucccaggagccccuuugccaauucugggucccccccauugccaggagcacuggcgccagccagagcuggagcggcgcuucucccggguccaagaggucgugcaggugcuaagggcucuccgagccacguaccagcucaccaaagcccggccccgaggugaggcaaggcggguccugggcucggaucccugcaggaaaagggggcugguggggaaaagagcagagccugaagggccaacccccccguuaggaggugcaggguaggaagggaggcaggagcugaggccuugccccugacaguuucuuucuuuccagugcugcugcagagcucagagccuggggaccagggccucuucgaggccuucuuggagccccugggcacccugggcuacuguggggcugugggccuguuacccccaggcgcagcagcucccuccggcugggcccaggcuccacucagugacacggcucaagucuacauggagcugcaggugaccagaggggauggggaggguuagggcaggcuugggaagcaugcugggaggaagggaggggcugggcucuauaaaguaggggaagggaccuucuaauggaggauggaggccuggcagcaggcggaugucugagccuuuucucccuguucuuccccagggccugguggacccgcagauccagcuaccucuguuagccgcccgaagguacaaguugcagaagcagcuugacagccucacagccaggaccccaucagaaggggaggcagggacucagaggcaacaaaagguaaggcugagggaggcccccagaaggcuccaccccugagggaaugugggccaggaggggccucauuccuggauccucaccuccuuuucuccucguccagcuuucuucccuccagcuggaauugucaaaacuggacaaggcagccucucaccuccggcagcugauggaugagccuccagccccagggagcccggagcucuaacucaucauccccaucaguuuuccucccucucagaccugucuuugaggacaaacagauuugucagcugucagggugcagugggacgucagagacuaugugguccaucgccuucauuguguaaaugaggacacagacugg

SEQ ID NO: 18307 - RNA, 1870 nt, Homo sapiens
acuuuuccacuccuccccuuaccucccuucucuucugaauucuccauucugggcucuugccugugaaaucuuucuuugcuuuccccaucuuuuccucgcauuuuuucaccaucuuucccucaaucuccaggagccaaugcgagacuuuggcuccgauuaagcgacggcccgagacucggggugcgcgaggaggaucgacagaguggugaggggaccuaggagggcgggaguggcagagguaugagagagagagaggugagugggaggcgaagagugagaggaaggcagggagaagcuaggagaucggaaggcgugggucagggugaaugacgugaaguagacuugggaagggaaaagagguggcuuuagauuugggaagcauggaggggagagguuaccgccguacuuagcagaagugggcuaagagauagaagauaggaaggacgggcagauuuggagcuuguagacuggucugaccaggaugggauggaagagagaggugugggcucaauuuucuuugucccuguuuagccaaagaugagacaagucauugaaauacaaaaugaucuugcaaacacuggacaguuaacaauucugucacuugguaauugagggaagacuggaguugaagggcagaaauagggugaggaggcaagaaagggagggagauuggucagguuugggagaaaccagaggagaugagugacaugggaaaggagaccacagaaaaggugggguuauuguggggacugauggaucuggaaucaguuagaaaggucaggggugacacuggcauggauggugagguugcacuucugacguuugcauuccucaggugauggagagcaccccuucaaggggacugaaccgaguacaccuacaaugcaggaaucugcaggaauucuuagggggccugagcccugggguauuggaccgauuguaugggcacccugccacaugucuggcugucuucaggugagaagccccuucauggcagggaaauguaauggggucugcggaguggaauaaaauaucauagguaaaaguguagcagccuggagucgggguggggacugggggcaaggguuggaaauugcucuaaaguguggaggccaaaacagcaggacugguaaaguugugcuggagugagaugagauguuugagagguaauugagggcagagaugcagauacaaugcagcuucugauacuaaccuuugaccucuguuccuguacagggagcucccauccuuggcuaagaacugggugaugcggaugcucuuucuggagcagccuuugccacaggcugcuguagcucuguggguaaagaaggaauucagcaaguaagucucagccagauacaaauuucucaacagcuacauuucccaaacugcuguuccuuggagcacuuccaggaaguguuaauagauauaucacaaaacuuaaaaauaaauacauuugggaaacucugcauauugccuuuucccuuuuauuuauuucccagcugagaucuugcuuucaaauguaucuucccucuuaaagaguuaugugugauaucuguaaugaggcucugauaaguaaugcaguaaagaauuugucuuaggaagauacuaauuucacucuguggaacaguguuccaagggucagcaaguucagaacaggcagagaugguggcuuuuaugggccuccuuuuuguuuuccaaauacccuacucaccucucugcuucuguuccagggcucaggaggaaaguacagggcugcugagcggccuccggaucuggcacacacagcugcucccaggcgggcuccagggccucauccucaaccccauuuuccgccagaaccuccgcauugcccuucuggguggguaug

SEQ ID NO: 18308 - RNA, 20092 nt, Homo sapiens
ucaucaccuuuggcuuugggaucauaguuuccaaaccaaggauugucugaacauugucugacaaugcccuuuuuuuuuuuuuuuaggcagggucuugcucuguugcccaggcuggagugcaguggugcaaucauggcacacugcagccuugaccucccgggcucaggugauccucccacccagccuccuggugcgcaucaccacauccagcuaauuuugguauuuuuuguagagaugggguugugccauguugcccaagcuggucucgaacuucugggcucaagcgaucagcccuccuuggccucccaaagugcugggauuauaggcaugagccaccgcaacuggcaccauugccauugguauuuaagaggugaugguuuaggcuuugaaauugggguuguuugugaaaacugagagcaccuuuuguuuucagauauuuccuauggccauugguguaauuggagggaagcucucgccauauauaauauuuuugagacagccaacuaagaaacugggauucugguucucuccagggugcaaaauccugggagaaggaagugaauucucaggggcccagaaggagucucuaaaggaccucugccagucaauucuaaucucucuucuccccugcaaaucagccccugcuucugccucuuucuccgccucuccuagauucucccccucuggagggccugagcucccggccaccacccccaaugccgcuuucuguuuccucugccucccuucaucuccuuuugucugggguuucuuugucuggggucucccuuugguucuguuucacaguucucagccuccccucccuuucuccacagccaggcugcucagucccucucugcgggggccuagaggcucggugaggggagcgggacuugguugccauggucacauugaagccagccgcagcuggcccgggcagcugcuccuccugggcccggggccccggacgcucggacaaagccaggcagcguuggcagccccagacccgaccccaaaggccugagacuggggugacugggaccuaagagaauccugagcuggaggugagaggggggaagccagagaugaacugggagggcaggagugggcacuggagcugggcccuccccuugugggcagggaccaggcgguccccggcuggaggcuggagguguguugggaggaggggagcggcccagagccuggcagggaggaggggaaagagagggaauagaguugggugccaugguguggugaaugggcugagggacuaggguguccccaaagggggaccguuguccagaaacagguuagauucucucuuugguccucauguccccaucugucccgcaggugccucuuccuuucucagccuuuuauacuucucaucuccccgugucccuuagcuucacacucugcgccccagucucccuccucuuucccuccacucucuguuucacuccagccccuucuucccuuguccuugcuucuuguccccuugaucugucugcccagcucucaagccuccucaguucccugccuuccucucuuaggaguuuguuuccaacacuguuuccuucccgaguccacuucaguuccuucauccaguucagcccuuuucuucccaaacuucagucuccuccucugagccccuggggcuucccaccuuuugcugugugugcccugucuucauccuccuuuuccucucucagaccugucuccuuggccuugaccucaguccaucuccgucucucugggaauucucucaccauuguccccaucugaccaucagccuccucucccucuucuggucccuugcccuuuucuuccccaaccacagcugagcuguuucaucucucucccagagcuacgucaucucaaucuccuccuucgcucccuggccucaguuuccaguuuauucaguggcaucaggucugacucacacccaaagccuuguacacuccuucacccugccccccacccgucgcuucuuacucuccccagcugcugacccagccugcuccuccagaggcagcugcagcucccggaaggggacugcagcuaguguaugugugggggcccaucugguccguccucucgcucgcuggucgugcugggcuucccuccuguggccagguggucugcaggccugaagcugccuucuccccucuccuacgugccucuccucacauuuuuucagcuguuucccauccucuccuuccugggcagcaggcugccacuggcuugaaggggagggaagcccaggaugggaggggaugguagagggucauuuggggguucucagggacacagggggccucugggguucggagugaugcaggagauguggaaugggcucuggggaccacggauggguaaucaggcccucuuggucuuuggugcugcucucugggccccaggauggcugggauuucccucucaggccccugggaaucucggcuccgagucccgcauuccagcuggcuccagcucccuuuccguugucacuugacuccacugggccccagccuugcaucccucccacuccuccagccuagagcuggggcgaggugggcaucaccacuaggaauuucuccugaggcagugagaagaggggacaaagguuucaggacucucuagcuccuucugcucuccccaguggaccccucugucuggcacugccaugccacuuagcuggggucagcgugggccugggguguggaaugucccaccaggguaugacgggcuguagcuugccuggcaggccuguuggggcuuucccagagcacagcuccuggaaggaggggcugugggcugccaggugaggugacuugggaagccuuggccccacccccaggcuggccccacccccaguccagcgucuccugggccuagauuccccagcugcuguucucuggagggguagguguucugggggaaugaaucccugggggcuuggugggacaggaaggcgggaagaagcugcucuucgagugacccuggggcugucuguuagcaggucccucagccguuggaacguccuugggcuucugaacuagugcccaugugugccucggccuuucccaagggccagcuucuuccugguagugcuuuuguguacuugucugguugggacuucguguuucuuucuugggauuguugucugggacugcaagcaggguauguuuuuaucuacugugagguuccuggggcggagaugugcaguggagcgagaacuuccugugaccgugacauugucuagguggugagcagguguggggguguggagagaggugaggggcugagguagugcugaguggggaaaaagcaccucccaccacaagcuguucugucccgcuccauccucugcccaguagcucucucaguugcuuugccuacucagucucacuguuucaucuucccugggucucuugguccccuuccuuuugacugugugugauuuucagugugccuccauccuucuccugcuccucuucuuccuccucccgaccacucaacuuuguccuggccucauuuuuggccucuucuggccagugaucagacccucuggcccacuacggccagagcuggcugggccugagggaggcuugcccugaggacuccugagucccccucccacuccacuccguugggagcccaggggaaucagggccugggcgucuggacccccgggucccuuagaacgcccuucagagagaggaacugagaggagaaggagaagagagugggcccgccuucagggucuggggccuuccagguugggucguaggggcgggagcgcacaggcugcgagagaggagcaaagguugguggagggagaagagcagucuggggccuggcuggacaggugagcccugagaccugagcucugcucccuucucugggcuaacucccgcagcugggcugggccgagccugugggaaccugcuucuuccucugugcccuggggcugcuccccuuugccucucccaccaggaaccgaucccagaaguaggaggggcgucuuccccucgugggcccugagcgggacugcagccagcccccuggggcgccagcuuuggagguucucguuuggggaagcgggggugggcugcgaguggguggagggggcugggcgcggagccggccggaggcagcggcgcgggcggcugggcggccugggagcgcccaggcgggcuuggcgggcggguuaccugggggaggccgggccgggcgcuagcgcgcggggugggcguggcgggcgcggggccuggagcucggcgccgggcgugggagccacugggacuacuggguccgggagggggaagggagggcugcgagcccgaacgcgcggcgagaaggccgaggggagggaggggagcgaggagcgggaggaggaagggagggagccgaggcgagggggaggcggcgccugggcccgagccgccccagcccuggcuccucuccccggaacaggcccccgacagcugcucucgggagccgccucccgacacccgagccccgccggcgccucccgcucccggcucccggcuccuggcucccuccgccucccccgccccucgccccgccgccgaagaggccccgcucccgggucggacgccugggucugccgggaagagcgaugagagguagggagagcggcggcggaacccgcgggcggaggccuggggcucuuggggugggggcgcgcggcggcgccugcagggcgaggggcgggggaggcaggacgucccgagccaugcuuggucguccagcucuucuaagccucccugcccgccuccccgaugcucuggcauaccgucugaaaaccgggggcggggacuggguggaggugaagcccgugaccucccagaaagaguuuugagccuccagccuugaggcaaguccccucucacucagugcggaggaacugagccccgggaggaggugcuccugugcagccccacugagucagcucaucuaucgccugcccuccaccuggccagucccugcgggcaucuaacugcuaagccuccgcucagccaacacccaguuggucagucuggucacaguccagcaaaaagagggacugccacucuaacccaccagugacaccacucuucccggcuggauggucaauuagcucuggcaugagagaaugucacugccggugagcgccagcuucagggucccacccccccaugccuggcucuuggcugaacauuucuucccagcgcuuccagcagccagaggcaggcgcccaagcucgcuggcuguugcugagggccuguagguguguccaggacugaguggugugguggagacaggugaaaggggagugaguggaaaggcagggaaaggcuguuguccuuauugccacucuucccacccagcgcccaccuguucccugcccccucgacgucccucuggcuuggucacccauguguguuagaggcugggccccaguucucuggggauccugugcccaagggcccgggugugugugucucaugcugucuuuuggucacaggagcauguggugucugucauuucauguucacaggugucugaagguggcuauucacugagcgaugggguuggacuugaaggaaugccaagguguggacggguugauguaugcaugagcuucuguguuugcucugucucagaaacucugugaggguugucagggacacugagaggugggugugugcaugccacauuuagccucgcuguuuacagccaguucaguaaguuuguguguuucaccguguguguguguacagagcuguguggguguugucugagugggacuuggggguugggagaggagcgugaagggcuugaggcaggguggccuggccccugguuugucuuugguuguaauggaguggaagggggugggauuggggaaggucuucugggcuuguccucucuugcccucugggucucugacuguggacugaagacccaguggagagagaugaggugacuggggguguuggagaacagacagcccagacgucucugugcuucuccguguuccucugcuuggcucugugccccguguuucugagccugcucuauuuaccucuugcauuguggcucucgcucugucuccgccugccucguauccucugccugccuuuguaucucugccccgggcuccucucggcucuguguggcucugaugacucaucugggauaggcaugaagguuacuuaggggaacaagagccccgcuguucccgagagaggugggguuggagagcggcacccaggaauuccaagccagucuccugggacucuggcagccugcuccccggcgcuggacccuaagggaccaggcgugaugccuucugguucuagccucugagugccccccacaacucagucgucccccucagcugcugcuucagagcucuggggucucagcugccucuuacauuccugcccuagugcauugugggagcagcuggaggaggacaaagggaugggggaguaucccccacuccuccuaccuccuggggugaccugccuuccuugucuuuagacccgcccucgucuccaaggcaacucagccuuuccucagucccucagaggcagccaccuucuggaagugggaacuggggggacuggaugucugggucucaggaaggcagagcagggauaacugggcccaagaugcccugaaccugauaagagguggcagucgagucccucaggacuccagggccuggagacuucaguacagggcucugagaccaguacagguuaggauagcuuuuccugcagcaggggaggggagaguaguuacuuggguuuguaaggagaugccauuuagaauaguuuuaugugggguaagcuuccugggccugaggaacagaguagggauuuucaaacuuuaaugggcacaggucaccugggaauuguguuaaaaggcagauuuugauugagcaggucaagggugagccugagauucugauuucuuccaugcuuccagguauugcugaugguccagggaccacccugggccuagagggcuauaggggacaguaagacuagaaggugcugggguccccucugcccuucucuuagaauucuggacuccuaugugggagggcagcagggugagcugguccaggcuuaucugauguuuaauucuaucauauccucaacaaggaauugcccaaccuuuccugggacauauuuauuuuuuaaaagucaaaaugauuuucauauucuuuuacauaucuuaugauuuuacauaaaugcauuuauguuacaagauuuagaaaaauaguacaaucaaccugucuuuuuaaauuugcuuuucuuuugccccguucauguuaacucuuguuauauuguauucuauuguuauauucuauuauauauucucuccuucuagacguacacacagguauauauacaaacaugggugcuuguuuauucuauuuucaaaaggugggauauuuuuuauacuucuguugcuugcuuuucauauucaacagauauacauggaaaucacacaaaguuaggaauauauugccucuuuguuacuuuucauagcugcauaguagucaauaaaccuuauuuuuuuuaauuccagccuguccccugugggcauucacauaucuuacagauuuaugucuuacaaaagguaccauaauaaacaucuuugaaaucuucuuuuuuauuuuuauuuuucacuuuuuuuaaagagauggggucucacuauguucaccaggcuggucucuaacuccuggccucaagugauccucccaucucggccucccaaagugcugggguuacaggcaugagccaccagacccagaccugcacauauguucuuacuuccuggugcuucucucucgagggaaugcugggucgaagaggaugugcauuuuuaauuauaauagacauugcuagauugcuuuccaaauagaagauaacacucauuucugccauugagcauggugccucccuuuucaucacuuucuaccacuuuuauauguuacagccuuaaaaaaauaucuugucagucugcuugguauuucccugaggcuggugaauuugaccauuaaaaaaaauguuuguuggcaauuuggcuuugcuuuucugugaaaugacuauucacauucuuuggcuguuucuuuauuggguuacuuauauauuuuuucuugucaguuccuaaggggccuuaguuuauuguaguuauuaaaccuuuuccuguuguauguguuauaaacauuuuuugcacacuuguuguuuguucuaagccguuguuuauggggauauuuugcccauuccugauuggagaaauggggcuuuaggaaguuauuuaacugaucucugcccuaguuucuucauguguuaaauauggauaguaauaguaucuaccuuaugaagugacugugaagauaaaauuauggauucuguuuaaggguuuaggccagugucuggcacaggggaagcauucuaaaaauauagcugaugcuguuaaacaaugacuguuguuguuguuuuacuguuauuauccccaaagcggcccauucugucuguugcugucagcuaugacucaguccccugauuaacuuacgcaccacccauuuuauccccugcagagaugcugcccccacccccuuaggcccgagggaucaggagcuaugggaccagaggcccugucaucuuuacugcugcugcucuugguggcaaguggagaugcugacaugaagggacauuuugauccuggugaggagacugaaucaugggucccugagggccagggcuugggagguagagaguugggggccuugaccuguuacaugccugcuuuuuacucagccaagugccgcuaugcccugggcaugcaggaccggaccaucccagacagugacaucucugcuuccagcuccuggucagauuccacugccgcccgccacagcagguacuuggcacaccuggcacacuuguagcugccccgagaggagcuccugggaccucuacuuccccuccaaccccucugcccaugccagugaaaccccugcaggcugagggggcaaaugaagugggguuuaaauacuggagauggaggcagaccuggggccagauguucucugugccccucuucacccucagguuggagagcagugacggggauggggccuggugccccgcagggucgguguuucccaaggaggaggaguacuugcagguggaucuacaacgacugcaccugguggcucuggugggcacccagggacggcaugccgggggccugggcaaggaguucucccggagcuaccggcugcguuacucccgggauggucgccgcuggaugggcuggaaggaccgcuggggucaggaggugagacuggcaggggcagcacccagaggagguuggcucuccucacuuccagcuguacuuuaaacaccaccuauacgcugacgacucuccaguuuauaucaucuccagacuaagccucucagcugagcuccaaacaauauuguaaaccuggccaccuuuuggauuucuccacuuagaugucuuuuuuuuuuuuucuaauagauggggucuugcuguguugcccaggcuggucuugaacuccugggcucagugauccucccaccuuagccucccaaagugcugggauuacaagcacuguagccagccaccuagaugucuaauaggcaucucaaacguacguuuaacuucccaagcugaauuugauucccauucccagccuaaaccugcuccuccccuggcauucuccagcucaggaagugguaucaccauugccugguugccuaggcuauaaguuaagaugauauccuugauuccuuuuuuucucucaccuccuuccaaagcaucagcagccccgucuguucuaccuccauaguguuccugaguccagucacuccucaccacuccaccucuacugcccuaggccaccugcccgccaucuccagcuuagaugagugcaguagaugccaaacgcgucucccugcuucugcccuuuucugccuggagucaaaucuccaccugggggggcggcauccaguggaccuuagagcauguaaaucagauacgucacaccuagcugacacccccaugcuggcuuuccacucugccagaacaaaagcugagucccuagcuggugcaggaugcucagccugaccuggcuccugccugcaucacuuguuucuuggcgccuccuuggccacgcugccuuucuucuuguugcuggaacaagccagggcucguucccacagcuucuggacauuuucucugugccugcaaagcuccuccccuaaauaaccacaggcucucccucacuccauucaguucucugccaggugucaccuccuuagagagccuuuucuggccacccaccucacugcucuguccauacuuccugccucuuguucuucgcagcuguuuucccugcugggaucucaguccuacaaggguggggagugacguucaccacugagaacgcgccuggcacagagcgggcacucagccaacuucugcugaaugaacagagggaaugggcugaaaugaaggggaagcugaggcaggggugcagggcugugaggauuggggagaaucugggcacaaugggaugauaggcuuggagacaaauggauggagccaggcaaggagaagagggcagcugagccugaagucugaggauggaacaucagagcugcgacagagccagaggucucagcugcagaucuucauuucacccaugccuggcugcgccccacagugcugugugcucggugccaccccucaugggucucuaaguggccacugugggcugggccagggagcagcuggugggugggaaguaagaucugaccuggacuccaucccacccacccccuguuuccuggcccacaggugaucucaggcaaugaggacccugagggaguggugcugaaggaccuugggccccccaugguugcccgacugguucgcuucuacccccgggcugaccgggucaugagcgucugucugcggguagagcucuauggcugccucuggaggggugaguggcucagcuuccugggaaucuguuuccugagcaggggacuggaggguggggaguguggagaaugggcauccaggaucccuucuccugcugggaagcugucacucugaggagggggcuagccagcauugucuccuccaugccaaugagccaguggagagauacaagaagggaccugaaaccugcccaggccugaugcagggaugggggauggagccuuagugccucugacccccauccucucacccugccccagauggacuccugucuuacaccgccccuguggggcagacaauguauuuaucugaggccguguaccucaacgacuccaccuaugacggacauaccgugggcggguaagaaaggccccugcaggauauggaguuuggggugggagggaggacugugugugugugugugugugugugugugugagaguguguguguguaggggggcugguaaguaggguggggagugagauggaagagcugagaagagggauggguuagguggggccucaaaggguagcacuagggugaccacuagcccguaugacacuguaugaaaaaggcaccccuuugcuaacacacauuguuggaaauugcugcaauaaauauacacaucauagauugaaauggugccccuuagagguggugccuuugugcuggaugugaccugcaagguaccuguagugcuggggugggguggagagaggagaagggccagcugcaugagugugaggugggaugggaaugggacuaguggaugggagccaggcuggccaugccacugugccggaggguggcggagcagaaugccuggaugucaagacccucuucccuuccaaccuccucuuccuugguccccucuucuccagacugcaguaugggggucugggccagcuggcagauggugugguggggcuggaugacuuuaggaagagucaggagcugcgggucuggccaggcuaugacuaugugggauggagcaaccacagcuucuccaguggcuauguggagauggaguuugaguuugaccggcugagggccuuccaggcuaugcaggugagugaguccggcucucgaggagggcucugaagccaugcagggugccguuggggugcccccaccacuccuagccuugacccugugcccucuucccuuccccccagguccacuguaacaacaugcacacgcugggagcccgucugccuggcgggguggaaugucgcuuccggcguggcccugccauggccugggagggggagcccaugcgccacaaccuagggggcaaccugggggaccccagagcccgggcugucucagugccccuuggcggccguguggcucgcuuucugcagugccgcuuccucuuugcggggcccugguuacucuucagcgaaaucuccuucaucucugguaagcccuggaguagcccagucuccagucccugaaauugacaacugauuucauuccuaacccugcagugucccuaaaauacucauuccuugcauuauaucuacccaucacccaccgaaacuucucaauuaggggugccccaaauaacuugagccccuuucugccucuuguucucugcguauccaucuuuccuuuguaagccccuugcccgugacuauuauugagccaguaugacaguacugguuguuaaaauauugaaauacuucuguauuaguugagaaauagccucuucucuaagccuccagauaccuguccuccaccuccccacaauccagcaacuauaggguuaacacccaccacagcuggguguuccaggacccugcucccccagcccccacuggucagugguugccuauugagaaucacccaugcuucugcuccuuugcacaacaguccacugccucugccucccuugggucuccuccucauuuaccucccuccuuucuuuuuguuccuucuccccagauguggugaacaauuccucuccggcacugggaggcaccuucccgccagcccccugguggccgccuggcccaccucccaccaacuucagcagcuugggugagcaaucuugggugggcguguggacccucugcacccuucucccugggccucccccucggcuagggugggacccuccuguggugcugacccugcugccuccaccagagcuggagcccagaggccagcagcccguggccaaggccgaggggagcccgaccgccauccucaucggcugccugguggccaucauccugcuccugcugcucaucauugcccucaugcucuggcggcugcacuggcgcaggcuccucagcaaggugggcacagccguggcauguggaguggcggggggaggccaggccccagcacgagccagcguccagugggaccugcagggcacagcccacuagcaucccaagaggagggcuuaguaaagagaccacuuacaccaugucaaagaggguauggggcucacagggagggcugcuccccagcucugggucugcucagcggagaggagcaaauaccacgacccagaggagagagccuguggagagggcaccuugacaggggcaguagacuuugguccugggaugcagcuggcccguaucuaccccucagggagggccugggagaauagaugcccugaccucacuuucugccccaaacuccugcugggcuccucucuggcuaacccaaaccaggccuguuggugcaguguacacuggucagccuuggggcagaagcaggguagagacaggcagagagugggguuggaggggcaaagggaagacgucuggcacaccccaagccacgucuuccggcuggaguccaguggcaguaauguacauuaagguugaugacuggacacgguggcucaugccuguaauccuagcacuuugggaggccgaggcgggaggaucaccugaggucaagaguucgagaccagccugaccaacauggugaaaucccaucucuacuaagaauacaaaauuagccaggcaugguggcugaugccuguaaucccagcuacucaggaggcugaggcaugaaucucuugaaccugggaggcgaagguugcagugagcugagaucaugccauuucacuucagccugggcgacaagagcaaaauuccaucucaaaaaaacaaacaaacaaaaaaaaaacgguugauaguuauggacugggcagaugaggguuagaaucucauugugggacagggaaguuaccuccaugcucuugagcuucacuuucucugccuguaagauggugcugauaguauccacagcuguagggcucuugugagggcugagggagggaacgcagggauggacacagcagagggccaggccgugugugcugagcaacacgggugaugccucccaucccuaugacaaggcugaacggaggguguuggaagaggagcugacgguucaccucucugucccuggggacacuauccucaucaacaaccgcccagguccuagagagccacccccguaccaggagccccggccucgugggaauccgccccacuccgcucccuguguccccaauggcucugguaagaccugccuuguuccagucgcaccucuguccucucugcuguuuucuuauuguaucccuuucccauucucuuuuuuuccugucuuccccaguuuccacuuguuuucuucuuucugugccccugguuacugucuauaucacucuuugucccuaccauguagucucucucaagaguuccccauguauuacccauagucccccguggugcuaucuugucugugucccacagacaucucucuaucuuuguuguacccucucauugugucucccuggccccuuugcuuuguauuagacucaccauguuuguuccuucaucuauccuccaucacccauccuuccauccauagucauacauccuugcauccauccaucaaucuuccaucaucugucuuucuaucuauauucauaaaucuauucauccauccauccacccacccauauccaucauccaucuauccaucuauauucacacauccaucuuuccaucuguuauccauccauccaacaaaacaucuguuuaccauccauccaucuauucauacgucccaucuguccaugcauucauuauccagccagccguccgucacucugcagauccuuguuuuauccugucugucucuuaaugcaaucaucccaucagcccuggucuugcccuauucaaggucucccugucugucuagccuugagucucaucccuuccccguguuuccccuccuccuucucccgacagcguugcugcucuccaauccagccuaccgccuccuucuggccacuuacgcccgucccccucgaggcccgggcccccccacacccgccugggccaaacccaccaacacccaggguaagccccucugccccugggcuccgccaggcuccccauaccucuacuggggcagggaaaagcccucacaccuugcacuuccuccucuccccacuguggccuauucugcucuccugagcucccaaggaggaagcucuugugcccuuagcucaucucugcugcugcuugcucuuuuuuaaggucccccccuugagcugaggaguagaaagcuuacugguccccagcucuucucccuccuccucuuccacgccaucucuucagcucuccagagcuagacaggagguugcugugguggccccagacuauaguaacuccuccuuuauucuccacucucucuagagcugcgaggaggagggcucucaccccgggcgcuugcccuuucccucacauguguccucucucugcagucccagaggugaaggcucaugccccaacccuuuccaucugccccucuucuccucaguguugccuucucauuguggccccuuccccagggcuaagaggggacagcucugcuuccucuccugucuguagacaacuuguguuggggcugugagcagcuguuacccucccuccucucugugugccucugucucugcuuguuguugagcuugguguguuggguugaaaggguugggagggcuuggccccagggggagccaggcugaaagccacgggagagcagcuaagugaaggggagggagcuguggugaacgggacaaggguuuggaagguggagggugccuggaugcugggaccauccugaggcgggagaauuccuggggaggaauucuucuuccagccaagauuuaucucacagucucuugagagacccuagggaggcccuaaaagaguaagacuuuaugacaguuuugcucaaccauauucauugccuugaaaagcucuggaauagcuaacucucgucccaugccagugucuuccugguuugagguuggcgcauggaauacugggaagauacagcauagacccagucucucacucaaccgggagacacagggcccuccgggaggcugagguguggggaacuauagcucuugggcuguuccugaugccucguccugucuucuuuccccucaccccugcagccuacaguggggacuauauggagccugagaagccaggcgccccgcuucugcccccaccuccccagaacagcgucccccauuaugccgaggcugacauuguuacccugcagggcgucaccgggggcaacaccuaugcugugccugcacugcccccaggggcagucggggaugggccccccagaguggauuucccucgaucucgacuccgcuucaaggagaagcuuggcgagggccaguuuggggagguaaggagggugccuacccagugucuggcccuauugugugcucugaugccaugccugcgcaucccccuagccaggaaccuuagucauuuguaaccguguuaauccguuugacccugugaccgccuagcaaacgaacuucuuucuccaggugcaccugugugaggucgacagcccucaagaucugguuagucuugauuucccccuuaaugugcguaagggacacccuuugcugguagcugucaagaucuuacggccagaugccaccaagaaugccaggugaggaccagggauggcaucuggaagaagggaggggaggccgugaagaguggggagccaucuagagagaacaauggcagagcccaacagagggguggcaucucugggaggggauuuacauguacgcuggggguggggacgccuggucugccugagguggggcaggggggugggggcgcgggggaaggugcaggccgcccacucggcauuccucuucagcuucuccuuguucuccaggaaugauuuccugaaagaggugaagaucaugucgaggcucaaggacccaaacaucauucggcugcugggcgugugugugcaggacgacccccucugcaugauuacugacuacauggagaacggcgaccucaaccaguuccucagugcccaccagcuggaggacaaggcagccgagggggccccuggggacgggcaggcugcgcaggggcccaccaucagguaccugcuuacccaggcugggccuugcucagaauucccccaggggaucuccuccucuccccucgcuucagccuggaggaaaagaggggagcgugggggugggaagggagagagguuccaggagggccugggauaaggaaugugugacaaguuaacccaggaacauggacagaaaggcuggaggugacuaugcaagaguggugaagggacuugggcccugccaugacgucccuucugcuuucucucacccucacuccccucugaguccagauuggggagcacaauaaaagaagagcccccuaguguuggccaggccugggagauugagagggaagugacccuuggccucacgugggcauuccaccuccacauggggagccagagugaccgggcccggggagugggcucucucuccucuccuggaugggaaucugcgaagcugcccccagugaccuucugucgguucccuucucagcuacccaaugcugcugcauguggcagcccagaucgccuccggcaugcgcuaucuggccacacucaacuuuguacaucgggaccuggccacgcggaacugccuaguuggggaaaauuucaccaucaaaaucgcagacuuuggcaugagccggaaccucuaugcuggggacuauuaccgugugcagggccgggcagugcugcccauccgcuggauggccugggagugcauccucauggugagcagcccgaggacagccagguuggagcagggcaggugggagaacacuggccgccacucacagcccuggucuccaucagucacacacuuucucuggguugcauuuuacagaaucucaucuauaauaugagguucuccuagcccaagggacuggggaaagcaggagcugcagugugaugggcaagaauccaggagccaagaguggguacuggggauggagacaggguggcagagagcucaagagaugagguugggcgaggaagcuggagauagaagggguuggguagggagaccgaaggucaggaccagaaaguggggguggauggagaggaaggaggagcagaaggaagaggugggccagggcccuggagagaggaccagagcauggagaggaaaggcagagcccaagggagaggaguuggaaaagguggccagcggaggagaguggagagccuggcgucaggagggaucaggccugaguggagcccagaguggaucuggggcuuccaauaggaagggaggagggucuacguugccugaugucccugucuguuuuugcugccuucucugcaucccaggggaaguucacgacugcgagugacgugugggccuuuggugugacccugugggaggugcugaugcucuguagggcccagcccuuugggcagcucaccgacgagcaggucaucgagaacgcgggggaguucuuccgggaccagggccggcaggucagaguggaggagagggaagauggguccgaggcgggggacagaaggggcagaguugucaucuuggagacuaaagaauauuuguucccugacucucauccacacugccacaaugcagguguaccugucccggccgccugccugcccgcagggccuauaugagcugaugcuucggugcuggagccgggagucugagcagcgaccacccuuuucccagcugcaucgguuccuggcagaggaugcacucaacacggugugaaucacacauccagcugccccucccucagggagcgauccaggggaagccagugacacuaaaacaagaggacacaauggcaccucugcccuuccccucccgacagcccaucaccucuaauagaggcagugagacugcaggugggcugggcccacccagggagcugaugccccuucuccccuuccuggacacacucucauguccccuuccuguucuuccuuccuagaagccccugucgcccacccagcugguccuguggaugggauccucuccacccuccucuagccaucccuuggggaaggguggggagaaauauaggauagacacuggacauggcccauuggagcaccugggccccacuggacaacacugauuccuggagagguggcugcgcccccagcuucucucucccugucacacacuggaccccacuggcugagaaucugggggugaggaggacaagaaggagaggaaaauguuuccuugugccugcuccuguacuuguccucagcuugggcuucuuccuccuccaucaccugaaacacuggaccuggggguagccccgccccagcccucagucacccccacuucccacuugcagucuuguagcuagaacuucucuaagccuauacguuucuguggaguaaauauugggauuggggggaaagagggagcaacggcccauagccuugggguuggacaucucuaguguagcugccacauugauuuuucuauaaucacuugggguuuguacauuuuuggggggagagacacagauuuuuacacuaauauauggaccuagcuugaggcaauuuuaauccccugcacuaggcagguaauaauaaagguugaguuuuccacaa

SEQ ID NO: 18309 - RNA, 8805 nt, Homo sapiens
caguucuaggcacugaaaauagagcaguacacaagauagauaaaguccuacucugguggaguuauaaucuggugggaaagaaaccaagaccaaaggaggagccacaacacugggguccuaagaagccggcuuuggcagaaggacaggaaugcugggcccuuucccagcucccggcucagcucauagcagccuccaggguagcuggguugaguugggcugggucaggcugagcugcaucccaggguagggucaucgugccacuuuugugaccuugccuuggugcucccggaacucuugccaugguuuugcgucaggggaacugccagggccugauuuugggccuccuagagccuagaugaauaucuuuaggggucauuuguuaacuugcugccuagaacucaccaccccacucuacccccaugccucuggagaauuguuccagcuaaaauguaggugggaggggauguuuaaaaucaccuguuccuugucaguauaguggugaguaaaaacaaauuuuuuuuuuugcugggugugguggcucacgcccguaaucccagcacuuugggaggccgagggggcggaucacgugaggucaggaguuuuccagaccagccuggccaacauggugaaaccuuaucucuaccaaaaauacaaaaauuagccgggcaugguggcaugcgcuacucgggaggcugaagcaggagaaucgccugaacccgggaggcagagguugcagugagccgagauugugccacugcacuccagccuggacgacagaguaagacuuucuuuuuuuuuaagacggaguuucacucucgucgcccaggcuggagugcaguggugcaaucucagcucacugcaaccucugccucccugguucaggcaauucuccugcuucagccucccgaguagcugggauuacaggcacacgccaccacgcccagcuaauuuuuguauuuuugguagagacgggguuuugccauguuggccaggcuggucucgaacuccugaccucgugauccacccaccucaaccucccaaagugcugggauuaugggcgugagccaccacgcccagccaaacuaaauuuuuuaaauaaauaaaggccagacuuuguggcucacgccuguaaucccaacacuuugggagguugaggcgggaggaucgcuugagcccagaauuuugagaccugccugggcaacauggcaagacccugucucuaccaaaauaaauaaaaauuagcugggcaugguggcacguuccuggagucccagcuacucaagaggcugaggugggaggaucacuugagcccaggagguugagguugcagugagccauguuuaugccacugcacuccagccugggugagagagugagaucuugucucaaaaaauaaauaaauacauacauaaaaaaauaaaaucacucacauuaguugaacaggaacuaggaaugcagaagucuuugcuucucuggaaaauaaagagccacaaaaccugccugauauggagagggagggagggcagaguaaaaagagaaagaacuuguaucuccuggugauguuagcaguuagagguuauuuucucauuccaguucccuacuccuggguuggcucacugcugcccaucccuguuccaaagcagucccucuucucauaauuauaauaaugccccugcuccaugcaagaagcaccuacuaugugcccagaaggaguaaauuuauauucuuaaccuuugcaguuaccuagaggucaauuugcccauuuaucaauugaggaaacagauuuucagcaacauuaaguaacuggcccaauauugccuaguuaauaaguagcagagcuggcacuuaaacccaauuucgucuaacaccacuagauuacaauauguucuuuuugcuauuccguguuuccuuucuaucucaaacccaucucaagucaccaaguaguuauugaggaucuacugaauaccaggugcagcuaaaaagcuuucacuuugucauucccuacccccaggacccuggugcagucccuucacccugcuuuccuuucucagaugcucccauuuccaaaucucugccucccuuuccccugcccauucugccuccgccagugcccauucuugccgucccccguucugggccuguggucagcagugcagcaguacccaggugaggcagcaggccugacucacuccuaugucagggauuguaaagggcgcgggccagggcuuugcugucgcugucgucacugcacaauuguuccugauucagcggcggaucaccugagccacaccugagugcccccaaccuccucuuugaagagcaaacaugggggccucuaaaggaacauggcuagauaaacagaccucucugcagaugagguuuagcuccucggaggagacagauuuaagaauauuuauuaaguuccuacuaggugacagccaaguacuggagauacuacagagaucuaaugagaaaaaggucagauguggcccuguacacucguggagauuauauuccaguaggcgggacaaacaacagcaaaaagcaaauacauaaaaugauuccccaacgugauaugugucaugaagaaaaacaaggggcugagaaggaggcuagcaguggugauggaucaaggcaaaggucaaacgagggaaaugaaggaacauggugaucugggggaagaugggaaggaaaugaggaggagagcuggaaauggaggaggcuaagggccuguuucuccaguaucagggcagugggagccaguccaguugcucgucucagccccuggcacuuucuggccuuaacucauuccccagccugcacucccccacccccuuauuggcuuaaugauucacccccaacauuucccuagcuuccuguguggcaggaaggagcaggagcagagcccuagggcucugaggguagcaggaauggggaugggauugguugggaauggugagcaguccggguucucaggucuucucuuugucccauucuggucuugccacaaagaaaggucucucugugccgggaggacagcgaggauaacuagacccagcuggaggcccagauuccagaugugggagguaguggcaaaacaagauccuggcauccccuucauuuccccuccucugccuaaugcccuagagaaauuuuccaucauaaacaaguaaugcauuccuaaccuuuggugcuucucucucucucccacccacuaguuuucuuccaucaucacuaucucccccuacucccaauuuauguuuaugugagugugagggucuguccacauguguaaguagucauggguuuauguuggucauuguguagcgugcgaguugccuuggaauaaggauguuggggguggugggcucccugugcuuggguguaaauguaagaaugauggcaggugugaagacaggcgugggaaagcaaugcgccuuuguuuacagaggagguguguuuuaugccagccaggaagaaguguguaauguggaagggaucuuguguauuuagauaagaguagugaguauaaaauaaagugacuuguaggcccaggaauuguacacagagcaguaguguauuucuagccgguuguggccuguccucuuauuuguguuccuacauguucuugauugaaaaauccuuuuaaguguuuccuaagugggaggggagaaaaguguuuccuguuuggugucuguguaagaauugucccagcuuuucuaaagauguuguacauuuguaugagugguuuggaggaguguagccacaucucagaagcuuggugugacccagccaaggugggaauacuacaugcacacuuacaguuguacauuucaccuggcauuuaacaagauuauugagcaacugcugccuacaagguaccaugcuggguucucuggaggacacaaagauguguaugacacagccuccaguggaagagaucauauauguauucacuuugugcaccaggcuuaaaaugaugguagaaagaucugagccagauguauuucaaaucucuggagucaucucagaucuuuucauccucuugcugucggcaacucucccucucccaugcucccuuccccuaaugauauccaucucauugcccaauucugauuaucuuaugcuaggaaugucucuuagggccaccuucucaggcucuuguuaucaucuaccugagccccuccaauagccuccugucuacugccuuagucucuacccguccagagcaucacuccucaucccaaucaguuuccugcuugaauuuuccucccuuuaucucauccagcaacccacaagcucuacagucuagagugaaacccaggcuccugaccuggcagcucugcucuccccacucugcccaauuccacuccuuuccagccauuauuacuucccacuacuccguuacaggaaacuuacucugagauuguuuuucuugugauuccccaaacacauccuguacuuuuccagcucaaggucuuugcuaauuccauucuuacagucauccuccacaucugaauuugucauaucccacccacuguucaaggucaccuucagugccacucuuccaugaagccuccccugauugauuggacagaugugaacacuagcucuuuugggucccccccuuaacacuuagucuucaguuuucuuagguuuuuuuguuuuuguuuuuguuuuuuguuuuguucuuguuuuuuugagacagggucucacucugucacccaggcuggagugcaguggcacgcucucagcuugcugcaaccucugccuccugaguucaagcgauucuccugccucagccucccgaguagcugggauuacagacaugcgccaccaugcuuggcuaauuuuuguauuuuuaguagaaacaggguuucaccauguugaccaggcuggucucgaacuccugaccucaaaugauccacccgccucggccugccaaaguguugggauuacaggugugaaccaccgugccuggccuuucuuaggaucuucaagaaagcuugccuuuccuucaggcagaaacucaauauaacaaaaaaagagagagagagagagcaacagagacagacagauagagagcucuccuggccaugguucccuccucaugccggaggguaaggcccucauggcuggaguaucagcuuuaucuggcuuuccucaggcagcugcauggcacagcacuuauacugaaacuagccucaggacucucaacaguaguacccucaacagagggcgccugaaacaggugaaugcucaaaagauguuaaauucugcacgguggcugccagcacuuugggaggccgaggcaggcagauugguugagcucaggaguucaagaccagccugggcaacauggcaaaacccuggcucuacaaaaaauuuuauauauauauauauauauauauauauauauauauauauauauauauauauauuagccaggcaugguggugcucaccuguggucccagcuacucaggaggcugagguaggaguauggcuugagccaagaggcagagguugcagucagccgagaucaugccacugcacuucaaccugggcgacaaagccagauccugucucaaaacaaaaaaaaaaaguuaaauucuguguccaugagcagcugucuguaaggaaguuauggaaaugugaaucugcuuuaaguugaguaauuaccauuacuguaacauuuguauaaugucucacaauuuagaauguuugucccauaaauuugguuguuugacuuacagcaaggggcaaaucuggguggcugcuaaccuauugccuuuguauuuguggcccucugcaccagccuuuaugugaauauuucugcacgcuccuaagagaguaguuuugcugaacugucccuauacagucuuugcaccuuuacuguguacauguguguugguagguguacgugguauguuuuccuuuuuuuccaggauugcauucuuuuuauggcugaauaauauuuaauuguguauuguuguuguuguuguuguuauuuuauagugacaaggucucacuauguugcccaggcuccugagcucaagugauccucccaccuuagccccccaaaaugcuaggauuacaggcaagagccaccaugccccaccauuguguauuacuuuuuuaaucuuucuauccuucccucccuccccaacuuuuauuuuaaauucugggguauaugugcagguuuguuaccuagguauacugcaugaugcugagguuugggguaugaaugauccugucacccagguacugagcauaguacccaauaguuaguguuucaaccuuugccuuacucccuccguccuucuucuacuggucucaaguugcuauuguugccaucuuuauguccaugaguucccaauguuugguucccacuuauaagugagaaugugugguauuugguuuucuguuccugaguuaauccgcuuaggauaauggccaccagccgcauccauguugcugcaaagcacauaauuuuguucuuuuguauggcuacgcggugugugucuucaugugugcucaggcaggcagguuugugucugugugugcuaguguguucauuucucccuuaaucuugacuauuucuguaacaauuuccuucuuggggaguuuauauucuaaggauaccuacaagugcaugaaugcgugcauauaacugggucaguauugcagcaggauggccugaucuccaauaaaaagcccucuuggcagggcacgguggcucacgccuguaaucccagcacuuugggaggccgaggcgggcaaaccaaauaccauacauucucacuuauaagugggaaccaaacauugggaacucguggacguaaagauggcaacaauagcaacuugagacuacuagaagaaggacggagggagcgaggcagaucacgaggucaggaaaucgagaccacccuggccaacagggugaaaccccgucucuacuaaaaauacaaaaauuagcugggcgugguggcgcgugccuguauucccagcuacucaggaagcugaggcaggaaaaucgcuugaaccagggagucagggguugcagugagccgagaucgcgccucugcauuccagccuggcgaccgaacgagacugcuccaucuccaaaaaaaaaaaaaaaaaaaggccugugagggauccuguggcuaaagugagccccucuccaggugccacaugccucgacaugugccugcagcccgggaucucacccacccccacucacgacucacacacucacaacgugcaguugggcgccuaggauugugcaugucaagucuccacccacucccuuuguuuaaucgucggaauuuccagcccgcugcugccaaccgcuccccagcugcgggaggaggaguuagaaggacccgcccaauuuucaggagcacauaaauuaccucugccggcagccgacccucacuuggccuuacacuccgcucggcucaccaugugucacucucgcagcugccacccgaccaugaccauccugcaggccccgaccccggcccccuccaccaucccgggaccccggcggggcuccgguccugagaucuucaccuucgacccucucccggagcccgcagcggccccugccgggcgccccagcgccucucgcgggcaccgaaagcgcagccgcaggguucucuacccucgaguggugaguaucgccgaagugggcauucgcggggugcgcugcccuggagucacuggggaacgacccgacuccagaggccucgaccugaccugucuccuguuuugucuccccuuagguccggcgccagcugccagucgaggaaccgaacccagccaaaaggcuucucuuucugcugcucaccaucgucuucugccagauccugauggcugaagagggugugccggcgccccugccuccagaggacgccccuaacgccgcaucccuggcgcccaccccuguguccgccguccucgagcccuuuaaucugacuucggagcccucggacuacgcucuggaccucagcacuuuccuccagcaacacccggccgccuucuaacugugacuccccgcacuccccaaaaagaauccgaaaaaccacaaagaaacaccaggcguaccuggugcgcgagagcguauccccaacugggacuuccgaggcaacuugaacucagaacacuacagcggagacgccacccggugcuugaggcgggaccgaggcgcacagagaccgaggcgcauagagaccgaggcacagcccagcuggggcuaggcccggugggaaggagagcgucguuaauuuauuucuuauugcuccuaauuaauauuuauauguauuuauguacguccuccuaggugauggagauguguacguaauauuuauuuuaacuuaugcaagggugugagauguucccccugcuguaaaugcaggucucuugguauuuauugagcuuugugggacugguggaagcaggacaccuggaacugcggcaaaguaggagaagaaauggggaggacucgggugggggaggacgucccggcugggaugaagucugguggugggucguaaguuuaggaggugacugcauccuccagcaucucaacuccgucugucuacugugugagacuucggcggaccauuaggaaugagauccgugagauccuuccaucuucuugaagucgccuuuaggguggcugcgagguagaggguuggggguuggugggcugucacggagcgacugucgagaucgccuaguauguucugugaacacaaauaaaauugauuuacugucugcagucuugaguguaucuuugcaa

SEQ ID NO: 18310 - RNA, 5152 nt, Homo sapiens
agcuuuuuucaauucccauuuauuuuuggcucuuggggcgaugucaucuuuucaauaugaaaaaaagcagcaaguucaacauaaaauagaaaucucaaauguaggauagaacaaaaccaagugugugaggggggaagcaacagcaaaaggaagaaaugagauguugcaaaaaagauggaggaggguuccccucuccucuggggacugacucaaacacugauguggcaguauacaccacuccagagucagggguguucauucuuuuuugggaguaagaaaagguggggauuaagaagacguuucuggaggcuuagggaccaaggcuggucucuuuccccccucccaacccccuugaucccuuucucugaucaggggaaaggagcugagugagggagguagaguuggaaagggaaggauuccacuugacagagugggacagacuccuccagaguagagcuuggagggagauugaaaguggagauaauacugcugacaccucccuugaagcugagaugggaaauggacauacuuagaaauuuagugacuuuaauagccuggauuucccucuccaaaacuuuuagaauggaaaaucccauccccuuccuuauauagugacuucuacccacuaccuucuaccauuuucuacuuugggcuuaggaugauggccauuaucuacauguguuuucagcaccugguugguucuaaaugggaucuggagacccagcuucuuggagauuuuuaagaggaaguauuaacuggacaaauggaaugggcaccagaaagaaauacagggucacccagaauggcagaaaccuagguuucccagaguggaaagagagaggagacauucaacaaacaaguauuuauugagcgccuacuaugugccaggcacuguucuagaccccccccagaagaaaaaacaaaaaacaagauagaggcagcaaacacaaauucugagggagaggaaaggggcaguugaguaagacggcuaagggaacugagaagccugaggugaugggggcucugccuuaggccuccucuucggccuccucaccgaaauccuccuccucuucugcgguggcauccugguacugcugauacucagagacgaggucguucauguugcucucagccucggugaacuccaucucguccaugcccucgccuguguaccaguggaggaaggccuuccggcggaacauggcagugaacugcuccgagaugcgcuugaagagcuccuggauggcugugcuauugccaaugaaggugacugccaucuugaggccacgaggugggaugucacagacggcugucuugacauuguuggggauccauuccacaaaguagcugcuguucuuguucugcacguuaagcaucugcucaucgaccuccuucauggacauccgaccacggaagacagcagccacggugagguaucggccguggcgggggucacaggcagccaucauguucuuggcaucgaagaccugcugggugaguuccggcacugugagagcucgauacugcuggcuuccacggcuggugagaggggcaaagccaggcauaaagaaauggagacgugggaaggggaccauguugacugccaacuugcggaggucagcauugagcuggccagggaaacggaggcagguggugacaccacucaugguggcugagacaaggugguucagauccccguagguugguguggucagcuucagagugcggaagcagauaucauagagggccucguugucaaugcaauaggucucaucaguauucucuaccaacugauggacggagaggguggcauuguagggcucgaccacggugucagacacuuugggugaaggcaccacacugaagguauucaugaugcgaucaggguauucuucucggaucuugcugauaaggagagugcccauuccagagccugugcccccgcccagugagugggucagcuggaagcccugcaggcagucacagcucucugccuccuuccguaccacauccaggacagaaucaaccagcucggcgcccucuguguaguggccuuuggcccaguuguuaccugccccagacugaccuggaaugcagucaggagaaaagcucaauuaacaggguauggaagauacaugauguuuccaucuuucaacuuuucaaauaauucccucggauguaucuucuuucuccuucacugugauauauucucccccuacugccccauaauuuaccagcaauaguaggcacuaccucuacccuccguuagauuucagaacacauuucuguauuagcacuccaauacaacaaucaucuccuaacuuuugcuguguccuugcacccaaauaaguugaacacgaugguauaucaucugcuaauaucaucuguauaacucaccaaauacaaaguugucuggucuaaagaucuggccaaaaggaccugagcgaacagaguccauggucccagguucuagauccaccaggauggcacgaggaacauauuugccaccuacagagaauaaaguuaagagcugugaaaucuggcagaagggaagguuuauagauauacuggaaaugggagacagcagggaucagagacuugucauuccaggucccgccaccagguggcagcagacgucuuuggccccgacggugguucacgaaagggacaaaaugacagauucacccaaaggggauaaggcgugcccagaaauggaaagagaucccagauaagugggagacagggaagggaaccugagcugcccgggcuccugcccuuaccuguggcuucauuguaguacacagagaugcgguccagcugcaggucgcuguccccgugguaggugccgguggggucgaugccauguucaucacugaucaccucccagaacugccgagggggagcaacgagaccacaacaggucaagucccagccaacuauguccccaacuaccauuuuauuucaucuuuuucuuaauuuuuuuugagacggagucucgcucugucaccaggcuggagugcaguggcgcuaucucggcucacugcaaccucugcuucccggguucaagcgauucuccugccucagcccccggaguagcugggacuauaggcgcgcaccaacacgcccagcuacuuuuuguauuuuuaguagagacggguuucaccauguuggccaggauggucuagaucucuugaccucgugauccgcccaccuuggccucccaaagugcugggauuacaagggugagccaccgcgcccagcuucuucuaauuuuuaagacagggucuuccuguugcccagccugcagugcaguggugcaaucacggaugacuacagcguggaacucccaggcucaaccgauccucccaucucagccucucgaguagcugggaccacagacgcgcgccaccacgcccagcuaauuuuuuacuuuuauuuuuuguagaaacguggcaugggggagggucucgcuuuguugcccaggauggucucgaaccccugaccuggagggaucccaauucgcccaccucggccccacaucucccauuuuaauuccacaagcgcucaggccguuguucuagggcauggcaucccgugggccugccacacccuuccccuagacacucgcucccccgagaaagccacagcuuucccugcucuggauaugugcagcgggucccaagugcucggugggcggauggaggucgaccacacuucgauaagcgccgcucuccuucccccaagcugggcaccgccccaccgcgcggcgcacaaaaggcugggggucugaggaaagagcugccgccgcagucgaccaccccccccgcccuccacgugacugcggcgcacgcgcaggucgagccgccgacaaaagacuucgcgcgugggcggggccagggacaaaaauuccgcgcgcgaggggcggggcccaagguagcgcgccccugccggcgggcaacgccgcauuguccccgcgcgcccacggcgccccggccccgccccgcagggccccgcccuucugcuacaacguagcagccgcacuuccucccgccccucccccgcuacacuguaaccgcgcgcaaaaaaaaaaaaucccccuuggccucggaauuuuuauuccuucgcuacauuucuaccccuugauuuaaaggauucuuucucucccauuaaguccugagggacucauuaaagaaaaccacacacccccauuuucucgacauaucuguucacgcccuaaaaaagucucucuuaggggccaugaaagcaaguaaaauuaaucccguucuuauucuccuuccacccaggaacaaauacaggaccggcccucuggggucgcgggcgcguuggggucccuggucuuuugugaaagguagcgcccagcgcagcccacccuggcgcaucgccccccacccuugcgcuggagcucucugcagccgcccgauggccucaccccuucccgcuccgguuuggcccuaaguaccccgcagggggguugggcgggaugcacaugggcaaaaccucgccccgcuuugucugcgaccguuuccgcaucucucucccugcccgguucucggaccguuagaagcccuuuuaaguaacaucuuauaaguccucggucuucccgcccccaaacccgaagagcccuuuuacuaguuucuccaaaaugugccugccaagaaaaaugauucccagcuuuccaaaggcaaaugcuagcuacaauuguuauauauauaaauguaacaaacuugagaggggcaaaucuugauuaaggauagcgggugcaaaugccccacaaccauuuuuucauaacuuaccuggauuuuuccuuguaaaaagaaauaaaagagguguaaaauucuuaccuuggcaccgaucugguugccacacugaccagccuggaugugcacgauuucccucaugguuaaaauuuaauuuuuuugcucgccucaagguauguauggggcaagaaaauaaguaauuuuuuuucuccgcaggucgcaggcuggaagguuggaaugcgccccagaggcuggagcagcgaggugcaaacgcgacggcaggaagguucugagagggagaaaggagaggggagggcgcggagggaaagcaggcugggcggggcgcgcgugcgccggggcugggaggcgggaga

SEQ ID NO: 18311 - RNA, 2572 nt, Homo sapiens
uguucuuggcaucgaagaccugcugggugaguuccggcacugugagagcucgauacugcuggcuuccacggcuggugagaggggcaaagccaggcauaaagaaauggagacgugggaaggggaccauguugacugccaacuugcggaggucagcauugagcuggccagggaaacggaggcagguggugacaccacucaugguggcugagacaaggugguucagauccccguagguugguguggucagcuucagagugcggaagcagauaucauagagggccucguugucaaugcaauaggucucaucaguauucucuaccaacugauggacggagaggguggcauuguagggcucgaccacggugucagacacuuugggugaaggcaccacacugaagguauucaugaugcgaucaggguauucuucucggaucuugcugauaaggagagugcccauuccagagccugugcccccgcccagugagugggucagcuggaagcccugcaggcagucacagcucucugccuccuuccguaccacauccaggacagaaucaaccagcucggcgcccucuguguaguggccuuuggcccaguuguuaccugccccagacugaccuggaaugcagucaggagaaaagcucaauuaacaggguauggaagauacaugauguuuccaucuuucaacuuuucaaauaauucccucggauguaucuucuuucuccuucacugugauauauucucccccuacugccccauaauuuaccagcaauaguaggcacuaccucuacccuccguuagauuucagaacacauuucuguauuagcacuccaauacaacaaucaucuccuaacuuuugcuguguccuugcacccaaauaaguugaacacgaugguauaucaucugcuaauaucaucuguauaacucaccaaauacaaaguugucuggucuaaagaucuggccaaaaggaccugagcgaacagaguccauggucccagguucuagauccaccaggauggcacgaggaacauauuugccaccuacagagaauaaaguuaagagcugugaaaucuggcagaagggaagguuuauagauauacuggaaaugggagacagcagggaucagagacuugucauuccaggucccgccaccagguggcagcagacgucuuuggccccgacggugguucacgaaagggacaaaaugacagauucacccaaaggggauaaggcgugcccagaaauggaaagagaucccagauaagugggagacagggaagggaaccugagcugcccgggcuccugcccuuaccuguggcuucauuguaguacacagagaugcgguccagcugcaggucgcuguccccgugguaggugccgguggggucgaugccauguucaucacugaucaccucccagaacugccgagggggagcaacgagaccacaacaggucaagucccagccaacuauguccccaacuaccauuuuauuucaucuuuuucuuaauuuuuuuugagacggagucucgcucugucaccaggcuggagugcaguggcgcuaucucggcucacugcaaccucugcuucccggguucaagcgauucuccugccucagcccccggaguagcugggacuauaggcgcgcaccaacacgcccagcuacuuuuuguauuuuuaguagagacggguuucaccauguuggccaggauggucuagaucucuugaccucgugauccgcccaccuuggccucccaaagugcugggauuacaagggugagccaccgcgcccagcuucuucuaauuuuuaagacagggucuuccuguugcccagccugcagugcaguggugcaaucacggaugacuacagcguggaacucccaggcucaaccgauccucccaucucagccucucgaguagcugggaccacagacgcgcgccaccacgcccagcuaauuuuuuacuuuuauuuuuuguagaaacguggcaugggggagggucucgcuuuguugcccaggauggucucgaaccccugaccuggagggaucccaauucgcccaccucggccccacaucucccauuuuaauuccacaagcgcucaggccguuguucuagggcauggcaucccgugggccugccacacccuuccccuagacacucgcucccccgagaaagccacagcuuucccugcucuggauaugugcagcgggucccaagugcucggugggcggauggaggucgaccacacuucgauaagcgccgcucuccuucccccaagcugggcaccgccccaccgcgcggcgcacaaaaggcugggggucugaggaaagagcugccgccgcagucgaccaccccccccgcccuccacgugacugcggcgcacgcgcaggucgagccgccgacaaaagacuucgcgcgugggcggggccagggacaaaaauuccgcgcgcgaggggcggggcccaagguagcgcgccccugccggcgggcaacgccgcauuguccccgcgcgcccacggcgccccggccccgccccgcagggccccgcccuucugcuacaacguagcagccgca

SEQ ID NO: 18312 - RNA, 2572 nt, Homo sapiens
ugcggcugcuacguuguagcagaagggcggggcccugcggggcggggccggggcgccgugggcgcgcggggacaaugcggcguugcccgccggcaggggcgcgcuaccuugggccccgccccucgcgcgcggaauuuuugucccuggccccgcccacgcgcgaagucuuuugucggcggcucgaccugcgcgugcgccgcagucacguggagggcgggggggguggucgacugcggcggcagcucuuuccucagacccccagccuuuugugcgccgcgcgguggggcggugcccagcuugggggaaggagagcggcgcuuaucgaaguguggucgaccuccauccgcccaccgagcacuugggacccgcugcacauauccagagcagggaaagcuguggcuuucucgggggagcgagugucuaggggaaggguguggcaggcccacgggaugccaugcccuagaacaacggccugagcgcuuguggaauuaaaaugggagauguggggccgaggugggcgaauugggaucccuccaggucagggguucgagaccauccugggcaacaaagcgagacccucccccaugccacguuucuacaaaaaauaaaaguaaaaaauuagcugggcgugguggcgcgcgucuguggucccagcuacucgagaggcugagaugggaggaucgguugagccugggaguuccacgcuguagucauccgugauugcaccacugcacugcaggcugggcaacaggaagacccugucuuaaaaauuagaagaagcugggcgcgguggcucacccuuguaaucccagcacuuugggaggccaaggugggcggaucacgaggucaagagaucuagaccauccuggccaacauggugaaacccgucucuacuaaaaauacaaaaaguagcugggcguguuggugcgcgccuauagucccagcuacuccgggggcugaggcaggagaaucgcuugaacccgggaagcagagguugcagugagccgagauagcgccacugcacuccagccuggugacagagcgagacuccgucucaaaaaaaauuaagaaaaagaugaaauaaaaugguaguuggggacauaguuggcugggacuugaccuguuguggucucguugcucccccucggcaguucugggaggugaucagugaugaacauggcaucgaccccaccggcaccuaccacggggacagcgaccugcagcuggaccgcaucucuguguacuacaaugaagccacagguaagggcaggagcccgggcagcucagguucccuucccugucucccacuuaucugggaucucuuuccauuucugggcacgccuuauccccuuugggugaaucugucauuuugucccuuucgugaaccaccgucggggccaaagacgucugcugccaccugguggcgggaccuggaaugacaagucucugaucccugcugucucccauuuccaguauaucuauaaaccuucccuucugccagauuucacagcucuuaacuuuauucucuguagguggcaaauauguuccucgugccauccugguggaucuagaaccugggaccauggacucuguucgcucagguccuuuuggccagaucuuuagaccagacaacuuuguauuuggugaguuauacagaugauauuagcagaugauauaccaucguguucaacuuauuugggugcaaggacacagcaaaaguuaggagaugauuguuguauuggagugcuaauacagaaauguguucugaaaucuaacggaggguagagguagugccuacuauugcugguaaauuauggggcaguagggggagaauauaucacagugaaggagaaagaagauacauccgagggaauuauuugaaaaguugaaagauggaaacaucauguaucuuccauacccuguuaauugagcuuuucuccugacugcauuccaggucagucuggggcagguaacaacugggccaaaggccacuacacagagggcgccgagcugguugauucuguccuggaugugguacggaaggaggcagagagcugugacugccugcagggcuuccagcugacccacucacugggcgggggcacaggcucuggaaugggcacucuccuuaucagcaagauccgagaagaauacccugaucgcaucaugaauaccuucaguguggugccuucacccaaagugucugacaccguggucgagcccuacaaugccacccucuccguccaucaguugguagagaauacugaugagaccuauugcauugacaacgaggcccucuaugauaucugcuuccgcacucugaagcugaccacaccaaccuacggggaucugaaccaccuugucucagccaccaugaguggugucaccaccugccuccguuucccuggccagcucaaugcugaccuccgcaaguuggcagucaacaugguccccuucccacgucuccauuucuuuaugccuggcuuugccccucucaccagccguggaagccagcaguaucgagcucucacagugccggaacucacccagcaggucuucgaugccaagaaca

SEQ ID NO: 18313 - RNA, 4905 nt, Homo sapiens
uuuucauuuuagaugggaaaacuagacgagcugagauucaacccacgugagcggcugcagagccgcuacccuuaacagcucucucucgggauucuaacauucccuucugugacggagagacagcaggccgggacacgcaucccaggacggauccacagcuggauggggaaggcugcgccaggcgggccggaagccuggcgguggcgugcaggagccccgcccuccugggcuggauucagccgggggcggggccgcgggcggggccuguggcagcgggaaucccgaccccgccccuuuccccaccccuccauuucucgccauggccccugcacugcuccugaucccugcugcccucgccucuuucauccuggccuuuggcaccggaguggaguucgugcgcuuuaccucccuucggccacuucuuggagggaucccggagucuggugguccgggugagcgggagggaucgaggaugaacugggaggaggaagguggagccguaggagagggauugagggcggggcuuggaaacaaaugacaggggaaguccaagagagggaacucgaaccuugaaagcggccgagaagcuacaggggagggagaccugaguucuaaauuaggaacucaaggauuagaguuuuggagaggcgggagagugaggacugagggagccgaaaagggcggugaccggaguauucuaaguaaaguguuuuguagagaggacuguugagaggagaguguuaaaaagaaggagcauuuggagaaccgaaguaagaggggcaauccagcguggccucuccagccaugcuuuuugcaacugccuaacaugugguguucuauaaauccucuuccccagguuugcaggaggccuagggaagagggcagaaacuagggauggaaaagugagaugggcacagccuagagaggaagcauuaaggcucuugaaagcaguaagggacauggccuggggauccaagaggagaugagggugggggaaacauucugccacuguuucgaucuuuugucucuuuuucccucaacuuccuguagaugcccgccagggauggcuggcugcccugcaggaccgcagcauccuugccccccuggcaugggaucuggggcuccugcuucuauuuguugggcagcacagccucauggcagcugaaagagugaaggcauggacaucccgguacuuugggguccuucagaggucacuguauguggccugcacugcccuggccuugcagguaugaggcccuggccuugcagguaugaaauccuggcaguugaguccccaagggagaccaagugugggaggggugccguggauuggaggggcaaaauauggguucaggaggagaauugaggaacuaaucucagcuuccauuccuccacagcacauauccuacuuuuuaucaagaaggguguacuuguccuucccuaagcacaagauaugcuucucaccucugcaacuuuguuuauguccugcuugagaucccuucucuucaguccuacccuuucuucaaaaccacuucccuaggucugaagagaaggccuugucugucuuuucacugggugguuggcacaggcuacuacuuugcguagcuaucaggucaccccaucuauucuauaaguucucaggguagagacaggccauccuuacaucuuugggaccucacccagcacgcacccuccacauggugaauauuugguggugaugcuuaggagagaggugggggagaguugcaggcuagccuguggugggggcagaucugggucugggucucccaaggucgggcagacuaggccacugggauacccagccccuuauccuuccacagcuggugaugcgguacugggagcccauacccaaaggcccuguguugugggaggcucgggcugagccaugggccaccugggugccgcuccucugcuuugugcuccaugucaucuccuggcuccucaucuuuagcauccuucucgucuuugacuaugcugagcucaugggccucaaacaggugaggcuccgagaucccuaccuaugaccucugacccauuuuagaacuccucguucccuuucaaggguuucccuccucccaugcucuucuacugucucccugcuucucccucguggcccuucccuuugacuuucccucguaagggcagcaagcaugggccuccugggccuggggaagguacauggaucagaagucaggaucagggauccaagucucagaagggggguuccugggccugaguucuagaaggguggugccuggaagaggaggaaagaagugcccaagaugagaaaagggcuugacuccauuucuaagcucuucucccucucuuagguauacuaccaugugcuggggcugggcgagccucuggcccugaagucuccccgggcucucagacucuucucccaccugcgccacccaguguguguggagcugcugacagugcuguggguggugccuacccugggcacggaccgucuccuccuugcuuuccuccuuacccucuaccugggccuggcucacgggcuugaucagcaagaccuccgcuaccuccgggcccagcuacaaagaaaacuccaccugcucucucggccccaggauggggaggcagagugaggagcucacucugguuacaagcccuguucuuccucucccacugaauucuaaauccuuaacauccaggcccuggcugcuucaugccagaggcccaaauccauggacugaaggagaugccccuucuacuacuugagacuuuauucucuggguccagcuccauacccuaaauucugaguuucagccacugaacuccaagguccacuucucaccagcaaggaagagugggguauggaagucaucugucccuucacuguuuagagcaugacacucucccccucaacagccuccugagaaggaaaggaucugcccugaccacuccccuggcacuguuacuugccucugcgccucagggguccccuucugcaccgcuggcuuccacuccaagaagguggaccagggucugcaaguucaacggucauagcugucccuccaggccccaaccuugccucaccacucccggcccuagucucugcaccuccuuaggcccugccucugggcucagaccccaaccuagucaaggggauucuccugcucuuaacucgaugacuuggggcucccugcucucccgaggaagaugcucugcaggaaaauaaaagucagccuuuuucuacauauggcaugcagucugucagugucucccaagcuacagggcugaguuugggaaagaaagccagagggagccugggagcaccgaacuggagucugggcagccaccacgcccucuggcaaccgcugggguucggccacccccgcagacccgcccccacuuugccagagcggccggguccccauucccauuccuucaaauccccuuuuucccggcagccgaccuguagacccaagggagacagguugaagcuagaaagagucggggcagcagcucugguaggggagggagcauccaaaaccucuggcuucugagcgccucuccugccgcccauccacaaagccccccacagccuggcggcugcccucgaccccgcaaaacaaaggacuucagaggcuggaccuacagacccagaugagaaggcaaaagcguagggaggagcggcaggagaugggaagggcgggccccgcucggagcagcugccgcuuccucccaaagucccacgaggggccugagucacgggccaccgcccugggucggcgagcugggggaagggaucuggacaccuggcguguccgggcgggaagcuggugagggccccuggggacagagcggaggaccagugguuggggcgagaagagggcagucccgcagcgagucccacgcggggugggagggaucuaggccccgcccucuccucggcuccgcccugcgcccccuucccucuccucauuguccuuagacaaagcggucgccgcccccgcccggcccccuggucucugucuccgucccuccuccuuugcugccucuuucccuccuccucucccucccuccuccccucccuccagucuccggaucucccucggucccucucuccuccucuuccucucucuggacgcccggcuccuccgcacccccucccccgggggucccgcggccugugaguugacugaggggcucagacuuggggagugggugucuccucgccccuguccuugcucccgucccuggcccggaccuuggcugucuccucuuugugccgagauugucagucugugcggcuacagcgggguggagacggccggcucugucacggcuucaugagagcggggacggggcgcaggacuugcaggcgccggggagaagagacauggagccggcccuuggcacucuggggucgcguggggcagucggugggggaggcaggcgguggugacaggacaggguggggguggacgccaggguucugggaacgcgcuggcagcccugacgcccggguuccgaaagucucggggguggcuauuucccccgacccgccucgggggcggagugcggggcagaggggugggggcuggggagaggcguggcccgagcggugcuggaagcggagccgggaccuuuggggcccgcgcugagacgcgcccggcugcugccgccgcccuccuuuccccucuucccugguuucccuucuccucuagaccuguucgcucuccgccccuccuugccuccccaacacccccucaggucccguugccuccugguccuuucagggauuccugguccuuccuucccacacuagccucccugggguaucgcugaggcagccuggccugcacccagguuccccucaccccugccacauuucucucuucucccucacgccaa

SEQ ID NO: 18314 - RNA, 19993 nt, Homo sapiens
gugacgucguguggggcggguccgaccgcgcacaaugggccauggaguucccguucgauguggacgcgcuguucccggagcggaucacggugcuggaccagcaccugaggcccccagcccgccgacccggaaccacaacgccggcccggugacagcucaaacccacccucuggcccuuuucucccgguuccucuccaaaccugguccaggcaccacgcccccuucucacugacuagugaucgccccuuuugauguccaggccugccuuuuuggugaccucugacccugggccuagugggauugaucagcgcuuggaucugugaccuuucaccccgggcccaaaaugucccaaucaaaggaugugguugaccuggccuuucugcuuccucacaauaaccuuaagggaggagggagugugccaccuugaaaggugugacagaaguuuggguuucagaaggguggggugggaaaucagauuggaagacucccaggcaaaggcagggagccuucaguguuaaaccuggguuggaguuguggcccagguucccaggacugacugccuaggacccgcuaauuuagugaguaucugacucuuuauuucuucucuuucucuaguguugaucuacagcagcaaauuaugaccauuauagaugaacugggcaaggcuucugccaagguacuggagaguuuuuagauggaguaaagggaggaccucuguggggaugguauauaagggaggccuggguccuucggagagacuugcagaaagucugacuuaaucuucccugcaggcccagaaucuuuccgcuccuaucacuagugcaucaaggaugcagaguaaccgccauguuguuuauauucucaaagacaguucagcccgaccgugagugccacaugcucuuccaucccauacuuaauuccuuccuuccucagcccuucccccaucuuugacuaucucuugcagauagauaccacuagccuguucauuauuuuccccguccuacagggcuggaaaaggagccauuauugguuucaucaaaguuggauacaagaagcucuuuguacuggugaguguuauuggaugcuaggaguucguauaccuugguuucugagaacaaaagugcuggagguuagggggcagcagagaugccgggguuccuaaaacauuuuuauuguuucucucuuaggaugaucgugaggcucauaaugagguagaaccacuuugcauccuggacuuuuacauccaugagucugugcaacgccauggccaugggcgagaacucuuccaguauauguugcagguaucacugaccucuucacugguucauccaaacuaggggcuccuuugcccugagcccuuccagaagcccugccucccaccccccauguucccaugucauucuauucccuucccaggcuucuggcuuccuguuggcaugcuuuccccauacuuccuccuacccugagucuccuuuucccugcagaaggagcgaguggaaccgcaccaacuggcaauugaccgacccucacagaagcugcugaaauuccugaauaagcacuacaaucuggagaccacagucccacagguuagagguuucagagaauagauccccacugagcauucccauugaauuuauuuguuauuuauggcaaagaaguagugacuuauuuccuaucacauagguuucauuuucuacaaccaggcucuuucuuucucuugugguaccaucucucauccuguagugacuucuuucucaucuauuuugauuuuuuuuuuugagauggagucucgccaugcugcccaggcuggaguacaguggcgcaaucucagcucacugcaaccuccacuuccugguuucaagcgauucuccugcuucagccuccugaguagcugggacuacaggcacccaccaccacacccagcuaauuuuuauaucuuuaguggagacggaguuacaccauacuggccaggcuggucucaaacuccugaccuugugaucugcccgccuuggccucccaaaaugcugggauuacaggugugagccaccgcaucugacuuuuuuuuuuuuuuuuucaaagcagagucuccugcuguugcccaagcuggagugcuauggcaggaucuuggcucacugcagcccaaccuucugggcucaagcgauacuccucccuuagccuccugaguagcugagacuacaggcaugcaccaccaugccuggcuaauuuuuuauuuuuuguagagaugaggucucacuauguugcacuggguggucuugaacuccuggcucaagagauccaccugccucagccucccaaagugcugggauuauaggcgugagccacuguacccagacuuauuuugauucuuuaccacaaguuguuuccuacaccuaauuuuucuuuuuuuuuuuuuuugugagauguagccuugcuccaucguccaggcuggauugcaguggcacgaucacagcucacugcaaccucugccuccgggguucaagugauucuugugccucagccuccugaguaguagggauuacaggcaugcaccaucaugcccagcuaauuuuuguauuuuuaguagagauggaguuucaccauguuggacagacugguccugaacucauggccucaagugaugugcccaccucagccucccaaaagugcugggauuacaggugugagccaccgcacacaacccuuaugccuaauuuuuuuuugagacagagucgcucugucacccaggcuggagugcaguggcacgaucucagcucacugcaagcuccgccucccagguucacggcauucuccugccucagccucccgaguagcugggacuacaggugcccaccaccauacccagcuaauuuuuuguauuuuuaguagagaugggguuucaccguguuagccaggauggucuagaucuccugaccuugugaucugcccgccucggccucccaaagugcugggauuacaggcgugagccaccgugcccgaccccuuaugacuaauuuucaacccaaacauagccagcucauuuucaccuccuuguuuucacauaguucauuacucaucuggucagucaguauuuauuaaggguccagaauaauaugcauucccuguccucauggagcuuuggccuaauauagggaaggaagucuuguuuauaacuaagugcagcaaaauguuacuaaugcuacccauucauccaauaaacauugagugccuggcaguguucugggcacuaggaaugguuuacucaaugaaacagacaacagccugggcaacauagcgaaacucugucucuacaaaaaauacaaaaaaaaauuagccaggcgugguggcacgagccuguagucccagcuacuugggaggcugaaaugggagaaucgcuugagccugggaggcagagguugcagugagccaagaucgcgccacugcauuauagccugggcaacagagagagacccugucuccaaaaaugaaaacaaaaacagaaaaaaaggccaggugcggugcgguggcccaugcccguaaucccagcacuuugggaggcugacgugggcgaaucacuugaggucaggaguuugagaccagccuggucaacaugguaaaaccccgucucuauuaaaaauacaaaaauuagcggggcaugaugguggguaccuguaaucccagcuacccaggaggcugaggcaggagaaucacuugaacccgggaggcagagguugcagugaaccaagauugcaccacugcacuccagccugagcgacagagugaggacuccaucucaaaaaagaaaaagaaaaagggccaggcaugguggcucaugccuguaauccccacacuuugggaggccaaggcaggaggaucaccugauaucaggaguucgagaucagcauguggaacauagugaaacccugucucuacuaaaaauauaaaaauuaacugggcaugauggcgugcgccuguaaucccagcuacucgggaggcugaggcaggagaauugcuugaaccccggaggcagagguuacagugagccgagguccugcuacagcacuccacccugggggacgaagcgagacucuugucucggaacaaaaaaaaaaaacagaaaaagaagggaacagacaaaagucccugucuuagugguggagcuuauauucuagcuggagagacaaacaaacauaauaaacaauaugguuaauaagugcucuggaaaaaugagagcaaguaaggguuugggaguacucaaguaagguggggaugggaguaugugggauugcagguugaaaggggaucaucacugagaaagugucauuugagcaauaacugaaaggaaguaagaguaaaaacuggccgggcacgguggcucaugccuguaaucccagcacuuugggaggccgaggcgcgcggaucacgaggucaggagaucuagaccauccuggcuaacauggugaaacccugucuccacuaaaaaaaauacaaaaaaauuagcugggugccuguagucccagcuacucgggaggcugaggcaggagaauggcgugaaccugggaggcagagcuugcagugagccgagaucgcgccacugcacuccagccugggugacagagcgagacuccaucucaaaaaaaaagaauaaaaaccaaggcugggcguggugacuuacaucugcaauccuaguacuuagggaggccgagguggguggaucacuugagcccaggaguucgagacuagccuaggcaacauggugaaaccccaucucuacaaaaaacacaaaaauuagccagguguaguggcacgcaccuguggucccagcuacuugggggucugaggcaggaggauugcuuaagcccaggaggucgaagcugcagugagccgagaugguaccacugcacugcagccuggguaacaacgugagacugucucaaaacaaacaaacaaaaaaaaagaguaagagccaagaaauaucuggagagagagcaucccagacagaagguaccaccaguguauggccgugaggugggagugugccugaaagagcaaauuggcuguguccagagcagcaugagucagcggaggaguaugguaggagaugagaccagagagguaaugcggaggaggggccuuauaggcuacugcaaagacuggcuuuuauuuuaaguaaaaaauaagaucaggccagggguggcgacucacaccuguaaucccagcacuuugggaggccgagguagguggaucaccugaggucucuacugaaaauaccaaaauuagcugggugugauggcaggugccuguaaucccagcuguuugggagucugaggcaggagaaucacuagaaccgggaggcggagguugcagugagccgcugaaauuguaccacugcacuccugccugggcgacagagcaagacuccuucuuaaaaaaaaaaaaaaaaaaaaauagcgccaggugugguaucucauuccuguaaucccagcauuuugggaggcccaggcagguggaucacaaggucaggaguucgagaccagccuggccauauggugaaaccccaucucuacuaaaaauacaaaaauuagccgggugugguggcgggcaccuguagccccagcuacuugggaggcugagauagaagaaucgcuugaaccugggaggcagagguugcagugagcugagaucgcacuacugcacuccagccuggauaacagaacgagacuccaucaaagaaaaaagaaaaagaucauuuuggcugugaucuugauuuuuuccuuuuuaacaagaucacuuuggcuguuaagaacaggcaauagccgggcacaguggcucacaccuguaauccuagcacuuugggaggccgaggcagguggauugccugaggacuucaagaccagucuggcuaacauggugaaaccccaucucuacuaaaaauagaaaaaaaaauuagccaggugugguggugcucgccuguaaucccagcuacucgggagacugaggcaggggaauugcuugaaucagggagguagagguugcagugagcugagauugugccacugcacugcacucuagccuggugacagaguaagaccccauaucaaaaaaaaaaaaaaaauggaaacggcaauaagggagccagaguagaagcaaguagacuaauuaggcagcaacaauccuggcgaaaaauggugguggcucagaccaaggugguagcaguagugaugguaaagaguggucaaauuuuaaauauuuugaagguaaagcaaguaagauuuccugacagauuguauguggagaaagaggacuuuaggacaaugccaaagccugagcagcuggaagaaugaaguugcuuuaacugagaugguagguagaccagcuuugggggaaauacuaggaguacauuuuuaauauguuaauuggagaugucugugauauguccagguuugaguagacaguuggauacuucccuggagaucagggaggagguuuggggaggagaguuuucagcauacaucugguaucuaaagccaacagacaggaugcgaucaccauagaaagauuauagauagagaagcugccccuuugggcccucuuuaagaagugaggacccccaacuggcugcucugaaaagccaucuuugcauuguuccugguucgguguccugcucaccacagccaccuccgccaugcacuuccucugcugccucagagucuggcagcuuaaucgacauaguccccaaacucucacuuucuucuuaaucccuugcaucggaucaccgcugugccccaccaugucagaggcaguuguggacacaagcuccgugaucaccaccaaggacuucaaggagaaguuguggaggaggcagaaaguggaagagacgcccaugcuaacgggaacgcuaaugaggaaaauggggagcaggaggcugacaacgagguagaugaagaagaggaacaggguggggagaaagaggagaaggaagaggaaggugauggugaagaaaagaacggagaugaaaacgaagcagcugaggcgguauggacaaaugggcagcugaugaugaugaagaugacgauguugauaccaagcagcagaaggccagugaggaugauuagacagcaaaaaaagaaaaguuaaacuuuaaauuaaggccaccgugaccuauucacccuccacuucccaucucagaaucuaaacaugguugcccucgagaggccugcuugcccuccacagacagugccacugcagaugacaggcacucaccaccacccaacccaaaccagagaauuugcaacagaggaggaaaaaagaaccaaaacuuccaaggucuugcucuuuuaaaaguacuuuaaaaaggaaguuuguuuguauuuuuuauuuacauuuuauauuuuuguacauauuguuagggucauuuuuuuuuucuuugagacggagucuagcucugucgccaggcucaagugcaguggugcgaucuuggcucaccgcaagcuccaccuccuggguucaagugauucuccugccucagccuccugaguagcugggauuacaggcgcccgccaccacacccagcuaauuuuuguauuuuuagcagagacaggcuuucaccagguuggccaggaugguuucuaucuccugaccuugugauccaccuaccucggccucccaaagugcucgaauuacaggcgugagccaccggcgcccagccagguucagucauuuuuaaugaucucagaugaccaagccagccuuuggaggguucucugucuuacuucugacuuuacuuguggugugaccauauucauuauaaucucaaaggaggaaaaaaaaaaaaaaaaaaaaccuuguuuaaaaaaaaaaaaaaagccugggcgcgguggcucgcgccuguaaucccagcacuuugggaggccgagguggguggaucacgaggucagaagaucgagaccauccuggcuaacauggugaaacccccugucuacuaaaaauacaaaaaauuagccaggcgugguggcgggagccuguagucccagcuacuugggaggcugaggcaggagaauggcgugaacccgggaggcagagcuugcagugagccaagauugugccacugcacuccagccugggcaacagagcgagacuacaucucaaaaacaacaacaacaacaaaaagucucguucugagcauuccaguagcuucuuuaguguauguaguuaguuguaccauaaguaguugguuugugugagaugguuaaaaaggccaaagauaaaauguuucauuuauuugccuuuuuugucuaugaaauggcugcuuauuuauuuaggccuauuugauguaugugugaaacaauauugugcaacaauaaacccaaauuuuauuuugcugaguuguucuaacagcaacaaaaagaaguuaaggaagagaagaagaccagcaaaugcaaccacagagugacuagugaaguagaugaaaacugaggccgggugugguggcucacaccuguaaucccagcacuuugggaggccgagucggguggaucaccugaggucaggaguucaagaccaacauggugaaaccccaucucuacaaaaaauacaaaauuagccaggcgagguggcucaugccuguaaucccagcuacuugggaggcugaggcaggacaaucacuugaaucugggagguggagguugcaguaagccgagaucaugccauugcacuccagccugggcaacaaagcgaaacuccaucucaaaaaaaaaaaaaaagaaaagaaaacugaaaaguaaggugaccucaaaggccacugaagaaaguguuuccaggaggaaggaaugguuuacuuggucaaaugcugcugaucaaggagcaaagaggucugagaaguuaccauuggauuuaucugcguuaggccauuggugaucuuaaugagcaguuuuggugcagcgguguuuggaagccuggaugcagugggucuuguagacugagaagcuaggaacacagcaagaauaagcuacucuuuuaaauccugcuuuaaugggaauagaaauagagcaagagcuggagagugaaguggaucaaaagaguugaucuuuugcagaugggagaacaaauagcauuagaaugauucaguagagagaaaauauuauuaugucagagaaaguggggagaacuguugaagugaugucauugaaugggcggcgggggcguugagauuugguugacaaguuagccuuggauaggaacauggacaguuaauccauuguaacaugauuugauagaugugauuacagaggaggcauaaggacauggauuugagugcuaucuugggcuggggguuggguaaagaaagaugacaugucuaaucuugaaaggcaaguguuugucagguggacaaaaggcuaaagugcauuucauguagaggaacaggcaugagcaaaggcagaaagguauuaaaccaccuuucaggccaggcgugguggcucacaccuguaaucccagcacuuugggaggccaagguaggcggaucacaaggucaggagaucgagaccauccuggcuaacacgguaaaaccccgucucuacuaaaaauacaaaaaaaauuagcugggcgugguggcaggcgccuguagucccagcuaaucaggaggcugaggcaggagaauggcgugaacccaggaggcggagcuugcagugagcccagaucaugccacugcacuccagccugggcgacagagcaagacacugucucaaaaaaaauaaauaaauaaauaaaaauaaaccaccuuucaggacacuacaagcaguguggugugguuggagugcugggcaugugcuuguuggggggugggggugaugaggaugggcugguagacauuacaacaaggucaaggcaagggauaggcagggucuuccuacaguauauuuuuccauuaagaggcaacagagagcaguggaaggagcacaguuuuuuuuuguuuguuuguuuguauuuugagauggagucucagucugucgcccaggcuggagugcaguggcacaaucucagcucacuggaaccucugccuccugaguccaagcaauucucuugccucagccuccugaguagcugggauuagaggcgcccaccaccacaccuggcuaauuuuuguguugaugagguuucaccauguuggccagacgucucgaacuucugaccucaagugauccgcccaccucggucucccaaagugcuacgauuacagccgugagccaccauacccgguccuggagcacaguauucgauaugaaacacauuacccaguuaacauguaaggccagagcaguauagaguguaaauaauaauucacauuucaugggcucuaugugguaucuauaugcaucaucucaguggauucuugcacaucuuuuugagguagguacuauuauuaaaccuauuuuggguuuauacaaauuaaugacuuaaccaaauucacacagccaguaaauaguagaguccacauuugaacccauagccauuugcacccagugaacuuuuuuuuuuuuuuucuuuuugaggcaaggucuugcucuguugccuaggcuggagugcaguggcacgaucacggcucacugcagucucuaccuccuaggcucaagagaucuucccuaccagccuggccaacauggcgaaaccccaucucuauuaaaaauacaaaaauaagccgggcgugguggcaugugccuguaaucccagcuacucaggaggcugagacaggagaagagcuugaaccugggagguggaaguugcagggagccgagaugacaccauugcacuccagcaugggcaacagagugagauuccauguuaaaaaaaaaaaaaggccggacgcauuggcucgcgccuguaaccccagcacuuuggaaggccaaggcgggcggaucacgaggucaagagaucaagaccauccuggccaacauggugaaacccugucucuacugaaaauacaaaaauuagcugggcaugguggcgcaugccuguagucccagcugcuccggaggcugaggcaggagaaucgcuugaacucaggagguggagguugcagugagcugagaucuugccacugaaguccagccuggcaacagagcgagacuccaucucaaaaaagaucuucccaccucaaccucccaaguaguugggacuacaggcgcccaccacuauggcuggcugauuuuuuguauuuuuaguagagacgggguuucaccguguuagccaggguggucucgaucuccugaccucgugaucggcccgccucggccucccaaagugcugggauuacaggcuugagccacugggcccggcccacgccuggcuaauuuuuaaaaauauuuuuguagagaugaggucuugcuauauugcccaggcuggucuugaacuccugggcucaagcuauccacaugagccaccaugcccagcccccauuaaacuuuuuuuuuugagauggagucucacucugucacccaggcugaaguacaguggugcaaucucagcucacuacagccucucccuccuggggucaauggauucuccugccucagccuccugaguagcuaggauuacaggcgcacgucaccacacccagcuaauuuuuguauuuuuaguagagacagggucucgaacuccugaccucaagugauccacccgccuuggccucccaaauuguugggauuacaggcgugauccaccacgccuggcccccgaguuuuuuuuuuuuuuuugagacggagucucucucugucgcccaggcuggagugcaguguugccaucucggcucacugcaagcucuccucuugaguaaacucuuaauggcuacacuauuuuccuggcuaaaacacugcagcuggaaucagaagucugaaaguugaggcccagcccugccacuuguagcuacuuggcauuggccaagcgaagccaugucuccaaggcuguauuucccccaaccuucuuucaaauagugacuuccaggauugugaaggccaaauuaaaugugaaaauauaaugaaguaacucuaaaauuaauaguuacuaguuaucaaaguagcauccuggccuccagcaugucuuccccugacuuuccccaccccuuggaacccugcugaauuuuuuauuuauuuauuuauccuuugagacggagucucauucucuugcccaggcuggagugcaguggcacgaucucagcucacugcaaccuccgccuccuggguucaagcgacucuccugccucagccucccaaguagcuaggauuacaggugcacacugccaugccuggcuaauuuuuuguauuuauaauagacacaggguuucaccaucuuggccagaccggucuugaacuccugaccucaagugaugccugccacagccucccaaagugcugggauuacaggugugagccacugaaccuggacuuuagcaccuuuuuaugugcuuauuggccauuuguguaucuucuuuagagaaaaguuuauacaaguccuuugucuguucuuaaauuguguucuuuuuuguucugagaguuuuucauauauucuagauagaacgcacuuaucagauguaugacuugcaaacauuuucucccauucuguagauugucuuuucacuuucuuucuuuuuuuuuuuuuuugagacggagucuugcuccaucgcccaggcuggagugcaguggcacgaucucagcucacugcaagcucugccucccggguucacgccauucugcugccucagccucccgaguagcugggacuacaggcgcccgccaccacauccggcuaauuuuuuuguauuuuuaguagagaugggguuucaccauguuagccaggauggucucgaucuccugaccucaugauccgcccgccucggccucccaaagugcugggauuacaggcgugagccaccgcaccugaccuuuacuguaccuuuucuguguugagguauguuuagauacaucagcugaaccauuauguuagaauugccuacagcuggcugagcaugguggcucacgucuauaaucccaggacuuuuggaggcugaggcagaaggaucacaugagcccuggaguuugagacuggccugggcaucauagugagacccccaucucuacaaaaaguuaaaaaaaaauuaguagccagaugugguggcaugcaccugugguccuagcuacuugggaggcugaggugggaggaucauuuaagcccagguugaugcugcagugagcugugauggcaccacugcacuccagccuaggcaacagagcgagacucugccucucaaaaaaaaaaaaaaauugccuacagcauucaguacaguaacaugcuguacagguuuguagccuaggagcaauaggcuguaugauauagucuggguguguuguaggcuauagugucuagguuuguguaaguacacucugugauguucacacaaugaaaucacccaaugacguauuucucagaauguauccccaucguuaagugaugcaugauuguauuuuguuuguuucaucuuccaggugaacaacuuugugaucuuugaaggcuucuuugcccaucaacaucguaaguuuuugcauuuuguuggucacguagucggggugagggaaaggaaagagcuggacucuugguccugccgaccccucacugaggggccccgccgcuuccuuccucacagggcccccugcucccucucugagggcaacucgacacucucgugcugcugcagucgaucccacgcccgcugguaaagccuguauugaagggguggaacuguagugcagugauggcuacuuacucuagaugccacgggguacagugccaucugugggcaauuuuggaaaauucuaaagcaacccaagucuccagcagucaugacuguuugccuuugcccucaugggagcucagugcauuuuauauuuggcaagacuuuuaacuaagcaagcucauugggagccuguuugacagcugauaucaauggacccucuugccaguucagguccgucaacauaggccagagucaggcuccuuuguaaaccccaggcuucuguuagccagugagggacaggcuggugcaaacagcccuuccauuugcagucacagaauagugacacaaauggcccaaaauuuaaauguuacuuuuagaagauaacacucagaguuuauaacauuuccaaccagauaaugaaauugauauggagaaaccaaaccucagaggcacuaaaaugcuguccagauuccccaucccauauacacacauacacacacacacacacacacaaacacacuuacugacagucugagccccacuccuuccucuuccucaccaccuccaccuuaccaacuucugacagcuguacagugcuugcuugcacagaagagcccccuuccugagcuggcucuguggccaggaaaggauguaaccaccauccaaacagcagucuguaaccagcuaugagcaucacagugucaggcacugagaggcaccucaacucgcuuugguuuccaaggcuucucccauuuagcuuguucagaaccacaggcugugagagggacugagggccaacaaggauggugaggucucaggccugcaggggagggugcuguggauaaagcuuaagugaauuugcugagaagucuuucauuugccacacauacaugauggagaaucucuugagagggaaagccgggagcaaguagagaagugaggagggggaggcugaacuuuggacauuacaucagccuccugcuuacucugauagcucccuuucagaugcccauauuuauuuucuuuuuuuuuuuuaaccuaauaaaacuucagucucuucccauuuucguauaggaaggagagauugugcccuccuuccaaaccuccccugaccucuccagagcaauuccugauuaaccaagggcuuuguccaucucauccagaggaacccaggguccucguuggcccggcugggaccauuccacugccccagaauaccagggggccaugacagcacccacugacaguaagagcucacuucccuuggcugcccuucuccugcaucucccaggcccccagagucuccccuucgaucuuucucccuagcucuguguuuggccuacuccuucuggcuuuccucaacaguguuccacauuccccucaaauucccuuuuggugugcuggcauugccauggugcugcuccugcaaguucucaggaggaacuguggugucagggagcagagguuugggguugggguauaguggcugggaggaggggugcaaaguaugucuccuaacgcuuacccugccuauguccccuccacugccagcuccagcaaggaagcugccacccaagagagcagagggagacaucaagccauacuccucuagugaccgagaauguaagaggggcaagggucgggugucugggccugggguaccuuaacacaagggaagagaaugcucaggggacccagggaaaggauucguucucucuaaagacucagauuucuugggcugggcaugguggcucaugccuguaaucccagcacuuugagaggcuaaggcaggcagaucgccugaguccagggguucaagaccagccuggccaacauggugaaaccccgucucuacuaaaaauacaaaaauuagcugggcacgguggcacgugccuguaaucccagcuacuugggaggcugaggcaggagaauggcuugaacccaggaggcggaaguugcagugagccaagaucgugccacugcacuccagcuugggugacagagugagacuccgucucaaaaaagaaaaaaaaaaaaaagaaagacucagauuucucuuuuuuucuaccaaaaccuuugcugucaugacucucuuccuuuuuucuucuuuuucugucuugcucuucauucucccuguccccaguucugaagguagcuguggagccuccuuggccccuaaacagggccccucgccgcgccacaccuccagcccacccacccccccgcuccagcagccugggaaacucaccagaacgagguccccuccgccccuuugugccagagcaggagcugcugcguuccuugcgccucugccccccacacccuaccgcccgccuucuguuggcugcugacccugggggcagcccagcucaacgucgucgcaccagguaauaggaguugaagggcuaaggagccucacagcuauaaaagaggauguuagaaauggcaaagggcaauuugaauccaucagagagauggaucaauaagauggguggcuugggggggguccugaaaccuuucaagaaaaauauuugugcaagugaucugggaaaaaaaugcagugaaggagcagaauaggaccuuauauggagccuagggacccuggcuuuaaugugagaguuauguggaaugguaggaagaacaccgagauccaucgaguugggggaacagagccuucuaagauugggaaaaucuucgcuuaauacuugcuggggaaggggcagugucugacagagagugggaagccacuggcuugugugccaagaguccaucgcagcaggcagggagugggcauuuccuuuauuucucucccuuucucuucaccucugacuucucuguuuuucucucccccgccccccgccauuucccaucucccuuccucccauccauaacauccuuccacagcucccuuccccgcucugaggagagucgauacuaacagcuacccucucccugcccugggagaccuggggugggcagggaaccccucccugagaaccucagacccacucuuccauugcauccuguaggacccaguggaaccugacagagcccauaggauucccucuucuacuuucuuagacagcagggaugucagggucucaaacugccuaacacuuuguagcuuuucuuaacacaaaagcaccccuucucuccuaacuugggcucugaauacuuucccaacaggaagucugaucuguugccagacuucuugguuagauggcucauacauuuaucuagagaagcacacucuugcuugcugucaaacuuuagaccaccauggaaggucuaagggcauccugugccagggaaacuuuuuaaggaauuuuaucuaugggauaaaccccauauucccucuagugucuacugguggcucuaauacugcuuugugcugccugccacacuugcccuuugagccugcgaauggccgcuagugagcaagcucugcuucagagcagucuaguuagguagaacagggacuuaccagcuucccaaagggaucuacucaccauugccaaacucuucauuuccacauuuuguguaggugucagggaaccccaaacugguguugcuuuggggucucuaaaggagauuggcugacaccaccauuucccccagauccagauucucugagggagguuguuucuugagaguagauccagagugucaaggaucuguuagauccuggaaucccuucuugcauccaucccucccugguagcuaggucccgauauacuccugucuugugagauugucgagaugagaugggggaccacucuuccucuguccuuccucucuccuuuccuccauagcaaggacgaccuucccugcuccaugcccagaguauagcuagaucccuuccccucccuacccucugaaugugugcuagaucaggugccccacuguguuuccugaaauccuugggagccggaucuccccaucuccccuacucacucuucccuuuucuucucucaguguugucugaauaaagugugaaaucuuuuguguuuucuaaauugacauuuucaaugaaaaaaagaaucacaaaaaaaaaaguugucagccucauuugugcgucaucccuuauuuuccugggaucucaggaccucugucccucucauuucucacuucugagaucugcacaucuuuuacccaggagccucagagcuccugagucuggugucugccuauccccaucuucacuguuaguccuccugcagauucugugucuccuuucauguaggugcuggaucccugugugugggcuuccguaucuacucccucauucccuccaggaaccuccagcucuccccagugacuucuacccuuuacucugggcgugccuuugccaagaugucaaagcuuaccaacaucucuggauccacuaauuaccuccugccuccuguauucgucuucccacucugauuaccugacgucugcuccacuaaaccgcuggaucucucucaagacaaacccuuaccuccauugagagugcaacacagucugucacccuauuuacagaggcccccuuccuuuuccuccuaaauucaaaauucagccuugucacuuccuauuucccucuggucuaaggaaucuuuuuuuuuuuuuuugagauggagucuugcucugucgccaggcuggagugcaguggcacaaucucagcucacugcaaccuccgccuccuggguucaagcgauucuccugccuuagccucccaaguagcugggauuacagaagugcaccaccgugcccagcuaguuuguguauuuuuaguagagacaggguuucaccauguuggccagguuggucucgaucuccugaucacgugaucugcccgucuuggccucccaaagugcugggauuacaagccugagccaccgcgcccagccuggucuaaggaaucuuauaguuaagguaacccuguuuuccaaaccaaacaccagaguacccgauccaacacauuuuugaccacaugugagucuguucuucugacaugauuuggaucacaccuagccauagauuuaacacauuaccucaacuagaaagaauagagcaauaaaucagaagcacuccagaaaaucuuggguauaaaaugaacuucccccgcccuuuucuggggcacagcuuugauuaaaaccuguuaggaaugauaauuacccccuucucuuuguuccugugcuauuccuuuuacuccucuccucugauuccuccauacccacccaucuuucauccaguagccuccuccccaucaucucccauuucuucuacagggggacucccccaggucugguagcccaaagcugcugcuacagccgccaugggggggugaauuccucaucccccaauacagguaaguauucacuccucccuacccucaaaucaaguaggccacauucacugucuacuccugccuucccauucacaugccugauauuuccacaggcaaccaagacuccaagcagggagaacaggaaacaaagaauaggugaggucuaaaccccuccccuaacagccucccaccaccaucugacucccuuccuaacaucauucucagucacuuccuacucuuaaaucuuauuguaugaacuggacaccagcuccucccacaauuccuucuaccuuacauccugcaagccccuuucccccacagguucaacucugguacuucccuuuggaauacggauucucugagagguuuuaaauuuggacauagcacuaaugguuccagcuucauacccaucauguguccuacauuaaaaccuggcccgagaccuugaagagucuguaaucuuaauuuccucuuuaguauuccuauaacccacucuccaucuccccaccuaccaggucugccagugaggagcaggccuugucacaggaugggucuggggagaagcccaugcacacagcuccuccacaggccccggccccgccagcccaguccuggacaguggguggggacauacucaacgccagguucauucgaaaccugcaggaacgucgcagcaccaggccuuggugaccgcagccccgucaaacaucuucaaaguauuauuucucccucacuacaggaaagagccaaagcccaacccucauaauagauggauacauucauucauucauucauucagcaggcuuaucagauucaagucauuuguaucuuuuaaccagaccaauaaaaguauuuauuuuuaucacaagagcuguugaaaaauu

SEQ ID NO: 18315 - RNA, 505 nt, Homo sapiens
aaaacguguguuuccaaaaugguggcagugaugcaagaggguacgcugagcagcaccuaugacagugugggcaagaagggcuuuaaagugaaaaaguggaaugcaguaacccucugggcugugauauugugcuugguaacugugccaucugcaagaaccacauuauggaucuuuuuugcauagaaugucaagcuaaccaagugucugcuacuucugaagaguauaccaucuuauggggcauguguaaccauacuuuucacuuccacugcaucugucacuggaucagaacaccacagguauguccauuggacaacaaagagugagaauuccaaaaguaugggcacuagaaaaagacaucuuccauuaaguuuaacuauuucguuauucauuaaugauuuucccuccugucaccuaauuuuaaauuagauagaacugugucuuuucugcuuugucuuuucaauuugcuguuucuacaaccauauuauauucugugucaaauaaaguc

SEQ ID NO: 18316 - RNA, 8160 nt, Homo sapiens
augcugguuuccacugcauuuauuacuaauauaaaaaaaguuaaaaagaaaaaaaaaaaaaaaaccucauucucaguucuccaacagcucucaccccucccucuugccaauacaacuccugacccauuuccucagggccaguucaaaacugaaccuguucacugcuguuuucacagaaaacaaccagugccagggauguaggggaagaggauuggaagagggcaacaguacuguccagcuucuacccaaagauaggcaagguggagauucacagaauucaaaugaauggacugguggccucacaaugacauagucuaauuaaaaugggcuggaagggaucuagguaggauaaagccauuggaggcuuuauaagacaugucaugggucugugucagacucagaauaaccaacaggagaagaauggggagggccagggaggcagucugauggaaaguucacaauucucccauguugggaagugggaaaguccagagggcaccaagcgccucacucauuuuggcaggaaaacuuauucuagugcugggaagucacaaaaaugccacggacacugagaaaggcuacaaggggaugcacaguuucacaaagcacggugaucauagauagaccauagcgguggggaucaugcuacugacagagaaacuaugaaauccaaaggcagggagaguggccuuuuaggaaguaacucugcaccagucacccaaacuugaccccagguuagacaaccuggcugaguuucacaagcagcugacaacauuggggguagggaaugucacauaaaaaggacuuaaaacaagcagcuaaaagaagggaaugguaggaaaccgcuccagggcucucaggaauugagggcaauacuggggaacagguggacagaugcacaagaaacagcaccaaagagguuuccuguucagcagucauuugaugacgggaaagaagauccaggaggcaacugaaaggaagcaaagaugggucccaaaggcgagucucuacaggcuggaucagaagaaagcgcguaugccgcgcaccagugaugcaacaccacucuggaccccacacgggggaagugguggaugggaugggugugucacugacugaggguguuagaagagccucacaguagccaucauagggcuacagagaaauaaauggccgcuaggucacagagagcuccuuccagccuggaugggaaggcacagucucacagaggagguccauugacgccuggaugguagaaggcacagagguccucauaucgacaguggcccuuuuuggcaaaaugucggcagacagggcggucggauuugucugugaacaagugaaaauggaacaguuaaaaauuugagcaacaaagaaaacaaauacaaugaaacgcagagacagaaggagaacugauuuucuacccccuaccauuuccagguauuuuggaaugguagucuuucuccugggagaaauaacauugaggucuacuucugcuucaaaagcaaaaaggaaagcccagagaagauugugaaugaucuucugaaaauuaggucacucugggaguaaugggcauaacaaaauggaccucaccuuccauaaccugggggucauccuugggcgggcagguauucuugauaagagaccagcuuuugagccuucgaggguuucucuguuccuugugaaagcuuccccuggugggacccccauggccuggccccggaaaaggagguucugcauugacuccccaccaaccacgaccauaugggcuagaccuggggccaagcccucuccgaauugggccucuaccccaaggaggaggugggagacucagcagugguggaaucagugguccccuugauccuggaggaccucugugaagagcuggagagagagagagagagagacacagaaaggugucuaaugggcagcugaauccugauaaaccgugauuaaaaaaauuuuuuuuauugaagaacagcauacauaaagacacaccaguuuuaagugcacaacccaguucucacaaaguagacacacuugaguuuccaccaccaggugaagagauaaagccuuauuagcaccucaaaagauccuccccuugugccccuuuucccauuacccacccuccuccccaaagguaaccacuauccugacaccauagguuaguuuuugccuguuuuugaacuucacaaaaauggaaucauacagucugcauucuuuuaugucuggcuccuuucgcucaacaucauguuugugagauucauccagguugccuguagcagcaguucauucauuuucguugcaguguagucccauugcaugcauacacaacaauuuauuuauccauucuacugaugauggacaugugggugguauccaguuuggggcuauaacgagaaaugccacuauaaacauuuuuauacauguuguuacacauacguaugcauuucuguugaauauauacguaguagagguauuacuggcuuauaaaguauauguuaugcucaaguuucauacauaaugccaaacuuuuuuuucacagugguuauaccaauuugcacucucaccagcaguuguccuauagccuugacaacacuuggaauuguuagguuuuuaaauuuugccauggugagugugaaaaguggugguuauuuuuuuguuugguuauuauuauuuauuuaaugagagauugggucuugccacacugcccaggcuggucuugaacucuugggcucaagugauccucccaccuuggucuccuaaagugcugggauuacaggcaugaaucaucaugccuuguuuuguucgguuuuuauugugguaaaaaacacauaaaaauuaccaucuuaacuauuuuuaaguguacaguucaguaguguuacauauauucauauugaugugaaacagaucuccaaguuuuuguuuguuuuuugagauggagucucgcucugucgcccaggcuggagugcaguggcgcgaucuuggcucacugcaaccucugccuccuggguucaagugauucuccugccucagccucccaaguagcugggauuacaggcgcccaccaccacgccuggcuaauuuuuguauuuuuaguagagauggaguuuuaccauauuggccaggcuggucuugaauuccugaucucaugauccgcccgacuuggccucccaaagugcugggauuacaggcacgagccaccaugcccgaccuccaaaaguuuuuuaucuugcaaaacugaaacucuguacccauuaaacaaaacuccccuuccuccagcuuccuucccccagccucugguaaccaucauucuacuguuucuuugaaguugacuuuauuuuuauuuuuuguuuugacaaucuugcucugucauccaggcuggagugcaguggcgugaucucgacucacugcaaccucugccucccagguucaagcaauucucaugccucagcuacccgaguagcugggauuacaggugugcaccaccaugcccagcuaauuuuucuauuuuuaguagagacaggguuuugccauauuggccaggcuguucucgaacuccugaccucaagugaucugccugccuuggccucccaaagugcugggauuacaggcgugaagcaccaugcccagccccugaauuugacuuuagacaccucagauaaguggaauaauacacuaugucuuuacuuaacauaaaguccucaaaguucauccauguuguaguaugugacagcacuuucuuccuucauaaggcugaauaauauuccauuguauguacacgccacauuuauccuuccaucaguggacauguggguugcuuccaccucuuuguuauugugaauacugcugcuaugaacaugagucugcaaauaucucaagacccugcuuuccauuuuuuuuuuuuugauauauaccuggaagcaggaguucugggguaauucuauuuuuaauuuuuuugucaucugguaguucuauuuuuaauuaagaggaaccucuucauauuguuuucuauaguaguuucaccauuuuauaaucccagcagcaguacacaagaguucuaauuucaaagugguauauuuuuaucuugcauuuacuugacaauuaaugauauugaguacuuguucauuuagaccuuuaguucauuuagaucuccauuuuaauaagguguccuguguuuuugucaauuuuucaaauggcuugucuggaagaguucuuuauauauuauagauacaggaucuuuauuuguuauauuuauugcaaauaucuucuauuguauggcuuccuguuaauuucuuaaugguauuauuuggcaaguuuguauuuuguuuuuucuuuuuuuugagacagucucacucugucccccaggcuggagugcaguggugcaaucucagcucacugcaaccuccgccuuccagguucaagcgauucuccugucucagccuccucaguagcugggauuacaggcacacaccaccaugcccggcuaauuuuuguauuuuuaguagagacagggguuucaccauguuggucaggcuggucuugaacugcugaccucgugauucgcccgccucggccucccaaagugcugggauuacaggcgugagccacuguacccagccgcaaauuuauauuuucuaacggaguucaauuuaucaaucuuuccuuuaugguuaguguguauacgugcauuucuugucuguuuaagaacucuuagcuacucuuagaaaauacauuuacuuucuagaauaauuauucucuuaccuuuuauacuuagaucuacaguccauuugaaauagaucuuuguauaugauuaugagugcaaggugaaauuccauuuuuuucacaugaauauccaauugauccaauaucauuuauugaaaagaccaacuuuucaguuccaucuucaucauaaaugaaguguccacacauguaugggccuguuauuggacucuucgggacauaaguccuauugacuuaugucuaucauuguuuccaaacugcaucguuguaacuauuguagcuuuauaguaagucuuuuuuucuucuuguauuuagagacaggaucucacuauguugcccagaguggccucaaaaacuccugggcucaaaggauccucgcaccucagccuccugaguaacugggacuacaggcgugugccaccaugcccagcuuacaaaucuugauauucauaguaagcccucccacuucaagauugucuugauagucgccuugauauuuugcauuucccuauaauaauguguauuuccacaaaaacauuauggguguucugacuuggaaugcaugaaaucuguuuaucaauuugggaagaagugacauuuuuacaacauugaguuuuuaaaucagcaaauauacaacuucucuccauucauuuagggauggaaucccugaucuuuuauuuuuaaguccuuccuggguuuuauccccucccuugcugucuucucuacgaccuaauacaaggaucagggccccuuccuccucaccugacuuagggucgccagguuuuccauuggccauggggggagggcccagaaggcugggugguccuaagagcagacaugaaaauauggucaucagaauggauuaaaggacugaugauucuguucuuagguguuuuucuuguauuacuuauuucuuaauucaaccaguaaagucagguauauuuucagcagucuugggaguucucaccccaucuaucugcccuuuuuucugcaaagcuguuucaggguuugcaaaaaguagauauucaaucaaaggggauaaugcaggaaaagauacugacaacuuuuuuucuucaccguaccgucgcuauccaaaacaaccuaagugucuccagacaugaaccaaucccucaccuuaacugcuggccagaggacuaguuuagagaaagcugcaccuguaccuuuucagucaaagucuggauacaaacugucaucccagucaucgcaaucugcaacaucucuacuaccccuuuccccuacuguucugcggcugcgcaaaagagcucuuuauucucuccacccccgccuucuccagaaaggucuggggccguauugagguugaugguuccaguaagagaacuccugguucaaggcuccauuugggagagccccacuuccaucccuccccagcgcgugcgcccuuccuccuuccguuacagcccccuccuucgcaccuuauuagccccuagccccuugcccggacgggcuugacaggcaugugcacaucccucccagaccccucaccgaugggacucccauccuccucaucuccagucucuucccgcucgggcagcgggggcugcugcugugucgguggcuggugaugauucugcuucuuucguuucggcaucgugucugcggcaauggcugcagcgggauuuggaggguagugaggaaggggcacgcggggauucuguuuccgcuuccggggggucggugggcagcaaugcugaggcucccgccauuccacuuccggaagguugcggagaacaucugcggcggccgcauuccggagccaacugccucccuccgucucugccaggcauggcggcaaccucacaccuucccuuugcugcguuucuauaaaugcuuugaaaaaauuacucuuuucuucccucgcuggaaaacaccacaaccagcuccucagagugugucacagagucaacaggcucucgggccagagggccugagaagaggacugucgcaccguaagaucgccacauccgguccucgguuacuaugguaacagcugcaggcacaacuucgugcccuuugaccuccccccaaaaguccuugucccgcuuggguuucccuucucgcccgcuuuugcacuuaugaucuguaaaccugcuccuuaucaucguucccacaaggaauuugggucccaacaggucggcacccaggacucucagaccgccgcccuccccuaaagaccucugaccgugcccccgguguaguccagcaaccuggacgcagucucggcuuuccacuaaggucaagcccggggcuuuguaguauagccucagcguguccacgcccccucuccccuagguaguaggccccgcccuccgcuccgccgcccccuccaggugagugguagguucucccgggagcgcaagguagugaugacacgcgcccccccuccuccgaacgcgaguugguagcguccgugacggaguuagccugguccucccacgcgcgccuccuuccucgccgccggggcgcccucucggugccacuggcucucacgugccaguagcccaccccgcaucauccucucgccucgcuccuggagggaagugacuauaucucccccguccgccuuccaucgccgccgcggcgguaauucugucgggcccgcccgcugacgucaccugcuagccccgccuccucuagggucccgggccccugcggcgggggcugccccggggggcagucaguugaggcggcgggagcucggcggagggcgggccaggugacugguccgggccaugccgaggaagaagccauucagcgugaagcagaagaagaagcaguugcaggacaaacgggagcggaagagaggucagugcgggagcgggaggagggggcggggcucgggcuuccgcacaucuggaaggaggggugugcccgcugcaccucuggggaucgugggagggggucgugggaccgcgucaacccucgcggccuaucgcggaggggaucccccacccccccuacaucuggaagggguggggaaggauggagaguugggggaggggaaucccuccagcuagcacggggcgccguccccacugcucccugaaggagugacuccccccacgcacauccgggagggucccaaauagggugucugggaggacugaacaucggaagaaguugagugggaugaaagggagucaggccgaugggggagagggucuuauggccccugagagcuggccagcacuggcgucaccggccccuccccgcagggcuucaagaugggcugcgcuccaguuccaacagccgcagcgggagccgggagcggcgagaggaacagaccgacaccucggacggggagucugugacccaucauauccgcaggcuuaaccagcagccuucucaggggcuggguccacgaggcuacgacccaaaucg

SEQ ID NO: 18317 - RNA, 8160 nt, Homo sapiens
cgauuugggucguagccucguggacccagccccugagaaggcugcugguuaagccugcggauaugaugggucacagacuccccguccgaggugucggucuguuccucucgccgcucccggcucccgcugcggcuguuggaacuggagcgcagcccaucuugaagcccugcggggaggggccggugacgccagugcuggccagcucucaggggccauaagacccucucccccaucggccugacucccuuucaucccacucaacuucuuccgauguucaguccucccagacacccuauuugggacccucccggaugugcguggggggagucacuccuucagggagcaguggggacggcgccccgugcuagcuggagggauuccccucccccaacucuccauccuuccccaccccuuccagauguagggggggugggggauccccuccgcgauaggccgcgaggguugacgcggucccacgacccccucccacgauccccagaggugcagcgggcacaccccuccuuccagaugugcggaagcccgagccccgcccccuccucccgcucccgcacugaccucucuuccgcucccguuuguccugcaacugcuucuucuucugcuucacgcugaauggcuucuuccucggcauggcccggaccagucaccuggcccgcccuccgccgagcucccgccgccucaacugacugccccccggggcagcccccgccgcaggggcccgggacccuagaggaggcggggcuagcaggugacgucagcgggcgggcccgacagaauuaccgccgcggcggcgauggaaggcggacgggggagauauagucacuucccuccaggagcgaggcgagaggaugaugcggggugggcuacuggcacgugagagccaguggcaccgagagggcgccccggcggcgaggaaggaggcgcgcgugggaggaccaggcuaacuccgucacggacgcuaccaacucgcguucggaggagggggggcgcgugucaucacuaccuugcgcucccgggagaaccuaccacucaccuggagggggcggcggagcggagggcggggccuacuaccuaggggagagggggcguggacacgcugaggcuauacuacaaagccccgggcuugaccuuaguggaaagccgagacugcguccagguugcuggacuacaccgggggcacggucagaggucuuuaggggagggcggcggucugagaguccugggugccgaccuguugggacccaaauuccuugugggaacgaugauaaggagcagguuuacagaucauaagugcaaaagcgggcgagaagggaaacccaagcgggacaaggacuuuuggggggaggucaaagggcacgaaguugugccugcagcuguuaccauaguaaccgaggaccggauguggcgaucuuacggugcgacaguccucuucucaggcccucuggcccgagagccuguugacucugugacacacucugaggagcugguugugguguuuuccagcgagggaagaaaagaguaauuuuuucaaagcauuuauagaaacgcagcaaagggaaggugugagguugccgccaugccuggcagagacggagggaggcaguuggcuccggaaugcggccgccgcagauguucuccgcaaccuuccggaaguggaauggcgggagccucagcauugcugcccaccgaccccccggaagcggaaacagaauccccgcgugccccuuccucacuacccuccaaaucccgcugcagccauugccgcagacacgaugccgaaacgaaagaagcagaaucaucaccagccaccgacacagcagcagcccccgcugcccgagcgggaagagacuggagaugaggaggaugggagucccaucggugaggggucugggagggaugugcacaugccugucaagcccguccgggcaaggggcuaggggcuaauaaggugcgaaggagggggcuguaacggaaggaggaagggcgcacgcgcuggggagggauggaaguggggcucucccaaauggagccuugaaccaggaguucucuuacuggaaccaucaaccucaauacggccccagaccuuucuggagaaggcggggguggagagaauaaagagcucuuuugcgcagccgcagaacaguaggggaaagggguaguagagauguugcagauugcgaugacugggaugacaguuuguauccagacuuugacugaaaagguacaggugcagcuuucucuaaacuaguccucuggccagcaguuaaggugagggauugguucaugucuggagacacuuagguuguuuuggauagcgacgguacggugaagaaaaaaaguugucaguaucuuuuccugcauuauccccuuugauugaauaucuacuuuuugcaaacccugaaacagcuuugcagaaaaaagggcagauagauggggugagaacucccaagacugcugaaaauauaccugacuuuacugguugaauuaagaaauaaguaauacaagaaaaacaccuaagaacagaaucaucaguccuuuaauccauucugaugaccauauuuucaugucugcucuuaggaccacccagccuucugggcccuccccccauggccaauggaaaaccuggcgacccuaagucaggugaggaggaaggggcccugauccuuguauuaggucguagagaagacagcaagggaggggauaaaacccaggaaggacuuaaaaauaaaagaucagggauuccaucccuaaaugaauggagagaaguuguauauuugcugauuuaaaaacucaauguuguaaaaaugucacuucuucccaaauugauaaacagauuucaugcauuccaagucagaacacccauaauguuuuuguggaaauacacauuauuauagggaaaugcaaaauaucaaggcgacuaucaagacaaucuugaagugggagggcuuacuaugaauaucaagauuuguaagcugggcaugguggcacacgccuguagucccaguuacucaggaggcugaggugcgaggauccuuugagcccaggaguuuuugaggccacucugggcaacauagugagauccugucucuaaauacaagaagaaaaaaagacuuacuauaaagcuacaauaguuacaacgaugcaguuuggaaacaaugauagacauaagucaauaggacuuaugucccgaagaguccaauaacaggcccauacauguguggacacuucauuuaugaugaagauggaacugaaaaguuggucuuuucaauaaaugauauuggaucaauuggauauucaugugaaaaaaauggaauuucaccuugcacucauaaucauauacaaagaucuauuucaaauggacuguagaucuaaguauaaaagguaagagaauaauuauucuagaaaguaaauguauuuucuaagaguagcuaagaguucuuaaacagacaagaaaugcacguauacacacuaaccauaaaggaaagauugauaaauugaacuccguuagaaaauauaaauuugcggcuggguacaguggcucacgccuguaaucccagcacuuugggaggccgaggcgggcgaaucacgaggucagcaguucaagaccagccugaccaacauggugaaaccccugucucuacuaaaaauacaaaaauuagccgggcaugguggugugugccuguaaucccagcuacugaggaggcugagacaggagaaucgcuugaaccuggaaggcggagguugcagugagcugagauugcaccacugcacuccagccugggggacagagugagacugucucaaaaaaaagaaaaaacaaaauacaaacuugccaaauaauaccauuaagaaauuaacaggaagccauacaauagaagauauuugcaauaaauauaacaaauaaagauccuguaucuauaauauauaaagaacucuuccagacaagccauuugaaaaauugacaaaaacacaggacaccuuauuaaaauggagaucuaaaugaacuaaaggucuaaaugaacaaguacucaauaucauuaauugucaaguaaaugcaagauaaaaauauaccacuuugaaauuagaacucuuguguacugcugcugggauuauaaaauggugaaacuacuauagaaaacaauaugaagagguuccucuuaauuaaaaauagaacuaccagaugacaaaaaaauuaaaaauagaauuaccccagaacuccugcuuccagguauauaucaaaaaaaaaaaaauggaaagcagggucuugagauauuugcagacucauguucauagcagcaguauucacaauaacaaagagguggaagcaacccacauguccacugauggaaggauaaauguggcguguacauacaauggaauauuauucagccuuaugaaggaagaaagugcugucacauacuacaacauggaugaacuuugaggacuuuauguuaaguaaagacauaguguauuauuccacuuaucugaggugucuaaagucaaauucaggggcugggcauggugcuucacgccuguaaucccagcacuuugggaggccaaggcaggcagaucacuugaggucaggaguucgagaacagccuggccaauauggcaaaacccugucucuacuaaaaauagaaaaauuagcugggcaugguggugcacaccuguaaucccagcuacucggguagcugaggcaugagaauugcuugaaccugggaggcagagguugcagugagucgagaucacgccacugcacuccagccuggaugacagagcaagauugucaaaacaaaaaauaaaaauaaagucaacuucaaagaaacaguagaaugaugguuaccagaggcugggggaaggaagcuggaggaaggggaguuuuguuuaauggguacagaguuucaguuuugcaagauaaaaaacuuuuggaggucgggcaugguggcucgugccuguaaucccagcacuuugggaggccaagucgggcggaucaugagaucaggaauucaagaccagccuggccaauaugguaaaacuccaucucuacuaaaaauacaaaaauuagccaggcgugguggugggcgccuguaaucccagcuacuugggaggcugaggcaggagaaucacuugaacccaggaggcagagguugcagugagccaagaucgcgccacugcacuccagccugggcgacagagcgagacuccaucucaaaaaacaaacaaaaacuuggagaucuguuucacaucaauaugaauauauguaacacuacugaacuguacacuuaaaaauaguuaagaugguaauuuuuauguguuuuuuaccacaauaaaaaccgaacaaaacaaggcaugaugauucaugccuguaaucccagcacuuuaggagaccaaggugggaggaucacuugagcccaagaguucaagaccagccugggcaguguggcaagacccaaucucucauuaaauaaauaauaauaaccaaacaaaaaaauaaccaccacuuuucacacucaccauggcaaaauuuaaaaaccuaacaauuccaaguguugucaaggcuauaggacaacugcuggugagagugcaaauugguauaaccacugugaaaaaaaaguuuggcauuauguaugaaacuugagcauaacauauacuuuauaagccaguaauaccucuacuacguauauauucaacagaaaugcauacguauguguaacaacauguauaaaaauguuuauaguggcauuucucguuauagccccaaacuggauaccacccacauguccaucaucaguagaauggauaaauaaauuguuguguaugcaugcaaugggacuacacugcaacgaaaaugaaugaacugcugcuacaggcaaccuggaugaaucucacaaacaugauguugagcgaaaggagccagacauaaaagaaugcagacuguaugauuccauuuuugugaaguucaaaaacaggcaaaaacuaaccuauggugucaggauagugguuaccuuuggggaggaggguggguaaugggaaaaggggcacaaggggaggaucuuuugaggugcuaauaaggcuuuaucucuucaccuggugguggaaacucaagugugucuacuuugugagaacuggguugugcacuuaaaacuggugugucuuuauguaugcuguucuucaauaaaaaaaauuuuuuuaaucacgguuuaucaggauucagcugcccauuagacaccuuucugugucucucucucucucucucuccagcucuucacagagguccuccaggaucaaggggaccacugauuccaccacugcugagucucccaccuccuccuugggguagaggcccaauucggagagggcuuggccccaggucuagcccauauggucgugguugguggggagucaaugcagaaccuccuuuuccggggccaggccaugggggucccaccaggggaagcuuucacaaggaacagagaaacccucgaaggcucaaaagcuggucucuuaucaagaauaccugcccgcccaaggaugacccccagguuauggaaggugagguccauuuuguuaugcccauuacucccagagugaccuaauuuucagaagaucauucacaaucuucucugggcuuuccuuuuugcuuuugaagcagaaguagaccucaauguuauuucucccaggagaaagacuaccauuccaaaauaccuggaaaugguaggggguagaaaaucaguucuccuucugucucugcguuucauuguauuuguuuucuuuguugcucaaauuuuuaacuguuccauuuucacuuguucacagacaaauccgaccgcccugucugccgacauuuugccaaaaagggccacugucgauaugaggaccucugugccuucuaccauccaggcgucaauggaccuccucugugagacugugccuucccauccaggcuggaaggagcucucugugaccuagcggccauuuauuucucuguagcccuaugauggcuacugugaggcucuucuaacacccucagucagugacacacccaucccauccaccacuucccccgugugggguccagagugguguugcaucacuggugcgcggcauacgcgcuuucuucugauccagccuguagagacucgccuuugggacccaucuuugcuuccuuucaguugccuccuggaucuucuuucccgucaucaaaugacugcugaacaggaaaccucuuuggugcuguuucuugugcaucuguccaccuguuccccaguauugcccucaauuccugagagcccuggagcgguuuccuaccauucccuucuuuuagcugcuuguuuuaaguccuuuuuaugugacauucccuacccccaauguugucagcugcuugugaaacucagccagguugucuaaccuggggucaaguuugggugacuggugcagaguuacuuccuaaaaggccacucucccugccuuuggauuucauaguuucucugucaguagcaugauccccaccgcuauggucuaucuaugaucaccgugcuuugugaaacugugcauccccuuguagccuuucucaguguccguggcauuuuugugacuucccagcacuagaauaaguuuuccugccaaaaugagugaggcgcuuggugcccucuggacuuucccacuucccaacaugggagaauugugaacuuuccaucagacugccucccuggcccuccccauucuucuccuguugguuauucugagucugacacagacccaugacaugucuuauaaagccuccaauggcuuuauccuaccuagaucccuuccagcccauuuuaauuagacuaugucauugugaggccaccaguccauucauuugaauucugugaaucuccaccuugccuaucuuuggguagaagcuggacaguacuguugcccucuuccaauccucuuccccuacaucccuggcacugguuguuuucugugaaaacagcagugaacagguucaguuuugaacuggcccugaggaaaugggucaggaguuguauuggcaagagggaggggugagagcuguuggagaacugagaaugagguuuuuuuuuuuuuuuucuuuuuaacuuuuuuuauauuaguaauaaaugcaguggaaaccagcau

SEQ ID NO: 18318 - RNA, 13060 nt, Homo sapiens
agccggcuuggcuggcgagcccggcugaggagccucuugggccgcacuuaccgccgcguccgcucccggucccuggccccucagcggcauggcgugcggggcgacgcugaagcggcccauggaguucgaggcggcgcugcugagccccggcuccccgaagcggcggcgcugcgccccucugcccggccccacuccgggccucaggcccccggacgccgagccgccgccgccguuucagacgcagaccccaccgcagagucugcagcagcccgccccgcccggcagcgagcggcgccuuccaacuccggguaaccugcccugcucuggguuuggcaggaagccaggcccaggcauuuuuugggggggguggugggggaggguugggaauaccaggccaguuuacccagggaccccuucuuugccuugagaaaagggaacugggaugccgcugggccugguugcuuccggugaugggaggcauccgggagggguaauggggccacagggucgguuuuagguuuuccugggggaggagagccuggagggguggacaccaagaggaagaugggaauaccucuggccgcuccgggcccucccugucgcugaagccccuccuuccuccgcuggccgggucugcaccgagcaacccugcagauccagugggccauggaaaauuggauucuacucacgaaccuggccuggagggcgggggugggaugggggcggguuaccgggaaggggcgcgagugcgugcuguuuagcccuguagggagacaugauuuccagaagucuuuaggaacccagaggccgccgcaagagucacggaauccgauuucaaccugauaauuucuaagggacuggccacguucuuuuauuauauggcuauugccucguaccauauauggcuugaaaucgguagaucauuagcuagaauuugagaauccuacgacauacggagguucuacagaacuaagaauguaacuguccuuaacagggacucuccuucaguaaggcguuccacuuuguccaaggaaaaggacuggcguuacaguagacaccucauagcgcaggaguagaggggagggugcuucagcauuaauauucugcgauuuuaaaggacuuccggaaaugaggggggcgucucaauaauggauuugggcaagucguuucuuuguguguuuuucuauuccucaagcuuaagcaaaaccuuaggcucaccguaaaaucauccuuuccaccccuuuucaguagcagugccuucagguuucauuuccuccuuccucugcauaucgauccacaaugcaaauugcaggcccucauccucacaccaagauuccuacacccagcuaaagcugucccagacuucauauccuuaacucgaguucaccuuuuuaauccuagaauucaaaggacuuaugaacugugaccauaucuuaccuagucagucucuuacacauuuuuuucaaacugugccucugcuuuuucccccagacccaccgcucugugcccuuaucauguuuuucccuucuauuugcuaaucccaaaagaguaauuucaagucucuuauccauuagcugacuaaccugcccauaaaaaacgcuguucuacuuaaauuccccggccauucaauguuguauaaccuuauguacaggaugagauaauguuugcaaaaguccauuuuaaagaacccucaaagacaggcgccauagauggccacuugcagugauguuuaguucuucccuagcuccugcagauaccuaaagauaguccauaaucuuuuugggucucacuucugcaaauuggaguucauacuugcgcuaucuuuuguugaagaacccucaagauaguugcaaaaaguauuuugaaaaguauaaagugauggguuuaauguaaauguuuuauucaauacuacuauccucuagacuaauuugguuguaguucacauuacaguagcugcuucguaagugauuuuugggcugggcgagguggcuuaugccuguaaucccagcacuucgggaggccaugguggguggaucaagagaccgagaccauccuggccaacauggugaaaacccuguuucuacuaaaaauagccgggcgagguugcguugagccaagaucgcgccacugcacuccagccuggcgacagagcgagacuccaucuuaaaaaaaaaaaaaguuauuuuuguuuugggggcagugguggcaugcacuuguaaucccagcuacuagggaagcugaggcaggagaaucguuugaagccgggaggcagagguugcagugagcggagaucacaccauugcgcuccagccugggccacaagagcgaaacuccaucucaaaaaaaaaaaaaaaagagaaugugggcaaggcgugguggcucacaccugcaaucccagcacuuugggaggcugaggcaggaggauugcuugagcccaggaauucgagacaagucugugcaacauaaugagaccuuguuuccacaaaagaauucuaaggccgggcgcaguggcucacuccuauaaucccagcacuuugggaggcggaggcgggcggaucaccugaggucgggaguucaagaccacccugacacacauggagaaauccugucucuacuaaaaauacaaaauuaguggggcaugguggugcaugccuguaaucccagcuacucgggagguugaggcaggagaaucgcuugaaccugggaggcggagauugcgguaagccgagauccggccauugcacuccauccugggugacaagagugaaacuccaucucaaaaaaaaaaaaaagcuaaaaaauuagcugggcaauuuuucugaaauccgaaaugcugcaaagucugaacugauccaaaaauugagugucaauaugacacucaaaggaaauacuuauucacuggaguuuuucucauuugggguaagggauguucaauugguaaguauaaugcaacuauuccacaauccaaaacuucugucucaagcauuuuggaugagggaugcucaaucuguaugguacuuuuuguggaaagguccuguaaaacuaagccuuuuauugcuuaaaucuuuauugagugcuaggugaauuccagacauggaagaaggggguugcugaccgcaggaaauauuuguaaacguaaugugcaaagcaauuaacugauuaugacuugagagucugagaauaacuucugaauuaagguagcauuuuagcugagucuuuuuuuguuguuuuuugagacagagucacucuguugcccaggcuggaguguaguggcacgaucuuggcucacugcaaccgccgucucccauguucaagcgauucuccugccucagccuccccaguggcugggauuacaggcaugugucacuacgcucggcuaauuuuuuuuuuuuuuuuuuuuuuuuuuuuuuuuuugagaugacguuucgcucuuguugcccaggcuggagugcaguagcaugaucucggcucacugcaacuuccaccucccagacucaagcgauucuccugccuuagccucccagaacgcugggauuacaggcgcaugccaccauucucagcuaauuuuuguauuuuuaguggagauaggguuucaucauacuggucaggcuggucucaaacaccugaccucaggugauccgccugccucagacucccaaagugcugggauuacaggcaugagccaccacacccggccuacuaauuuuuguauuuuuuuugucaagacaggguuucacuguauuggccaagcuggucucaaacuccugaccucaggugaucugcccgccucggccucccaaagugcugggauugcaugagccacugcgccuggcuagcugagucuugaucaaguuugagcaauagucccauuucgagcacagggaaaccaugagagcaaaguccaaaaaacccacaauuuaaggagagaauaauguaauguaacuaaauuauaguggaauccagauggaaccaggaaaauaaauugaggccacaucuuggaaaguauugacugccauguucaagaguuugaauuuugguuuguagcaguaggaacacuguagaguuuggaggaugggcuuagaccggaaaaaaucuggcagcacaaccucaaguaauggagggaaggauuaaaauuauccacuguuaaaaagaaauuugaguuuuucuuuuuaaaaaaauuuugugcuuuauauggccuucuacagaagaaaaucaugucuaacuuucuuauuuuucucccauggauaccguguuuagauucuuggacuucuuaguccuaccacccucaaaauuguaucuuuccauuuguuaacauugccauacaggaggcagagguuuaucaaagaccuucuguucucuuaagcguuguccucauacuuguccuuucuuguuucaaguauuugcaguucuuauccuuguauuggcucuggcuugaggaauaagacaucuuaaaauacagggggcuagcgguggcucacgccuguauucccagcacuuugggaggccgaggcgggcggaucagcugaggucaggaguuugagaccagccuggccaacauugugaaacucugucucuacuaaaaauacaaaaaauuaggugggugugguggcgggcuccugaaauccaaacuacucuggaggcugaggcaggagaauugcuugaaccugggagguagagguugcagugaacugagauugugcuauugcacuacagccugggcgacaggguaagacucucuuaaaaaauaaagugaggugaaaacuuaauaaauucaggaaucuaaaauacaaacuucauagcacuguuuuguuuuguuuuuugagacagugucuuacucuguugcccaggcuggaguccaauggggugaucucggcucacugcaaucuccaccuccuggguugaagcaauucuccugccucagccucccaaguagcugggauuacaggugcgcaccaccaugcccagcuaauuuuuguauuuuuaguagagaugguuucgccauguuggucaggcuggucucgaaccucaggugauccaccugccuaggccucccaaagugcugggauuacaggcgugagccaccauguacaggcuuuuuuucuuuuuuuuaauacugggucucguuauguugcccaggcuggccucaagugauccucccaccuuggccuuccaaagugcuggauuacaggcaugagccacagugccuggcccauagcacucuuguuuuuuuguuuuguuuuucuauuuuuuuuuugaggcagagucuugauuguguuucccaggcuggagugcaguggcacaaucucggcucagugcaaccuccaccuccccgguucaagagauucuccugccucagcuuccugaguagcugggacuacaggcacgugccaccacgccuggcuaaauuuuuuuauuuuuaguagagacgguguuucaccauguuagccaagauagucucgauuucaugaccuugugaucugccugccucagccucccaaagugcugggauuacaggcauaagccaccauacccagcuggcccauaacacucuuaaagcaucuccuacauuguucuaguauuuaggcugaaaguuagggacuuugacuauguguggaaccacuugaauucaugucaguuccuggacuguacugucacuuguuaugacauuauuguuaccuuuaguuuuuauuuuuacaaccuuaucagguagguauuuaauguuuacauugaagaaguaaagauccugaauaacuucucaagguuauagucacacagcuaguaagaagcaaaguggcauuguuaauaccucccaccauuaaaaaaaaaaaggugguuauagcaaaguauacacuagaauaauuugaguuguuugagauggauacagguaucucuuuuuuuaaauuaguagguacaaacaaagaacuugaaaaccacauccuuuuagauucuuuguuguuucuaggaguguauuucaaggugguuaguaauuuguguuuccugggcucccuuuaauaguguuagcaaauuugcuuugugauuaccuugacuuauaaucuccccacacacugaguugccucuuaggaucagaaaauuauuuucuaagcccugaccaucacuucuaggcauuaaaucucaguucuuuccuuggucgauguccacacuguaaacauaaugguuucugcugcccccuuucccaaaguuuauuuugauuuguuuuuuagauaaaucacccaggcucccuugugguuuuuuuuugagacgagauuuugcuguguuguucaggcuagucuccugggcucaagggauccucccgccucccccugcagaguagcugggauuacacccagcuuuggagccaccacuuccagcuccaaagaugcuuuuuuaaagucccauaugggacaagagcuuccuuguuagaaggucuugggcaguaugagacucaccccuuaauacccuagguugugaaauugcgaaauuuaaaggagauuaaaaaauaaucccuguuagguaaacagagguuucuuuuacuguaaauuguacuaguuaaccauccagcuaacugcagaucuuguguucuuugccacaggaaaacaaguaaagggaacucugucugguuuaugccaaaguagcuauucuuuuaugcauuguugaaauaguggcaauaagaacauacugucuuugaagccacuggggagugcuugguacgguauaaacguuuugcuuguuuaugucgggggagggggagauugagaccuacaugccaaagggaguaucuaaagucuagucagaagaucuuugucucuucccacuucugaagaaaguuugaagaaaugagacaauaaagugaaagcucaaguuuguuucuuuuuuauuagagcaaauuuuucagaacauaaaacaagaauauagucguuaucagagguggagacauuuagaaguuguucuuaaucagagugaagcuugugcuucggaaagucaaccucacuccucagcacucacagcaccuagcucuccagguaagcccacuuugaucugcaaaauucgcauuaagaguuuguaaaugguacuuauaaugaugaaucuagaauuggccuccucuaauguaauagaauugcuaacggggauguauuaauauuuacagauauuuuuaaaacuauacagucaugaaauuggaagaaaccucacauugauuugaugugcuuccauccacccaauacaagaauaucuuccuguauaacugcaauguguaauauuguagccagggugcaauaaauagccacaugugggcuauuuaauuuuaaacuaauuaaaauuagauaaaauuuuggccggcugagguggcucaugccuguaauccuagcacuuugggaggcugaggcaggcggaucuccugaggucaagaguucaagaccggccuggccaacauggcaaaaccucaucucuacuaaaaauacaaaaaaauuagccaggcaugguggcucgcagcuguaaucccagcuacucgggaggcugagguugcagugagcugagaugacaccauuguacuccagccugggugacagagugagucucugucucaaaaaaaaaaaaaguuuuuuuaaaauucuguuccucagguucaguagucacauuucagguacucauuagccacauauggcuguuguauuguacaugcaguuacgagauauuuccauaauugcagaaagcucuguucaacaggggcugcucauuauugacaaauggucaaagaggaugugcuaaaaaauagaaucucaagguuggagacagucuucauggucauguagugacucaguuuugccugccauauugccuccuguugggguucaacagcccaguguuugaccaucuccagugguggugaaaucugucuccuuuaacaguagaagagucuuauuuccucacaaaguauucuacuuaacaguucuaaagguuaaaaguuaccuugguuaaaaaaugucuccuuacaaaauauaaacugggguuugcccggaauuaggguuaggggagaaugaggagauauugcuugauggguaagggguuuuaguuuuuguagugauggaaguguucuggaacuagaaguggugguaguaguguaacauuuugauuaugcuaaaugccacugacuuguuugcuuuaaagugauuacuuuuauguuacgugacuuuuaccucaacaaauuauuauuuuuuaauccagaguuccuggcucuggaacugcacccuuucugauugcucuugcacauacaugauaaaccugucagugguuacaacuagcacuauucucuugagauuucaguaauauaauuuuaaaguaaugggauauguuaugguuaacaaaacaguuacaaauaaugacuagugagauguuuugguuagauuuuauuuguagagaaaaaaauauccuugaguuaguuuaagcaaaaaauuguuucaguguguuaaauggcuuacuggcuaacaaauggccaaagaaacagauuuuagccugagcuuugaggaacaccugagaacagggcugcugcccauguuuuuuuguuuuguuuuguuuuuuuguuuuuguuuuuuguuuuuuguuuuuuuggguuuuucuugagauuugcucugucgcccaggcuggagugcaguggcgucaucucagcucacuggaaccuucaccucccagguucaagcaauucuucugucucagccucccgaguagcugggacuacaggcgcccaccagcauacccagcuauuuuuuuguauuuuuaguagaggcgggauuucaccauguuggccgggcuggucucgaacuccugaccucaagugaucaacccgucuuggccuccaaagugcugggauuacaggcgagagccaccaugccuggccagggcugcugcuuuuaucaugaucagaaagccacuugugggauuuguucacuugccagcuccagaaccaggcugguagaagcuuaucccugugacuuaucucuguacugaauucaaaucuucugugagugaaccugauuaggagaaccuuuuuuuucuuuuucuuuuuuuuuuuuuuuuugaguccguuuugcucuuguugccccguuuggagugcaugcaguugugugaucucggcucacugcaaucuccgccucucagguucaagcgauucuccuuucucagccucccaaguagcuggaauuacaggugcccaucaccacguccagcuaauuuuuuguauuuuaaguagagacagggguuucuccauguuggucaggcuggucccgaacucccaaccucaggugauccgcccaccucgaccucccagagugcugggauuacaggcauggccacugcgcccggccuuuuuuucuuuuuucuuuuuuuuuugagauggcguuuuacucuuguugcccaggcuggagugcaguggcacaaucuugacucacugcaaccgccaccucucggguucaagcaauucuucugccucagccucccgaguagcugggauaaugggcaugcccuaccacgcccagcuaauuuuguauuuuuaguagagacuggguuucuccacguugucaggcuggucuccaccucagaugauccgccugccuuggccucccaaagugcugggauuauaggugugaaccaccgcaccuggcccaaacucacuuuuucuuuuggccagguuccucauggaugaagaaggaccagcccacauuuacccuccgacaaguuggcauaauaugugagcgccucuuaaaagacuaugaagauaaaauucgggaggaguaugagcaaauccucaauaccaaacuagcagguaggcccaggcagugacugccauugucauuaacaggguucaguuaaaaauuaacaccaguuaaauaacuuagaaaaagagaguaggaccucaugcaagggaguuuauugaguugcggguauggaaguuacucuuuggugauuguaaacacaucauuuauacauuauauggaaggacuuuuuuuuuuuuuuuuuuuugggacagaguuuugcucuuauuuuccaggcugacaccacaaccuccgccugccagguucuaacgauucuccugccucagccuccagaguagcugggauuacaggcaugcgccaccaugccuggcuaauuuuuuuguauuuuuagcagagagggggcuucuccauguuugucaggcuggucucaaacuccugaccucaggugauccgcccaccuugaccucccaaaaugcuuggauuacaggcgugagccaccgcgccuggccaagacuuuguuuuuuaaauagaggcaagguuuugcugugagcccagcucuaggagucuccagcuccaggccucaagaaguacuccaccucagcuucccagagugcuggcauuacaggagugcuacacaccuugcccagugggagggauuuuucauuugcauuucugaaaagaaacaaaccaagcucuugcaagaauuuuccauaucaaugaaggcauugaguaggccauuugggcuagcuggcugguaaacagaugguugugauacuguacuaaacucucaacagguguuguggaagaguucaguaacauauucaaacuuccuaguuaagaagucauaguuauggauguggcgaguugggugugauuugggaggaacaguagaguaaaagcaaggcuagggcagguuagaacaaagauagugauuaaugauggcaacaauuaaagccuuuugugaaagaaagagaucugaaucagaaauaggaaauaguaccuguuuagugaaaguggauaauauuccacauuaaaccacaguacucuaugucaagcacaaaucucaucauacuccuuuucugauuaaaguccucagcuguacccuaugggauauaggucaagaucuguugcuuagggugacagugugaguaauuaagaaauuuaugggcagcuuucaugcuuugcugcuguguaaucaucagagagugaagaagcacaacuuuuuccuguaacacuauuguuuccuagucuggugacccauacaacgugguuccucagaauauuaauagaucuguuuuacauugggagcuguuggguuaagcaaaguuaaaugaguuccuuuauaguagaacuacuuugauccuuuaauauguauuauaagaagaaggucuaggccgggcgcaguggcucacgccuguaaucccagcacuuugggaggccgaggcgggcagauuacaaggucaggagaucgagaccaugcuggcuaacacggugaaaccccgucucuacuaaaaauacaaaaaauuagccgggcaugguggugagcaccuguagucccagcuacucgggaggcugaggcaggagaauggcgugaaucggggaggcagagguugcagugagccaagguugcgccacugcacuccagccugggugacagagugagacuccaucucaaaaaaaaaaagaagaagcucuaauauaucauucccucucccacucccaccauaauacuguuucagucagcugguucugagucacuucuuuguucacagaugucaggcuaccuucuuccuuucuacucaguuuccccuuaaaaggugguacuucuguggaacuguuugcaguuagaugguauagauuuucacuuagcuuucuagccaucccacacuucuuccacucauguuuuucacucaauguguguugaaauuuauaacaaggaaagaguuucaaagauucaugucccaugggagaugggcugaaauuuccuggcuaugguagugagcuauuaauaggagauagaguuaugucacgggggagagguuaucaggaaaauaccauuauauaccaucagugacccauucuagaagccaaggauuuggcucuggguucuaagaggaacagaucucagugaccuuuauauaaggucacuggacuuuaauacaaggaccuuuauaaagagggccugagagggugaagaauucaaacugggaagcuauuugugauccugacgcuugauucuuaaaaauugagggagaguugcugaggauaaguauguacugucuucucacagaacaauaugaaucuuuugugaaauucacacaugaucagauuaugcgacgguaugggacaaggccaacaagcuguaaguauugccacauuuucuuugaauuuucuaaguuucaagagcaaaauuucuacacugaaacuucucuccucagaguaaaaagucccugugaaguaaaaugugcccagcacuaugcuaagaguauuaaauccacaccaaagcuuauauaagccucacagugacccuaugagggaguacuauuauuagcuccauuuuacugguaaagauagcauuuaaagagguuaaauaauuugcccaagcuuauacagcuagugguucagcuaggauuaaaaucuagguagucugacuugagcaccaauuuguuaccugucuuuucuccagaaagauaguuucaguuguuaauuuaugaaaguugauuccuuaaguuaguuuaucaaguguggucaggauuucuuauucuaaauaauuugcaacuaccagauauucaaagcauaaaauauuaacaguuguauaucuaacugaauuucagucagguuccuuaaauucuugaucuuuaguaucuuuuaaguggugagucaucguucaugcuauuucucacauuuacuguuagugaaaauuuuuaaagcaugacacuacaguuuuuaguauucuuacccuuuuuguuuuuuauucuuaauuuacagaugugucaugaagcuuugucacauaucuggguaccagguuugaccucaagagauggcugcuguacacuuuuugcaacugguuugaugucacauuucagcuccaacuuugcauccugagaacacuuaaacguuucugcagguccauuuuauacaacuugaaagaccguaaaacuuucugguugccacaagcauaucuuucuuuucugcucauccaauaaacagcugugcccuacugugauagauuuuccaaacaaaaauaccuggagcagcaguuuagcaaaauaugccuucaguggcauucaacaaau

SEQ ID NO: 18319 - RNA, 451 nt, Homo sapiens
aaauuuuuuuuugaucuuggggauucuggcugugaauuuggugcacgacaauuaugguaaaaaaacauuugcuuggucuaaagaagaucauuaauguuuugugaccauacaaguuguaacaguggauuguuuuuauguguagguauuguuaaauacagggacuguuuccaggcacagaauaugaaucguaaguuaggauggacauuagaugugauuaugaugauaaagcgaaggucugcgguccuauaucuacagacacguggugagaaauuagaacaaacuggagacgggccauugacacauggacucugccugggcauguuagguuaauucuuugacuccaagccuuaaaauacucacauggagucagcgcucaccucauucacacaauuaucauagagcucccuggacacugaaccucuaaagggaaaaggucuacccuggagccagg

SEQ ID NO: 18320 - RNA, 451 nt, Homo sapiens
ccuggcuccaggguagaccuuuucccuuuagagguucaguguccagggagcucuaugauaauugugugaaugaggugagcgcugacuccaugugaguauuuuaaggcuuggagucaaagaauuaaccuaacaugcccaggcagaguccaugugucaauggcccgucuccaguuuguucuaauuucucaccacgugucuguagauauaggaccgcagaccuucgcuuuaucaucauaaucacaucuaauguccauccuaacuuacgauucauauucugugccuggaaacagucccuguauuuaacaauaccuacacauaaaaacaauccacuguuacaacuuguauggucacaaaacauuaaugaucuucuuuagaccaagcaaauguuuuuuuaccauaauugucgugcaccaaauucacagccagaauccccaagaucaaaaaaaaauuu

SEQ ID NO: 18321 - RNA, 456 nt, Homo sapiens
uggcggcuaacacuaguaccagcuccuuacagcugcuacugcuagagcuuguagacaaauguaagaaucaaaaauucucauugugaugaaaacugauaaggaaauuguugauacucuucuaggauuugauaacuuugucaauaugguacugcaagauaucacugaguuugaaaucccaccagaagaaagaauacuaaauuagaucagauuuugcuaaacggaaauaauauaauaauguugguucauggaggaggaggaccugagguaugaauguguuuccuugacuuaugcuggauucuguuuugucuuguaaugaaaagaaaauagauuuuuuuuuuuuuugccuuuuaguguuuagauccuguaaagcuaaguuuccuauuaagggaaauguuuugaagauguauacccauuuuuguaaguuaaucaugauuaucuuggaaaagaagaaaagag

SEQ ID NO: 18322 - RNA, 456 nt, Homo sapiens
cucuuuucuucuuuuccaagauaaucaugauuaacuuacaaaaauggguauacaucuucaaaacauuucccuuaauaggaaacuuagcuuuacaggaucuaaacacuaaaaggcaaaaaaaaaaaaaaucuauuuucuuuucauuacaagacaaaacagaauccagcauaagucaaggaaacacauucauaccucagguccuccuccuccaugaaccaacauuauuauauuauuuccguuuagcaaaaucugaucuaauuuaguauucuuucuucuggugggauuucaaacucagugauaucuugcaguaccauauugacaaaguuaucaaauccuagaagaguaucaacaauuuccuuaucaguuuucaucacaaugagaauuuuugauucuuacauuugucuacaagcucuagcaguagcagcuguaaggagcugguacuaguguuagccgcca

SEQ ID NO: 18323 - RNA, 3031 nt, Homo sapiens
uacauuuuauuuaugagacagagucucguucugucgcccaggcuggaguacaguggugaucucagcucacugcaaccuccgccucccagguucaagcaauucuccugccucagccuccagaguagcugggauuacuauggacuauagccaugcaccaccacacccggcuaauuuuaguggagacaggguuuugccauguuggacaggcuggucucgaacuccugaacucaaguaaucuaccugccucagccacucaaagugcuaggauuacaggugugagccaccgugcccagccuacaucuacauuuuaaacacaccacucucauuugaguccgaaaacccuugugaaacuaguuccagaggagguuucagccauguccuuccucccagcuggagcccugcuugucuguccccgccuggcacugggucugaaauuggagagaagucauccucuccugacuuaugcugcccuccccaucucaggguucauugaucuucuaccccuccaauucaugucccucugcuucugacuucaguaacugauagucacuaugagucacaggacaccagacagaagaacuggaagauagaagaggucagagggaggggugugaggugaaugucaguguggggaguggggugaaguuucaggggcaggggaugcuguugacagauuucugugcuguaccuaagccuaggaguuagaaaccauucacucagaaagugaggaucaccuacuguguguccagcacugcauaacaggaaguguguuucuuugguagguggaauaguaggaguaaacugugcuuucugaggaccgggaguccuuuucccucccuccagcacccucaugauccuucccacuuucacccccacuggcaccagugcuuuuuuuuaauguauuaccucugugccuuccgucuguagaucuuacaggcaucugccucggaccucaggagaguagggcagaagcucuagcuggguauaaauugcacauaaccaucuccccaacguagcuacauaaagagaccagccuucuguccugaaaauggccgauuuaagauccucaccugcuccacuaggucucuaggugauauaauuggucaugagcuugaggaagacaaaagcacugaaaauucauaaagggacccugggcauggauugcugggguuguguuuagaaaccgaugaguuugugaggccuccgggaggcucccgagggcgcggggacuacguuucccaggaggccucgcgcggacgcccgggcggggcugugcgagggguggggcugcgggaggcccuggagcgcggcggugauggcggggccggugaaggaccgcgaggccuuccagaggcucaacuuccuguaccaggugagucugcgacaagggccccacggggacggugcucggcgucccagagugacugcuccccucccgcaggccgcccauuguguccuugcccaggaccccgagaaccaggcgcuggcgagguuuuacugcuacacugagaggaccauugcgaagcggcucgucuugcggcggugagacagccacggggcgggcggcgggcgggacgcgggaggaacgcgagagggagcgcgggcgccagaccacuauccuccuccgcccccagggaucccucggugaagaggacucucugucgaggcugcucuucccuccucgucccgggccucaccugcacccagcgccagagacgugagugcuccaacggagguggaagacugcggagcauugggggcgcggaggggggcgggguggggggcgggcacuggaggccaacagcgccuuucucacuguagauggauguugggugugggauucgcaggagucuuccuucuucggguuuggauuaaguuccuaacgccacuugcacaaacuaggguuugggcucggcuguuuuuuuuuuuuuucuuccagugugggcaauaaauaauaacuuuuaagaggcaaccccacccaugcacaauaauagauguuguucggcuuuguggaggacgauucccaucaccauucauuuauuaagcaaauacuuauuuucuaaaaugugucagguacugugcuagauucauuauucucauugaaauuacggucugaugggacagacuaagaaacaaaaugguguagaaaaagauuaacugggggaguagaaugcucacuuacucaugccagugguggcgaaguuuaugauaagcaaagggagugagagauggaaauucuaggcaugugugcagacucugagacaagagagcuuguggugcugucaaagaaaugagaguucaggaggcuggaguuugagguaggagggcaaaacaugagacuggagggggaaacaggccaguucuugaagucuuguuagggaguuugaacuuuaucuuaaagaguuccaggaaaucgauggagcuuaugccgaggccugacaccaucaaaugugcauucaaauuggggguguggugggggagcggggauaccuacugaaaaacacuggaggcaaaacuggcagcaagagaccguuacuucuaaacguggacagucuuuuucccauguucacccuaggcugcaggggacagcgcuggaccguacagaccugccuaacaugccagcgcagccaacgcuuccucaaugaucccgggcauuuacucuggggagacaggccugaggcccagcucgggagccaagcaggugagaggugagggagaaaauggaggacaccccagaggauagggacaauggagaacguagagugaagaggacacauggacagguucuggguuggugugagaaguaccacagucagaaaacuaauucuguuucucugauucugcucauuuacucagauuccaaaccacuacaacccuugccaaacacagcccacuccauuucagaccgccuuccugaggagaaaaugcagacucaggguuccaguaaccagugauggauucaccccaucucccaaauaaaguuuacuuguuuuacauuccaugauucuguucuguggguauuucaacucuu

SEQ ID NO: 18324 - RNA, 17429 nt, Homo sapiens
aucacuucaguggauccuuuguuccauauuauuuuaaccaaccaaaguaucuugccacaaagaaccacagucaaggcacaaagguaagaggaggagagucuggacaaaguccuguugaggugguaggaggaacugaaaugcccucaguaaacugcagauucuucucucagucauuucugugaagauuacccgaauagcagauaauccaaauugguuuaguuugguuuggcaugcaucacuuuuaccuuuuaugacaacauauguacccuauaaguuguuuauuuuggccuaacaugaaaaucauuuacauucucugaaaagggaaauggcaaagggugagggauggcaacaaacaagcaaaagccuggcuuaacaccaguuccaggccagaugcacacaagccaaaugaaguugccuaucuggcccuucccuauauaccacccucuuccacccuguccuuagggugagaaagacuccauaaccuuuuuuccuuucuggcuuggacaccuuggccagguaagaaggcugacaauuugggaguagcuacuaaguaacauucuuuaaggccagggcuuuguauacaaauacccuucucuuuccucuaauaccugacucuccuuuccaaguucccuugggaacacugugaaaggauagaugugucuugcaggaucucuuccacuuugccucuggagaggagcaaggugacugacuuauugguauagaggcaggcaauaagccaacucugcugaaggcugaggcagggaccuggguucuccucugcuuucuuuucagccucuccuucuccccacauuccuaccucuggccaaucuuacccauaaucgcaaccuuacccuuggaauagaagaccaaagaaaccucccuccucuucauuaaucucuaggaaucuguuccuuuagcccacuucccugacccuucuagccuuguugauguccaaucucugcccucagaaaaacuccucaauaucuagacccaugagagcaucugucauucaucucucaugaauucagagguacacagaccccugugaucuaccucaagaagcaagacuauccugggucaaagaacccccuaaaaagaugugcagggguuucuguuuccuccucugguuugagcaagucagacccucacagauuuuuuguuucuggaaaagccucuccuuccuuccugacccguccuugugcaacagaaaaccugauggacuucaggguagacaauccucugggaaccagcuccccacccugacaguuaggaggaagucacagcugugcucucucauccagcccaguccuaccucccccuccacacaaaaccauccuagaaaccaagguguuucuccaagaugauucaggacuggacccagguggacacgaagacguuccagcaggacacgggaaggaggcccguagcacuugacccugccucaccccagucauucccacaucccaaccugucacucccaaucuguugggggccugaugguaaguggugcagcauucuuccguccagcccggaugccuggguagaagaggggccaaaguuucucaguaaaaguaucagugaagguguagauaugagagcggucugugacauuguagaaagacagugugccggccucauagucuaggaauaugccuacccgcuuggguuucaccuugaugugcaaagggguaaaagguguggugguggcugcauauuuguccccauuccauagccgcacccgccaguagccagucucagggaguggagucaacucgcccuuucggcucacggagucccggcauacacccacugcccagugggucuugucgcccaccuccaccucccaguagugucgaccugaggugaaacccucaguagccaggacgcaaggguagaaggugaaacgccuuggugugucagggagaucccggagucuugucuccacgaacuugacgcucuuacgauccucugacaggacuagguuaggaugagcugucucaggguccagggucacauccgcuggcgggagaagccagaguggggagcuagaugaggaugggaauagcuaaaugccccugccucacucuuccagccugccuuuacagagccuggucccuuaaagguccccagaacaaccugguuugguuaacuuucucaauccauggugucaccuaaggaaggggagaaagcaauggcucacuucucacccugacccuaaaguaaacagauaauaaucucuugagucugcaguggcugguaaucuagguucccgccugguccucucuucaucucccucugacauuaucauuuaucucacuauguagagaaguacaagguguagucugaggggcagaaaaaaacggaaaguguuaagaaggaugccgagcaagacagcauauggucuagggauagggugaccauguguguuuuccaggaacuggccugguuuaugacuauuuucccugcauauucacauuaauauaaugacacucccuuucaguuucuuucuuuuuuuuuuuuuuugagauggaaucucacucugucccucaggcuggagugcaguggugugaucucagcucacugcaaccuccgcuucccagguucaagcaguucuccugccucagccuccagaggagcugggauuacaggcgcccaacaccacaucuggcuaauuuuuauauuuuuaguagagaugggguuucaccguguuggccaggcugaugucgaacuccugaccucaagugauccaccagccuuggccucccaaagugcuaggauuacagaugugagccaccgcacccggccuuugaagguuaugcaaguuuacaugguaaauuauauaaccacucuacccgaugacuuuggcaaauuauuuaaccuuucugggucucuauuuagaaaagaauggaccuaagaguagauaacgcuuaaggcuuccucucacuccaaguucugugacucagggugagacuaaaagccagauaaagggguaggugugugugggaguaagaaaagugagacauaggauaacugaaacccauauaagguaggaccuaaaaacuuucuucucucuagugguuucuucuaguuuccuuuugggaacaacucaccaauuagcuguuuaaggauuuuccuuagggcaaaguacugucggggaaaauugcugaaguucuuuuccagcucuauggauacugaagucaccuccauggucuucaccuuuucacaucuaggagggauagggagauaggggaagaaagggcaggguuagggagaagcuccagccaagugacuauucagauguuaacauuuuuagggagaaauuaaaauucuccaucuucccacuuucuuccuccucccugaaaagcucaccuguugauuucuuuuacuaauccaaggagagccuuaugaucccguggacagaucguugagagugagccuccgaacuuucuaggaauauuccuguauuucaugcaaauggaugauugcccucccugcucucccaaccccuuccuccugccaucuuguuuggacacaauuccacccacuggcacaaguagaaucugauucuaccuuaucauucuccuucucaagaaguccugauguucaaaggggaaaagggauuauuauucccaauaauuuguucucuaacuggcuucaugggcacaaugaacauucucccauacccugcccagacacacuacaugacuuucccaaccucacccccaacccaaacuccugacuguaccccuccucucuaagccaagaccuaacucacucagagagauacaacaaucacuuacuuuuccaggguacuuuugacauccuagaaggaaggagaaaagaaagcaauauugguccugguauucagugguccugaaggcaaaagguucccccuccuccccaaaguuccacagcuauaaaauagggauaggauaaacugagggucacacagugcaagaagagcuccagcgggaccugaaugcacuucucccaaccuaaucccuacuuucaacuucuggucaucaugaagcuuggucauuuauaucacuucccaaugauuucuuuuaugcuugucuuugcuccucaaggaugcugggagcucccuauaagggacagggauuguaucaauucuuuacucugucccccaaguaccaaccacauaucucacucuccuugaggauaaguacagagaguuccagacugguggcauaggaacaaaucacacauuccuguuacgguuugguauccccugucuugcauuaguuaauaaacaucaauaacuggcugggcacaguagcucacgccuguaaucugagcgcuuugggaggccaagacggguggaucacuugaggucaggaguucaagaccagccuagccaacauggugaaacccugucuuuacuaaaaauacaaaaauuagccaggugugguggugugcgccuguaaccccagcuacucaggaggcugaggcaggagaaucgcuugaacacaggaggcaaagguugcagugagccgagaucaugcacugcacuccagccugggcgacagagcaagacucucucagaaaaaaaaaaaaggaagaauaaacacauuaauaacugugugcuaauacugauuugugaauacuugggguccagaagacaaagaagacaaaucucugucccacaaggauuucccaguuuaauauggaaggcagaacacacauacaugaaaggccauaggaacaaauaccaagcaauacguaacauaaaaauaaauguacaaugaagccucacugcuucaaaugcugguaaucuaaucucuaagauaaaaaauauguucccuaguuuugcuaacaccauucauuuacguaagagaacaaaauauuucaaacacuuuagagguauuauuaauauauacauaucaaaagcaauauauuauuuaaacaauuucaggcauaccucauuuuauugcaccucgcuuuauuguguuuuguugacauuguauguuuuucagauagaugguuuguggcaaccuguguugagcaagucuacuggcaccauguuuuccaacagcauguguucacuucaugucucugugucacauuuugguaauucucacaauauuucacacuuuuucauuauuauaucuaguaugaucugugaucagugaucuuugauguuacuauuguaaucguuaugggggcacugugaacugcauccauauaagacgaacaacuuaaucgauaaauauauuuuauguguucuaacugauccacuaccagcuauucccucaucuuucuccaucuccucuggccucccuauuccgagacacaacgauauuaaaauuauaucaauuaauaauccugcaauggccucuaaguguucaugugaaagaagaaucacaugucucucacuuuaaaucaaaaccuaaaaauguuuaagcuuagugagaaaggcacauugaaagccaagaugggcugaaagcuaggccucuugugccaaacaccaagccaggcugugaaugcuaaggaaaaguuauugaagaaaauuaaaagugcuacuccagugaacacaugaaugauaagaaagugaaacagcuuuauugcugagauggagaaaauuuuagugaucuggauauaagaucacaugauucccuuaagccaaagcccaauccagagcaaggcuguuaacuccuucaguucuaugaaagcugagagagguaaggaagcugcagaagaaaaguuuaaaguuagguagguuguuuuaagaaaagaagccaucucuguaacaaaaaugugcaaggagaagcagcaagugcugaugcagaaguugcagcaaguuauccagaagaucuugccaagauuacugaugaagguggcuacacuaaacaacacauuuucaaugucaacaaacagccuucuauugaagaaggugcuauccagggcuuucacaguucgagagaagucaaugccuggcuuuaaagcuucaaaggacaggaugacuuucuuauuagaagcaagggcagcuggugacuuuaaguugaaaccagugcucacuuaccauuucaaaaauccuagggcucuuaagaauuaugcuaaaucuacuuuccuugugcucuagaaauggaauaacaaagccuacaugacaguacaccuguauacagcaugguauacugaauguuuuuaauuaaaaaaaauuaccuuuuguagagaugggguccugcuauauugcccagacuggucuugaauuccuggccuuaagcaguccuccuggcuugaucucucagagugcugggauuacagaugugagccaacgugccuagccuuuacugaaguuuuuuuuggggggauggaguuucacucuugucacccaggcaggagugcaacugcaugaucuuggcucacugcaaccucugccucucggguucaagcgauucuccucccucagccucccgaguagcugggauuacaggcgcccaccaccaugcccagcuaauuuuuuuguauuuuuaguagagauugggcuucaccauguuggccaggcuggucucaaacuccugaccucaggugauccaccugccuuggccucccaaagugauaggauuacagguguaagccaccgugcccaacccuuuacugaaaauuuuaaguugagaccuacugcucagaaaaaaagauuccuuucaaaauauuacugcucacugacaaugcacuugaucacccaaaaguucugauagagauguaaaaugagauucauguuguuuucacguccgcuaacacaacauccaaucggcagcccauggaucaagaaguaauuuggacuuucaagucuuaauaaauguauuucauaaagcugcuauaaauagugauuuuucugauagaucuaggcaaaguaaauugaaggcuuucugguaaggauucaccauucuagaugccauuaagaacauuugugauuugugaaaggaagccaaaauaucaauauuaacaggcauuuagaagaagucuauuccaacccuuauggaugacuuuuagggguucaagacucccauguuguaaguaacugcaaauguggguuuucaaagauuuucaaagaaguucuacuggugaguaaaaugcuauuaaacagcaucacaugcucagagauaucuuucauaaaaggaagaguugaaaguaaacuucgucguugucuuauuuuaagaaauuaccacagucaccccaaucuucagcaaccaccaccucgaucagucaauacuaacacaagacccuccaccagcaaaaauaugauuccacuaggaaacccaacaauuaaugugacuugcuuuaucaagauacucgcuuuauugaagugguauggaacugaacccacaauaucucugagguaugccuguauccuuuaaacuauguuucuguccuuuuucagcaguacauaaaucaaauuucaggacuuaaaaguaaugguaacugcauuuacaaaauuuuuaaugcauaguuuuucacuaacucaggcuagacuucccuccuuucaaaagaaugaaucuuuucuuuggaacagauuaagcacauaauugcugaccagagauaagaacacaaaaaugguuagaaggggaugggagaaaucacuuuuccguagcaaagacccuuugaguacaccuggcagaaagaacuggauuuagagaaggagagcagaagaaugaguaucccaggcugacaaaucccaggcuacgcaaagcuacgcugcacucagccugaggggcuaugcaggggcaaaggucgaaccuuaagcaucucgaagccugacuguaagcacuugcccuccaccucggcagccaagugggccaggucccggcgcuuguccccaaggugagcagcauuuucucggagucgcugcagaauguccuguuccucuucuuccagucgugaaagcaacaccugcugcucuucauccagccgccuaugaagcucuucaaacucccucaagaucugcugucggcgacuuuccacuagucucugagaagagagggaagauguuguaucagcagggucagugugguauaaggaagccuuucucucacccaccauauguaugaauuaacacagacuuccaguuucauugaaaaugguuuaacaaaggcuggguguggugacacaugacuguaaucccaggacuuugggaggccgagggagguggauugcuugggaugagaaguuugagaccagccuagguaacauggugaaaccccaacucuacaaaaaauacaaaaaauuagcugagucugguggugcaugccuguagucccagcuacuggagaggcugaggugggaugauggcuugagcaaagaaggcagagguuggaguaagcugaaauuguugcaccauugcacuccagcuugggcaacagaucgagaugaaagacagacagacaggaaagaaagacagaaagacaaagacagaaagaaaagaaagaaagaaaaugagagaaaaugguuuaacagaacacucauuuuuuauuccauuggaauuuccuucuguaaagaauggcuccaucacuaucaccccccuacugaugacuugguagugaagaccacugcggauauauauauuuguuuuaauuuaagauaaagaacucaauaauaugaugacauuaacuauuacagauaucagagauaucuguguuauuaucaacuguaaaguucuaguuaauucaaucugucgagaaaaggaaaguauaggcucagcaugguggcucaugccuguaaacuuagugcuuaggaggcccaggugagaggaucacuugaggccaagaccaaccuaggaaacauagugagaccuuguuucaacuaaaaagaaaaaaaaauuagucgggcauggcaaugcacaucugcaguccuagcuacucaaaaagaaucaagaggauggauggccugaacacuggaguuugaguuagugugcugugaucacuacugcccuccagccugggugagugagauucugucucaaaacaagcaaacaaaaaacaacgaaacaaaaaggaaaguacaaauaauaaaaaguuaaaaauaagauugucauccuuugcauauugcaacacaugcaccagauaaaaaccagagaacugggaaaguguaagaaucaguaagaguuauauggguuauuauaaaauauacauauguagauuucagggcugaacuuguuaaauuguuucaagucacuucagagaacuggcaauuccuaccccaggaacagguuacagaaguuuguuaguaauuuaguuucuugaaauuugaaacaugcuuucuuuaagccagcacacagacuuaagccucuaacauuccugaaauuugauaauauaggacucaaacaccagccauaacacuuucugagaauuaucagcacauccucucuucugcaucuccacuacaacaaauagugaucucccuaaagaauuccccaagcaucaugugacugaugaugaagcaaagugagaagcagagacugggacucuagaaggaaguggauagggaaugaaaggcaggcuugaggguggagagagaguggggaugcaaagccaggaugggccugacaagcguggcauuuguggauucaagcuaguuccuggcagaggcugacuagcucuucuaguuuagggccacuugcugcuucacuuuccaccacugccuucucaguguacaucugaacaaaauauauucucacauuugcccucaauaaaacacagccuuuguguguguguguuugcacaugugugugcaugcauguguguuuguuuagguauggguguaaguuuaacauucaugacugugauaaauaggaagcaaaaaggcccuuccucuuauaaaccgguaaucuuuucucuuuuuuucacucuauauuuuagggcagugguucuugaugaagcuguuaacacacucugaggauauuuuggaaauaggcacaucuucuuguuuuccaugguuggggaaguuccugacaaugacgcaagcacuccuccaaugugugagacaauccggcauagugaacugaccugcaacauuuucuaauguucugcuggauauucaaaaacacaggccugggcggccaggcacgguggcucacgccuguaaucccagcacuuugggaggccgaggugggcagaucacaaggucaggagaucgagaccauccuggauaacacggugaaacccugucucuacuaaaaauagaaaaaaaaaaucagcugggugugguggugggcgccuguagucccagguacuugggaggcugaggcaggagaauggcaugaacccgggaggcagagcuugcagugagccgagauggcaccacugcacuccagccuggaugacagagcgagacgccgucucaaaaaaaaaaaaaaaaaaaaaaccacaaaaacaaaaacauaggccugggcuugaaugccauuuuauauaguauaaacacagaguaauucuuacaugguuuuacuauacgugaauuuuucagcaauagcugaauaaaacccaagauuauauuguuauacuuagaacuuuaccaaaaguuauuacuaugaaaaaucauaucaccaagagcuaagcuacuuaugguauuucaaucauauuggcacacauccaucucagucugaauuuguauuuauggcguugcugauaaugacacauauaggggcaagcauauaaccagcuacacuguaaagucguucaggguagucaugcccaaauauuacauaccacauuuuaucaucaauuauguuucauuauauuauauuuggacaugauagacucuuuaaaauuuaacauuaugcacauagguuauauuaccuguaauuuucaguucagcauaauuacaaauuauuuuuuaaaggggcauugagucugaugagggagaaggagggagaauucaaauggucacaagaggaauguuggugguaguuuuggagaccacugaaaugacaauuuacaguuuaaaaaacaggacaguucuguucaagcauuuagaagguuuuaaaaagguauauuucucucuccauccuuuaccuucaagaaggugaucaacaugaagaagaaaguuaaugacuagcaauaagcaccauuuucauauuuuuagguuucuuggaaggccucuaaaagaacaaaaaacuuuaaaaguucacauuucuaaccaaaauugguucaaauuuuaaaauuucaaaugcuuacuuugcuaaaauguauaaggcacuaagguaauaauacuugcuuucugaugaaauguuaucauucauuuaaaaauucauguuucuaugaaucaaaacuuggauuuagcuucuggugaucucuacaugucaacucuuaaaaacucauuacuucuucgggaaaccuuuaaugaggccaaauuucuauguugucuucuuaugaacuugcagcugugcauuuugugccauuacuuauuuucuccacuuaacuuuaagcucaaggagggcaggaacuguguuuuugcucaucauuguuccccagugucaaauaccggguuuggccuaaaccaggagcuuaacaaauauuuacugauucacgaagaacuaguauuccugguuuugccacuuacuggcuuuaugaucuuggacuagucacuuacccaagguccauuuccuucuguguaagcugaagguaauaauaccuaccuuaaagaauaucuagguuuaccccuacaucuuacuaaagauggccucaggauuuccuucugucucuuucucguagcuuuucuaugucucacuuaucccaauuuggccugaacucuaagacccuaacaacccuauaaaucuggaauguuacggauaccuaaugaauuaaugcauaggacucaauucuaguuauuuuugcuacaaaugauaauuguucacuguucaauggaagacagacagacaccaaaauaccaugcuacaaauaaggcaaugcuauaaaagaggugcaaaauuguaugaaaauuaagaauguuaauuucugaagggucaggaaaggcugcauaggaaguggcuuucaucccgccugagagaugaauaagauccuaugguggaggauggggagggggagaacauucuagcauauguaagcuuacuugaguuuuaagaaugugguccuaaugucauuagauaguucuucugagacucuuggucagcuccuuuucccuuucuccccagugaaucuuccauauucuccucucuucaaguccucuaagaaacucccaucccugccuucucagcagaaagccuccuuugcugcuuuaacaaaaaaaggagaccaagaggcacgaacucucucagcucaccagauguaagauauucugucuguucuucaucucuuaaaucccucuuaauacuuaauucaugacaaguaauuuaaguacaauguuuaaugacaaucaagccuaauaaaaugccaucauuuuugagagaacuacauuguucuuuuuuuuuuuguuuguuuuuuuuguuuguuugagacagagccuugcucuguugcccaggcuggaguacaauggugugaucuuggcucacugcaaccuccgccucccagguucaagcaauucuccugccucagccgcccaagucgcugggacuacaggcaugugccaccaugcccggcuaauuuuuuguuuuuaguaaagacaggguuucaccauguugcccaggguggucucaaacuccugagcucaagcaaucugcccaccuuggccuccagaauugcugggauuacaggugugagccaccauguccggcgagaacugcauuuuucuaaugaaccggaacugguggauuaaauaguguacaguuaauucccucauaggcaaauacccuucagagcagccuacaugggauugccugccuuuaccuugagcucaccaggcuucuucuccucagaggacuugcagcgagugaucuccugcagcuucuguuccaggggcuccagacacuucugcaguuuuuccugagggguagggaggaagugggagaggugacauuugggguugacugguauaccuaccauucagagauuaaaccauuuguuuuaaaccauuuauuugcuuccuagccaucuuacugccucuugaucugacuuccuuccuugccugucauuugggaugucaacuuucuacagucccuccuccugccacuagccuguccacaucaccuucucugcucacccaacuguccuuuuacugaaucugagauagcugucaucaacucuguguccuuucucaacucuuuccauuuucuuacugaggcaacugccuauuaccauccaagcaaccuucuguacccuaauaucucucuuuaaaccuguccucccauccaccucuguccaccuacaauaaaaacaugguuauuauacuguaaguuaccugaaaucuuguuuucaagaguaacauaacuaagcaaaguauaugauaaaaugcuaacacauucauaucucuguucccuuuauucaaacauuuuccuuugucucagcaguaaguuaaaugauaugccauguuacccauuaccuagagaagcugcaaacaauugaaugguucagcuuaguccgguagguaucagucucaagcgauauuaccuaugcccaauaaccagugugaaaacaaggagcauucugagcaggcaggcagaaugaagaaaccagacuacuuuucaguucuuccuaaguuuaaucuuuuccaugugguuucauucauuuaugaaaaauaugaccacacauaccaauauucacccauaagacucacauguauugcaaaagucagagagaaauuuuagggcacuucucaccauugcucuuuuucaggcuagaggacaacugaucacacauacugugugccccugcauaugcagcucugagaauacaaagugaguaguaggagcuuacgaucucuaccuagggaguaucucauccucugccgcuucucccuuuuuacccacacugacaucgugugucugcuuccccaccuuguacuccuguguagcaucguccaguggcacaacggugugggcccggugggugugggaaauugcacauaucaagcauacagccuccugguccucauaacagaaaaggcugagggccucaugguguugggggcagaggcucucaucccggaucuuccgcuugacggccuggagcugcuuggcaauuuccaccauacugccuaguugccgauuaggucggagacugcgguagcgggaugucuuucgacagacaggacaagggaagucccucucuagguccucccaccagcgggugaugcaagcuuugcagaaguugugcccacacucaaugaugacagguuccuucagauacuccaggcacacagagcagcucgccuccaccuguaaguucuccaaagccgcagcuguagaggcugcagaggccccagccucuaacagacuugucucugccauaauuuaacuugggaguggggaagaggacagagaaaauaaaaauauuaauuggagguuuuuucuuuuuuuuuuuuuugcaucccugacccgacauuuaucccuauguuaaguccuaacuccagauuugccccuucuuguuauucuccaucuucucuuccaaucaauucaaccucuuuguuucuccauuuucaaaacuugugacucccagccaucaaccuuuuuuuucuuguuaguaaacugacacacaacccccaauugaucuaucuugucucuuaccucugcuuucucuuguuagaaagagaagcuuccuucaacucuagcucagcauacuucuccugauccaggcucauuccacuuauaucuuagaaccaauaguuccagacacuguauccucguuugacauacguuucuaacagacaagaaaggaaucugagaaguaaaaaagucauaaaaauauuaacauuucuuaaauuaaccauauuuuaaaguuuaauguuauaagagcuuuaugauuaauccacuggagucuaagcuugauucucugacacuguucucucauucuucuaaaucacaauauccaaccuuuuggcuucccugggcccacuggaagaagugucuugggccagacauaaaauacauugacacuaaugacagcugauaagcuuaaaaaaaaaaaaguccaugcauaacuuuuguucuaucaccaccacagaagguccaugcauaauuuuuaucagccaccacagauaagcaaagagaguccucauauugaaaggguuagauaccacugcucuaaaggcuaacaaauggaaugaaugaggcaaaggcaaccuccucuuuucaggaaaaucugaaauuauucuuccuuuuauccaucagacuagccuaaaggaaaucugcucucuucuuggaaugacauuucacgcaacauuccauuucucuuguguucaucuggacacucagaacugcugaaaacugauaaauuauggcaaccauauuaaauauugcugagcucaggccaacgacuucuugaaaagagagcaacgagucuauuuguagugacuggaaucuuucaauauagcuauugauaacuaacacccugggcauagugugucuccaacuuauagguccuggagugguugcgaauuaagagacacaaaagaggcaaugagaucucccucaagcgcagccucagaagaauuggaaaugcauaggagagauuuauaaaacacaaggcuggcccccuacuccauccuuaaaacauccauacuuuuagccauggguaaguugauuuaacuauccccauaaccuuuucuccucccgacccccauccuucuccagggaccuacuggaaggaaggaaauuugguagaucuaugugcugagagauaaguggccauguaaugagguagguuaacaacaauuguuccuguauauauuguuggcacacacaaauguguuugauuuggaguaggaacugauaacuucuuuggauuugaauuucuucugucagcaauaggagagaaguucagucagaugauuucuaucugugggaauccaacuuugacuuguggugauccuaccccuuccucagucuuuuacaaauuaaguggccuccucaccugagacgaguagaacuguaugcacaguaaggcaccaggacggaucuagacuggcaaagaaguggugagagaaauggggaaaggguuagggaagaagggagaggacucucaacuacagucauagugagaccuugagugccucugcguuaguccuuccucuuccucuacuccuugugucucagcugaagggcaaacuucagggacaaucucauuuuguuucuaccacuguucagggucccaccuugcgacccucuccugagagguuguccacaacucugucccacccccguucuccaucuucuuccgccagaucuggggcuggggcauuggagaggggaaagaggaaacgucguggcuggcaggguaggaagggaugcguguccaggugagaaagaggugugacgugcagaugggaugcccgccgcuaugacgcugccgagacccgcggugacugcgucagaguuucacccggggaggugagcagcagcgggacgggggaacggcgggguagccaagcaacgccggacgcgcugacgucgccggggcggcaaaacguccgcccgggcccgaggcgggcggaggcagcugugguuacgugcggggggccggugacgcagucgcggggcgcugggacgcggcuugcggagccggccggcgagcgcaggccccaggcucgggcgcggcggcgggacagcaccuaccuucccggcuucggguccgggagugcggggcgcggagccgccggagcgcugccucccuccuuccuccuccccucgcccccgccccgcggcgcgacacacaauacucgccggaagcggaagccgcgccgaggcucgugucaguggaagcuggggugucggcgggcggccgcggccgggucuagcggugccugcggaagaaggaggaggagggcuggcgaugagaagcagcagggggaaucaagggcaagaagggacccagaggggcagguggcugagaugcuggcguccaggugacccgaggaauccucuggagauacaggcccgcgcaugcgcgugcucgagcgcugaagcccauugcccgcagggcgcuggacuggcgccccggccggcgaggcugucuaguccaggcuccaggccccggcucuggccaggcgccgccgccucccggugcagcugaaagucgacgaagagggcggggcgggggcggcuuguggacuuccacacuuuuccucucuucgggccagucuggggagaggguggcuagcuguggcggcggccaauuacguggcggaccugcggggcuaagcuggcacgucacuuccgacuaguggaguuuuuagccuuuuaacauucaaggauuagguaaguucuccccgcgguagacuucaaauacucuuuguccugccccugcuug

SEQ ID NO: 18325 - RNA, 1679 nt, Homo sapiens
uucagaguuuuaguauuaaucguaugacuuuaucucucacuucgggaucacugugcucugcuaagucuuggaguuucugaccaaacuguuuugcuuccuggaauauugaaauaagcucagauuuagugaacuuuuccuugguaaauagcuuugccuuuguuuugaacugaaaauuuauauucucaaauauuucaauaauauuaagaauauuggccuuugacucauucuuguuaaagggugcaaccaaugaugacaguacuuuggcacugaucaauucucuuguauuggcgugauuuuuagacaaacacgaaaacacuuuuaaaacauaaaacuugguuuugacacuucccuuguuuaacaaggugaggaaaucuggaauauaacugguaaucacauagugaucuucaaauuuuauacucaagugcccuaguaauuucaguccagccagcugcacaggggaguucaaggggcaagagauuaugccuuuacaaacuugauguauauaugacuccccugauuuugguucuucggaagacucagagcugucauccaccauacuuaaagcuccaggguguucuuuaacauugggauuauugaccaaguuuucaaucauaacaguaauaccuacaucaugaauuauaucuugaguaaauggauaagcaggacugaugcccauuaucauuguagcuauuucaugaaugaaaggauccuuaguuaacuuaaggagggcaacaaguuuaucaaacucuuuaggcucuaaacuaaagccacgugauuugcaguggcaggccuucggauuaggcccauacuuuucccuuugccuaaucuguuuuuugaucucagcuaaggucugguaauaaggcccaugauaaggugggaucuuggucaaaggucgaauccccagaggaguuucaaucaaggucucaaccaggguccaguuuccuucuggaggcaaggauugcuccccuccuucaacuggaacuaggacaauauaccuggcccuugaccaugcuauuaccuuuuguuuuauaguaaguguggguuugugugugggcuugggcuuuuccuggaucuuagguaggggcuuauaaacuugaagagaggucucuucuucaggccagaaccaggacccuacacuaggcucuucuccaguccagaaccaggagcauauauuuucuucauccucaucacuggauuucaucccaaugcuggucucuucccuucugucaggucuggacccaguauuggccuuaucaugugacuuggcauaggaccuaauauuugccucaaugacagcaacaaccuugacuucagacuugguuacaguacugacccuagacauaggcauggccuuugacuugguuuguggcacuauacugcguucugccagggguuuugucuuagucucaaccaugacucuagucuuaguuguaucuuccaccuugaucacuucccuugucacagccauagccucccuguaggucacuguauguguccuggucauugcuccaucaccagcuuuggccugggucacugauucuguuuucaguucugccucagccacugccucggccuggguuuuaccauucacucuagcaguggcaggaccacugauuccaucuugcaggccagccucagccuuuccucuagcccuugcuucugucccagagucaaccaug

SEQ ID NO: 18326 - RNA, 9351 nt, Homo sapiens
auuggacacauggaauccagaggucugugagucacacuuucuuaggacauucucuacaaguccagagaaaugaccagaagggaagggaaaggaaggggcccugggguccacccagggcugauaaaaaggcccuaagcccuacaaagguggaggcaucuucaggugugugucaaaguacgaaguuaacuguacaaauuagugcaaguccagcaaaacccugauuuuucccaagauaauuauuuugaaacaguuuaaacauuuuauuuuagaugucuuuuucuuuuuuuuccccgaaagcccgcuggcuccuagguuggcuguugcccuaggcacagccgaagccgucugugguucugcacucugagguacagagaaggccagagcgucacagggaggcucaggacgucagggagcugagggccuaagauaaauaaaguaaaaacaaccgcuguucgagacucaaguccccuguucucucgccucacgcgggcacagggagcccccgggccgcacacuggccaggggcggagcuggaucccggagagccgccgucuccgcuucgccgcccuucgcgcgccccacuucagccuuucagcguaaggcaggaaccuuuuuuccagacggcaaagaaagggaagacuuugccggagaaagaggcagugaaggugaagaugggcuccugggucugggcguuguggagggucaccugccccgccucguaguccagggcgacucucacgccgcgcgggaucucgcucagcggcaggucggugcccggggaggugcuggcccagcacugcuggugcgagaugaucacggcccagacgccguccucggcgcugagucccaucucucccuuccuccucacccccuccccggccacccccaccgugcagccgccgccgucgcccagcugcaggucaaccugccagcgguggcgcccggaggagaagcccgggaagcccagaaccgccgggaggccgucgaagcgcagggggcugucuggcaggcucuucuucugccggguguaccucacugacuuccugucuuccgagagaaccaggcuccggcuggcggucugaggguccagagugaugaccccuagagggaggagcgcgcagacaucaacagcgggcggcaaccacagauguuccuagagcaggcaacgcacgugggaggcagaaggaguacuggacuugggcagccugccauugggccacuucucugaaccgcccuucuaccuaaucagcaaguggugcuguuaaggauuugcuucucaaagugcagcgggagggaccagcagcauccccaccaccuggguguuuguuagaaaugcagaauauugggccccaucccacccuacuaaaucagaaucugcauuuuaacaggaucccuaggagacguuucugcauauuaaguuugaaaagcacuuaccuauaccagagugagugaggugaugcuuauggaaacaacuucuaaauuaagcaccaauuuaaaaauaaaugugauuuuuaaaaaauugcacauuuuuuguucaaaucaguagagagcccagcacaaugcucucaaaaaacuagggcuugauaaguauuuuucaacgaguaauaucuacacaaguagaugacauuaauugagcacuuacuaugagucagguaauauacuaagcucuuugcauguauuaauuuauuuuguccucacagcuacuuaugggacagguacaguacuuuuauuuucauuuuacugaugaagaaaauauugugggacagaggcuuaauaacuugcccagugucucagagcuagcaagaacuggaaucgagaacucaagcaaucaagcuccagaauucaugcauuuuauugcucuguuugcugccauggauugaauggaugaauggaagaaugacuccccaaaucccaagcuguuuaccugaaucuauuuccagaugaugcgccaaguuuucugagggaagcagaaauagaaagagagaucugugacuuauuacuucuuauaggcacccccaggggcaaggugacuugaguacaaugugaagaugaggacagaagacucggcuucugcuguggucuaguggaggagaaggguccucacccuccuggacucucaguccugcaccuguccuuagggaguggaggagaugcucugggaauagugccccugaauaaauugagaucacuaagggaaggcucuggggagggaagaugucucgagccagguuucaagggcagagaaggauggagauggguggaagacaggagggcagcuaaugggacuggggaaaacuguggcgccuuccccuuuaccugagaacauccucaucaucucugggagggugaguauuuuccuguggaaaucacggaucuucuugacaaggucaggagaaauggccucaggacucacaaaagucuucaucucacaccugcagacagguuugguaaccaguuagguccaaauuccaaaaacaaauguucgggugagaccacgugaggcuaaaaucagacuaaagaaugaucuuggcgucuguggugaauaaugaaauugaguaucauuucuuuacuuuugcuggaaauguguaguuacuaaaauaguaggcauuucaguuaaaccuaagaggaacuaaggauaaucacuucucaagaauuggagguaagccccuuuaggagaauguuugguucuguaggggcugagggacagagaucauuaccccuuuuggucucuagagggcaacaggguaccauuugaaaacagccuuaaacuacccuuguguaugcugcuauuuguaaaggaaaagaggcuagaagggaagaaaaaaaaaggaucaacgaaaauauauauugcaaugaaaaaaacuccugauucuggucccagcucaguccucauuagacacuugcugcauuaccuugaagacucuucacccccugggucucaguuucuuccucagacuggaagaccuccaagcccuucuagaucuaaaccucuaaugcucuuugaaaagcauguuuggagacacuuccugauucauggacccuggguuuauccucccugcacgggaauaggcacaaagcacgugacaauuguucccuagucacuacaccucucuucaucucagugcagacugcuaaugcuuauagcagacagggaaggaaagggccaugcauuuacaaugccacuggcuccugguggcuguccuuuuacaguagcauuagaaaauucugaaggaaaccagagauguguguaaaaaaugaaugaaugaaagaacaggcugguauuccugguuuccaugcuuaucauagucuacagaaaguauucccccuuuaaauuacauuuuaaaugguguuagauacugacucaaguacuaauaauuucauagauuaaauaaauguuccuggaucaaccuaaaaacaugauuauuauuuauaacuucacuucuaggggaaaaaauguguccccaauaccaaccaaucaauuuaaaaaugaaccuuuagaacgcaaaucuuuagugaguuuggacuguuugugcacaguugaaugagacagugugucugccagagugccuuugcuuuccuggcaaaguggguggcaguaagugccccugccccuucccauucagucuugauguugaguaaaaggaggcaggaccggggagugggcccuaccugcucugguugacucugacauccugcaaaagaaagacaagaacauacauuuaguuuccauaaguccuuccugucagggauucuguacaucacuuuucccuuaaaauaugaacucaaaacucuccuucugcagagaguuguccuguuuaauuaccuacucauuagauuguucuuuuacaucauguuuucuuacuaauuuggguuucuguagucaguucauuugugcugguuucccuguuucagccuuaucguggggguggguugugucugcaaugauuaggaggugguagagagcaggggccugccuucaguuaucagcuggaccugaugugagccaggaucacauauucauaaccauagcagacaccaguuauugaguucuuucuguauaucaggaaucaugccaagcauuuuuuauggauuguuucuuauaauuuugcaauaacuuuaugagggaggugcuauugcuguccccauguuuagagaggcuaagagacucacucaagucacacaauuggaagagccaacauucaaauccaagacugucugacccuaaaccccuuaacaugaccacaguguaugacuugggcaagucuccagccccucuggaucugcaccccguuaaccucucuccacuucccuuuccugccucucuccagcccaaagcauggugcccacccccuuccccguggagucccucucuuauccuacaaaguggugaagugucucucacuuguagaagcucacuugcuggcugcugacacuucuccuccagcuccuugaccugggcuccaagccgggugacuuccucagagaccuuugugauauauucaucccucuccuuccaaaucugcugcuccagcucccucagccuggccagcaggagacaucgcugcugcuccagcuccugcugcagccucucaaaagcuguuuccaccugaugcuucuugcuuucgaucugagucuucaagggauaaaaggcagacaugguuaggaaggggcucagagauagcuuccaggaugaucaucuauauacuuauuauugauuaacagggauagggagcaacugguccaagacucauuccauuuacuaauaugccuagaaguaguuaggucucaggaugaacuuaccaaugaugagggcugugcuacugucuuagcuagauacucuaauaauaaugcuacauuaugcucucagaaugauguugaacuuuucaaaaauauuuccacaacuacaauaccaucauaacccuacuaugccuucuuagaguuagguggggaagacuguaauaauuucuuagaggcaaaaggaaguugugauuggagucaacacaacuuagugggagaguguguaauuuugguuuuagccguggaaaucaccaacuacagggcauacguugaugagagcugagggaugguggauagguugcuuuguccccacacucucuccuuggucaagguaccagaaauccucacacugugauuccuccauaacuuuauagcaugaaaagagaggcgugagggauccagauguagccacaccaucagccuacucuccucaaggucagccuguagucaggacuagaaucccgacacuaacauauguuuuugaccccaagcuucccaucugaaggugguguguucaggcaaacagacuaggauggaaagaacaaugaauuaagggucaagaaauccagguuccucaugaacuucagcuuugcuauguggccuugggagcauugcuuuucugguccuaaguuuucugcucuguaaaaugugauauacaagauggaucuuggauugcaagacaucagaaccacuucuagugcucauggucugagaucccaaaugccuuugugcagccacaggaaggugaacgagaacaguuugucaguucuuuucagccaggaaacagauaccagccaacggguuuccccagagucucuuaagaaaaccuucaaaggaaaagguagccagugacguggccuguaccagcagcacuugaagcuucuggucuucuugacacuuuacauccucaaucucaucucucuccgugcucagagcuuccagucgacuccugagacgauccuguggggagaagaauggguggauagaggugacugaauuaauaauucaacucacaauuauuaacuaucacauccugggcacacuguugagugcugagggguucaaagguggaaaaggcccaguccuugcccuaaagagaccaccaucucaggaagaagucaaugucaagugauuaaaauacagauagauaaaugcaauaguccagggguacacacagugagaugggaacacagaggucagcucugccuguaggccuaagggaagguuuggaaagcagaaaacauuuacaaugugccuugaaagauaaauuuccaguugaauagagagggagagaaaaggacuuagugcccacagaugugaaggaccucuucaaggagaacuacaaaccacugcucaaggaaaucagagagaacacagacaaauggaaaaacauuccaugcucauggauaggaagaaucaauauugugaaaauggccauacugcccaaaguaauuuauagauucaguguuaucccuaucaagcuaccauugacuuucuucacagaauuagaaaaaacuacuuuauauuucauauggaaccaauaaagagcccacauagccaauacaaucuuaagcaaaaagaaugaagcuggaggcaucaugcuaccugacuucaaacuauacuacaaggcuguaguauaugauaucaaauaugucugguaucaaaacagacauauagacaaauggaacagaagaagggccucagaaauaacaccacacaucuacaaccaucugaucuuugacaaaccugacaaaaacaagcaauggggaaaggauucccuauuuaauaaaugguguugggaaaacuggcuagccauaugcagaaaacugaaacuggaccccuuccuuacaccugaaauaaaaauuaacucaagauggauuaaagacuuaaacguaagaccuaaaaccauaaaaacccuagaagaaaaccuaggcaauaccauucaggacauaggcaugggcaaagacuucaugacuagaacaccaaaagcaauggcaacaaaagccuaaauugacaaaugguaucuaauuaaaugaaagagcuucugcacagcaaaagaaacuaucaucagagugaacaggcaaccuacagaaugggagaaacauuuugcaaucuauccaucugacaaagggcuaauauccaaaaucuacaaagaacuuaaacaaauuuacaagaaaaaaacaaacagccccaucaaaaaguaggugaaggauaugaacagacacuucucaaaagaagacauuuauguggccaacaaaccuaugaaaagaagcucaucaucacuggucauuagagaaaugcaaaucaaaaccacaaugagauaccaucucacaccaguuagaauggugaucauuaaaaagucaggaaauaacagaugcuggagaugauguggagaaauaagaaugcuuuuacaauguuggugggaguguaaauuaguucaaccguuguggaagacaguguggcaacuccucaagaaucuagaaugagaaauaccauuugaccuggcaaucccauuacuggguauauacccagaggauuauaaauuauccuacuguaaagacacaugcacacauauguuuauugcagcacuguucacaauagcaaagacuuggaaccaacccaaauguccaucaaugauagacuggauaaagaaaauauggcacauauaugccauggaauacuaugcaggcauaaaaaagauguguucauguccuuugcagggauauggaugaagcuggaaaccaucauucucagcaaacuaacacaggaacagaaaaccaaacaccacauguucuuacucauaagugggaggugaacaaugagaacacauggacacagggaggggaacaucacacaucggggccugucagggcuugggggacuaggggagggauagcauuaggagaaauaccuaauguagaugauggauugaugggugcagcaaaccaccauggcacguauauaccuauguaacaaaccugcacguucugcauauguaucccagaacauguauaauaaaaaaaaaaagaaaaggacuuagugccccugaauuguauacuuaaaaacagagagagaggugggaggaagggagaagaguauucuaggaggaagagacuaugugcaaaaaguauuggaagcaggaaugaauaagacaacucaggaaaaaacagcaagugcagcucagucuggccagacacguggugccuugaggagggaggcugagcgaugaggccggacagggaggaaggaucccgacugcaaagggccuugaaugucuugcuaaagaccuuggacuuucuuugggcacuagguauacaugggaggauuuugugcagaugagugacuuuguguuuuaggaggaucugucucccagcagauuggaaggugacuggaaagggugagaauggagacaggaaaugccauggagacugcaaagucugcgcaagagauagggagaaccuggcugugaggauaaggcagaauuaaagauuugggagauguuucuaagguaaccacuuccagaccuggugacuggaugacaagagagagaucugagaggcugacaggaaagugccccaaggccagauggggaauucucacaauucuggacuacugccacccucccuuucucaagaagaagagcagugcuagcagguuccccuucccagcuccucccuccccucugcgcccuggcagucagggcccuauaaaccccauuuccagucuggauccugggagaacaaguuuacccugcccauaaucugcagaagaucccacucggcauuggagcuuucuuuccauagugagugaagccaaggcuacaguucuuugcacuccaccucugugggguccucugagagcuggagcugaaguuccccccagaccaggaacuaccacacauccaaguggagcccuaucugccuucagucugggaaugccucgaaagucccuguaaccuuaggguucccugauguggaagccuuucauccagauccccgcccgauuuccuccccucauaacaggacaucauccugccccaaacaggcccuagguaaagcuacacuucuuacccgguagggcugaauggccucguccaggaaccccacggugugcgccuggugcgugggacccucccugcagaacacacagaggaacucggcaucguucucgcagaagaaguagaucuucucgccgugcuccucgcaguaaguuucucccagcgggcccaggggcacaggggccaugggagucucugccugcuccuccucuuggcagagcgggcagagcaggaucuugcccgaggauugggcccccaucugggagagcgcggggaggcagagccggcagaagguguguccacagggaauggucaccgcauccuccagcggccccgcacagaggguacaggcaggcagcucauggaccaccuucagggacgggguugcgggcaucacggugccuuccccagcccguccacuccggucuccucagcccacgcgaguucccuuucccugaaaucgagucacacuuacaugaaucgcagagggaaacggc

SEQ ID NO: 18327 - RNA, 15560 nt, Homo sapiens
gaaagcaugagucuuuccaccccccgcccugagauuuacugacauaugaacacauaugauuggcaugauauaagaaccacucaucugcuggccaucucuccaggucuggagccagagaagaugaucugaaauuguagcaggagaaauugagguaggauacuaagaaagcuuuucaggaguggggcuaggcaagaggugcagcaugagggaauaagagugaauccucaguaucuaagggagguggcagguggcgggggacuucuuucuuugggucaucuuugguggugauuugacaggaaggaacaaaguggcuucaaacauuauacaagucucuagucuguucuguguccuguuuucuuucucauucuuucaguguggaaucuauaugacccugggagggauguugguuggaagaaugaccagcugauggagaugcugcuguaauuauuggugguaauaaugggcagcagugagccacccggugugacaguguaggagaaaacaguccaaacuccugccaaacucucucuacugauggcaaaucagaggagacucaaauuguaaguuuauaguggucuggcuuuuggccaugacaaugacaccuugcccuuuuaauuuggggcccgugcaaauauucacugaaagcugucaagaggaaaacagaauugguuauugaaucacuugcuuccucuagguguaugaaaaauaauuucaaguuuaacaaacacaaggaaaccgcaggguccaugucaaagcugaugagcuauuucugaaacucgugcagaauugugguuuguguggucuaugucacggcacccuugagggagagugggcaauugccugaacuuggaggcuguguccuguccccaggcugcuccagggcugccuccuuccgacugggccuucuuaucugggacuguugagggcaacaggccuuccgaagaccagugaagaaggaggcccugcaaacaggaggcugacaggguaggaacgaggccaugaucccuuugcagaaggacaaccaggaggagggugucugccccaucugccaggagagccugaaggaggccgugagcaccaacugcggacaucucuucugucgagugugccugacacagcauguggagaaggccucagccucuggggucuucugcugcccccucugccggaagcccuguucugaggaggugcuagggacaggcuauaucugccccaaccaccagaagagggugugcagguucugugaggagagcagacuucuucuauguguggaaugccugguguccccugaacacaugucucaucaugaacugaccauugaaaaugcccucagccacuacaagguaagccugggucaccgcagccaggcccugccuccaccucgcugaggugcugcauccuacauguucaucaugccuggcaccucagaguagcucaacaauggacaucucucuuuguuucuucugcuucauccuguuuuggacccuugucuugcuuuucuguguauauuuugaggcugauguuuccaugcauuaaugugagucugucuaaaagaggauauugucagugugauguuagagucccagucugcucaucuguagaauagaguaauuggacuaacuaaugcaaaacccuuucaggacuaaaacugugugaacuccugguugauaguacuagaaacuuggcuagaaauguaaucagguuuuauauacacuaguaauuauccugcaaauauauuaaaaccugaaaguuacuacauaauuuuuucucucuuuuucuuccuucugcauuugucuuaucuuuccuuuuccuuucuuugcuauggcaauuauuuuaucuuauucuguuaaauuuucuaucacaaaaguuacaugcuguagguaauaaauucagaaagcacugaaagguauaaagucaagacuaaaaauuugucuuccuuucucccuccauucauaguccucagagguaaccauuguuugauuuuuguacauccuuccaaaaaaugugugugcuuaugaaugcacucuuacacacacacacacacacacacacccucaaaggauucucucuauauuuuuuucuguaacucauuuuuguuaucuaaaaguguggcuugaacauuuucucaucagcauguauagaucuucugaauuauuuucaagaacugugugguauuaaauucuaugaauguaccauaaauuggcagacauugggucauuuccaagcuauuguuuuguuuuaagauuacacagaacguucuaaugaauauccuucaacauauauauuggaggaccuagaauauccaagauauauuuuggugagagcauaagguagaaaucuaacuuuaguuuuuccaaguuauaaucaauuuguccuaucaccauuuguugaaugauucauauaguuuccccauugauuugaaugccaaugucauaauauaccauauaugcauauuuucuugcauacugccuugauucuuugugcuguucuauucugucuaugcuugccuauaagccaagguauuuuagagauuuuauccuuaccauauauuuuaaugucagguauuuugauagaauccucacaauacucuuauuuuucagaauucgugcagauauuuguauaucuuuauuuugccaauuagcuuuggaauuauuuuuaucaaccuuuccccugacccuaauccaguuaguauuugacuggacaauugacaauauuuucacauggcauccuucuauccaauagugaaggcugaacuuccaaagcugagguagcuuugagauacuugacuuuuggagaacauguuaugauacagaaugagaaaguggggaguccagauuaaaagugacuacagaaagguagagaaauaauugaaaaagccagaggcaaaguucuauuugguucuaacaucauucccuccaggugcaauguccacaggagaguggggagggauuccucaccugccgaugaagcagcauaagauggagaaauuuauuuccucacuaaaugauuuuuucaggucuguccuuuguguuagaugucaugcuaggcauuguagaaaguacaaagaugauucauaauucuuguuucaaaucugucuuuaaauaaugacaagaaagcuaaaacaaauaaauaacgaugacacuuguucauuaaguaaaaacuuaguaaguuccugcugugugugagaaacugcagcaugugcuaggaaucaaugaagacagaugccauuccuucugccaggaguuugcaguguaguaagggagacacaaauaaguaaucaaagaacuguaacuuuuuuuucuuuuuuuuuuuuuuuuuuuuuugagauggagucucauucugucacccaagcuggagagcaguggcaugaucucggcucacugcaaccuccgucucccagguucaagcaauucuuugccucagccucccgaguagcugggauuacaggcacccaccaccaggccuagcuaauuuuuguauuuuuaguagaaacaggguuucaccaucuuggccaggcuggucuugaacuccugaccucaugauccaucugcgcuggccucccaaaagaacuguaacuuuuuauuaguuaggaagaaaauaaacaagggucugggaugaacaguaauggguggcccauguccauuuggucagugagggccucauagaggaagugaccuugaagcugagggcuggcagaagagaaaucaaccugcaaagacaggggguagggagugcauacagaugcccacaccugagaagucuuguuauauuugaagaauuuaucauuagaguuugaaucgacaggacuuacugagagauuagaaguggguucuuuguaagaaaaaaacaaccccaucaaaaagugggcaaaggauaugaacagacgcuucucaaaagaagacauuuaugcaaccaacagacauaugaaaaaaugcucaucaucacuggucuuuagagaaaugcaaaucaaaaccacaaugagauaccaucucugccaguuagaauggcaaucauuaaaaagucaguaaacaacagauucuggagacgaaguggagaaauaggaacgcuuuuacacuguuggugggaguguaaauuaguucaaccauuguggaagacaguguggugauuccucaaggaucuaaaaccagaaauaccauuugacccagcaaucccauuacuggguauauacccaaaggauuauaaaucauucuacuauaaagacacaugcacacguauguuuauuguggcaugguucacaauagcaaagacuuggaaccaacccaaaugcccaucaacgauagacuggauaaagaaaauauggcacauauacaccauggaauacuaugcagccauaaaaacagaugaguucacguccuuuacagggacguggaugaagauggaaaccaucauucucagcaaacuaacacaagaucagaaaaccaaacaccacauguucucacucguaagugagaguugaacaaugagaacacguggacacagggaggggaauaucacacaccagggccugugaggggaugggggguaggggagggauagcauuaggagaaauaccuaacguggaugacgguuugaugggugcagcaaaccaccauggcacguguauaccuauguaacaaaccugcauguucuguccaugugccccagaacuuaaaguauauauauuuuaaaaaguggguugaaggaaggaggaaggucaaagaugacuucaugaguuucugguuugagaaacugaauagaugaugugaaagauaauaacuugguagaacagguuugaaugcaacaccaagaguuucauuuaagacaaguugaguccaaguugagacacaucaaaauaggaucuuacauacgcagcuggaucacaaauuuagaucuccagagucuuauuccuagaaccuagaacaaagauccauccaggcaaagacaauauuuaaauccaagaaaagcgggcacgguggcucacaccuguagucccagcacuuugggaggccaaagugggaggaucgcuugagcccaggaguucaagaccagcuuaggcaacacagugagauacuaucucuagaacaacaacagcaacaacaaagugaaauuaacaggauuuaaaaaaaagaacgugacaauuuggggcugggugcaguggcucacgccuguggucccagcuacuuggaagguugaggugggaggauugcuugagcccaagagagugaggcuggagugagcugugauugugccacugcacugcagccaggaagacagagcaagacccugucucaaacaaagaaacaaacaaccaagaaaccaaggaaacugauguaauugccucaaaagaggcuagacagaaaaagaaguuuugggguaagguucugggaaaggccgucauuuagauguaggcagaggaggacccagcaaaggagacaggaugaguugccagaaaggcaggagaaaaacaaggggaauggugccccagcugcuaagagagaaggguauuuuaagagauuauaauagauugcauugaacaaugcuaacacuucaguaagaugguggcagaggcaugagagcugaguugggaggaggcacacuucuuccauaguaauaacagggaacaagagaaggugucugcaagccuacauaguuuugcaguuuuggaaauccagguuuuguucugguuuuuauuuucucauaauauuugaggaaggaacaucagcaguaugggugggaucaggauggaugugaaagguuugaaaagaaacaagauggugugaugcagugugggagagcgcuuacaagagaaacuauguaggguuggcagacaguauguagcaccaauuugaggucugaaauguuuaacauguuucaggaggcugccugaggacagacagcaaacaagaaggugaugguacauuuuaccauggauaaggaguugucugaaaaguaacacagagagggaggguaagggaguugaguauauuucugaagaagugauuauaaugguggaccuuauguguacucauggauauugacagcguaauuuugaaauuaaggaggguuuuuuuuuacugauuuuuucaccauaucucuauuuauuugaauuaaacuuuguaguuaaguauuguaaauuuuguucuuuuaaaagaaucauauaaucccugacuguacucuaaaaagaccgaaaaauuuauaaaaucuacaaauucuuauuuguauaccuguuuccucacugaccagucaaugucagugucaaucacuuuaauguauuuugcugguuuaguaagugugugacagugauguacguuguuuuacuuugcuugauuaugaaugcuaguaguggugaggcuuuuauccaugaagacucgcugucugcauuuuccccuagaaucagggcauaaauucuacaugauugcaucaaaauaguuuaucuuuuggauaaugagcuccauuaguuguguuuguuuaaccuacauuuuuuuauucuguuauuucuucuuaauuauauuuuugggcaacuuuuuagaaauuugcauuuaaauuggcucuauucuuuuuuauaauauaaucuccaugucuuaaauacacagaaauuuguuuaauaugagugugcugcucuguuuuauuuuuaaagguuuauuaauuccuggcuuacuuggaauuucauauaguauguugugugaaggaugacuccacguuaauuuuccuuuauucugguauccaguuguucccaaaauauuuauauaacagugaguccuuuccacauuuacguguuguuucucgcuugacaucaauuaaguucucaugaugggcuguuuuuuuuuuacucuaguccauugauuauucuuucuguuauauaguuuugacaacauguuacuuuaugguuuauuuuuaaaucuagcagcauuuuugccauuuaauaauuuuauuaccugauauuuuugcugucuuuuaagaugagugcuuuuuuacaauguuucuaaauuucauagaucauuccauaagauuuuaaugguuauugcauuaaauuuguugauuacuaagaaucaugacuuuuggggguuuaguuagucuucucaaccaguaccaagauacaucacuaacggcuuuccacuauguaucugaaucagauauuaaauugucuuuacuuaaaccucaugugcccugacucuauugaggguagcuauguauuuuacaacacuauuuuuuuugacaauuuuuacuuguagauucaaaugagauucuuugcugagcucauguauuuaccauacauuuuuaaaaauuuucugacauuuucuagaucauaauugugugagugauguuguuuuuaauucauauuuuuggacacaguucuguaaggagcaugcauuuugaaagcuguuaauuuuucuuuuuuuuuuuuuuuuucagugucagggauagguacuuuuugucuguuaaccacuuuucuuuuguacauuguguuagcaaguuguuuaagaacaaauuuaaugcccuuuuuugucagauuuuaaaaauuuaauaugauuuaaccugaaugacagaauuuuaaaauauucauuuagacaagacaggucuucgacuauuuucuagauuucaacuugucuuuuuuucucugaggaauauuuugguaggugaaaguguauagaauuuagcuuuucaauucuaaugagugucuuauuuauauuauaugcacccauuaaauaccuuuaugcaaaaauuggugaaaaaguacuuuuuagaaacagaggacuuuaccuuacucauuuugaauauuguaaacaauaugacaguauuaucuucagucauucuaugccuuuaucuuuauuacuguuaucuuugccuucuuuuuuucauuuacacagugucuguaguuggcuuuauuaaauuuuaaacugccagaugauaggacuguggcuuuuugaacuggaccuuaauaggccugacuuugacaggcagaaaaauaaagcacuccugacagagagaaguaaaaggccaugaggagguguggcugcacggguguguuugggaagcagagagcaauguugugugcuggugaagagaguucagugagcagagagagaaucccggacaaugucaguuggggcuggguccuggggcaccuuggaugcugggugaaggaguuugggcuuaucuuuguugcugagaagccauuuugaagggaggacuaacaucaacaaaggugaaaugugacagauuucaagcugaauggcaggcagaauggcagucccaaugucagaaacaugaaggucaagaggaguggacugcagaagagcuuggggaacugggcagcauguuugauucuaccauauugauuuugagcugccaacagggcaguaggcagcacuuagcucucacuuggaagcaugagauggauugcuaggaaaaaagauuugguuuuggaauucuaagaucugaaggcuccagaaaggaaagcuaaggacauagucugagauagaaaaggguugaggagccaacuucaaggcuccuuuuuacagaaaaaaaugaagaggcaaagaagcaguggcagaaggcacaggucuaggaaggaugggguggagaggagguacagaaaggcaccugcggauuucauggcuggagaucucaggugacuuuggagagagaggcuuuaaaggagugaugagaaacaaggcggcuggcugaggaaugacgacagugaggaggugaagacagcaacaccaaacaacuugacugugagggcagcaagugaguagaugcaagcggugaaggcuguuugugcuuuucaggacaugaacucuugugcucgcacaaacaguuccacaccagccugccaccuucuucagcgagacucaugagcgacauccaugaugcccauuuauuacuucccacuccuaugacuuuuuuauuucgucucugcugggaaaugccugcaggaaacacccagugacgugacacguuuuuaguaacuuuguggugacaucacugucuucucugcuuacugcagcuuucuguucaccaaaugcccuugcugaccccucacacacacaguccuuugaccuugauuucaccaggaaauucucaggcuggaaagaacuuucaguugucuucaccauccccugacuucuaccuguacaucuccaaaaucuccucaaaaaagauuaaaaaaaaaaaaucugaagugggaaagauuuagugaaacacacacuuuucagcuaauagcacauccugaucuuuaguucacaaaucucuucucguuuuguuuucuauuuuaucauucacccuccaacugccccccgaaccaugggcagccauuuaaagcauuuguuguuauuuuugcuucucuuauaggucaucaaaaaccugaaagcaaaauuuuuuuagaaacucaaaucauucuuuaacuccauagcuucaaggacacagcgacacauccagaugcugauuuaagauugagagagaaggcacugccuaccugggcuaugaguuugcaccuaguaaagggcucuaucuugucacucaucccagugaggaccaggcagcagagguagcagaggguugccauuuccucuuuaaggcaauucccuccagacuggcuccauguguuacuguaaaauaguaagaagugcuagaagacugucauauaacuuuuguauguugagagaaagcacccugaagucaaguagaaaugguucuguugcuaucuauuauuuuuucuguacuucuaagacuguaaaaaaauuacccauuacuauuuccccccaucauuauccaauaaauaaacucucaagucccuuacuccaaccaugaugcucuaaaagcauuucuuuuuaggcagaauuuuacauuaguugcauucugggaucaggcccccuaccguguuccauugacuccucccagugggugccccccucacucccagucugacaagcaggugugucugucucuuuaggaacgacucaaucgccggagcaggaagcucagaaaggacauugcagaacuucagcggcucaaggcucagcaggagaagaaacugcaggcucugcagguggguuuuucggguuccugggaaggacucccuggaguguucucaggagcccuuacuuaacuauucuggacaucugucugucccuggaacagccugaugugggcagauggucguggaggcugaaaacccggguguuggccuuggcgucaaaguuugcugguugagugaccuacgcaaguuaagcccucugaucuuuaugugacuuacauguuaaaugagaaccaguccugcucugccuggaucacaguagggaucaaaggagaccagugucucgucaacugaaaauuacuacacaagccauaggccucuguuucuuuuuauuuuauuuuauuuuuuuuuugagauggagccuugcucugucgcccaggcuggagugcaguggcacgaacuccgcucacugcaagcuccgccucccggguucacgccauucuccugccucagccucccgaguacugggacuacaggcacuugccaccacgcccagcuaauuuuuucuauauuuuaguagagaugggguuucaccauguuagccaggauggucucgaucuccugaccucgugauccgcccgccuuggccucccaaagugcugggauuacaggugugagccaccgugcccggccgccauaggccuccauuucugucucugacagucuaccuuucuauuccucuuggucacauggcaucuguagauauucagagagugagguggaaaggugaggugucccugccuuuaugagaaucaaagcugcuucugcuauaccugugacacacagaggcaacaccaugagggcaagaggacugaggaaucagcauuccugcucagacauucagagacugugaagggccaggagggagccaccugacacugagucuuagggagccccuuuccuguaguuucagguagaccacgggaaccacaggcuggaggcugggccggagagccagcaccaaaccagggaacagcugggugcccucccucagcaguggcugggccagcuggagcacaugccagcagaagcggccagaauccuugacaucuccagggcaguaacacagcucagaagccuggucauugaucuggaaaggacggccaaggaauuagacaccaacacacugaaggugcauacccugaggccuuccccaagggcugggauucuccccgauaggaggcagcccaucugcaucacccuucugggagguguaagagggaggggccugugugauauguggugacuugugguagauguggcuuguuccaggcuacagagugcugcugcagcagaaugggcacagaagagggguguugcuauguucccccaguucucaagguggcaccccagaguggccuccaagagugaauugggaaaggaauuuggaggugauaggaaccugagaaccaauuaugauucucacuuuuucucucuccuagaaugcuggugacuuacugaacagguacgagcugucccuucuucuuucccacaugugcauauaaacccacacaacacagacaugcacagaggucaaggagacccacugcuccguuagcuuuuguaucuugaugcuacauggccaauggaagagccaauggaauauaugaauacauauuaaucuaugaaagauuucuuuguuucuaggagugcuccacagaaauuagagguuauuuauccccaguuggagaaaggagucagugaauugcuucuucagcccccucagaagcucugaccuguucaucccugggacaccucacuucaggcucaccucagccuccucucucuccuuccuccaaccuguccaggcccccacugggucuacccagugcaucuucgggccugccagcuccugaacaugucaccauuucuucauguccacagucaucaccugaugccugacccucugacucuuggacgauagccagccuccuuccaggacaggcucaugcuuggggcugccacuguggaggucggggcccauggucuccaggagcauuugugaaaucuccauuuugccuguaaacugaugguagugcccaucucucacaaucucauucaaauaggauccuccaggccucugaauggcccgagcucaucagcagugacaccaccucacauguggagcccagcugaguuccugcaguacuuguugucuguaccacucaccuggcacuuauuuauuauuguuguggaagacagacucaaagacagccucccuucaugauccucaccucuuggaauucaugcccuuguuugguccccuccccuugaguguaagugggaucugugacuugcuucuaaugaauggaauaaggcaaaggugauagggugucacucuggcaacuguguugcauuguauagaacuccuccuugcuggcccacccuuuuagagccccuccuaggagccaagagcagcuuccagccaacaacaagcagaggcccucagucuuguggcugcaagaaccugaauucugccaacaacccgagugagcuuggaagcagauucuuccccaacugagccggauaagaaccuaguccagccaacaccuugauuauagucuugugaguaccuaagcugaggacccagugaagcugugccaaaauuucccacccacagaaacagugugacaauaaauguguguguguuuuuuuguuuucuguuuucguuuuugagauggagucucacucuguugcccaggcuggaaugcgguggugugaugucggcucacuguaaccucugucuccuagguucaagcaauucuccugccucagccucccuaauagcuagggauuauaggcgcccgccaccacacccggcuaauuuuuuguguuuuuaguagagacaggguuuaaccauguuggccaggcuggccuugaacuucugaccucaggugaucagcccaccuuggccucccaaaaugcugggauuacaggugugagccaccgcgccuggccauguguuguuauaaggcaguaaauuugugguaauuuuuguggaguaauggauaaugaauacaauuguauauuagucauuuuuguauaagccucacuucuuugggugagcagggaucauauucugucuguguccucaugucuagaacagugucuggcucauagcugguguccaguaaaauuuuaaauguauguauaagugaacuaauaagaaagcauaaggaagggcucuucucaauccucugauuaaaaagagccaucaauuaccuuauaaucaguauuuauugagccuuugccaaaguagucaauaccauacugagagguauaaggaauaaaacauggccacaauuauaaaacaagccacgugguggugcaaagagugaaaacuacagggucagacuugaguuuaggucucgguccugacaccuaaugccucuguaaccuugggcaaauuacuuagccucucugaaccucuguacuccccccucuaaaauaaggguuaugguaccuguggccugggauuguugucaaaauuaaauacaugcugagugucugcuaaagugucuaaaacguaaacauucaaauauguucauuuuaucuuuuuuuuuuuuuugguguauucuggcuuuauuguuauuuuuuuuuaauuauacuuuaaguucuaggguacaugugcacaaugugcagguuuguuacauauguauacaugugccauguuggugugcugcacccauuaacuugucauuuacauuggguauuucuccuaaugcuaucccuccccccuccccccaccccaaaacaggcccuggugugugauguuccccacccuguguccaagugaucucauuguucaauucccaccaaugagugagaacaugcgguguuugguuuucuguccuugcgauaguuugcugagaaugaugguuuccagcuucaaccaugucccuaaaaaggacaugaacucauccuuuuucauuucaucuuuuuuuaaaaaaaccacuuccccuuuugaaaugaaauauggaaugauaaaaaaauuuuaaauaaauuccacuucaccauccagaaguuuauaauuuagcuguggaacuaugacuaaacagcuacagaauaagaagagagcguguaacugcacugaauuagguaucacagaggcuaagugcccugggaauucagaggaaagaaacagcgagccugggaaagucaggguagguuuugugggggagguggggauuggacaagugggagaggaaggugagaacauucuaggucacaauaaccacaugaaugaaagcauagagguaggaaaaagccacgguaccuuuguaggagugugaggaaaccaaccugguuaggcuggaauguucaggaauggggaagacgagaagucaacaggcuaaauggaugacaccaagacauagugagguuucugagucaggaaugaagggagaagugguguuuaaugaaagccagucuggaucguuugcacaagaaggacugggacagagaguugggggcuggaaggagaggggaggagaaagagccuagugcagauguucagaaaaaagguauaguuauuuggcaagaagcugcagaucucagagaaacauaagaucccaaaucuaagagcaagacauuagccaaggaaagaacaccccugaaagugacagcuagcaauuucugcaucccagauggaguuaaugucaccaagagaacuuguacuaggaguaggaggagacugacagcccccagggucucuccucaggagagaauucaguuauacugaagaugccuuccaggccccccuuggucccuucugacgucaccacagaugaucaggccaggggugggagucugaacagcagauaauuggccaaacaagucuaugaggucaccugucaaggaagaccuuaucaaagagggacaauaguaauuaacugaaaccaucagguccucucggagauucagaagggauccaugaugaaugugucauuaguuggcaagaagagcagacacagagagaaucagagaugcaugugcagccacgauguauuggaacagguguccaugacccaugcugcugagaggccgcaggaauauccagucuucacgcuucuuuggacuucgagcccacuucuuaccgguagguccugggcauacaacauaccacugcauaauggucaugagcacagacucgggagccaaaccacaagacuucaaaugcuggcucugcgacuuacuaucagcugauuugagaccagcugcucggccuccacaugucucaguucucuuauguacaagaugggcaccuaccuccugagguuguugugaggauuaaaugaguuaauauauacaaauauuuauuaugguguuuggccaaaauaaguucuaugugugugauuguuaucagcauuuuuggaaucucuaguucuuccuacaggaacgaguggugaccccaccaacucgcucacgccugacauagcuucucacggggccuggcucaugguggaaaaucgcauuuuccuuauuucugcuuuuauaauaaacuuaccuaucauuugaacua

SEQ ID NO: 18328 - RNA, 5326 nt, Homo sapiens
aggggaagguaaaauuggggcucuucggggggucacagggggcuacccuccccacacagggcuaccccgccccagagcgcccucuagugaccgccuccuaggcucugggaaccaggugugcuauucuccccucccugcucccccaaaccuuacccgggaagcaggagaaccagaugaggcguuacgcaaggccugguguuuaccucccgugggagccuccucccucccuauaaagccugaugugguggagagauuugacgagacugagacucugguugaagagagaggcaaucccaggagaggggcggaaagcggcaaaaguuaaugcgggagucggagagaagggcaucuacacagcaagcagcaggggcggcccgccaucugcgcgcucgaaggcggucacgguggucgcggaaggggcggcguccagauccuggcuuuccauggaugcgcccgagcugggcccggggcugguggagcgucuggagcagcuggcgacguguccucugugcgggggcuccuucgaggacccggugcuucuggcgugcgagcacagcuucugccgcgcgugucuggcccgccgcugggggacuccgccggcgaccggcaccgaggcuucccccaccgccugucccugcugcggccugccguguccccgccgcagccugaggucuaaugugcggcuggcgguggaggugcgaaucagccgcgagcugcgagagaagcuggcugagccuggggcccgugcggggagacgccgaggggggcgcauccccaccaugggcugccuggaccugcccggagaggugaggcugggcgcgcgucgcggaguuguugguggaagcgggagguucccggggaagccgggaauggcacgucuggagccggaggcccuguggaaguuuaggcaaaggaugggguggggagagaaaagcaaaggaugagggggcgaggacccuggguccucaaggugagaggcgcccggaaggacgauggauggaguugacacuugguccacaggggaggaggcuggaccgaugccugagccuugugagaggggcuggagagaagagacuggggaggcagagaagggguaccggauagaacgcggagagcccuggagucgccgcgaagggcaugggaacugcagaaguuuuggcagggcagccgcaggcgcccgggaggaggagagcuggcggaggggagggagcggcgggcggaagggagagccgacccagcugagggugaggagggguccugggaggauggugggcgagggcagaaccugcuuagaggagcgggagcaggaggcugggcugguggguugggggcggagaaaaagcuggggaggaggggacugacaagaggauggaggaagggagcaagggguuggggcauauccaaaccuccccguagcgucguggggguuggucucggacucuggcucaagcuaagcccuguguuguuuguuauuguuauuucggcuccucccaaggccccaggcaggagcggccagggguggaggcgaggugcgggagaacagccgcuggggccucuggcuccucuccacaucccagucuuaccacccaucuaccccccgcgccucuccugggccccggcuccuuggccacuaaccagcccauucccuugcccgaccgaccccugggcgucugggacuccugacuggcuucuucccagcagccaagcuggucuugggucuugcuucugcccuuugaagucuucauagaccuaauuagucugaaaguaauuggcacaauuaugcaaauuguuucucucucccccgcuccaccauaucggccugcuccagccaucagcacuagacagugaaguggaggggucgguaucccaguguuuggaggggagcauccagugcccucuccuggcucccauaguacucuguggaucugcugggccuuuugggacacauucaagucuagcugccucccuggccaggguccagagacacaaagcaaagggcccaauaaaugccacugggcuuuuauugcaagaggggaagcagcuuuauuguaaggcuuuuauauaccaacucuuagcccgagggcucuggguguguguuuggucugugugauggagggaggaagggacagauguuuuucugggaugcacuggggaagguagauaaggauggggccgcugaaagagacagagaaugggacugaggaggcagcaaggaaggcaagggcucugaggacaagaaacagucacggacgagccugggaaaagagaauugagaacccuuggggaguggaaagggggaggacaguggggauggaguuaggaggaugagggaaaagugauggggugagaggaaggagggaucaugaaaggugaaggaggagaaugagagggaaaggagcacaguguguaaagaggugagaucacucugaaaggugaggagggacacugcuaacucagacagaacucaccugaggaggggagagauagggaaggaugccccagggaaugaagcccagagcucacauccauguuuguuucugcccauccuaggauaugaggaagacauggagacggugaguuccacuuuucuguucccuccuuuucucaccagcugccauagccaucacguucucacugggcccacaccuuuguucccauuaauaggcagguuuucugggguauagucucaucccuucuuccuccagagaugugagugggguaugcgugggggcauuaggaucagagggcugauuuccugacccuuccccucaucuguguagauuugaagucccaacauccaagucaucuaauucagaggaugaucucccugaagauuauccaguggucaaaaaaaugcuucauagacugacagguaaggaaagaagaagggagggaagggaauugaaugaaagucuguguuagauuuucuuccuuuuagcccuaaaaagugaucagguccuuuuugaugucugcauuaguuuccuaguacugcucuaaugaagcaccgcaaaguagguggcugaaacaacagacauuuaucucaaaguucaggagguagaagucugaaaucaaggugucagcaguguugguuccuucugacggccaugagacagaaucuguuccaugccugucuccuagccucugguagccucacauguucuuugggugauaggucugcacauuuucuuuuguaugcauuugucucuguguccaaauuuccucuuuuuguaagucagcaaucuggauuagagcccacccuaaugaccuucauuuuaacuugauuaccuauguaaagauccuguuucaaaacaagguaacauucugagguuuggaggacuucaaccuaucuuuguguguguguguggagugggggagggcacaguucagccuauaacaaugucuauccucgauuccucauauuccagccauuuucccucuuccuuuuucauacauucaaacaacagaucccugaagguuaggugccucucaaaaaucucugcuuccaccaccucucgucacuccucccuggaaggggaccccagcaucuccuugacccuucuuuccucacucacucccaagaagaagggugccucuacccuucuuuaaacugccuagagaaggugguccaccaucuuggucauccaccaucuugcccaguccagauugcuucugacaccccuaauccagaaauuuuucuucaaagcaccccauacauauaaggccaaugguucuuuuucuggucucuggcuaucaccaccugcucuccuccucugccccacaaccccuacagaaauaggacuguccaccccaccccccaauuccugugggugggugggcugguuucucaggauaccuuggauuccucccugugccccucccauuacuugagguuccaguaucaguacgacuuucucuuuagaugaaccuuccccauuuugcugacccagcucccaugccccaccccagaugaugcagauugagguaucaguccuuacuccucccucgaagucagaucagccucacucuuccucccccaaccccacaaacgagacaaccucucauuugaucuuccugcugugcucccugcacugggccaguaugauccuuccccagguccaauucuacagaaguggugcaucaguacaaggucugauauugcccaggucugcucuucauaugccuuccuucuuuuugguccugcagucgccuuuugagcuguuguguggucacuagcucucagucuuuuacgugaucuucguugacuauucuccacccuaccccgccugugauuuagaaaacucucucaugagguccucucccugccuccccgucuccagccgaccugacccuggacccugggaccgcacaccgccgccugcucaucuccgccgaccgccgcagcguacaacuggccccaccagggacgcccgcgcccccugacggccccaagcgcuucgaucagcucccagcugugcugggugcgcagggcuucggggccggccgccacugcugggagguggagacugcggacgccgccuccugcagagacucuucuggggaggaugcggacgacgaggagagccacuaugcagugggcgcggccggggaaucagugcaacgcaagggcugcguaaggcugugcccugcgggggccgugugggccguggagggccgcggcggccgccugugggcccucacggcacccgaacccacccugcugggcgguguugagcccccgccgcggcgcauucgcguggaccuggacugggagcggggccgcguggccuucuacgacggccgcucacucgaccugcuuuacgccuuccaggcgccuggcccccugggggagcgcaucuucccgcuguucugcaccugcgacccucgugcuccgcuccgcauuguaccagcggaaagcugagucucgucuccaacuagaaguuuggcccggccacuggcccugcagcugcuuuuuggggguggaauuccccacucauuucugggaacacauucacacgcccauugcaggaguauuaauagcaacccacauuuucgccccaaaauaaugagaccucaccuggucuccacguuuccacgucccugcucaaaaccaaauccauuccugccuucuggcucucagaaucuucucuccccuacagcuacuacaguacuuccugacuucucccauucaaaccauucuaggccugcaauggggaacaggcccuccccaucaguauugguaaagugaccaugauuccuacauagaggcucugcuggucaaauacuugacucccacucuugccacuccuagcuccagaagggcucaggg

SEQ ID NO: 18329 - RNA, 4071 nt, Homo sapiens
ggggagcgcaucuucccgcuguucugcaccugcgacccucgugcuccgcuccgcauuguaccagcggaaagcugagucucgucuccaacuagaaguuuggcccggccacuggcccugcagcugcuuuuuggggguggaauuccccacucauuucugggaacacauucacacgcccauugcaggaguauuaauagcaacccacauuuucgccccaaaauaaugagaccucaccuggucuccacguuuccacgucccugcucaaaaccaaauccauuccugccuucuggcucucagaaucuucucuccccuacagcuacuacaguacuuccugacuucucccauucaaaccauucuaggccugcaauggggaacaggcccuccccaucaguauugguaaagugaccaugauuccuacauagaggcucugcuggucaaauacuugacucccacucuugccacuccuagcuccagaagggcucagggccuuccccacagaucuaaggacugggcuacccugccuguccacugagguuucuccuaaaacaagaggcuugacucuggucugggcccuguggcccucugggaagcuuuguaccucuuuugcaggaucuggggguggggagggacaagcuaguuccccaaccuccuaugacugcuuucuaugcucacagccuuuuuuccauaagaaccuucuugaaacuucuccccgcacauacucacggaaaggaaccaauggugcuauuuccccucucuccuccucaaccugggaauacuucagacaucuccaaacucauccuuguguauagucucacacccuuccccauaaguauaaaugggcccauauuuaacacauuuugugauuuuggguuauuuauuuugugcaucuguggcaauaaaugagaucucaguggugguauggauuugacugaucucuguaacuguguauggcaaaaggaccggaaaaugaaaaccggaucccaguaagggguagagaggggccaagagaacugaacaucugggcugccggagaaaucaaagucuaggaaguaagagguaagaguguacuacaggggacauaccccaaucucuuugcucccucccucuuccuuccucucccagagacccaggucccugggacuauauuggaucugucucugaagcugaaaaacaaaaggcagaggagacagucggcucuaagugaccaaucucaagccagcuuugucagaaauccuaaauaacaggagaagggugggaagaaaggauaugauuauuucuuauuccauuuuccauaagaggugagaaugacaaggaccucuuuucuaacuccucuugagggugugagaaggguuagcaggaggagaagggcugggagcucugaggucuccuguaagaccucauaucucacaggcaaggacuaagaauuaggauuaaauauuuuagugggauagcucuaaaccaggauuagcaagcaaaguuagggcgcaaauuccuggaaucugacugggacccuggcagugaaagcugggacuguugaaaacccaauuuaaguguucgcuacucauguugagagugcagggccaagauaacuagaucccaggacaggcaguuuggcagugagaacaaaaggaagacacugggaccaaggugccuagaucccucgagagagaaggguggguauugggaggaaaaaugaggacuggggaaacccaggaggcuggguucuggaauagcagcaagucagaauuucaggaucucuguucguccuccucuuccucuucccucuaucaggcagaagagagggaaggagggggcuggagaaguagccacauggauacauuuagggccagacagacacaggaaugcuggaggagagagggauuuagugcugcauuggcccuggagggggcugggaagggucaggaggcuggggagggguggugggggucgguccuaggguugcacgacgccguccuuugcgguggccacguacacaguguguaugaccacagcccucuucuuccuccucaucacuuuccguggagcucucgccaaaggcccgagguuucucauaaauacagcagccuagauuuagagggaggagcccaguuaaagaggaggaaggguaagauauauagucaguuccauucccacucaaacucagugaaaauuccuauuuucuccuaccuuccaggauccagcuuccccaggcccacccucugggacucaggccccaccccucuuguccucuuagagagccacgaauucaaagccccacuucucccaccucugacacuucuugcugucagaccuaggcaauuccaguucuagcccuucccuaccucuuucccugauaccacagcaccaccaaaaaagugacagaacuaugaacaucugggggcuucuggaaagccaguggauaugaguagauacaagauaugcugaagggagccagaacuccagggcuacugcgggccaacaauuacucacauuuggaugagcggcggcccauguguucauuguccacagugucacuuguccauucuaccuuuuucucuggcuuccguuuccgaaguuugaugguaaggcuccgguucuccuagaagguuaaggaugagcauaccuaucuaguccccucuuacuaaccuuucccacucccucccagggaaccuccucucuuuucuucuuuagcucaaucaguaccauaggcauagcaccagaggagcugacagaagauaaaacagaacaggucuuuuaccucagauagucccuugaggaauaaguauuauuuccuguucuuauaccaccaguauaagagaagacacaauuccuaaccuaggaaaggucccagcaacucuucaaaggaaaauauaauccuugcuguuucuccgucuuccuccccaaaucauccuugguaguauuaauacaugaaaauuauuuuucaguccccagcaccuaaucuuugaucucccuuccuuuuuccagauccccuauucuuuuucucuuaaaaaaacaaacaaaaccucucucauucucaagcuccagcccucccuaccucuuauccaccuauucucuggcauccuggcaucucuaguagcaaguauuacuaaucuauuaauuacuaaacuuccuuuaauccaagaguauuaagcccaaugcaaccuucucccuuugaaggcaacuuaacauguuuuuggauaaauacuucuuguuucuccauuuacaucuuugcucucugauuucucaaaauaccucuuuucaucuccuuuucuuguuuccucauuccugccacuuccuuuuacauucauccauucaauaaauauuuauucgaauaucaauauugauaauauugauaaguuggccuccaaccaugcuuucuuacacuaccuuugauuuccucccaacaucuuccuggcuccuuaauccucaauuucccuuucguuuauuacuuacacacauaaccaccccaagcagcaacaccuauauccuaacuguaccucccuauuacaaguuccuugaccugccuccugcaccaucucugccacuccaaauagcuccaauaccuuccgauucucccagcccuagauauucaaccccacaccucccauaucccuaggccuagcuccuccaacaacucuucuaaucccuguccccucccucccaguaucucccagaccccuaaacagcaccgcccccccgccuuucucacgggcucgguugucacgguaaccguugucucagugacggucucgcucagcccagccccugccucggccauggcuaaggcucaggacagggaggagaggaggaagggggaugagacacccuucccuuuuucugucgcugaggucuaagagaagcgguaucggauucagagugguagccaggauccuccaccuucuuuauucccccuccuccugggccuccgcuucuccaccccuggggauaaccuggcuaaccccacuuccggcucgccgcuuccgggugugacgcauacugcagucccccuuuuucccuuccacggcaccaaaugcgucaaagcgcaggcgucgcuggauuaguuccgccguaacg

SEQ ID NO: 18330 - RNA, 4243 nt, Homo sapiens
uugaaacuuuaaucucuuauuuuuccuauuugacuucuuaaaaaggguggcauugccaagaauuuucuuugauaugguuucacaauuguauucaccuucucuccauucugagacuuauccauaagaauacucacuuuaauccgacuucuacugcaugguuggaaaagaagauacgcaauaacucuuucaaacuccuuuaucucuuuuacucucucaugcuucucauauguaaguagcuggcucuggcuucuucucaagauucucuccuugagucuuuguucugcaaguucucucccucgaaucaugcguuccuggugauccuuagucugcaucuguucccucucauuuaccugcuuucuucucugugcguucuggaugccaugcccuucuggcauaauuuuugguaauuuuguuucauugggggguuguaguacuugucuaaaugguuuguucuuaaauucuccagccuuuccuguuugauguaugugccuuucuauguguuucaucucucucucagguaccaaacaguacuguuuuaguccuucuacgcucuggguuguuuucuccuccauuuuuuucuagauuucauugccugucucuucuuucaucauuuccacuauuauuuuauuauaauaagacucugcuuuggcaagccaguagucaagagaaacagcuugcucccuacagaguauuucacacuccuccugauauuucugcauuaucaacugucuugcugcuguuguaugcacaccaccuagauucugucaaagugaagucagaaauuuauaaugugaucaucuuuuuccuuugaacacauuuaaacaggagccaagcccacccucccuaaugacaccaggaaaagcuacaugcucuuuacuuuagcuuaguuguuauuuuauucccaucacucccaggugagccugggagcucugaaaguauuaaguacucaccaccacaaaucaguaacuagguuuaaaaauguaugguguuggaaguuuccaaaaaugauacuuuguuuugcaacuguggauauagcuggguaacauuugccaguguagacauacuaccugaaugugucacuugggcagaaggauuuuaaaccuaagauuccuucucuguguaguuccaaacuguaugaugugaagauaauuuacuuaccaagaucuuuuuuuccaguggagacugcugaccugcagcaauccuaggaucuuuagaugauguaccccaggccaaucuggaagauaaaaaaggcaagguagauucaaauguaggaggugucagaacaaaucugcuaauagggaggacuacagcagggccauuucccccaugggaaaccacugcauuccuaugguagaaaauaaugaaugcucuuuuaauaagaggaucuuuccuuucauaugaacaagcauacuuuuccuguggacucagcgugaaccacugugaaucucguauuggggauugugagugggaagagacaugcuccuuggugagguguuguccaaguacaucuaugucagucugcucaguccucaagccuccuuuguguucugagacgauuguagguucuaguuuucuagacgauucuagguuucuaguuuucucuuccugcaguuucuugauccgggcccucucugacucuaucagcacauacagcauuucugcccucuaaucuuuuguucugaaauucuguuauuugacugcucagcccucugcuugccugacuaacaaugccaaucauccuucacucuaaauccauuaugagacuauucccuguugaaccccucaggauggcaauuugugguuacucuggguuuauuuauagaggaggcugauggcaacacaaaugaaaacuaucaucuuuuaugugucaucccuggucuagccugaguuuacugugaugucguauuuaagccacugaggaugccuggcauuuccucuguaugucuuuuauaccauuuagaguucaaaggauggucuuuacagucugacagagcuagaucugaaaucuaauucuaccacuuccuaggugugugacucagggcaaguaacuucugucagcuuucucaucuauaaaauggagauguaagacaaaaaucugccucucaggguuauaaagaacaaauaugaauuagauguaaagagcuugguaaguucucaauaaauucuaucuaucuguccuucacaggucaagcuccugauuauaaagucuuuccagucuacucugucagugaucuucccuuccucuaaauacuugacauauuuuaauucuacaacucauuugaaaauuaaucgugguuuacacugugauaucuguauucacauaucacuuuuaacauuuugaugcugaaauuuaggcucauaaggaaugaaaacuguaauuuauaucuacaaauaugaugccucuauauuguuggaaaggaucugauaucaaauauuuggucucacugaccucuuaggaacauucuuauuugucuacguaagcuuauuuugagauuguaaacguaugaucaucuuacuuuuacuucucuguacauggcuucuagcacaauacuuaacauuagagucugugaucccaaguucucaaaauuaaugauuugcugauugcugaugauccuugacacauaauaucugagcaucuuuuuuaaauaucugccauaacauuguaucuauuuuuauuaagccauuucccagucuuccuugaaguuuacagauauguuuccuuuauaugcauguucugggcucucacauuuuguaccuacuagcacaguuuuauuauauucuaauuauucauucauguuccuugaggucagagaacacagauuucaacuuugcaggcucagccucagcucaaaaccuggcauaguugcucaauaaaucuuuacugauuagacugugagcuuuuguugggaaaaggauaugccuuuuaaugcuuuguuccuuuacugcaauucacaggggauguuggcuguuuuucaaauuaaaaacagaaaacugaggaggguagaauuucaaguuccauuuucaaaggagacacacagauaagugagaauaaaaacugucuacgacaaucagcucaacaacacgucucccuuuguaagacagaauaacaagcaauuucacaguuaaaugauagggcuugucacucuucagcaguuugcugaguuuuaacccuuucacuauggcguucucuccauuauuacagagaaaggcagaugggagccucucccagcgaaaagacuacagcuuguguccuucauaggagaaaacagugauggcuccagaacuuuuauaugaaugaacuuagcacagcuaucagaguggaugguggugggagggcuagcaggaaacuaguaaacaacuacaagcugccccuucagggaaaguuucuacuuggaauauaaguuacagauuaaugaaaauagaaagauuucccaaagauacuuauucucauguuuuauaaaagaucagggaaaugucagcuguccacuuaacggaugacauaaugaauuaagaguucgauaggcggcaggcacaacuaaaagccaaacucgaccuaagucuuaugaaauccuacuuaaugagcuuucuugacuacugcuagccucacuuaucuggcaggagucgaaggagaggaagccccaagcuccucuguuccaccaccuccaaaguccugaaccccuucucaaguguaccacuucaucccugcuuccuuucgucccgugggacuaagcauuccucgggccuucacucucaccacuugcugucccucaaaaagccgacucaccccuuuccaagcgcagugaaccguccgcaaagcacgaggccgguugcgagcugcagaaagcccacgcucgccagcgggacccaaggaacgcuagaacuauacgucccagaacacuuagcuuuguuuuuaacuacggugcagccgcaaaagggaaauaccggcucaggacccaggggaguuguaguucucuaauccaaagaaaucauuauuuggcaacguacgguuuucagggggauauaccccgcgacugcguuccuguaggaugugagacaaagagaauaaauaucccaggauugggugcuggugggaaaauuugcuggaagcgcagcauugguuaccaauuuugugcucaaccucucaguaccagggugaaaguggagacgcaaucucccuuggaagacguuagucuccaucucuaacgcucccgagacacgguucgcaauuaauuaugacgucaca

SEQ ID NO: 18331 - RNA, 3822 nt, Homo sapiens
agauguccccaaggacaaaucccugggcaaccaggcucuccuccaccccugccaagaugugacaucacucagaagggauuuccuagaagaaggagaaaauaacuugaaaaacguaugucaguaguuuguaucauaaaaccauugaacuagggagaagaaaagcccuuggggucaucuugucuccauuccugccucaaugguugaucugagaggugaggcacugggcaguugcuguggaaugggcaaugagaccagcuaggguuggauuccugcuuaggggcagugaaggaggaauggaucagguggcagauaggagugccuccagcuucucugccaccuguaaaugugucucuaacagcuggcuucuuugcccucuaccucccaggaggagucuucccuccacccaggcucuccagcuccuccuuuccucugggaaugugaucccucaauagcccgccucuuccucuuguugcuucugucucccuuuccuggcuuuuuauucucugcuuauaacagagagaagagaacuuacguagcucuucaaggaauugcccugaaaacaaaaagaaacaaauaugugauuaguggaagaugaauagcaccuuccccacauccucccuauggacauuuggagugacccacacugcccuuuccacugggggaucccacagauccaguaagugguucucuucacaguuucucagaagagccugggguugggcauggggacagaggaauaaggaaaucccagcuccccuaaucuugaguccugguucuauucucuuuuggcuucccauucagagcugacuuggucccccacuauuugguggucuugccugcugcccagccacugcaccugcuagucuucgauguagccaguuguagcagaugaucaaggcaaccaaggguccaagaaccggcacaauuacaaacaggguuaucuuccagcagggcacccucagaaaguggggaucugaauuguucaccagaacaaacaggguuaacauguguucccccucaugccccacccaccugucuuuuuugguuccuuaaccugggguccuagaacaccaaaggacucuggggacaaaauucagaaaguccaugaacuuggaugagaaaaguacugccuccuuauuuucaauaacuggauuuaacauuuucuuucauuaaaaauguaacaacugccaggugugguggcucaugccuguaaucccaacacucugggaguccgagacggguggaucaugaggccaagaguucaagaccagccaggccaacauggugaaaccccaucucuacuaaaaauguaaaaauuaggugggcgugguggcacaugccuguaaugccagcuacucaggaggcugaggcaggagaaucgcuugaaccugggaggcggagguugcagugagccaagauccugccccugcacuccagccugggccacagagcaagacucuuguugaucccaccaacacccauucccccaagucuuggaaaaaacaaaacaaaccaaaacauuuuacaacuaaccacaauaugagcaguaccugugacuuaauuaccaauggaagccacagauguuuucauucccauuagaguuauugcagaaaucuugaaauacuguuuauguuuauuaguauguugaaauuaaagguuauugggcugggccugguggcucaugccuguaaucccagcacuuuggaaggccaaggcaggcagaucaccugaggucagggguucaagaccagccuggccaacauggugaaaccccgucucuacuaaaaauacaaaaauuagcugggcaugguggcaugcgccuguaguuccagcaacuugggaggcugaggcaggagaaucgcuugaacccaggagguggagguugcagugagccgagauugugccauugcacuccaucucaaaaaaacuucaucucaaaaaaaaagaaagaaagaaagaaagaaagaaauuacagguuauuagacuugcugcuacauuacuuaauguauuacuuuggcuaaagaaauauuuauggccgggcacgguggcucaugcccguaaucccagcacuuugggaggccaaggcagguggaucaccugaggucaggaguucgaggccagccuggccaaccuggugaaaccuagucucuacuaaaaauacaaaaauuagcugggugugguggcgggcaccuguaaucccagcuacucaggaggcugagaaucgcuugaacccgggaggcagagguuucagugagccuagaucgcgccauugcacuccagccugggugacaagagcaaaacucugccucaaaaaaaaaaaaaaagaaacauuuauguuacuauaucacaaaugugauuaucgguugauaacuguauuuuaguacaaugauuguuuuugcaauccuauguguucuauuuuauguguauauuuaaaaacauucugcaaagggguccuuuagacuucacuggagugccagagagauucaugguacaaaaaggaguuaagaccuuucauagucaaguccuccaaaacaaagauacuauuccuccucuuuggguguguaaagaugugugugugugugguccacacacuggucuaauuuccuaaaucguacgauagaacucugugugccaggugacaagaguagagucaccuacagccucgggaggaggagcugugaaggaaguuugcucagagaagguaccaucugugcccuaaugacaccuucuagugucugcaacauuuaucuaacaaauauuugggugcucuucuguugccauuaucuuuaggcauugggcaaucugcagugaacaaaaaggcuagaaaccauguccuugaggggucaauuccuaguggggcuugguggcuuuucuauuccucuaugaggucuucucugauuagucauguucuguacucauggaaacauccugaguuuguaaagcagaaauauaaguacaggugauacaguugugucuuguuucuguuuguuucaccuccccaaccagacaucagguuuacguguaaacgaucuauuuaccucuguuuugccauuccugaaaagagagaucaugugcauaaggaguuaaacagaauaagauaacauuuuuguaaaguaguuagaauagugccuggcacauaaaaacaguacaugaguauuuuuauuaugauuuuaccaauccuaaaugcaaaugacuucuuauuuaaagaaagaaaagagaagagaggaagggacucaaccaggagccagggguccuuguucccccaggugacuggaacuagagugaaauaccaaguugaccugggagggccuagacaugccggaacuuaccaaaaguccgguggagauucucugaaagagaaacaaauggaaauggauuuaguagggcacucaaaaaggaucuuuuauccugagucuuuguuauuuaauuacuuaaaacuuguucuaggcacgacacacccacuguagagaaagggaaacugaggggaaaacaggguauugagagggagagacgguccaagaacgggaccauuuccguuaugccaaaaaaccaaaaggcaagaauugggagaaacgaugacuggaacucaccuaucucugcucgaaguuuuccuaaaauagaaaaaggcaacauuuuaguuccugcauguucuggcucucgguggggacccucccacacccagcgccugggccccuugugcaggcuauuucucugcagccuggaaacaaccucaggagaguaggaagagcacuggauuuaaagccaaugguugcggcucuuucucuagcuauagucuagauacaauagcgaauaaagaaugug

SEQ ID NO: 18332 - RNA, 32528 nt, Homo sapiens
ccccucucuuccccccgcccugccuucccuugcacccuccuucuucccuccgcccgggagcucucccugguccccggcgccgccuccuucccucccggcuccccgcuccccgcucccguggcugccgccgccccggggaagaagagacaggggugggguuugggggaagcgagagaggaggggagagacccuggccaggcuggagccuggauucgaggggaggagggacgggaggaggagaaagguggaggagaagggaggggggagcggggaggagcggccgggccuggggccuugaggcccggggagagccggggagccgggcccgcgcgccgagguaagagccagggccccggguuagcagggcucggagagggggcgcgcggcguggugggggagggggcagugggcgcagggcccagcugggggaagcggggcugggggagaggaggaaccgcggggauggaaucggggagcgcugaggcggccgaugccgggagcguggguaagccaggcuucugcgagccgcgggggccgggggagaggagguggugagagguggagucccgggaggguugggggccgagggaggcaggaggaggguggggacaggcuuucucuccuccucuccccccaccccgcgcggggcuccgcccccgccuccuccgcggggcgcucucuugguccccaggcugagcccggucggagccugcgaggcaaccggcaagaggucgaguagucuccgggugcgggccgcgccggcggggcucgguccaguccucauggccgccucucacuuagauguugcugcugcugcuacuggcgccacucuuccuccgccccccgggcgcgggcggggcgcagacccccaacgccaccucagaaggugcauccuucuucgacgaccuccggcccuccuucgcuccacuucccuuucccugcaucuccucauuucugguccucaucacuaucccaucagucccacauaucaucccggucuggcaaccccuucugcucggcccgacuuuacuacugcugaccuccuucugucaccccacguuacuauccagcaccucuuuucucugcccacauugcuacacuauaccaccuuccugugcauuuucuccgccucaauccccuuucccagccccacauuacuaccucaauuacucccuuuucuuggucccacuuugcuguccagaugaucuuauuagccucccuuuauccuccuauccuaauucaacucgaauauccucauuuagccuuuuuuuuuaaagaaaagcuccacccacauaucauacccuucaugauuucuuaauuacuuuucuuucuuaccuccacccagcacccuucccuccccacuuguggguucucucaucagcuuuaacccuggcccuuuacucucuguccuuuagccaggggaucuguaccuguccccacucccacccucuagugccccaucccucuuccucuguccccagccugcccacagaccacgcccuacucuccccuuccucccacuggggagccugccuuuuccucuuucccaccauuccucucuguaugccuccccgacucaccccuuagguugccagaucauacacccgcccugggaagggggcaucagguaccggggccugacucgggaccaggugaaggcuaucaacuuccugccaguggacuaugagauugaguaugugugccggggggagcgcgaggugguggggcccaagguccgcaagugccuggccaacggcuccuggacagauauggacacacccagccgcuguggugaguagccucggaagccccuccccucuucaagacuauuccuuuuccugccgcaaacuuagcauuacugcuugcaagucagcacuuuaaauccaguauaccaaaauucacaaauacauuuauugaaugacuacuacauaagagcaauuuugcucugugcgguuggagguaguagagcuagcagccugcacaguucauuucauccucccuucauuaggccacugaucauuggccuauaacauugauaauucaucuugucaguuauucucuuugaggaucauuaguggcagaugaugacaaaaaaauucuaaaaugauuucaucacauuuuugaauaccucugucaccaacccagagaccauaugcccaagaaacaaaagccaguuuaauauuaauagaagccaacuauaauaagaaaagcaaaucugauugugcauccaaaguuauauacaucuacauauuucaaagccagagaaccgcccacuguagcugacuuugaagagaucccauuuugugugcuuauagccccaucuuggguuccuaaaaugguaauuuuuuuuuucuuuugggaauguguggaugcuugcacagguaagggaggauuggaagauagguaggcaaauccuuuucacaugugauuuucuuuagagcaggaugcuuguggacccaaaccugcaccugaguccccugcucuuuaaagggaaagagccuucuucaacucgccucucuucuuauuuuccuaucucuccacaguccgaaucugcuccaagucuuauuugacccuggaaaaugggaagguuuuccugacggguggggaccucccagcucuggacggagcccggguggauuuccggugugaccccgacuuccaucuggugggcagcucccggagcaucuguagucagggccaguggagcacccccaagccccacugccagggugaggggaacagcugccugcaugcagcugaugaggacgcuugugugaggaugggaguggggugggaauggauaaugggaaagaauggagagcuauaaaaaugugggggaggacacuggaaaggggagaugaaagucccuuuuuccuccaucaccugccucaaacuuccucuugcaguccccgguauccucuguagguugggggcuuccuuccuuuaccuuuuaaaaaaaucuuccugcucccgauucuuagaccucacguuuucucuuuuccuuuaugaaucucaccucucucaccuucuucagguuuaaauacuccaauuuucccuuucucuaaacuuagaaauuuccaugcaucacccucuucuagaauucaucccucaccauuccuuauauaauugauuuauuguaaagacucagaaauaaaucaaacauucuacuaagaaaaauugagaaggggagcucuggggguggaaacauauuaggguaaaagacuuaaaauuggaggcagcauuaucagaagaugaagaacaacucagggauggggugggaagaagacagguccuuuucuguacuuccuagacaaccuccauuauucccuaagggaaucaguguugugucugucuacuuuuuuuuuuuuuuuuuugccacguaauuuuacaaacucucccuuuucuaggcacccgaacucucugccaucuucucuccugggaugcagucaucccauuuguaugccucauacuuccucuacccugguagauucuuucaagauccuugggcuuuacuuuccucacauaacucaguuauucugcuucuaguuuaccauuuuauucuggaaauugagagucccauccagggguggacuuaugacacuacugaaacuuagacuucaagguuccucaccuacagggcccucuuccugugcucuaauaauauagagggcucgauggauauguguucauaugguaacaggcuuuuguaaaaauugcagaaauaagauuuuaacagcaauugcuuaaagccaauuguauguguaauuuuuuuucuuaaagacucccaauuuuguaauauucaggcaccacagaaccaagaucugccccaaacuuagcuauuggcauucccgucucaaauucuguuguccuaugaaaaaucgaagaagaaaauaaguccugacccccuuacccccagacccaccuuguucuuauccccaggcacccuccccucagaaacgcaggcuucugcucuccccggucuucagcauggacaggugugggagggggcuggggaucaggccagggaagcugggcgccagugguaacucuucucugauccccgucuuuccugcugccagugaaucgaacgccacacucaggugagaugagaaacccuuaccgcgcgcacugcaaugcccuccccuucacucugcacccuccaccccccugaaauucugcccuuaggcuacggggcgucguccuuucgcaccuuccccaacccaccccaguuugcggccacccccuucccucccuaccuguuuccugccuccagucccgguuuuccacgaggcugcggucucuccuugucccugcuuggcuacacuucccugggcuccaccuccucccagacugagccucgccggugucaggcagagcccagcagagggcggcagggugcugggagacccugagcucccaccacguuuuccccugugggguuccuugcgaccuucgcuggaaccuuuuccagccugcugccuccuaggauuucaccuaauggacuuucucagccugucccacccaucccaacccuggccaggccucucgcgcucuuccccacaucuuuuccuuccguguaccccuucccucgucuuuucucaauuccauguccugucucccuuucuuaggcuucugucuacccagccccaggcucccuuccacgaccccaccacucccucaaaccagccucccuuccguacccaacucguucccuccaaaaccguuuccucucccccacauccucagugcuucacuguaucgacucauacucccacuucagaccucaggcgccagccccguuucucucccgucccacucgcauccuucccuuccuacccugguuccuccgugcuucagccucccgcggcucccuccgcccaccccgcccuccuggcacgccccguccccauuucuccuccccucggguccccuuaagugagaucccucccuuccucuuucguuccuuuccuccucgagguugcauccccccuccccuccccgccccuccgacugucgcucccaccucggcgcucgcuucccuccccgcccccuuccugccuccccagcucccgcccgcccccccaccccccgcugccgcgcgccgcccgugacgucagagcccccucccagccccacaucucccuccugcuccuccuccuccccuccgucggucagucaguccgcgaggagaguccgcgguggcggcgacgguggcgagagccgcgggggccguaggaagccaaccuucccugcuucuccggggcccucgcccccuccuccccacaaaaucagggauggaggcgccuccccggcacccucuuagcagcccuccccaggaaaaguguccccccugagcuccuaacgcuccccaacagcuaccccugccccccacgccauggggcccggggccccuuuugcccgggugggguggccacugccgcuucugguugugauggcggcagggguggcuccggugugggccucccacuccccccaucucccgcggccucacucgcggguccccccgcaccccuccucagaacggcgcgcaguguacaucggggcacuguuucccaugagcgggggcuggccagggggccaggccugccagcccgcgguggagauggcgcuggaggacgugaauagccgcagggacauccugccggacuaugagcucaagcucauccaccacgacagcaagguagcccuggacaugggggugggugggaggugggggcuugcggggcagggggccagccagcugcacgcgcccccaucugucugagucgucucugggauugcgaggcagaccccucccuugugugacuggcaggagaugggcugggggugcaggagcuuggggagagucgcaggggcuggagguccaagaugagggucuaggggcucaagaugguuaagcaugcugcaaggcagacccuucugccccgcugcgggagucucgcagaagugucgggguuuggagaaacuggugguggauuuaagguauuaggagacacugauccucugagggaguaaacuaacccuggaauggguuggggguggagggaaugucagagguggggagcuggauuggggguuuacauuuaccaugguaacaagguaaaaucuuggcguagguuggagcuggaaggaauagggacagaaugaggaaaauuuugagagacuugagagcucuaguuuauuuaucuuaacaaaacagcaagguaguggugagcccuaccugacuccuucucauccuucuauucccaacccuguugagcauucccagacugugggauagauggcauauggugauuggggaaggcuaaugaucaagaggugggcagaggcacugggaaaaugaauuggauuggggauccacaugggaacccccacaauagcauggggaugaagaagagucaacauacaaggagaagagaacagaaaagaauggcagugggggagaggggcaaggagguagcguggggauaaugagagaucuuggggcaccuuauggaacuuggguccugaccuucccuucccuuauagcauuguggccucuaggaugugagaagggaaaugggauguagggauuagggaggugaguugagggagagagagaagguaagcaaauuuggguccagggguauuaggggauagcuuauaaugagguuuuuuuucccaccccucuccccuacaugaauaauugggggugcagggaaggaugugacacagggaaggagauuuaagaucucaaauuuaucuucacugacauguggccccagagacuuaaggaauuggguuagggugaaauagaguacacaaggugagaauuuggugaucuuaccaaauaucaaccuuggggugauccaaggauuuauauucauuuuuagaacaucacuauacaccuagaaauaggugugugucugggauaggugugugaggggacagaagugagguugaagguagggugcuugaagagaagagagcacaaggauuaucaggagcuuggcaagagaacuuaaaauccuuuuugacuguuacuuucucgugguucucagccuucaguguacauaagaaucaccagaggaguuuguuaaaaauacagauucuagcuccuuggucagggaugaaucccaaguauuuaucuguauuuuuacuaauagacauccuaucuugguggauuccugagcuguaagcuaaccccagaaugccuaugggaagagcagcaggguacaggaaaauaauuagguauuaggguacgggaggcaggaagagaaguagaggaucagaucugguagagggucagacuugggacagucagagagaucauugguuuuggggaguggagugugaagaaaaugacagggagagaugggugcaggcuuuaugauaggggaucacaggagauaggggaggccuggcugugagcucaaacucauccaccaugacaggugauucccuggagguggcggggagcagacgugggaccugggagaagggaacuggagaacaucagaggcaucaagcggggugggaugggaaggcagaagaaccagaaugugucaauuggaaugagucgguuuccugccugcaaauccagauccuugcaagagcaaagagagggaggagaacuaaggaaaucuauuggggagggggagagaaucacgugguggagagaaucugcagugaugaauaguguguggaagagggaaacgguugcaagaaaagguagauaagaaaucaggaaacaaaauggggggcaugccuugcccuguugauauguaucuuauauguucuuguauguccucauuguuccuauuaacccugucuuuagagaaguggaggggcacugaggggcugugggagaagcugggagcaggaucuggaguaauagauguggggagagugcaggaagguggguccugagaaugguaaagauuuacaaaguugcccuagugggaggcauaaagagaaaaccuuccaauguuguugagcacugcccuuggccagagugaggguagggugggcaacagagaauucucagugacugcugguucuucagauuccaacagcuuccccuggcucccccuucuccaacuucccaccgugucccaaaugucaggccucagugggagguaagcaggcuccagagugcuuucuuuauuuccuuucuacuuauccuccccuccuggcaacauuucacccuccuuaguccccugagcccccugucuguguccccucugcccuggcuccccacuggcugccauuucgucuucacaugcauugggguuccagcagcuucugaaaugucauauaucagugggaggggaacaggcagugggagacccaaggcuggcucuuccucccccauuuccccuccucccaagcuuccuuucuucuccagcuuucugcuuguuuacuuucccuagcuccaagccucucuuuaaggcaccucucaaauugucugguuucuugagaguuccauucuauucauucucucuguucuuuccucauccuacauucuucccuacuuccaccccccagugucuuuuuuucuaauggaccugucaaaugucagcgcccagcaggagggauggaucacugagcgggacccccuacuggucuuguuccuguucucucuuuacuuaucacuagcucugaaaagagaagagggaggaaacaaauggaagguggggagaagggguuugcagaggugaggaaggaauuuucauaauauggcuuugagcaagcuaucuggggauguggaaagaguuuaccguauuccuacugacuucuuccacccacugguguuugaagcauagaaacaugggguaaagggcuuggugacagagggaagggggaugucugagggugagcugaaaggagguaaggugguauguucauuaauaccaaaggaggggugugcaggagaggugauggguaaggcuccagauggaagacagagaaggaaguuuaaugaaagaggagaaaaaaggcacuugacaggaagagaugccagaaaggagaagaaaacgguaauuaaugaugaaagugaguaauugagaaaggaacuaauuuguucgagaaagauaagagcaggaauugcagacaggggaggggccccaggagagcuugcccucaucuccucuugucuuucagugugauccaggccaagccaccaaguaccuauaugagcugcucuacaacgacccuaucaagaucauccuuaugccuggcugcagcucugucuccacgcugguggcugaggcugcuaggauguggaaccucauugugguaagcagggcuaugggggucagaagauggggucauucccuuuugagcucuacugaagggacgauggcgauuguggguuuguauugaaaaggaguguggaggaccugcuacuaagauucagaguccucugcagaccugagcuaggcagccuccuagcaacaguggccugacagugcugcagcugaccuccuucuucagaaggaauugaaauuagaucagugaaagagcaucccgguugugaggggugugugggccuuugagaaucucuuuuccuuaggcagaccagagguggggagguuuggagagaguaaggaagagaaacccaaaggcaggaagaggguuaaaggaacucuuggccacucuugguguccucagugaacagacccuguugcacucacucucccugccccacagcuuuccuauggcuccagcucaccagcccugucaaaccggcagcguuuccccacuuucuuccgaacgcacccaucagccacacuccacaacccuacccgcgugaaacucuuugaaaaguggggcuggaagaagauugcuaccauccagcagaccacugaggucuucacuucggugaggagggguugggcaagggguaaagggacauaagcucaaauuccagcaccaggagaugugacgugagagucacuuuuaggggcaagaacuugauucuucauugaaagagaacgcauuccauguggauuaagugcaguucuuucuguagccaggggaaagaaugaguugaguuuuugggauccucucugucuuuaugauuuuaugauuuuuuuccccuguuugaugcccuguuccccagacauauagacccagaaugacucaguucuguuaaaguagguucaauccaaagugggggcaagagaugggagcgaagaugagauaggaauccaggaaggcagcagauuccagaggcuuucaagggggguggugggugggugugaaugggaacagaggggauggagccaguggauuacagaggagagagggagaggaaagagagagagagagaggaaugagggagaggagagagaggggcagaaaggcagcugcauggaucugguaguugguacuaagagagagaagccgacagacaaggagagguugagggggaagagggagauuuggggagguagagaggaaauacaggcucuacaucugaagaaggcagucugcucccucccuuuuauucuauucuuugggucuucuauccacuguguucaguggcccuuuaauccucccccacuuucacucugauucagaccauucuucucugauccuuugucugucugcccauuugccucuugagguugacaucaugcugucugucccaguccuugccuugucuuuuccugguuccuuuauguuucuuuaccccaucuuugccuucagugguaggagugggugaauggaguggcuucccccacacagagccucagcaggggcucaccauucaccuucccacuuggaauccacauccuaagaccagaugccuucccgaacuccucacuucagggacagaagcuguugaaggaagguucagaauggcugcuucuuugcucuaucugaguauugcucugaaauccccaguuaaccucucuggucuuuauucccucaugcaccccguguuuuuccaacuuguuuuuuauucccacccaagacucuggacgaccuggaggaacgagugaaggaggcuggaauugagauuacuuuccgccagaguuucuucucagauccagcugugcccgucaaaaaccugaaggucagauggcugggaguggugggcucuguuuacggagggaccaagcugggggacagugacugguuggagaggaaagccaggcgggggcagguuuugauucucugaggcaauagcaucuccuggggaaguuuagcuccaucuuccaguugacguuuauucacuauacguugagcguuacccugcacuaagcacuuugggaugggaaaucaaagcugugaagacaucuggcuuagccccucaggcauucccgggcaucccucaggagcuguuucuuucucuguuguagcgccaggaugcccgaaucaucgugggacuuuucuaugagacugaagcccggaaaguuuuuugugagguggaguuggaucugaagagggaggggcacugggugggaguuucccuugguuuucuuguggggccuccucuuggcaucugugccugaguugauagcauaugaucugaggugacgauucauaggaugucucugucuguuggcucugacugcaucccuugucugcacacacaugauacuuucuucagaucucauuuuucuacugcuuuguguuuccugagaagcccaugaauuccaucuguccugacuggcuggaaaaggccacucagaaauacaggggcuggggagaaacuuagaaggaagaauugucagccuuuccuacuauccccaagacuuguagauuucucuuuuuaguucuacugcucuucccugauucccaagaggcuaaauaguaucaagugagauaagacaaaaacaaacaaaugagcaaacaaaaacucagccauucuccucuguauucagguguacaaggagcgucucuuugggaagaaguacgucugguuccucauugggugguaugcugacaauugguucaagaucuacgacccuucuaucaacugcacaguggaugagaugacugaggcgguggagggccacaucacaacugagauugucaugcugaauccugccaauacccgcagcauuuccaacauggugagaguguggggacuugcagucuggcaccugggaggguggagaggacugagggggccuugcaggggaaaggguggcagggagagggugcggaauuuggauauaaaggagaagagggggcugugcccacccugaacuugucugcauuauguuuccuguggauccuaccuuugcucugacuuccuuggguagagagagaaaaaaaaaaaaacgauggaguuguauguucaguagguuccugaugaguggaagggcuguuaccauggagacgaggagcaguuggugagaagucaggaggaaccggcauuaaugauaauauggaugcuuguauacucaagcacaccuuuacaggagcacugugucugggcagaauugcauuucauuuucuuggugauuuauguuaguguuuuagaguugcuuaauauucacucaugauugauaugcaauuagcuuggauccuguugcuuuuuuuaaugauucuuuuuuuagaauuuuauguggagaaggggcuuuugaaaucauuuagccccagacagcugguuaaugacagacuuggagcgaggaggcgcauucucugauuugagagggcuggggcagcccugcagcugaggggcagaagugagugugggugugggcacaggggaagaggcuucuuuguugcucagcacuacauuguaaagaguacaggaauuuuggguaagcucgauacggccaccuaugugucugcuuauuacaccaaguguguaccugcuuuggagagcauguuaggggugaguuaaugguuguaaagccccaaaauagcuugauuuaaaaaguuuuacuaacaguggcauuugugugguacuuagauucaugauuucagggauucuaacagcaaaacucugauguggacuuaucuacauuuuguagaccaggaaaaugagacucagagugguuuaaugacuugucucaggucaugcagcuacucagcaguccagcuggaauugaauccuaguuaaaucuggcuccaaacugcucugcucaucacuucccauggaaaaccaugaagccugacuaaaaaguuuguacuuuuaucugcuaacacuguuuagcuacuggcaauugcugagcaaaggagaaauaagauuuaggaaguugacucuggugguguguugugaugaaagaucugcugccacauggacucugaugauacacacuguuuugggacauucuaaauggacucuauguuuuaagguauguuaguugaaaaauacaaugaaaaaauuuuggaagaucacuuuccuguagaguacccaagaggugagucauccauaaaaccugggaaaguauuggaacuggcuaccaaagccagaaagacuuguuggugcccugagcccaggacuugccaaucguugcuucugucuuauagcagggagcuagaggaggcugacagaaaacagggauuuggcuggaucuaguggcucacaccuguaguccccagcaccuugggaggccaaggcagaggaucacuggagcccaggaguucaagaccagccugggcaauauagugagacccccagcucuaaacaaaaagagagagagagagaacagagagaugguuagggacauagagggacaccugagcauuggggugggaagacuuggaaggucccuuucugacuuugugucuagagaaagaugguuccugcuuuugaggccauagggcuuccagugggaccagccuaaaaugccaguggggaagccaauguuuucugaagaggauagagcagucuuaacaauagguuaggggcaaaagagauuauagauuaaucaaacagcacaaauagaaguggaucaaagcaaggguuggaccuagggggccggagccauggagacuuagaaaagaagcagaguugcuuuuauucccuaaggauggccuuauguuuagaucaauaguucucaaacuuuaacauccgucagaaccaccuggaaagguaguuaguucacagguuaucaggcccuuccccuggaaauucugauucaguagaucugggcuagggccugagaacugacauuucuagcaagucccuggggaugcagauguacuggucuggggaucacaccucgagaacuauuaguuaggguagugguuuucaacuacuacccuagacucagacgcuauacuaucuggaggcauuuuugguuguuacaguuggggguaggggauggggagggauacaugcuccugauaucuaauguguagaagccaaagaugauucuaaauauccuacaaagcacagccccuggcaacaaagaauuaucuugcucaaaauguuaauagugcagagaaugagaaacccuaguuuagagaaaacaucuuuaggggcaauauguggaaauggagaguggguuagagugguuuuagagaaauguagcugugggcuagaggggaaugugggagguggcauccuggagauaagauugugaggaaaucuugauugggguagagaucccaucagaccuaggaccaguacaaacuaaaaagcuaccucaagauauacauuuuagcccacugucaagcauccauucuugagagccagacaaggcuguuaaaaaaauuagguauaaauuugcacuugguugauuaacuaauugcuguggguugaggggucuuuauuguucagauuuccuuaagcugcagaguagagugucucuuugacaaucuauaacuguaucuuuacugacucaagggggaagcauucuacucuucuuuacucuugggguggcaggagcaguggugcccccagugguuaggcguguuagugguagugaccuggcgugagcacagggucugaccaccugagcaggggaccgcaucgugcugagcagauuaaucccuuucuuucugggugauuuuuuugaugccauauuuaccuugaacugaagauuggauagaccaaucuuucaauuugaagccaaaagacuacucaaaguauuagccuagcugcuauuugugcaggugcucuuagagagaggcagucucauguacagagacuguguaggguggcugguaagaguauggauuagcucugcuacucauuaauaguauaacuuuuuuauaggcaaguuauauaacuuuucugugccucaguuuucuuaucucuaaaauggggauaauaacaccucauuggauuguuugaggauuaaauaagguaauauaguuuccucaggaaaaugcucgauacguccuaaggacuguauacauguuagccaccaucaucguuaucauuaucaucaucauccuguguaaggagggaucgauaucaaugaaacauuucaacaaaagaguuaagaggacucagugauuugaaagggucugauguaauuccaaggcuucagucucauuuacugggagcuguuugggaguaagaaaaaauugagcuucaucuuggauauuuugauuuugagauuauucaucauacauuaaaaaugccucagagucaguuagaaauauggacuugaggcugggcgcgguggcucacgccuauaaucccagcacuuugggaggcugaggcagguggaucacaaggccaggaguucaagaccagccuggcuaacauggugaaaccccgucucugcuaaaaauacacaaaucagcuggguguggugucgugugccuguaaucccagcuacuugggaggcugagacacaagaaucgcuugaacccaggaggcagagguugcagugagccaagaucgcacuacugcacuccagccuggcaacagagcaagacuccaucucaaaaaaaaaaaaaaaaaaagaaagaaagaaagaaaagaaauauggacuugaaauauugggcugaaauuauagaucugaguaucaauaacaaagaugagguugagagucaaggaaauucacguagagaaaauguaacuuacuucauacccagcauuuuuauacauguucuaauuucauuucauacuauuuuagauaguauuauucucauuuuaaagcugaauaaccaacuagugagguuuaauaacuuguuugagauuucauagcagguaaaaugauuagaauaugaauucauccauuuaucuauccaacagacuuuuuuuuuuuuuuuuuuuuuuuuaguagagacgggguuucaccguguuagccaggauggucucgaucuccugaccucgugauccgcccgccucggccucccaaaaugcugggauuacaggcgugagccaccgcgcccagccuuuuuuuuuuuuuuuuuuugagguagaguaucccucugcugcccaggcaggagugcagugguacaaucgcugcagccuugaccuccugggcucaagucauccacccaccucagccccucccaaguaagcugggaucacagacauaugccaccaagucuggcuaacuuuuuuuuuuuuucucgagauagagucuugcucuguugccuaggcuggagcacaauggugugaucucggcucacugcaaccucugccuccuggguuccagugauucuccugccucagccuucugaauagcugggauuacaggugcgugccaccaugcccagauaaguuuuuguauuuuuaguggacaugggguuucaccauguuggucagguuggucucgaacaccuaaccucaugauucacccuccucagccuccugaagugcugggauuacaggcgugagccacugcuccaagccaaguccggcuaauuuuuuuuuuuucugagauggagucuugcucuguugcccaggcuggagugcaauggcaugaucuuggcucacugcaaccuccgccuccuggguucaagcgauucuccgauucuccugccucagccuccugaguagcugggauuacgggagcccaccaucacacccagcuaauuuuuguauuuuuuuuuuugagacagaguuucauucuuauugcccaggcuugagugcaauggcgcgaucuuggcucacagcaaccuccgccucccagguucaagccauucuccugccucagccuccggaguagcugggauuacaggcaugcgccaccacacccggcuaauuuuguauuuuuaguagagacaggguuucuccauguugcucaggcuggucucgaacuccggaccucaggugauccacccgccucagccucccaaagugcugggauuacaggcgugagccaccgugcccagcuaauuuuuguauuuuucauagagacaggguuucaccauguuggccaggcuggucuugaacuccugaccucaugaucugcccgccuugaccucccaaaguccugagauuacagaugugagccuccgugcccaggccaagucuggcuaauuuuuaaaaaaauuuuguagaguuggguccucucuguuuugcccagucuugucucaaacuccugggcucaaggaauccuccugcguuggccucugaaaaugaaaauguugggauuacaggcgugagcccccugugccuggcugccuuuuuuuuuuuuuuuuuuuaaaggcagagucucacuccaucgcccaggcugaagugcaguggcgugaucucugcucacugcaaccucugccucuugaguucaagcgauucuucuaccucagcuucccaaguagcugggauuacgggagcccaccaacacacccagcuaauuuuuguauuuuuaguagagacggguuucaccagguuggccaggcugucuggaauuccugaccucaggugauccacccuccuuggccucccaaagagcugggauuacaagugugagccacugugcccagccugacuuguuuuuuauaaugccuuuuuuuuuuuuuuuugagacggagucuugcucugucgcccaggcuggaguguaguggcgucaucucagcucacuguaaccuccaccuccuggguugaagugauuuucucaccucagcccucagccuccugaguaguugggacugcaagugcacaccaccaugcccagcuaauuuuuuguauuuuaguagagaugggguuucaccauguugcccagcuggucuuuaacuccugagcucaggcagucugcuuaccuuggccucccaaagugcuaggauuaaaggugugagccacugugccuggccuuuuuuuuuuuuuuuuuuuuuugagcaguuuuaguuucccagcagaauugagaugaagguacagaaacuucccauaugcuucccacaugcauagccuucuacauuaucgacauccuccgccagagugguacauuuguuacaacugaugaaccuacauugauacaucauaaucacccaaaguccauaguuuacauuagaguucacccuugguguuauauauucuauggguuuggacaaauguauaaugagacguaucuacuauuaaauacuuuacagaguauuuucacuggccuaauccaauggacauuuauuguuacuucauuaugguugggcacagugcuagaugcugaugauuaagagagggcaugggauuuggucuuguccucaaggguagaaccuaggcccauugcaucuucaaagcccaggcuccuucaaagcccaguguaguagcaacugcuguaccuugccugugcccuuugcguaucucacuccucuaucucucuagaaaguuggagagaaaagugagcaaggcaugaggaacaaaguuauuuauuuauucuucauucaucuauuuauucuuucauuaccguuuguguuaaaacauuccaaacccaaacaauuauuuguaugguccccuguguauuacuugugguuucccaagaaguaguugcuaagcuuuuccuuguaugguuucugugagguaaggaaggaaugaugugauuuucuccaguauguagaaugcaguuccaagagguuaaguaauuuacuuacaguuauuuagccaaacaagguuacugcaagguauaugaagucaggucucuugacccaguucaugagagaguuaaaggaacuaucauucuuuuuagcuuucauggaaaaagaagguugaguguugggagggguguggguaggauugauaauggacuucaaaaaugugaaggguauuucuguaguuuucauucuucugaaagccuucuaagaggcagugaaccaaaagcacacaagaauggcaagaaguuagcaugcugaagaaauauccuccuggcuggcaagcagagugagaagacugcuaucaccuuuucuagaaucuuuuggaauuguaggagcuguuagauccuggguuaacucuaugaagaaagucagaaggaucagagaacaucagugucacagcucuucauuggaauauccaugucuccuccuuuacucugcucuaccuuccauccuuugccacuaauuauccagaguguuugucaaaauucucuguuugcaguucugagcuagcaacuguacacacuaacaccaucagacacagcuaauaccuacucuagucuaguagcuuccgaucuaaggcagacacauggguauaguuaaagauuuugaauguacauguguccaaucugacaacaguaacacaaaccauccauucaaguagaagugauugagucagaauuggauugcaccccuucccccacacccacacacauuucaguucuuuccucaugauuuuuuccucccaagacaucccaggaauuuguggagaaacuaaccaagcgacugaaaagacacccugaggagacaggaggcuuccaggaggcaccgcuggccuaugaugccaucugggccuuggcacuggcccugaacaagacaucuggaggaggcggccguucuggugugcgccuggaggacuucaacuacaacaaccagaccauuaccgaccaaaucuaccgggcaaugaacucuucguccuuugagggugucucugugaguuaaaacuuccuucauacuccccugucuucccaaucuugagagagacucccaagaggcaccuucuacaaacaugcauucucuguuuuucucaguuacuucuuugcagaaucagucuccgaccagagaaguagggaccuucaaauuagaagaacccaucaaagacuagaggaaaaaaaaugauguauuccauuuuuuuaaaccccuccccucauuucuuuucaaacuagaccaaguauucaugagucagaugagaacuauaggauuuugaaagacaaaacagucugaaaggucaucuucuuauuccuuuuaaaaugaaaagauuaguuuccagagagauuugcugacuugcuuaggccacacaaccagaagccugcugguguucugucuggggauuuuuucccauucaaaucucauaagugaagcuccuucuccaaagaauaauguuucuaaaaucuaggguaugggcaucugggguauguccuauaugcaggcaaaugccauaaauagcauucauucagaggcucaauuacaucaaaaacagaaggauuuaaagagucccugauguucucuuucacucuugcuuuugucuccuuugccuugcuccacauguuccuucccucagggccaugugguguuugaugccagcggcucucggauggcauggacgcuuaucgagcagcuucaggguuaguacaggggcaggaggggaccggacaugggggcuaggcuggggcugggcugggaugcccccuggggaagaaugccagagacaucacaagauugcccuggcaccucccaacuucugcccuucucuuuuaacucuguucaucaagcuuguaaauaauaauaauaauaagcuuaacuacaagaagauugaugucuuugaguugcacugguuuugcucuugaaaagaggugugcaggcugggugugguggcucaccccuguaaucccagcacuuuugggaggccaaggcaggcagaucaugaucauggucaggaguuugagaccagccagaccaacauggugaaaccugucucuaccaaaaauacaaaaaaaaaaaaaaaaauuagcugggugugguggcaggugccuguagucccagcuacuugggaggcugaggcaggagaaucacuugaacccaggaggcagagguugcagugagcugagaucacgccacugcacuccagccugggugauagaguaagacucugucucaaagaaaaaagaaaagaaaagagacaugcaaauuaaaaacagcuacucucuuucccaguggcuuccauuaauuucaggaauuuccccuugaguggcuuggguugagagguugaugaccugucaguuagacucaagaaagcugaaucuaggagaaccgcuauuuuuuuuuuaagggaaucugccaaauuuccuugcuguguaaagcuucaauguguauagcuuggcuuuuguagauuguauuuucuugaaacuuagcacacagguauuugcagaacuucuaggaguuaauuuuucugcuccacucggcucucagucuuuuacggcauggccaagagagcuauuucuuggccuccugugaaaaguuucuuucuuccuuucuccccaccuccacauccuuucagcuccucuuuguauccaggacaagaggaaauggacuucagccauggugaaaggagugugaguuggcuuuugaaggaaaaguuaugguaacggaaacaguucuagaacagaaaucuuagaaaugaccaaauuuuacucaauggcgcuuuaagaggcagauauaacuuauccaaggaauuaaaacccaagccaacagaagagaauguucuaaaauuaaaaugaaagccacugggaaaauagagccugcccaucaugagaggaagaauaagcagaaauauguguaaagcuuuagaagccaaaaucaaagugagagacaucucgccgagagaggugugaggaauggaauagguggcagacauguuguggagccuccucacugaagacuuuuaaacauagauauucuuauuuauuugaguugucuugggaaccaccuuauauugcuuuuaagucauguugcugauucaagagucucguagguccuuccaagcauccuuagggccucaggugaaaauaaaaucagauacaaccaugcaaagcucuagggaagugggaaguugaaaaugccuaggaucagcucuuuggcuaccuguggucacuccuuuuauugucgucugcccagguggcagcuacaagaagauuggcuacuaugacagcaccaaggaugaucuuuccugguccaaaacagauaaauggauuggugaguggaucuuguuuguauuuuccuucagccccucucgacagucaagggaaaaagucaugccuuugagugaggauggaaugguagagacuguuagguuggaauguggcuggcagcugggccaggagaaaggguuaagugagagugaauacaaccccuaaggcguggguaggggagacugguguauuuggagagggaauaggcggugguuaguacuauuuuuaauggugcauugcugggguaacuggggauuagaggcagggggugggcagagggcgggaaauggaaacuccauuuggguuucccagauguccuggugucuugauauauuugaaccagcuacuucaagcccagagcugucucuuugucugucucugucaggaaaacgguugcuuaaacuauggaggaggagggaaaaccucauguaauugucaucugccaaaaugugcuuuuuauuuuuauauguauuuuuaaaaauuuuccuauuuuuauguaauuuagagguagacgugcaguuguguuacaugaauauauugcauaguggugaaguccgggcguuuagugugccugucacccgaacagugcaccuuguaccuaauagguaguauuacaucccucaaaauauacuuuuuaaagagagaaagcaagcaguuauucuuuguguacuuggucuaaaugauaggacauaggagagaaacugaagguggacaaaaggaaggaccuacugauaaaagaaagccuccuugagaaugaaggggaggcucaaccauugaagauggcugccgucugcccugcccagcagauauccagucauucccagcacugcuggaguuuugcccuuuuuuuuuuuuuuuuacaauucgaauuuaggacaauguucuggauugcuauaaaugcugcauggccuaaauuauucuuuaaaaaaaaaacuaagcaaauugaaauuaguuuuuuuuggugaacucugacaaauuugaacuucccccuaauaauaacuggaaaacauauuugggaauauuacccugccaggauuaaaauuucagauuagcuuuccuucuuuuuuuguuugucuuaagaauagguguccacacuagauacuucaaggccuuuuuagcuuuaugauuccauaauugucauuuaaaacuuugauuuggguuauaagaaaccuuauaacauuuuuuaaugauccccuucuuucuccucccauuuuccuuugcuguaagaaagacagaaaaacuuaaagaacaaacaaaaacaaagacuacaacuuuggggacaugccucagcauuucccaaccuauggauagaccauucacuccaucuucucaucucauuucugguugcuuccuaacggccccaguggcacugagcauucugccugcaguaaccucuguccagugcaguuagggccucauguccccagccaaugacugaauguccaucagcaaucuaguucuuugcccuuuucuccuaucccgucuucauuccuuuguccuccuucccuucucuuuucccuuccccucuuccuccccugugccaugcaggagggucccccccagcugaccagacccuggucaucaagacauuccgcuuccugucacagaaacucuuuaucuccgucucaguucucuccagccugggcauuguccuagcuguugucugucuguccuuuaacaucuacaacucacauguccgguaaguuucucuucugacguuuuccuugucugccucucugagauacugaucauguuccuggacaggaugagaauaaaaccuguguaacucccauggccauguaucauggaguuuuucauucugacuuguugagaaugaaaacagggaaaccagauauaacccccacuccuacuccaaaguagcuaacgggaggaaaaaagaaaagaagagaaaaaaacaaccuuuggggccaggucucacagucuuggacucuacauaaauagccuguauucuagugggggccugugcuugggaagcccucugcaacuccaucuucagccccaugacugcauugcucugccucucaaggcuccacugucuucuccaauccugucuuccuuuagccccuggcccugaaauuagggucaugccauugcgugguauuuggagagcucagccucccuggagaagagggguaauucucucucccucucacccucuccaccucugcccuaguuauauccagaacucacagcccaaccugaacaaccugacugcugugggcugcucacuggcuuuagcugcugucuucccccuggggcucgaugguuaccacauugggaggaaccaguuuccuuucgucugccaggugaggagguggugggcaaauuccuuacaggaugugacucucccacccgucucaggagcaccuuccaugauuuaugauucucugcccuuccuccucagcuuucccugacucuugucccuguucuuuccuucuagcaucaccccucuguucucuguuuggcucugucccuucuuucugugucugcaggccauuuucauucuguaguuuacuugucaguuccaagguugccauggcaggccuugcagagaagaggagggagccauugaaggcaaaggaaggggaucugcucaaaggucuccugaacaaugguggcuugucugugguaugggggcugagaaucagaacuguggacuuuuuuugggagccuuuguuggguuuggaaggauagaagcagagauggaaacacagcagagaguuggggggaagggaccacugccacacagggaggaggggcucugggacuguugguacauggaagguucuagugcuguggggagaggccagcuucaacagugauaguugagugguucucuuuuccacugguggaaacacccacucuuucuccugaucugccugccuguccuugcucucucuuuuuccucugcucugugcuguccugaucauacaucugugcacauggcauuuccaugcacaugcacaugcaguucaucaggaauccucuguucccagugaggccagagugcagcuggagaagcagacaauuagcuguagugcaauaggagagguuccagaguagggaucugcacaaagugcuuugggggcaaagaagggaacacaguucacugcuggcgugauuggguggaccucacugaagagguggcauuugaauacugaaggacaaauaggauuuuaucagcuagagaaauagaggaaggcuacuucaggggcauagggagcaucguguggcuagaaaauacaugaaagagaguagaugaagagaaagugaguaguucagcauggcuggagcgugggguagguguggggcugggagaugagccuagcuggacagguggaugggagcauguugugaagggucugugucauauccagaaguguucaggcuauaacuuauagauauuggggagugguuggagguuuuuggccacuaaagccaggagguuuuagcaagaucacccuggugguguggaaguagaggguggaugggaggaauuguucaagguggggagacugcucuccuccugccgcuccccguccugcucacauuuucgcauccucccugugccaccaugagcucccugcccgugcucccugcccacucucccuuaggguucugcccauccuuacugcagucccggcuacuacucuacccuguucugccugugcccucucuuccuuucuaggcccgccucuggcuccugggccugggcuuuagucugggcuacgguuccauguucaccaagauuugguggguccacacggucuucacaaagaaggaagaaaagaaggaguggaggaaggugagcugcugcccaauccucagcccccagauccuuggcuccuggggcacagagcauuuuccccugacgugccuguucuccccacauauuuauccagacucuggaacccuggaagcuguaugccacagugggccugcuggugggcauggauguccucacucucgccaucuggcagaucguggacccucugcaccggaccauugagguaccacuggagaggaggugcuauggucaggagaaugagcagggcucaguggccaucagggcccuggggcugugugugucuugagggaugaagcuacuuggagagagugccuuccucguauuggaagcucuuccuuuccuuccuagaaggagccccucauaggccuccagauucagcugaagaaaggaaggggugggaaucugggaaggguguguagaacuuccaggcaucagggaaaguggggaacaagcaccuccaaggguucaggaaaacauucuuaggccuagaaugagauuuggcaucagcauugagggucucauaggaaaacaguuggaagccagagacugagaagcguugaggagaggaggggaggcuggcaaccaucuuucuugugaccuuguuucugcccuagacauuugccaaggaggaaccuaaggaagauauugacgucucuauucugccccagcuggagcauugcagcuccaggaagaugaauacauggcuuggugugugggaugugggcaaaggagggcagggaugcacaaaggcaggagggaaggcagggguagagggcuuggagggagaggggucuuuggaagaggagguagagagcuugucaacccaguuugaacacccuacucuuuguuauugcacuaaucuuuucugagaauaggggagaguugcucuuuugcuaugaggagcuuagggcccaaagcacagaaagcacagaugaagaacuuguguucagcagaggaacaaguggggguaaccccaccuccagacuugacauuaucuuuuagaucccccuuggccuuauuagcauuguucgauucauggucacaaauugcaaaccuacccucugccuggaaagccaccuucccaccuguaggguaagggugaggcauguguggcccagacuggccuauuucuagauauucaacaagcccuugccugacugacagcagcuugccaccauugcuuuccugugugaaucccaggaaaaagugauguggucugggcaaguuggguggacauaagggauaggggacacagggugagguuugcuaggucagagggguuggauuggagaggagggcccccuuuccauuucagaguaggugaagggcagagaggggauggggauugagugaggagcauugugguccuuguugcucaagugacucucuccugccauccuaggcauuuucuaugguuacaaggggcugcugcugcugcugggaaucuuccuugcuuaugagaccaagaguguguccacugagaagaucaaugaucaccgggcugugggcauggcuaucuacaauguggcagugagcacugaccccauggcauugacccuguaggcugaccacagcagcccagauauagaggacuaggaagaaucaaugcuagaucugggaucgguugcuuagaagucuuaaaaaguuuguuaauucuucaggucuauaaagcacuuuacaguuuacaaagcucacuacagacauuguaucauuaaucuugcaacuacccagugaaguagauauuaguauccccacuuuauaggugaggaaacagaaacacagagacguuaaauugcuugucugugguuaaugggcuggacucuauugacauuuccugccagggaccgacucuggaggacccggaaucugugcauagagauccugggaguuccugccuugaggggagggguuaaccaagagugaaaacugguuugggacaguuugagauuuuucucaaucuauauuugaggaugauccugaauuuggauccuuuucaaagggaaaguucaccaggaaacugucugcauagacucccucccaugggaaguaaacucuggaucuugucugagccugcagaccugagacucccucaaugugucuuucccucuagguccugugccucaucacugcuccugucaccaugauucuguccagccagcaggaugcagccuuugccuuugccucucuugccauaguuuucuccuccuauaucacucuuguugugcucuuugugcccaagguaaggaucuggcuuuucucccacccucuuuguucccauguucccuccaucccuccuuccuauauuacugaguuccucugcccuuccguucacccuccucucacuccuccccuuguuuugggcccaacucuuaucagcauuccuuccaccuccaaccuuccaucagccagucacuaguacaguccuugcugggccaccccacgcccaaacauuugcccccagaugcgcaggcugaucacccgaggggaauggcagucggaggcgcaggacaccaugaagacagggucaucgaccaacaacaacgaggaggagaagucccggcuguuggagaaggagaaccgugaacuggaaaagaucauugcugaggugcgggggugggugucaggguaggguguuggagugguccaggaggcuugcgucuuagcuuggguugucugaagccaagccugagauacagggucagauguucuuggcucauggagggaggguccuaggagacaaccuguaaggagugaauggagcagcauaggggaggggaaagggcugagcaagauucuaucucaggcaaaauccaguguuggccuggcagguggaagggcucuggagugggagcuaugugguugacucagccuccuuaaggcaagaggauggcuguuggcuguaggugacaacuggagagaggcagcugugagccucuaguagucaacacucacagcagcuggguguagcaugcagccccagcauaaaggaccugggcaggcguucacugugccccaggcugucauuaggggcuggugcaaugccaaagagagggauguuccaacuggguugacacaucucucugauuuauuggaagcucugugcacugacuuuucucuccuuccccacuuuuuccuuuuguuuuuaaauucucucuuauuucccugaucgcauuuuuucuaucgguauccuuauguucucuggcuuuucuuguucuguuuugauuucuccuuuuaauuuauucuguccacuuacccuacguccucccccuacauuuuucugugcccuuccucucuuucccugugcccuuccucucuuucccuccuccccacuccuucaucaccuccucuucuccuacuaucccaauugugcuucuuccuccagaaagaggagcgugucucugaacugcgccaucaacuccagucucggcagcagcuccgcucccggcgccacccaccgacacccccagaacccucugggggccugcccaggggacccccugagccccccgaccggcuuagcugugaugggagucgagugcauuugcuuuauaagugaggguagggugagggaggacaggccaguagggggagggaaagggagaggggaagggcaggggacucaggaagcaggggguccccauccccagcugggaagaacaugcuauccaaucucaucucuuguaaauacaugucccccugugaguucugggcugauuugggucucucauaccucugggaaacagaccuuuuucucucuuacugcuucauguaauuuuguaucaccucuucacaauuuaguucguaccuggcuugaagcugcucacugcucacacgcugccuccucagcagccucacugcaucuuucucuucccaugcaacacccucuucuaguuaccacggcaaccccugcagcuccucugccuuugugcucuguuccuguccagcaggggucucccaacaagugcucuuuccaccccaaaggggccucuccuuuucuccacugucauaaucucuuuccaucuuacuugcccuucuauacuuucucacauguggcucccccugaauuuugcuuccuuugggagcucauucuuuucgccaaggcucacaugcuccuugccucugcucugugcacucacgcucagcacacaugcauccuccccucuccugcgugugcccacugaacaugcucauguguacacacgcuuuucccguaugcuuucuucauguucagucacaugugcucucgggugcccugcauucacagcuacgugugccccucucauggucaugggucugcccuugagcguguuuggguaggcaugugcaauuugucuagcaugcugagucaugucuuuccuauuugcacacguccauguuuauccauguacuuucccuguguacccuccauguaccuuguguacuuucuucccuuaaaucaugguauucuucugacagagccauauguacccuacccugcacauuguuaugcacuuuuccccaauucauguuugguggggccauccacacccucuccuugucacagaaucuccauuucugcucagauuccccccaucuccauugcauucauguacuacccucagucuacacucacaaucaucuucucccaagacugcucccuuuuguuuuguguuuuuuugaggggaauuaaggaaaaauaagugggggcagguuuggagagcugcuuccaguggauaguugaugagaauccugaccaaaggaaggcacccuugacuguugggauagacagauggaccuauggggugggagguggugucccuuucacacuguggugucucuuggggaaggaucuccccgaaucucaauaaaccagugaacagugugacucggcaccuugcagucuuccugugaacagaaugggcuucaauccaagaagggagguucagaggacuccaaguucaugaaaaggcauuaaagcggagggugaaaagagguguuuuauugauccauugagggcuuagcagaaugaagcaggacaugauuaagucugagauuagugagugaggacacuacugguuaaaagugugggcucuggagucagacugccaggguaucagauccaaccacaugcaaacauuuucuuagucucuauuccccauguccucauuuaugaaaaugagaauaacaguaauacauuccuccauagguuggguacaaagacuauuauaaauugugcauucaggugccuagguuggcccuugggccaugguauauguugcgugaauguuagccucugucccugcuguuuaaugaguuccuugacaguagugggcauguauugggagccuggagcaagugccuaagcauccccucuagggacgcuccuucccaggaacuaagaagaguaaaagaaugaugacugcuagaagguaauggaugagauggcugcugagugcuuccaaccuuaaacaucuuuguuuaggaacucugagcaucuuggaaauaauuugcuaucaaacugaaaaaaaaucuugaauggacaagggcaaaaacauuugccugagacuuuaaacauuuuuugugucaucuuggagagugcuuuuuugaagcucaaauuuucuuuuauuuuggcacugauuuuuaaagugauucucagauuuuuguaagacagcugcaaggguuggaugggcccugucauucacugaccuguuaagagccaauuucugaacuuccacuaaagcaugggcugguugaaucuuagaccaguacuugaaaaacuuuccacugugauuauccaccuuggaccaguuggacuuaauuugagucucucuucuucccacagugaaauauccgcuaggaaaagagaagaagucuauggaguagauaagccugcaguuuggaaaaugaauaguuggcaucagaacagcagcaggaggcugggugugguggcucacgccuguaaucccagcacuuugggaggcugagguggguggaucacgaggucaggaguucaagaccagccuggccaagauggcgaaacccugucucuacuaaaaauacaaaaauuagcugggcgugauggugggugccuguaaucucagcuacucgggaggcugaggcagauaauugcuugaacccaggagaugaagguugcagugaguuugugccacugcacuccagccugggcgacagagugagacugucucaaaaaaaaaaaaaaagaaaaaaaaaaaagaaacaacaguagcaggagcuauagaacagcccuggguagaaccuaaaagacccaaauuaucaucucaaacuugcauugcacuuaagugggcuguaaauuauaaacaaagggugaaaaguucuacuguggccaaagguaagccagacacucugcuagcaggagugcaggagucgagagccaaacggugcggcuagcagagugcccagugcaaaggggugggaaggag

SEQ ID NO: 18333 - RNA, 930 nt, Homo sapiens
cucaacuuuguaugagccccauuuccuucgccagcaaucuccugaaugcccugguuaccuccuuguuccucaggguguauaugagaggguuaagugaaggagugcccacugcauagaagagaccaaagaacuugccccucucuugggcauagggauuuuugggcuggagguagacagcaaugacugagcuguagaagagggugaccacagugagaugggaggagcaggucccaaaagcuuuccucugcccuuuugcaguuaguccuuagcacugcccaggcaauggcuccauaagagacaaggaugaggcugaggcacagccaagaugaagacacuggcaacagccaucuggaucucauuguaggaggugucuucacaggagagucgaauuagagcugggaccucacagacaaaaucauccaccugcugaugggggcagaaaggcaggcgcaggguggauggugucuggaccacugacucuaccagcccaaugacccaggccacagaugccagcugccagcacaggcagagguggacgaugguggcauggcgcaggggcuugaagauagccauguagcggucaaaggccaucaccgucaggaggaugcacucagugguccccagggacaggaagaugaagaacuggacagagcagcccaguaagaugauggucuucuuuggcucccagagguugaccagcaucccggggacacaacuuauggugaaacagagguccaagaaggagagguuggagaggaaaaaguacauuggagaguggagccugggguccagcacagacagcaggaugaugaguccaccgggguuaggagguaggaagugaagacaacuacaaagagaguccuuuccagugcuggguguucagagaagcccagaaggagaaagccuggugcggagcuuugguuaaccaug

SEQ ID NO: 18334 - RNA, 4610 nt, Homo sapiens
aaccaaaagaaauuuauuuacaaauuucuuacuugaccaguagugucagccaagaaacaguauaccaggaaaaaucaacuaacaccccacuaacagucuuuagaccaguucauacaagggaaugaccagagcagcuccugacuguuagacuagaaagauguccuucugcguauccuucaauuguacaagaauuuacauuuaaccaaaggggucugugcaaguagcaccgugguacuuguagucucaauugagucauagcuucuagagugcuguucccuguauaccuuacauagcuuuuucaccacuuuuguugauuucuuugucagcuucuuucccuuuuucuccuccuuugucaguuuugucuucucuguugauuccuuccucuuuuucuucuccacuaucagcuccuuucucuccuccauucuugguguucucuucuucuccacugucagcucuuuuuucuccuccauuguugacuccuuucucuccuucuuuguccugaacacugauauaaacagcuuuguuauagccuucccgguuccgagcaauuucaauggcaaagaauuguauccugggggcugaaaagugaacagaauugauuaucauccuacucucagcuuauucccuaaaucucuuuuuuuugagacagggucucacucugaugaccagggcuggacugcaguggcacaaucacagcuuacugcagccucaauuucccugguucaagcaauccuccugccucaaucuccugaauagcuggaacuacaaacacucaccacuauaccuggcuaauuuuuuaaacauuuuuguagagauggggucucccuauguugcccaggcuggucucaaaauccucagcucaagugauccucccaugucagccucccaaagugcugguauuacaaggcaugagacacugugccuggccuguucccuaaauaugcuggaaaucuacugacaaaauugaaauaacaugcaaaccauuccaguauagucauaaacuucagagaucuuuaauuccaaucucauauuaaugagauugaaaauacuuaacuaucuucaaguuacauaaaaauagcaacaagaucuuuaaagaugaaacaagauaaggugaccuaacuauacacaucacugauucaucaguaaagccagacuguucagucuccuuacacagaaacaauuccagagggaagaaacucaccaaagaugguguuuuccucaguguagcccugagaacaaucuagucgcagcaaaguaccauaguugaagucuucaacaaucccauuaaacuucaagcagaauggccuccacuucuauaaaggcaaaaacgaugcuuuagcugacaaaugcaagaggcugacguacuaaggccaggagagggacuuccauuuucccaguaaggaaaauaaucauagugagacugggauugaggugauuguugguuucacagugaaacuagcaaugcguuucugugcuaccuauugugucuuuagacugccauuucccaagaugaacaauauuuuacucugaaaaauauauaaauccuuuacugcagaauuaaaauauuauuucuuaagucaauuguuuuguuuugaaguuauuggucaguucagcccaaaauggucaucuauccccacuaaaacacaaaugauuuuaauaaagaaguccauucaguagugacaguuuuccaaagacaaagaucacuaacugccugcuaggaguuaaaaguguaguuucuuggcugggugugguggcucacgccugcaaucccagcacuuugaaagaccgaggcgggcggaucgcuugagcucaggaguuuaagaccagccuggucaacauggugaaacccugucucuaccaaaaauacaaaauauuagcugggcaugguagcaugcaccugcagucccaccuacuagggaggcugaagcaggaggacuguuugagcuugagaggcggagguugcagugagcugagauggcaccaccgcacuccagccugggcaacagagugagacccuguaucaaaaaaaaaaaaccaaaaaacaaaaaacaaaacaaaacaaacaaacaaacaaaaacuuuagauucuucauuagccaaggguuuacucucaaggaaaacauuuuuuuccuaacuguaaauguguuaguuuccuaucaaaguauaggauaaucacauaagcaaugaaaaacaaaaguuuuccaguuacccauggccuguaaucacaugaacuuaaauccagagaaucaaaacaccuuccuauacccuauuugccacuccccauccaagccuucuggcuauacuaccuaaauaaacugauccauccuccucugaaagggcugauggguggagauuuaaaauguccaagacaaaaaggagaaaaaaauagacucaacaacaugaaaaguccauaaacuggaaaaacauucauuuccuaacuuaguugauuacaacuagaaaagaaguucugguucuuuacauauuuuucucaaacaaaaaaagagcuuaaauguaaaaaaacauucgcaaucaaaaauuguugguuaaaugcuaaguaauauuuaagaaagagaauuuuuaccucuuuggcugauucugacuugaguucuucuggguccaacacaucuauccuaagggucucaaaauuuuuccggaacucagaguaaauuuggucaucuacuuuggugaguuucaggaacugugggucaacugaugaaaucagcugcgaaacaguaagacaacauacagaugcuagucuguaauuuacuauacuucuaucuuccccauccccaccagaaaaccuuuaugguucucagggcagaagaucucuucaggaagugucgacagucuacauccuagaugaaaucaugacacaguuuaaggccauaauauauuauuacaaucccuuccaccaauuuggcaguuggcuuacuuaaccacaguacugccuggcuauugcccuccguggauuguucauucauucaacaaacauuuauuaagugccuacuauguaugggccagacgcccuuuugucaguuagcauuauaacgcugggcaaagcagcagaacucauuguagaaacaaauuugccuucgcuccucuguugucuguggguaagaacuuacauuaauaaaaacgaucuccaaaacacaacuguuuaacuugcugagaauagugauaagcagagcaucauacacuauaauuacauguuuaauucugcuuaaugaugaagaaagacaacucaccuuguaauagacuucagcaugcugcauugcucucauggcccaagccaucucaaugucaggcugcaaaggagugaagaaugccaggucauaaaucuccccauccuacuacugaauagcaaauuaaggaaguauguggaugucuaguuaaugcucaagagggcuaccaaacuugauguuacugucaaaugauaaaaacuggaguaauaaauuuggacaauaauuauuuugucuguaugacaaccaaaaaaagcuaccuacacaguauaaugaacacaaugagccaccggcuaucuuuucccagcugcuagugaaagcugggagacuaaauaaagcaggagauaaaucaccuucucaggauugaguuaaaucauuguaaaacugaaauaauauacccaucaauuccacugaguuguugggagaacaaagaaucaaaaugaaaauuacuuuucacuuuuaagacugaagcaugucauaaucauuuuuguuuaccaaacagccaauuccccauacuguaacaccuagaaaugaauuagcacaugaaacaggucaagguuauaauaagucuuaccaagcaccccacuggagguuccacuggaaucucccauuccaacgagaccgagcuauuucacugacuccagaaaaagccauuugcauuuguuaccuccaugccuuagaccaugcacuuuucccacgugccaauccauguccuuuguccaccuacacuuugaggauacagguaaagcuccauuuccucagucaagucuuccacugccuuggccccuuagggauuucuccuucagcuaaauuauuuggaucuuauggccugacccacucauuauauguaucacacucuuauuuggguguuuuuacuauucucacauccucuugucuuguuuuggaaaauaccucauauacuuucucaguaauuuucuaaaccagacacaccauaagcugcacaauggaaucccucagagacccuuuaaaaauacugauucuuggcucucauuacccagacauucugauuuaggugguaugaacugcaaucuaggcagcgggauguuuaaaagcuccccaguaauucuaaagcguggccaacuuggggaaccacuuccacaggcguuaguccugcguuuguggaccaagauuaaaacgaacugaacgaaggugcaguuucugguguaaguggagagggucugcaguagauuaucaggacgugaaguuauaacuuaguggcaggcagguccugcagagaucccaggcuagcugagugggugggagcugugggugagucauacucacaucguugccauacgacucugcugggagagaaagcgcaugugccacagacaccaacuccccggaaacc

SEQ ID NO: 18335 - RNA, 910 nt, Homo sapiens
cauuuccuucgccagcaaucuccugaaugcccugguuaccuccuuguuccucaggguguauaugagaggguuaagugaaggagugcccacugcauagaagagaccaaagaacuugccccucucuugggcauagggauuuuugggcuggagguagacagcaaugacugagcuguagaagagggugaccacagugagaugggaggagcaggucccaaaagcuuuccucugcccuuuugcaguuaguccuuagcacugcccaggcaauggcuccauaagagacaaggaugaggcugaggcacagccaagaugaagacacuggcaacagccaucuggaucucauuguaggaggugucuucacaggagagucgaauuagagcugggaccucacagacaaaaucauccaccugcugaugggggcagaaaggcaggcgcaggguggauggugucuggaccacugacucuaccagcccaaugacccaggccacagaugccagcugccagcacaggcagagguggacgaugguggcauggcgcaggggcuugaagauagccauguagcggucaaaggccaucaccgucaggaggaugcacucagugguccccagggacaggaagaugaagaacuggacagagcagcccaguaagaugauggucuucuuuggcucccagagguugaccagcaucccggggacacaacuuauggugaaacagagguccaagaaggagagguuggagaggaaaaaguacauuggagaguggagccugggguccagcacagacagcaggaugaugaguccaccgggguuaggagguaggaagugaagacaacuacaaagagaguccuuuccagugcuggguguucagagaagcccagaaggagaaagccuggugcggagcuuugguuaaccau

SEQ ID NO: 18336 - RNA, 3415 nt, Homo sapiens
cggguucuagagaagccaaucagcgucuccgcagucccgguucuaaaguccccagucacccacccggacucacauucuccccagaggccgagaugcgggucauggcgccccgagcccuccuccugcugcucucgggaggccuggcccugaccgagaccugggccugugagugcgggguugggagggaagcggccucugcggagaggagcgaggggcccucccggcgagggcgcaggacccggggagccgcgcagggaggugggucgggcgggucucagccccuccucgcccccaggcucccacuccaugagguauuucgacaccgccgugucccggcccggccgcggagagccccgcuucaucucagugggcuacguggacgacacgcaguucgugcgguucgacagcgacgccgcgaguccgagaggggagccgcgggcgccguggguggagcaggaggggccggaguauugggaccgggagacacagaaguacaagcgccaggcacaggcugaccgagugagccugcggaaccugcgcggcuacuacaaccagagcgaggacggugagugaccccggcccggggcgcaggucacgaccccuccccaucccccacggacggcccgggucgcccagagucuccccgucugagauccaccccaagguggaucugcggaacccgcccagacccucgaccggagagagccccagucgccuuuacccgguuucauuuucgguuuaggccaaaauccccgcggguuggucggggcggggcggggcucgggggacugggcugaccgcgggggcggggccagggucucacacccuccagaggaugucuggcugcgaccuggggcccgacgggcgccuccuccgcggguaugaccaguccgccuacgacggcaaggauuacaucgcccugaacgaggaccugcgcuccuggaccgccgcggacaccgcggcucagaucacccagcgcaaguuggaggcggcccgugcggcggagcagcugagagccuaccuggagggcacgugcguggaguggcuccgcagauaccuggagaacgggaaggagacgcugcagcgcgcagguaccaggggcaguggggagccuuccccaucuccuauagaucucccgggauggccucccacgaggaggggaggaaaaugggaucagcacuggaauaucgcccucccuugaauggagaauggcaugaguuuuccugaguuuccucugagggcccccucugcucucuaggacaauuaagggaugaagucucugaggaaauggaggggaagacagucccuggaauacugaucaggggucuccuuugaccacuuugaccacugcagcagcuguggucaggcugcugaccuuucucucaggccuuguucucugccucacacucaaugugucugaagguuugauuccagcuuuucugaguccugcagccuccacucaggucaggaccagaagucgcuguuccucccucagagacuagaacuuuccaaugaauaggagauuaucccaggugccuguguccaggcuggcgucuggguucucugccgccuuccccaccccagguguccuguccauucucaggauggucacaugggcgcugcuggagugucccaagagagaugcaaagugucugaauuuucugacucuucccgucagaacccccaaagacacacgugacccaccacccccucucugaccaugaggccacccugaggugcugggcccugggcuucuacccugcggagaucacacugaccuggcagcgggauggggaggaccagacccaggacaccgagcuuguggagaccaggccagcaggagauggaaccuuccagaagugggcagcugugguggugccuucuggacaagagcagagauacacgugccauaugcagcacgaggggcugcaagagccccucacccugagcugggguaaggaggggaauggggggucacaucucuuaucagagaaagcagaaguccuucuggagcccuucagccgggucagggcugaggcuugggggucagggccccucaccuucuccuccuuucccagagccaucuucccagcccaccauccccaucaugggcaucguugcuggccuggcuguccugguuguccuagcuguccuuggagcuguggucaccgcuaugauguguaggaggaagagcucagguagggaaggggugaagagcggggucuggguuuucuugucccacugggaguuucaagccccagguagaagugugccccgccuuguuacuggaagcaccauccacacaugggccaucccagccugggacccugugugccagcacuuacucuuuugugaagcacaugugacaaugaaggacggauguaucaccuugaugauuaugguguugggguccugauuccagcauucaugagucaggggaaggucccugcuaaggacagaccuuaggagggcaguugguccagaacccacaacugcuuuccccauguuuccugauccugcccugggucugcagucguaguucuggaaacuucucuuggguccaagacuaggagguuccccuaagaucacauggcccugccuccucccaguccccucauagggcauuuucuucccacagguggaaaaggagggagcugcucucaggcugcguguaagugauggcggcgggcguguggaggagcucaccuacuccauaauuccucuugucccacaucuccugcgggcucugaccaggucuuuuuuuuuguucuaccccaggcagcaacagugcccagggcucugaugagucucucaucacuuguaaaggugagauucuggggagcugaaguggucggggguggggcagagggaaaaggccuggguaauggggauucuuugauugggacguuucgaguguguggugggccguucagagugucaucgcuuaccaugacugaccugaauuuguucaugacuauuguguucuguagccugagacagcugccugugugggacugagaugcaggauuucuucacaccucuccuuugugacuucaagagccucuggcaucucuuucugcaaaggcaccugaaugugucugcguuccuguuagcauaaugugaggagguggagagacagcccacccccguguccaccgugaccccuguccccacacugaccuguguucccuccccgaucaucuuuccuguuccagagagguggggcuggaugucuccaucucugucucaaauucauggugcacugagcugcaacuucuuacuucccuaaugaaguuaagaaccugaauauaaauuuguguucucaaauauuugcuaugaagcguugauggauuaauuaaauaagucaauuccuagaaguugagagagcaaauaaagaccugagaaccuuccagaa

SEQ ID NO: 18337 - RNA, 2209 nt, Homo sapiens
cuucccaguaaccaggcagggcacacuucuaccuggggcuugaaacccccagugggacaagaaaacucagaccccacuugucaccccuuccuuaccugagcucuucuuucuccacagcacagcagcgaccgcagcuccagugacuacagcugcaaggacaaccaggccagcaacgauacccaugauggggauggugggcagggaagacugcucugggaaaggaggugaaggugagggucucugacccccagcccucaccaccgacccuguuaaaggucuucagagaggcuccugcuuucccuaacagacaugaugccuccaucucccuccuuacuccaucucagcaugaggggcuccggcagccccucaugcugcacauggcacguguaucucugcuccucuccagaaggcaccaccacagcugcccacuucuggaagguuccauccccugcaggccuggucuccacgagcuccacguccugggucugguccuccccaucccgcugccaggucaguaugaucuccgcaggguagaagcccagggcccagcaccucaggguggccucauagucaaagacaggguggugggucacgugugucuugggggggucugaaaggaagagucagaaaauucaagcacuuugcaucucucaugggacacuccagcagcaccuggaugugaccauccuaagaaugaaccagauaccugggguggggaagggagcacagaacccagacaccagccuggacacgggcaccugggauaaucuccuauuccuuggaaaguucuagucucugagcgggggagcagggaccuccgguucugaccugaguggaggccaagggacucagaggagcuggagucagacccccacacacauugagugugaggcagagaacaaggccugaggggaaaaguccuggugccaaggcugcuguggggucaaagggaaccccugaucagucuuccagggauugucuuccccuccacucccucagagacuucaucccuuaauugucccagagagcaggacggacccucagaaucacucucugguacaggaucuggaaacccaggaggauuccucucccucaggaccagagggagggcgauauucuaguguuggucccauuuuccuccucuccuugugcuaggccaggcugagaggucuacaggagaucagggaggcgccccacugccccugguacccgcgcgcugcagcaucuccuucccguucuccagguaucuguggagccacuccacgcacgugcccuccagguaggcucuccuuuguucagccacauuggccgccucacacuugcgcuuggagaucugagccgcaguguccgcugcgguccaggagcgcagguccucguucagggcgagguaauccuugccaucguaggcauacuguucauacccgcggaggaggcguccgucggaccccaggucgcagccaaucauccacuggagggugugagaaccuggccccacccccucggucagccccgcccaccgagccucgcccucgcccggacccacccgcggggauuuugguaaaggcgccuugggguucucccagguagagggucugggcgggucccgcggccucgggguggaucccagacccggagacucgggaguacccgggccguccguggggcauggaggugggggucgugaucugcucccugggccggaguuacucacuggccucgcucugguuguaguagccgcgcagggucugcagguucauucugucagucugugcgugggccuugguguuccgugucuccucuucccaauacuccggccccuccugcuccacccacggcgcccgcggcuccauccucggacacgccgagucgcugucgaaccgcacgaacugcgugucguccacguagcccauggcgaugaagcggggcuccccgcggccgggccgggacacggcggcgcugaaauaccucauggagugggagccugggggcgaggagggguugagacccgcccgacccuccucccggcgcggcugccgaguccugcgcccccgccgggccggccccucccuccuccgcgcaggggcuguuucccuccugaccccgcacucacccgcccaggucucggucagggucagggcccccgagagcagcaggaagaggguucggggcgccaugaccaccauccuuggcgucuggggagaaugagucc

SEQ ID NO: 18338 - RNA, 936 nt, Homo sapiens
cacuugguaucuucagagagacuauggucaauuugacuucaaugaguggauuccuucuuaugggguuuucugaugagcguaagcuucagauuuuacaugcauugguauuucuggugacauaccugcuggccuugacaggcaaccuccucauuaucaccaucauuaccguggaccgucgucuccauucccccauguauuacuuuuuaaagcaccucucucuucuggaccucugcuucaucucugucacagucccccaguccauugcaaauucacuuaugggcaacgguuacauuucucuuguucagugcauucuucagguuuucuucuucauagcucuggccucaucagaaguggccauucucacagugaugucuuaugacagguacgcagcaaucugucaaccacuucauuaugagacuauuauggauccccgugccuguaggcaugcagugauagcuguguggauugcugggggccucucugggcucaugcaugcugccauuaacuucuccauaccucucugugggaagagagucauucaccaauucuucugugauguuccucagaugcugaaacuagccuguucuuaugaauucauuaaugagauugcacuggcugcauucacaacgucugcagcauuuaucuguuugaucuccauugugcucuccuacauucgcaucuucucuacagugcugagaaucccaucagcugagggccggaccaaggucuucuccaccugccuaccacaccuauuuguagccaccuucuuucuuucagcugcaggcuuugaguuucucagacugccuucugauuccucaucgacuguggaccuuguauucuccguauucuauacugugauaccuccaacacucaauccagucauuuauagcuuacggaaugauuccaugaaggcagcacugaggaagaugcugucaa

SEQ ID NO: 18339 - RNA, 941 nt, Homo sapiens
ggcaugaccaacagcagugucaagggagacuucauccugguggguuucucucaucagccccaccuggaaaagauccucuuuguggcuguuuugauauccuaucuccuuacccuugugggaaauacaguaauuauucugaucugcucuguagacccuaaacucaagacacccauguauuuuuucuuacucaccucuccuuaguugauaucuguuuuaccaccaguauugucccccagcugcuguggaaccuaaaaggaccugacaaaacaaucacauuccuggguugugucauccagcucuacaucucccuggcauugggcuccacugaguguguccuccuggcuguaauggcuuuugaucgcuaugcugcaguuugcaaaccucuccacuauaccgccguaaugaacccucagcugugccaggcucuggcagggguugcguggcugaguggagugggaaacacucuuauccagggcacugucacccucuggcuuccucgcuguggacaccgauugcuccaacauuucuucgugagguacccuccaugauuaagcuugcauguguggacauccaugauaaugagguucagcucuuuguugcuucacuggucuugcuccucuugcccuuagugcuaauacugcuguccuauggacauauagccaagguggucauaaggaucaagucaguccaggccuggugcaaaggccuggggacauguggaucccauuugauaguagugucccucuucugugggaccaucacagcugucuacauccaguccaacaguucuuaugcccaugcucaugggaaguucaucucccucuucuauacaguugugaccccgacccucaauccucucaucuacacacugaggaauaaugacgugaaaggagcacugcgauuauuuaacagagacuuaggcacauaaaaaaugaagcaga

SEQ ID NO: 18340 - RNA, 853 nt, Homo sapiens
ucagugcagccuucacuucuuuauuccuugagcuguagaugaugggguucaacaugggagucaccacuguggaagagagugacagcagcuucuugcucucagaagaggcacuggauuggggucggaaauacgugaggauggcagugcuauagaagagagagacaaccaagaggugggcggaacagguggagaaugccugauguuuccccucagcugacggcauccugaagauaguggagaggaugcggacauaggaucccaggaucagcaagaaaggaaagagaaugaauaggacaguggcugucagagccuccaguucaaacacagaggugucagcacagaccagugcaauaacaggagggcugucacagaagaagugguucacccuguuggggccacaaaaagggaaacugaaaauccaugugguuugcacaguggccacugaaaacccugagaaccaagaggcagcugccagcugggcacaggauauguggcccaugaugacuggguagugcaaggggucacagauggccacguagcggucauaugccaugguggccaggaggcagcacucagcagccccaaaaaagaagaagaaauacaucugaguggcacauccaaggaaggagaugguugugucuugaaugaucaggguccccagcaucuugggcacaaugaccaaguugaaaccuaucuccaggaaggacaaguuucugaggaagaaguacauaggacuuuguagugcagagucagcuauagugaccaggaugaugaggacauugcccauuaaaguaaccaaguaaauggucaagaaaaggagaaacaguagagccugaagcucaguggacagggc

SEQ ID NO: 18341 - RNA, 3433 nt, Homo sapiens
agaccauuccucaagaauuuuguauccaaggcccaaaaguuuguuacccaagaugaugaaugcugacauggaugguauguucuucauuuucuuuuuuguauacuccugguuuuguggaugcuuuugcuuuauuaagcaauggaaagggcagagaaaccauguuuagaagacuuugaucuuggcuaauuacuuauuuauaucucaucuaguguuagaaaggaccaaccaaagcagcuuccauuccuuagcuaugagagguuggcaaguuguuuuuaucuucuuuaccuuggugguauuaucugcaauuuggggauacaaaauuuuauuucacagggcucuuguauaagucaaguaagaaugaauauaaaacauuuugcagauuuuuaagugcuacccuacacaaauguaccuaaugcuaauuaauaguaaauuugaaccuuuauauuacagcaguugaugcugaaaaucaaguggaacuggaggaaaaaacaagacuuauuaaucaaguguuggaacuccaacacacacuugaagguuggcuugcauuuuguaguuuauuugaaugacagccaauuaauugaacuuguaaaaauuuauauugcuaaauuuuguuuguuaggauguauaauuuuuaaaagaaugaacuucaaaguacacacauauauauaucuaucuuccugcuuugguaguuuaaagaacagauacacuucagucaagucaaauguuguuauugugcuucccucuuugaagccuaacauaaugcuggcuaguaugagacccccuuuuaaguccccauaauguguuacuaaguccgcuuuaauaaagcuuauuuuaaaguaaaaacaauguauuagccuuggagauuaaaaaggaauucaucugaauuuuuucauuuucuaaaucuugcauaaaauuaauacacugaaacaucuuuugaguuuuaaugaaauuaagagguuguguuuuuggugccacagugagcagaucaugucacucagaaccucccacugauuuacauuuuacagaguuaauaaaagucaucugugacuucccuauuagcuuucuuuuucuuuuucuuuuuuuuuuuuuuuuuuuuugagauggaguucacucuuguugcccagguuggagugcaauggcgcaaccucggcucccugcaaccucugccucccagguucaagcgauucuccugucucagccucccgaguagcugggauuacaggcaccugcuaccaugccuagcuaauuuuuuuguauuuuuaguagagauaggguuucacuauguuggccaggcuggucucaaacuccugaccucaugauccacccgccucggccucccaaagugcugggauuacaggugcgagccaccgugcccagccggaauuaaccucuuaugugaucaucaggaacugcauguguucaaugucuugauaauguuacaauacaagaugauaaguugcuuggaaacugacugccuguauucaguauaugaauucaguuguguuaaccugauauauaucuuaaacauuucuaguaaagauguuauaguuuuauguugauaagacaugaaccaaaauucacauuuuaaaaacaaagucuuuuuaaaaaauuacucaacauuaaugcuauuuaugaagaauagcauuuagucuaaugugaaauaucuuuuuaggaauuugucuacuaauuuguacucaguuuguuuaccuugcugucucuaaaauccgaauucuuaaaauuuaaggauuguauuauuucuuuuaagaaugaauccuaagaauuuuguaauauggaaucauugucauuguuuuauugauaaugggcauuuuuauuuuuuauauagaucucucugcaagaguagaugcaguuaaggaagaaaaucugaagcuaaaaucagaaaaccaaguucuuggacaauauauagaaaaucucaugucagcuucuaguguuuuucaaacaacugacacaaaaagcaaaagaaaguaagggauugacacccuucuguuuuauggaauugcugcugaucauuuuuucuuuaaaacuuggauagauuccaaaaguuacaguaccuuuguggcuucauugaauauuuaugaagauaaugucagauguagacaaaaauaacacaauaacaggagacuuccauaaguuuguguauuauguuagucuaugaaaacgugcaaauguauuguagagacuuuaugauuagaauugcauauauuuaugaaacuuaaagaugaauguuuuauugaauuuguagguuuagcacugucuuuuauuauaggauuaguaagauauacaagaaaauaaccaccguguugugaaaaagugaccaaaaucauguacuaaaugcacagcuuuauguacccuguccaccaucuugugccucuucuccauuugccucuuccuuccuauuucccuuccgcuaaggaaaaaaauuggugucacauuuguaaaaguaauuuuaauaguuaaucaucucugagaguaaccuguauuuuaauuguugaaacuuaaccaaaauaagauacugucucagcuagggcuugucauuuguguauuuaguguuaagauaggaaugcuagugucucuuuaauuaauuggaaauagauggaggcuaaaaaugaagguuuuucuuugaaacugaauuaacuugggaauauuuguuguuaaaaacuucuuuuugcccaaaauaacucauuuuguauuaucugaaaauauauaauuucuggucauguguauguuaaaauagaaaauuuugaggaaaaauggaaauaggguggaaaaguacucgguaaacaguaguaaccaaauauuuucacuccagauuuguguuuucucuggcacagaguagaucuuuugggaaauauauaugaaaguggauuaaguuugacuacccuuauguuagccacaucuggaugagaacaguuacaaagaguuuggucucuaaguugauuuguacccagugggucaacuucugcaaaauuccguaaugguguauuaguauuagaauagugaauaaaaugggaaaguuauacauguauacuuauuaucuugcucaguauuuuaucucacuuguucuagaauuuucuguaaacccugcuacuggguuugaagaguuuuagucauccuuuaacaauuuuuaaaaauuuagcuucuagauuccauuugguaaggaaaucaauauuggaaguauugcuaaaaucuuauaauaugaaaagagauccacuaauguagcuuaagguuauuagauuugggcuuuuaaucauggaauaaucuuauguauugguguaagaguugaugaaugacuuuagcugugugaauauauaauagucaaacugcaaacauuuugcaucccuuuugugaccuaauuuacagacauuuaaauuguguugcaguucugcuuugccguuuaauaaaaagcuauuucaga

SEQ ID NO: 18342 - RNA, 902 nt, Homo sapiens
gaugggcaugaccaacagcagugucaagggagacuucauccugguggguuucucucaucagccccaccuggaaaagauccucuuuguggcuguuuugauauccuaucuccuuacccuugugggaaauacaguaauuauucugaucugcucuguagacccuaaacucaagacacccauguauuuuuucuuacucaccucuccuuaguugauaucuguuuuaccaccaguauugucccccagcugcuguggaaccuaaaaggaccugacaaaacaaucacauuccuggguugugucauccagcucuacaucucccuggcauugggcuccacugaguguguccuccuggcuguaauggcuuuugaucgcuaugcugcaguuugcaaaccucuccacuauaccgccguaaugaacccucagcugugccaggcucuggcagggguugcguggcugaguggagugggaaacacucuuauccagggcacugucacccucuggcuuccucgcuguggacaccgauugcuccaacauuucuucgugagguacccuccaugauuaagcuugcauguguggacauccaugauaaugagguucagcucuuuguugcuucacuggucuugcuccucuugcccuuagugcuaauacugcuguccuauggacauauagccaagguggucauaaggaucaagucaguccaggccuggugcaaaggccuggggacauguggaucccauuugauaguagugucccucuucugugggaccaucacagcugucuacauccaguccaacaguucuuaugcccaugcucaugggaaguucaucucccucuucuauacaguugugaccccgacccucaauccucucaucuacacacugaggaauaaugacgugaaaggagcacug

SEQ ID NO: 18343 - RNA, 1313 nt, Homo sapiens
cagauauguaacugguucaucaaugcccggcggcggcuucucccagacaugcuucggaaggauggcaaagacccuaaucaguuuaccauuucccgccgcggggguaaggccucagauguggcccucccccguggcagcagccccucagugcuggcugugucugucccagcccccaccaaugugcucucccugucugugugcuccaugccgcuucacucaggccagggggaaaagccagcagccccuuucccacguggggagcuggagucucccaagccccuggugaccccugguagcacacuuacucugcugaccagggcugaggcuggaagccccacagguggacucuucaacacgccaccacccacacccccagagcaggacaaagaggacuucagcagcuuccagcugcugguggagguggcgcuacagagggcugcugagauggagcuucagaagcagcaggacccaucacucccauuacugcacacucccaucccuuuagucucugaaaauccccaguaggcaucugccaagaagggugcugaaggcuccagccagcuguccuggguuuccguuuugguucccuuucauacagaggguuuucuauggaucacugccaaacauugggaucaucuccucuguccagaggucuucaacaggaagaugccagcuggcaccacugcacugugaugggggcccucuccucugcugacucugccguuucuccaggccuccgcucagugaugagaccaagagaucggagacaagcauggugcugcugcuucugcugcuucuccagaaaaucccugggacaccuuuguuccagccugguuuccugggcugggcucaggaaagcugccaaauucaguccuauguuggguccaagcugccccugugcuguuucugucaagccagguguggacauuccaaguucauaugcgugaacaaaagaaaagaggaacccaguggauguaacagaaccgacuccaguugaauguuuagauuuuugcuaaacuguuuucuuuuucccuuuuuugcugugguuugcauucacggcaguaguuagcccagguguggggaacgagagugcacugcaugauagcguucuggugagcugggaaggacccaccacugccacugaggauuguuuuggaagaaaggaauauuuuuaucuuggggaccagcuaagucucugcaguagugugaaauuccaaaugguuguuuuaucauugguuugguuuaccaaaaaaaaggcagggaaaaaaaaaaaaaacaaccguaugagcgcauuggcuugucugccgcaggca

SEQ ID NO: 18344 - RNA, 29748 nt, Homo sapiens
uaaguggccaaagaagauaccgacauggccccuaaaguauuaaaagcaccuucuuuccagaaguaccuccgaauugccagggacuucgcccaaaacuagagguuggucgaagugaaaaucuaaaccuaaggagaaggcagagagugggaucccgucacaguaggaagguaaagaagacagaaguaaaggacagagcgggagagaaaggacaaaaguucaaaauacagggguagaggagggacaggagccagaagaauggagcgaucugaaagguguacguccuacucacugguaggccuguuuuggacuccgcugugggagagggcggcugcacuucugcgucccccgccucaccugucagacauccacacagccaggccuccccgcccucaccaagcccacacaaaccgcgccaccgccagcgucagccggacgacucugggggcguaggccgacaccgcccucccuccagccaaucuaauagcgcucucaugggcgcauuccugaugacguuuagggguaggguuagaugcccguuuccgcuuucuucccacccacuuccgggucuccucuguuuacgaauguuugggcgcgaauuacucuaagcgcggcucucagaagggugcaagaagaaucaguggugagucgugauauccuuaaccggcuggguggaucuaaaguucagggaugaguuuuaaagccaacgcguuuguggcagacuccgcaguuugcauuugaggauagcgaggggggauugcuuacggggaaaugcccgauguccuaaaagaucugcccuuaggauccugagauugagauguuugauuaggggggagggagcaaagccaugaauacuuccuauuucucccgaaucauccucauggcucauccucauugcuaaauuucucccgcgggcacuagugaagucaagugcagccuuggacauuagugucuguguuucuccaggaguccuacucacucuugugcccacauagaggucuaaauugagguaauugagucccaugaguaucaacaagcugguaagaaaaacaagacaaccuagaaugccucccucucuccuaaagcauauagucuggcggcaaacuacuguaccagccuuauuucuuuucacuucuccuauacacauuaaaagccucgcuggauuauccugucccugaacacgccagguuuuuuguguuuuuuccgagcuuuccugccguccgaguuuuacuguuuucccuuggaugcuucauuuuucuacuuuuuggcuaaauauuucaaaauguuauuagaauaauacuuuuucuaugaauaauguacaaacauacuuccgagauauugcggggucgguuccagaccaauaaagccugucacacgauuuuuuugguuucccagugcauauaacaguuguauuuacacuguauuguaaccuauuaagugugcaauagcauuauguguaaaaaaaaauuacaugcuguaauuuuaaaauauuuuauugcuaaaaaaugcuacuaaucaucucagccuucagcaaguccuaaucuuuuugcugguggagggucuugcuugauguugauggcuguugaccaaucagggugaugguugcugaagauuggaguugcuguggcaguuucuuaaaauaacaaaauaaugaauuuuguacagcaguugacucuuccauucacuaaagauuucucuguagcaugugaugcuguuugaaagcauuuuacccacuguagaacuucuuucaaaauuagaguaaauccucuuaaccccuaccauugcuuuagcaacuaagguuuugugauauucugaauucuuuguugauauuucaagaauauucacagcaucuucaccagggguagauuccaucucaagaacuucgcucauucauaagaagcaacuucuuuuccacuaguuuuaucaugagauugcagcaauucagguacaucuucaggcuccacuauuucucuugcuauugccaccagaucuuucaucacuuccuccacugaagucuugaacaaagucaugaccuuuacaaagucauccaugaggguuggaaucaacuuuuuccagacuccuguuaauguugauauuuugaccuccucccgugaaucaugaauguucuuacuagcauuugggauggugaaucauuuccagaaguuuucaauuuauuuugcccagauccaucagaggaaucacugucuagggcagcuauagcuuuacaaaauguauuucuuaaauaauauaacuugaaagucaaaauuauucuuugauucaugggcugcagaauggauguuguguuagcagacaugaaaacagcauuaaucuccuuguacaucucuaucagagcucuugggugaccaaguacguggucauugagcaguauuauuuugaaaggaaucuuuuugugagcuguaggucucaaagaugggcuuaaaauacucaguaaaccgugcuguaaacagaugugcugucacucaugcuuuguucuuccauuuccagagcacagacagaguagauuuaaaagaauaagagcccuaggauauuucagaauggucaaugagcauuggcuucaagucaccacccauauuagccccuacaagagagucagccugucuuuugaagcuuugaagccaggcaaugacuucuuucuagauaugaaaguccuagauagcaucuuccaauagaaggcuguuuugucuucauugaaaaucuguuguuuaguguagccccuucaucaauuaucuuaccuagaacuggauaacuugcugcagcuucugcaucagcacuugcugcuucacuuuguacuuucauguuaugcagauagcuuacuuccuuaaaccucaggaaccaagcucugcuagcuucaggcucuuuugcuacagcuuucucaccucucucagcuuucauagaauugaagugaguuaagaccuugccaugaauucgucuuugguuuaagggcguguuguggcuaguuugaucuucaaucccggaccacucaaacuuucucccuaucaguaauaaggcuguuuuugcuuucuuaucauucaugucuucacuggaauagcacuuuaaauuuccuucaagaacuuuuccuuugcauucacagcuuggcuaacugguguaguuuccagccuaucuuggcuuuugacaugccuaccucaccuugcuuaaacauuucuagcuuuuaauuuaaagugagagaggugugauuuuugcuuucacuugaacacuuagaggccauuguaggguuauuaaauggccuaauuucaauaucauugugucucagggaauagggaggccuaaggagagggagagaggcagggaacagccaguugguggagcagucaaaacacaacgcaacauuuaccuauuaaguucucugucugauauuggcaugguucauggugcccuaaaacaauuacagaguaacaucaaucaccauaacagauauaauaaugaaaagguuugaaauauugugagaguuaucaaaauaugacacagaaaugugaagagugagcacaaucuguuggaaaaauggcaucaauauaguuguucagugcaggcuugccacaaaccuuuaguuuguaagacaacaacaacaaaauacagugucugcgaggcucaauaaagugaaacacaauaaaaagaguuaugccuguacauucuuacccauagcacaaaccaguuuaagacagucauucgcucacuugccucuuuauaacauuuauaaauacacauaguaauuauuuucauaucugucucuaccugugcacuaucacuaagcugugguuucccuuggaucuaagaaugggacaaaauaccuauucauuuuuauaugcacugugaguagcccagaagugauagaaacaaugucuuuuguuuauuggauucuuacuaugucucaaauaccguucuaggugguuuauauauucuuuguuacaucauuuuugcuuuacaaaagccuuuaauguuaguacuuuuauuaaucguuuuacuaauggggaaaaugaguuaauuuacuggcccaaagauauacaguuaauuaaguggcagggcuagauuuggagcuugaacaauuuacccucguugcaggacugcucuuaaccauuaugguaguguucucaaccuggguugauuuugacccaggagacauuuggcaaugucuggaaacaauuuugauuggcucuacucagggguuggaaguauucuagcaucugacggucuacguagacccaagcaugcugcuaaacauccuacaauacacaccacagucuccacaacaaagaaugauccaucuaaaauguuaauagugcugagguugagaaacuuugugcuauagucuagugccucaaguagguuucauuguuaacaguacuucucaaacucuguuagaccaguuuugcuuuuuauuucuaaucagucauaacugauacuuuuguaaaaugcaauuaaaaaucaauuauuagucaaacucccuugugguauaauaccaggagugaacucugauguaaacaauggauuuuggguaauaugaugugucaacaauuacagcaaauguaccaguuuggugugugauguuaauacuagagguugcagggaauggggaagggcagggauuauauaagaaguuucuguauguuuugcucaauuuucuguaaaccuaaaacuguucugaaaaaagucuuuuuuaaaaaaauacuaauuacuagaaaaugauauggcaaagacaaggcuaauuauuuuaugauaagguucaaugugcauaaaauuacucuaucaaauugcuacaaaaguuucuaaaugauuaccuucaauuuccacacuugauuauggcaaacaguuugaaugagauuuggaguagcgcuaaauuacauguuauuuuaauaaagaauaucaagaagaaaaugauuaauggacccaagcuauaaauaaguaccaaaugagacagagcaaaagagccacagacuuagagagaaaugaaguagaauaguuaggaagauuuugaaaagaagguggcucaugaucugagagggugggcagagacagaagagagcugcucagguagaagguacaguguauguuugggaggcagaauuacucaaaguguguucaggaaaucaucaaaucuagcuagagagggagauuugauuaaggaguaguaggagagaaguaugaaaagguaggcagaguuagguugguaaggacuaaaaauggcaugguaaagaguuugaauguuacacagaacguauugggguaaauuuuuuacucaauuaauuuguuccaaaauuugggauugggagggacuaggcagggcuugcucaugucuuguccacacagugugggcugcagcauauugacuuagguacauguaccagacuggccaguuggugcuggcucuuggcugggagcucagcuaagacuuuccugggguuucaguuccucucgguguuggccuuccuccuauggugguggcuggguuauaagagcaaguguuggccgggcucaguggcucacgccuguaaucucagcgcuuugggagaccgaggcaggaggaucacuugaggucaggaguucgagaccggccugaacaacauggugaaaccccgucucuacuaaaaauacagaaaauuagcugggcgugguggggggugccuguagucccagcuacuuggaaggcugaggcaggagaaucgcuuaaaccugggaggcagagguugcagcagugagccgagaucgcaccacugcacuccagcccaagcgacagugcaagacuucuuaaaaaaaaagcaaguguuucuaagcaagaagaagucaaaguugccagucucuucaugucuaagccaguaagcuagaacagaaucacuucuacuauauucuacugcucaaacagcuucagagucugccaagauuuaagacaagggaacauagaccuuacugcucauuaacaaucaugagaaggaauguguaccauuuuuaaucuaaaaucucagcuguuacuugucccuucaccuggaugcucuuauucagugaacaacuugaacuauuguacaugucagcccuuccaggagagaucuacaagugaaauucugucauguggauggguuuuuaaguaggggaaguauaaggguguagauguaaaguugagguaauuaggcauuuuagaaauugaacacaagauagagaaugaguguuugguaagguaucacauuguucaagagcaggguaaagugauauuuugacuuccacugcuuuuuguaacuggugugauaugugguugcuaaauguaguuugugaucuuucuguuaauucuuucccaauuuuuuuuccagucuuguguggaggggaguuugaagcuuuuaacguuugagaggauagauuuaucauugucuuucucuaaaucugcacauauauuuaaacuguaucaguauaauaauucugaauguuuagaaaauaaaugaugaauaauuuaucuguauaucuagcuauggcuaauauguguauauguuuauauguguauauauauauuuucuaggcauauauagcuaauaugugcauauacauauuuccuuguauacugcaccuaacuucuauccacuucuuaugguguaaugcaagaauaaguauuucauucuucuguuccuuuuaucagaaauuaguuugguaauaaaagagggaaaauuacucuaaauuuuaucaacauccccauuuccaaucccaugucuguuuuguaauuugugggagggcaggguauucaguacauuucuguacucuuguuaaaaugcacauagcccagauaggauugcaguuuaaauucuuaauagugucagacuaacacaugaauuuccacauagauugaugguauaauccuaaaaagugucuccuuccauuuuuggcaaaaauuggguaaugguaaauuuauuacuuaaaauaacaagaccuaggcuuuacuccuugaacugacauuaucugugacuacuuuauauuucuauuuccuuggacuuaaacauggagaggauguuaucauacgauagaguauaaaauaagagauacaaaagcauuuuuaaaugauuuucuaaaauccauacaaacggaaguuaauuucuaggaaugaaauugaauuagauauccuuauucugauaagagugaaaauuauuucuuuuaaaaaaugcuuguuuaaaagcauacaauacuauccccaaacuuuuauuaugauuuuucuuuaaaaaaaaaaaaaaagagaauguggaacauuuacaggauaguuuuuuaaacaaaacauugugcaaggcuuuagcuuuuuuuguauuauuuucaucuuuacagauuuuuuuuuuuuucgaagcacuguguuuagaucaagaugucugguaaagcaaaugcuuccaagaaaaacgcucaacaguuaaaaagaaauccaaagagaaaaaaggauaaugaggaaguuguguugucagagaauaagguaaugaaaauaucaaguuucucauuuagaaaucuucaacuguggccaagcacuauggcucaugccuguaaucccagcacuuugggaggccgagguggguggaucacgaggucaggagaucgaaaccauccuggcuaacaugaugaaaccccgucucuacuuaaaaaaaacaaaaaaaaaaauacaaaaaauuagccaggcgugguggugcacaccuguaaucucagcuacucgggaggagguugaagcagcagaauugcuugaacccgggaggcagagguugcagugaaccgaguuugugccacugcacuccagccugggcaaaaagagugagacuccgucucaaaaaaaaaaaaaaaaaaaaaaaaguuucagguuuuacccuacucauuaggcaaugccuauauuuguauauaacauuauuucuuaggcaaagugaguaauaauucauuuaaaacauucuuugacacuguauaaaauucuguuauuaucaucauugucaagaauugcuuuaguauguccucucugugauaaauauacaccauuuuucuuuagaaguagcaacauacauuuuuucuauguacuagaaauuauaugaauacucuuugacauauauaaaaaucuauuguaaaagcaggauccuuuuaucugauguuuaauucuguuuauguuuaugcauguguuuuucccucuagguuagaaacacagugaaaaaaaauaaaaaucaucugaaagaucugucuucugaagguauuucuuuucuauuaccuuguuuaaccugcuucuauaucaagcuauaucuacauucgugaaaaaauguucagcaucuuguuuaugaguucugcaaaagauaguaauaaacaacuacauuugcauuuuuguaagaauauguaguagugguuaguuauuuuggucaacugaaauuuuacuuagcaccucugacgaaauacuguagaggcuucaaugccacugaguugauaggaaauagagaaacucaaaguggcccacagccugaauuauuagugaucugugauauaaauacaaauguacuaauuuuucuucaagacaaauaugcuuucuguucuguauagauuaguuuggaaccauuauuauaaguuuguuuggaguaaacuaguuuagaguaguugccuuugcuuaaacaucacuguuucauggaaggauucucuacgucuccucagccaacacuagguuagguccucugguuuuauacugccauaguguacaauacuuuuuuuuccuuuuguaugcuuugcacaccuauaauuuguucaauaucccuucucuccaacacucauuuucaugagauccaguacuauuucuucuuuuuuuuaauaccuaauaaguagaacaguaccaacagcauaguugacacuaucuauuugugguuugauuagucuguuuuguuccaguugccauccaacauuuggaaaauaguuuccugguccucucaaugaaauguuuaaagaauuuaggccauuucugagaaugaaacuuuucauaauuaaaguuugauucuucauuuaaaauuauuucuauuaucacuugguaguauuucuguuaacuuaucaauagaaagcauauucauauucaacaccugggauguuacagcugugugauaaaaaguaaauuaaacaguuuauacagcuuuauaauauuuuguucugauaauuucauaagcuuuuuuagaugaaaacauuccauuuuuaagcaaaaacauguaaaacaucuagauugaucagagccucuucuauuacuaacgacaggacaaacaaagcacacuaaccuaaaacacggaaagacagcagccagcaagagaaaaaccuggcaaccucugucaaagaguaccagagaccauuugcaaacuaugauggaaucaguaauaaugugaguauaaaauuguuccauuucauucuuuugguucccauuuagguguuuccuauggauauuauucuuuuaaauauugcuaucuauuuuaagguaauagaguauauuucuauuucggaagcagauaaaauuaaugugacgguauuugccuucagcagaaaagucuuuguuaauuuuagaaaccugaaauuccaucggugaaauaaaagcaaguguuuguggccugacuugcuaucaauaaaauuuuaauuuuugucaauagagauucuuuaggaagaaguugaguucaaagugacacuuuacauagaagcuaccacacuggaggggauacagagaaaauaagacagaauucugccauuguggagcaaauucuaucagaagagccaggcauguaacuuauuacaauacaguguggcaaaauauauauauaagaagaauuuuuucauuguacuucuguuuaaagugucuuuaauaugaaaggaaaagugauugauuuugccuggcuaguggggagggguacuugagagaaaucagagagaaaaaguacaaagaguauaugauuugugcaucagacuacuauuuauuccaucuuuuuuucuuuucuaggacaauuuugaguaacaguauuaaagaaaaagaagaaauacaauaccaucucaacuuccugaagaaaagguaauacuauugcauaauuaaaaugauuaaaacauaauuuuuaaaaaccugacuucuuucuauguugccaaauagacacuuguggaauguaaguuuuucuuuuuuuuuagagaaggugaacaacuuggaaguauguuuucucuuuuuucuaaacugcugcuccacauguuucucaaauaaguuucaggggaacuuacaaaaaaaacccugaaaaucacgaaauucuguuuccacaguucacucuuccauaucagaauuugaaaacaguuuugucaacuugaacucccuucaacuucauuuuuaauaauuugaaguuaauaguucacaacucuuaucuaucugauauuuacccuauugcuguguuuuuccacuucauauugucuuaaauuauuugcaugagcaacaaguauaauuuucuaagauauuauugcucuucaucuuaugguaaaucaccaauggagauuucuucucaggaguucuuaaaaggcacaccacugccugugauuuucaauaauuacuuuucucuaguauuuacacaacuuuuucuuuuuauaagaaacuaagcuucauaagugaaggagaaauaaaauccuuuacagacaagcaaaugcugagagauuuugucaccaccaggccugcccuaaaagagcuucugaaggaagcacuaaacauggaaaggaaaaaccgguaccagccacugcaaaaacaugccaaauuguaaagaccaucgaugcuaggaagaaacugcaucaacuaacgagcaaaauaaccagcuaauaucauaaugacaggaucaaauucacacauaacaauauuaaccuuaaauguaaaugggcuaaaugcuccaguuaaaagacacagacuggcaaauuggauagagucaaaacccaucagugugcuguauucaggagacccaucucaugugcagagauacgcauaggcucaaaauacagggauggagaaagaucuaccaagcaaauggaaaacaaaaaaaggcagggguugcaauccuagucucugauaaaacagacuuuaaaccaacaaagaucaaaagagacaaagaagaccguuaauaauaguaaagggaucaauucaacaagaagagcuaacuauccuaaacauauaugcaccuaauacaggagcacccagauucauaaagcaaguccuuagagaccuacaaagagacuuaggcucccacauaauaauaaugggagacuuuaacaccccacugucaacacuagacagaccaaugagacagaaaauuaacaaggauauacaguaauugaacucagcucugcaccaagcagaccuaauagacaucuaaagaacucuccaccccaaucaacagaauauauauucuucuaagcaccacauugcacuuauuccaaaauugaccacauaguuggaagugaagcacuccucagcaaaugcaaaagaacagaaauuauaacaaacugucucucagaccacagugcaaucaaacuagaacucaggauuaagaaacucacucaaaaccacucaacuacauggaaacugaacaaccugcuccugaaugacuacuggguacauaacgaaaugaaggcagaaauaaagauguucuuugaaaccaacgagaacaaagacacaacauaccagaaucucugcgacacauuuaaagcaguguguagagggaaauuuauagcacuaaaugcccacaagagaaagcaggaaaaauugacacccuaacaucacaauuaaaagaacuagagaagcaagagcaaacacuuucaaaagcuagcagaaggcaagaaauaacuaagaucagagcagaacuaaaggagauagagacacaaaaaacccuucaaaaaaucagugaauccaggagcugauuuuuugaaaagaucaacaaaauugauagaccacuagcaagacuaauaagaaaagagagaagaaucaaauagaugcaauaaaaaacugauaaaagggauaucaccacugaucccacagagauacaaacuaccaucagagaauacuauaaacaccucuacgcaaauaaaauagaaaaucuagaagaaauggauaaauuccuggacacauacaccucccaagacuaaacagggaagaaguugaaucccugaauagaccaauaacaggcucugaaauggaggcaauaauuaauagccuaccaaccaaaaaaaguccaggaccagacagauucacagccgaauucuaccagagauacaaggaggagcuggaaccauuccuucugaaacuauuccaaucaauagaaaaagagggaauuuuagaccgauaucccugaugaacauugaugcagaaauccucaauaaaauacuggcaaaccaaauccagcagcacaucaaaaagcuuauccaccaugaucaagugggcuucaucccugggaugcaagucugguucaacaucaauaaacguaauccagcauauaaaccaaaccaaaaacaaaaaccacaugauuaucucacuagaugcagaaaaggccuuugacaaaauucaacaacccuucaugcuaaaaacucuaaauaaauuagguauugaggggauguaucugaaaauaauaagagcuuuuuaugacaaauccacagccaaugucauacugaaugggcaaaaacuggaagcauucccuuugaaaacuggcacaagacagggaugcccucucucaccaauccuauucaacauaguguuggaaguucuggccagggcaaucaggcaggagaaagaaauaaaggguauucaauuaggaaaagaggaagucaaauugucccuguuugcagaugacaugauuguauaucuagaaaaccccauugucucagcccaaaaucuccuuaagcugauaagcaacuucagcaaaaucucaggauacaaaaucaaugugcaaaaaucacaagcauucuuauacaccaauaacagacaaacagagagccaaaucaugagugaacucccauucacaauugcuucaaagagaauaaaauaccuaggaauccaccuuacaagggacgugaaggaccucuucaaggagaacuacaaaccacugcucaacgaaauaaaagaggauacaaacaaauggaagaacauuccaugcucauggaugggaagaaucaauaucgugaaaauggccauacugcccaagguaauuuauagauucagugccauccccaucaagcuaccaaugacuuucuucacagaauuggaaaaaaaaaacuaaaguucauauggaaccaaaaaagggcccgcauugccaagacaauccuaagcaaaaagaacaaagcuggaggcaucacacuaccugacuucaaacuauauaaaaaggcuauaguaaacaaaacaccaugguacugguaccaaaacagagauagagaccaauggaacagaacagagcccucagaaauaauaccacacaucuacaaccaucugaucuuugacaaaccugacaaaaacaagcaauggggaaaggauuccuauuuaauaaauggugcugggaaaacuggcuagccauauguagaaagcugaaacuggaucccuuccuuauaccuuauacaaaaauuaauucaagguggauuaaagacuuaaauguuagaacuaaaaccauaaaaacccuagaagaaaacauaggcaauaccauucaggacauaggcaugggcaaggauuucauguccgaaacaccaaaagcaaugacaacaaaagccaaaauugacaaaugggaucuaauuaaacuaaagagcuucugcacaucaaaagaaacuaccaucagagugaacaggcauccuacagaaugggagaaaauuuuugcaaucuacucaucugacaaagggcuaauauccagaaucuacaaugaacucaaacaaauuuacaagaaaaaaacaacccuaucacaaagugggcaaaggauaugaacagacacuucucaaaagaagacauuuaugcagccaacagacacaugaaaaaauguucaucaucacuggccaucagagaaacgcaaaucaaaaccacaaugagauaccaucucacaccaguuagaauggcgaucauuaaaaagucaggaaacaacaggugcuggagaggacaugcagaaauaggaacacuuuuacacuguuggugggacuguaaacuaguucaaccauuguggaagacaguguggcgauuccucaaggaucuagaacuagaaauaccauuugaucuagccaucccauuacuggguauauacucaaaggauuauaagucaugcuacuauaaagacacaugaacauguguguuuacugcggcacuauucacaauagcaaagacuuggaaccaacccaaauguccaucaaugauagacuggauuaagaaaauguggcacauauacaccauggaauacuaugcagccauaagaaaggaugaguucauguccuuuguagggacauggaugaagcuggaaaccaucauucucagcaaacuaucacaaggaugaaaaaccaaacaccgcauauucucacucauaggugugaauugaacaaugagaacaccugggcacaggaaggggaucaucacacaccggggccugucaugggguggggggagggggagggauagaauuaggagauauaccuaaugcuaaaugaguuaauggguacagcacaccacauggcacauguauacauauguaacaaaccugcacaguugugcacauguacccuagaacuuaaaguauaauaaaaaaaaaaaaaagaaaauguucuguuucucaguuucaaguuugccuagaaauauuugugaccuauuuuaaggaauucuuuugaguacaaauucuauuuaguuuuucuuuaaauauaauuuucaacccacaauagccaaguagaaagagugaaucagauggguugggucagggugggaguuugcugagaaagguuuaacaaauuaaaaacugcuagaagcaggcuuguaaauugcuuaaagguauagcagccuauuauuaaagaaggaagaagauauuaaaaagauaauaagcuaauacaaguauaaugaaaauguagcuguuuaggaucuuuuuaauauagaacaaauacuaauguuuaguuuaugaaugugacuauuacauaauaguugcuguucauagugaucaccuugguucauuggaaaagauuauauucaacagauaggcagucucuuugucauguaacagcuauggaguacauacauuucaaggccugacuauuuccuccuuauuuuuacuuucacagcuugcuuucuuuaguuccugaagucaccauacccaagauacaguuacuucuaccaauacaacaaaguacaacauuagcaaacugauccuaauuggaacucuaaauacauuuuucuguagcaguguuucugaaaguauauuugaaacacuuguucuuacagauagucuauggauaaaaguaaccuauggugaauuauauuuggguaccuuagcauguaagaagcccugcaguaaauaaaucuauuucauuuucuuuaagcuagcaucucccaaauugcuauuucugggaacucauuuucauauaaaucuauuucauuuucuuuaaccuagcaucucccaaauugauauuucugggaagucauuuucauauauuagucucaucucugcuuuugacuaaacguuagcuucauuauuuucauuuuuuaguuuucaguucuuacuagauuacagcuauagucauaggcagcuuccuguguauaucauuuuagccuggcgaagaaagaggaaaaagacgauucuuaccccuuagcuucaguuagaaaauucuaggagaugguuucugauuugcugagcuuaggugauauacaccuauucuuggcgugauuuugugacaagagcuaccauggauaugauugauauagacuggauuauauaccuagccccaugauuacacagacaaguuugcuaggcaaacaaaacuauucgccauuacaauucuaaaggaacauacuuccagaaagucugcccuauagaaacaauguuauaaguggugauuaaauguugcugauauaauaggauauauucaagccaugguuuuaguuucuaagaguuagugagacucuuggaaaucuaacugcuauuuagaacauuuggagcagugaaugacucuuccacauaauugguuuaauaaacauauagaagaaacuucauaauuaaaauauuuuuguuaagaaaauaaaaaacuuauuccucuuaggaaagcuuaggcagauaguuuguguuuaaaugugauagccuaaugaugauuuuucuaaauaacuagaguuugucuuaacaguuuaaugagaauuaugauuugugggguuuuugcugccuacuuuuuucuuuacaaaaauuaaaauuuuauuugcaaacaaugcaucaaacaaaggucuguaucaagacucuauuagaaacuuaaacaaauuagcaagcaaaaaaccaacaauccuauuaaaaagugggcaaaggacaugaacagacacuuuucaaaagaaaacauacaugcggccaacaaacaugaaaaaaaugcucucaacaucacuaauuacuagagaaaugcaaaugaaaaccacaaugagauaccaucuuaaaccagucaaaauggcuguuauuaaaaagucaaaaaguaacagaugcugggagguugccaagaaaagggaaugcuuauaaacuucuagugggaauguaaauuaguucaaccauuguggaaagcaguuuggcagauucucaacuuaaaacagaacuaccauccaacccagcaaucccauuaguggguauauaccugaaggaauauaaauuguuauaaagacacaugcacacuuauguuuaccacagaacuauucacaauugcaaagacauagaaucaaccuaaaggccuaucagugguagauuagauaaagaaaauguaguacauauaaaacuuggaaugcuaugcagccauaaaagaaugagaucauguccuuugcagcaacacgguuggagcuagaggucauuauccuaagcaaacuaacacaggaacagaaaaccacauagugcauuuucucacaagugggagcuaaacauugaauauauauggacacaaagaagggaacaaagauaccagggccuacuugcgggaggagagugaggguugagaaacuaccuaucagguacuaugcuuauuaccugggugaaaaaauaaucuguacaccaaagccccacaacauuugccuacauaaccugcauauguauuccugaaucuaaaauaaaagauuuuuuuuuaauuaagauuuuuaaccagaucccaaaagugggauaguggguuccacuauuguucagauuucuucaaaucuuaaguaguagaacuuuuuagaacccaaagauacugcuguuauaaagggaaucaaauuuagcuuuuccuccucauaaaauucaagaaucaaaucugggaaagcuauuuugcagucugccagaugugaugauagaaauagauguuucuacuggugaucaacucaaauuuguaaaagaauuuuuuaacuuuaauauuaaaugccauucauguuuauagaauuuuugagcaaugcacuuugaucuuaguguuuuauuugccuuaaacucuauagaacucaguuuucuuugaaaucauuuagaauaacuaauguaaaucuucucuauuuuugaucacauucucuaaaauaauugagauuugggguccagggucauaguuaagacuucuagacuaguguucugucucucaaccaauaauucacaauguauaauagacucauguaguguaauagucuagaaaacaucuggaugauaaaaggaaauuuugguuuuaaaauguauauaaauugucaaauguguaagauagaaaauuugcuuuuaguaaaguagccccagugucccuuaauuugagguaaaucuuaauaaauugaaaggcuaaaugaugauuugucagggcuuuuagagggggagauuuacuggcaauguuacccagugguaauaaaagaauauuguacccuuaagaauaugaggacaagaaaaaaugaggacuguuuuaaaauaauaauaguacucaaaaauaaacaaaauaauuguuuuuauuuuauccuuaagauugcuacaacagugugaaacucugaaagucccucccaaaaagauggaagauuuaacuaauguaucaagucuacugaauauggaaagggcacgagacaaagcuaaugaagaaggucuggcauuacuacagguaugaaauuugaauagggaauccauaauuagagaguuagggaaagggaagaagaccaaaguuuuuaaaauuaucaugauguucuuccaguagugaauacuagaucuugaaccagguuuuuucauuaaauuguuuuuuuguuguuguuuucauuaaagcaaaaauuugucugaacuuggcaccucuaaaguugaaguauuucuaauauauuugugguuaaguaguguguccggaauugguggguucuuggucucacugacuucaagaaugaagcugcggacccucguggugaguguuacaguucuuaaaggugacgugucuggaauuuguuccucccgguggguuucuggucucacuggcucaggagugaagcugcagaccuucgcggugaguguuacagcucauaaaggcaguguggacccaaagagugagcaguagcaagauuuauugcaaagagcgaaagaacaaagcuuccacagcauggaaggggacccgagaggguugccacugcuggcucaggcagccugcuuuuauuaucuuaacuggccccacccacauccugcugauugguagagccgaguggucuguuuugacagggcgcugauugguguauuuacaaucccugagcuagacacaaagguucuccacguccccaccagacucaggagcccaguuggcuucacccaguggagcccacacuggggcugcagguggagcugccugccagucccacaccgugugccagcacuccucagcccuuggguggucgaugggacugggcgccauggagcagggggcagcacucaucggggaggcuugggcugcacaggagcccacggaggagggaggcucaggcauggcgggcugcagguccugagcccugccccacagggaggcagcuaaggcccggcgacaaauugagcgcagggccggugggccggcacugcugggggacccaguacaccccccgcagccgcuggcuugggugcuaagcccuucauugccuggggcuggcagggccagccagcugcuccgaguguggggccugccaagcccacacccaccggaacuccagcuggcccgcaagcaccgcgcgcagccccgguucccgcucgcaccucucccuccacaccucccugcaagcugagggagccagcuccggccuuggccagcccagaaaggggcucccacagugcagcggugggcugaagggcuccucaagugccaccaaagugggagcccaggcagaggaggcgccgagagugagcgagggcugcaagggcugccagcacgcugucaccucucaauccccccucuaaacaggacaucccaacugcuguugggaauuugccugaugaccacucuagcuacuuccugcuggauggggcgaugaaggggcccuggaguuguaguguccuccagaggggaggucucuaggccagggaaagugccagugggucgguccagggguccucaguagaaguuguuaguugaacuccuuugggauucuauuuguaagaccaucuguagcuugauggccucgauuuacucagugauaggcaauggucucacugcucggcgauuggcgauggucucaccgcucggcgauugucucaccgcuuggcgauaggcgaaggucccuuuguggucgccaaaaugugucuggaguugguggguucuuggucucacugacuucaagaaugaagccacagacccucguggugaguguuacaguucuuaaaggcagcguuuccggaguuuguuccucccaguggguucguggucucgcuggcucaggagugaagcugcagaccuucgcggugaguguuacagcucauaaaggcagcguggacccaaagagugagcaguagcaagauuuauugcaaagagcaaaagaacaaagcuuccauaguguggaaggggacccaagcggguugccacugcuggcucaggcagccugcuuuuagucucuugucuggccccacccacauccugcugauugguagagccgaguggucuguuuugacagggcacugauugguguauuuauaaucccugagagcuagacacaaagguucuccacguccccaccagaguagcuagauacggaguguagaauggugcauucacaaacccugagcuagacacagggugcugauugguguguuuacaaaccuugagcuagauacagagugcagauugguguauuuacaaucccuuagcuagacauaaagguucuccaaguccccaccagacucaggagcccagcuggcuucacccaguggaucccacacuggggcugcagguggagcugccugccaguccugugcugugcgcccgcacuccucagcccuuggguggucgaugggacugggcacuguggagcagggggcggcgcucaugggggaggcuccugcugcacaggaacccucugaggggggaggcucaggcaugucgggcugcaggucccaagcccugccccacagggaggcagcuaaggcccagcgagaaaucgagcagugccggugggcuggcacugcugggggacccaguacacccuccacagccgcuggcuugggugcuaagccccucauugcccagggcuggcagggccagccagcugcuccaaguguggggccugcuaaacccacgcccaccuggaacuacagcugaccugcaagcaccgggcgcagccccgguucccgcucgcgccucucccuccacaccucccugcaagcugagggagccagcuccagccuuggccagcccagaaaggggcucccacagugcagcagugggcugaagggcuccucaagugccgccaaagugggagcccaggcagaggaggcgccaggagugagcaagggcugcaagggcugccagcacacugucaccugucaguagcaguccuauuuuuucaucagauuuuaacugaacuaucuuaguauuuuuaauuaucaauuuagaggagcuuaucacuaaauacuguggaauuuuaaaacguggaaauuuuucugaccuguguauggcaagaaaacacaauuaucauuagaguuaauauauacuggggacuuccuacacuccagacacuguucuaagcacuuuauaguuauaucccuuaauccucacaaugacuuagaguaugaccuaaauuauucuguuuuuauaaaugugauaaaaagacauaaugcuauuucuaacugaaccuuagacaaguugcuuaaaguugagaugcuaacuuugucauucugacaguagcacaugauucuugaucacuauguuguauggcauccuguggaagauaauaggagauaaccuuaucuaucaugguuaacuuccagcuuuuaaugaauggauauccaaacaacuaagucaaagcaaccuugaggagcuuauuagauaauuauaaaaacuaacacauaugggaccguaucucuuagacauuuugaaguaguuuguagauguggugcauagauuuuaguugcaauuuauuaaguacaaggugguaguaguuucugaaggaauauauucccaaaauuuauaauaauucaaagguaacaauucauucccauuuuuccauaggauugagaauaaaguugaaggaacaauuucugagcacaaaucuauauguauuuuuagcuaauagggcggcauuuuuugguggcugccucacuuuauucaaacugugguauuauauuuuauuuccaucccaagguuccuacuuuuuuagggcaucuuuucaguauuggcacuagcuucaucaccuaaacacuuagaugacguuuauuuagguuauuuuaaaagguuugaaaguauaaucauggagaauuuuaacauuuaguauuuaugcacaucaguuaaggguguucugaagucauaaaugauagugugauuuuuaugcuacugguaagcauuucuggccuccagcugaaauuugaccuccaugggacauaagcauaauuacaaucuauaauuugcuuguuagucacucagaagaagcaccgcuggcauuuggggcaggagaguucuccauuggcauaagaagaucuuuggacuagcagcuuguaaacucuaucuguauucauuaguuuucuccucugugccuuagaaccauugcuuuuucucacugcagccuagagucauugcuggugaugaucuuccaaaaccuguaauaguaacagaaauuuuauucauuuaacauuuucaucgugcucucacucaguaauggugcuggggaaacaacaauggugaacaccaucucggagauucugggaggauggcauuagaacagcugaagcauaauuuuuuagacucccuugaucuugucauaaaaauggagccauaggauuucagaaucagaguuagcauaagaaaauaugacaauaaagaccaaaaauaacauuccugauacaccgaaagcauaccaaaaagacacgugccuagaacagauaaacauuaaccuaauuuaucaagugaacugaaauaaauucagaaaaaaugauagaaaguauaggggaaaaauuauaaaucagaauuagaaauacugauaaauguaaguagagaauucaagaaugaaugagacauaaaagagaaaaccuugcagauauguagacuaaauuagaagaaacacuaaagcaaauaaacaacagauaaugcuuaugguaaauagaagauaaagagaaaauuuucagaaucauaaaaacauuuuuaaaaggaauugagaaaaaaaaaaccucaaagaagauaccauaugaguaugguaguaauacccaaagauaaccaaagcaauggaacaaaauaaauuuuauaaugagaaauuuuaauccuuguuauauuuaacccuuuuguucauucaaugcuguuauacauucccuuuguaguggguugaaucuaggaaaagggucuuguccaauauaauuaaggaucucaagaugaagcauccuguaucgucacggguacguccuaaauccaaugacaaguguucuuauaaaagacaagagaaggcacaaagacaaagaaaaagccacgugaaacacaauagaaggcauaaauaaaaagccacgugaaagcaaaggcagaaacuagagcaaugcagcuacaaagaaugcugacagcuaccaaaagcugaaaaagacaagaaaccauucuccucucuugucuucagagggauuguggcccugccaacaccuugauuuuguacuucuguccuccagaaccaugacagaaugaauuucuguuauuuuaagccaaguaggugguacagcagccacgggaaacuaauauaugugguuugcuuuauauuuauguuggacagcauucucuuagauccuacaaccaauucacagaaaacacagggcugaggaaccaguuaaacuucaccagggaauacaguucacaaaauuuagcccaugggaaauuccacagaguaaacuaucuaaucuccacaaauaaauugaaauggaagccuucuauggaugaaaagagacucagacauaucaaccagucacaaccaguuuggaaccugauuaaaacaaaauguaaaaaaaaaacuccaauuuaugagaaaauugaaaaugugaacacuaaccauauguuugauauuaaggaauuuauugagauuuuuuuaaaguguaguaaugauauuguacucuuauguaucuuuaaauccuuuagagcuguauacugaaauauuuauagauaaaaugauaggauaucuaggauuugaaauagcacaggggaagcaggagaagcagauggaguuaaaggugugacaggauggccaugggccaggcgugguggcucacgccuguaaucccagcacuuuuggaggcugaggcugguggauaaccagaggucaggaguucaagaccagccuggccaacauggugaaacccugucucuacuuacaauacagaaaaaaaaauuaucugggcauaguggcaggugccuguagucccagcuacuugggaggcugaggcaugagaaucacuugaaccugggaggcagagguugcagugagccaaaauagugccauugcacucuagccugggcaacaagagcaaaacuccaucucaaaaaaaaaaaaaaaauaaaaaaaauaaaaacagagucuguuccuccauggaguuuagauucaagugaauagagcucacagucccaaaaucuuaggcauucagagaacagcacauucccaguaaggggccagacaacauuuuagccuuuauggaccacaugugguugacuguuuuguugcauauccuuuuguuuuguugagguuuugaccaaucuuuuaaaauguacaaacaauucacaguucuugaacuguacaaaaacaucccaugggcaauugcugaccccugcagcuacccuuucuuaaaaaaaaaaaaaagucauuuagaagccaaaauauauuucuugaggaagacuacucucccagcaauaguucugcauccaguauuuggaaaagacauagauauagcaucaacuuuauugcugaacaagauuuaagaguuauuacuuauguauauuuucuguguggcuuauuuacuuguuccccaaagcauacaggcaauguuaucauugacuguugcuaggaccauauuugaaagcagugccauguuuaauacccuuuagaaaccuggaggcuugcuaauuuuaauuuuauacuuggccugcacacaacacauccuugauguguuguccccauacuuguuuuauucauuucuuauuuucuuuucaucuuccucucuaaauuauguauuccuuuaaugugggaaacuguuacucuuuuuuuuuauucucccugcucuaaugcccaacauuacuuccuuuugacaaauuaaaauagcaggcucuuaaauguuccuaaauaaaugaaaacaauucagaauuucuccacuacaugaaguuuuaugcugcuuaaggaagguugcuguauuuguugucaucaguucugggcucugcuagauuuacacuuggaucuuccaggaucucugacccuaccagcauugguacguuuugaggaaguguucauguacaucuccuuauuccagggaaauuagauauccuuauaacacauuaauaccuugacauaccagcuuuccaagaagucucuuuuuugaaagaaacaaaaguaaauucaccaguugcuucuaaaaauguuuuaaauauauaugguguuuuuuuaaaauguguauguauaacaauaucuauuaggauuuaauauaauaauguguuuaaguuaaaauguuuuuuuucucuuucugacucaggaagaaauagauaaaaugguagagaccacagaguuaaugacugggaauauucagagccuaaagaacaaaauucagauucuggcaagugagguggaagaagaagaggagagaguaaaacagguaauuauuuuaaacuguauuauuggaauuuggauauaauuuuuaaugguuaaauuaugcaaagauaacuuucgaguauaauaugaugagagaaaucagcuuuuugaaauaaucuguagcuuucuucuacuuuagaugcaucaaauaaauaguaguggaguacucucucuuccggaacuuucucagaaaacucucaaagcacccacacuucagguaagugccuauuuaccauauugauuacaggcauacuuuagagauguugcaaauuuggauucagaccacagcaaaaaagcaaauacugcaauaacgcaagucacacaaauguuuugguuucccacggcauauggaaguuauguuuacgcuauacuguagucuaguaagugugaaaaagcauuauuucuuuuuuuuuuuuuuaaagggacauaccuuaauuuagaaaacgcuuuacugcuaaaaaauguuaacaaucaucugcaccuucagcaggucguaaucuuuuugccaguggagggucuugccucaauguugauggcugcugacugauagcguggugauuacugaagguugggaugcauguggcaauuucuuaaaauaagaagacaaugaaauuugccacaucaguugauucuuccuuucacgaaaguuuucccuguagcaugugaugcuguuucauagcauuuuacccacaguagaaccuccuucaaaauuggagucaguucucucauuccuugucacagcuuugucagcuaaguuuuugucauauacuauauccuucauugauauuucaacuauguucauaacaucuucaucaugaauagauuccaucucaagaaaccacuuucuuugcucauccauaagaaguaacuccucguccauccaauuuuuaucaugagauugcagcaauucagguacaucuucaggcuccacuucuaauucugguucucuugcuguuuccaccacaucuucagucacuuccuccacuaaagucuugaacuucucaaagucauccaugaggauucaaaauugaauccauuuuuucuaaacuccuguuauugguauuuugacuuccucuugugaaucaugaaugcucuuacugacaucuagaaugauaaauuuauuuuaauauguuuacaauuuauuuugcccagauccaucagagaaaucacuaccuagggcagcuauagccuuaugaaauguauuucuuaagugauaagacuugaaaauugaaaugacucuuugauucagaggcugcagaacagauguguuagcagaugugaaaacaacauuaaucuccuuguauaucuucaucagagcucuuggguaacugugaacauuuucaaugagcaguaauauuuucaaaggaaucuucuuuucugagcaguagcucuuaacagugggcuuaaaauauucaguaagccaugcucuaaacaguuguacugucauccaggcuuuguuguuccauuuacagagcacagacaacacagauguaguugauuuaguagaauuaaggacccugggauuuucagaaugaucagugagcauuggcuucaacuucaugucaccagcugcauuagccccuaacaagagccuaacaaaagcaucuccuuuaaagcuuugaagccaggcauugccuucucuuuuccaacuaucaaaguccuagagauagcaucuucuuccaauagaaugcuguuuuauuuacauugaaaauauguuguuuacuauagccaccuucaccagugaucuuagcuagcuaggucuucuggguaacuagcuguaauuuuucuaucagcacuugcugcuucaccuugcacuuuuuauguuauaaacacagcuucuuuccuuaaaccuuaugaacuaacuucugcuagcuucaaacuuuucuucugcaacuuccucaccucugucagccuucauagacuugaaaacaguuagggccuugcuguggauuaggauuugguuuaagggaaugucguggcugguuugaucuuccauccagaccacucagacuucccauaucaacaauaaggcuguuuugcuuucucauuauucauguauucacugaaguagcacuuuaaauuuucuucaagaacuuuuccuuugcauucacaacuugggcguuuggcacaagaggccuagcuuuugguuugcguggcuuuugauaggccuuccucacuaaacuuaguaaucucuaguuuuugauuuaaaguaagagacaugauucuucuuuucaccugaacacuuagaggccauuguagcauuauuaacuggccuaauuucaauaucguugugucacagggaauagggaggcccaaggagagggagagaaacugggaaauaaauggccgguugguggagccgucagaacacauaacaauuaccaauucaguucacuguuugauaugguugcaguuauggcacccagaacaauuacagcaguuccaucaaagaacacugggcauagaucaccauaacagauaccguaauaauuuuuaaaguuugaacuauuacaagaauuaccaaaaugugauguagagauacaaagugagcaugugcuuuuggaaaaauggugcugauagaccuccuuugcacagaguugccacaaaccuucaguuuguaaaaaaugcagugucugggaacacgguaaaaugaggcauccugguauaucauagaccaauuauacauuacauauaugaaaacauuauguccuauuucguucuuuaaacaaauggaaccugauauaaacuguuuggcaaauuacuuuucucauucgacuguauaguuugaacaucuugucagucacguagaucucucauuuuuguugauagcuauguaacauucuguuguauggaggucauauaauuuguaaauuacugauggaaauacauaauuuuuuuaauacagguaagacuggguacacccuuguacauaugucuuuacugauuuguauagucauaauuguaggauacauuucuagaaguaaauacugacaguuugguuuuuuuaaugcuucuaacaauagcauauaacuccuuauaaaauaguacugucuuauuuguaguaaacuauuucuuccaagggcucuaguagacauuguaguauaaauguuuguagcauuggaaagucuucauguuuucucaagaaguaauuugaaauuuuccuauuggcugggcacaguggcucacaccuguaaucccagcacuuugggaggccaaggcaggcggauugccugaggucaggaguucgagaacagccugaccaacauggagaaaccccaucucuacuaaaaauacaaaauuagccaggugugguggcacaugccuguaaucccagcuauucgggaggcugaggcaggagaauugcuugaaccugggagcuggagguugcagugagccaggacugcgccauuguacuccagccugggcaagaagagcaaaacuccaccucaaaaaaacaaaaacaaacaaacaaacaaauccuaucauuuaccaguggugaaaggagcaggauggggagagggagagauagauuugaaagaagaauggcgauucguugacaauuauugaaguuggaugauagauacuuaagguuuauuuuacuguucucucuaacauacauuugagauuucucauaauaaaauguuaacaacuacauuuaauacuaucuuucccacagaaagaaauuuuggcgcuaauuccaaaccagaaugcucuucuaaaggacuuggauauucuucauaauucaucacagaugaagagcaugucaaccuucauugaagaagccuauaagaaacuggaugcaucuuaaagaguguuuuuuuuuuagauuguuccauauuaauuuaauguucgugaauuuguaaaacuguuaaccuaugauuauauguacagaggcuaaggcuucugcaggauuuauuaucuccugauaugcacuuuaaaauuagucuuuguaguucuaucauuagcaucuaauguaguucugaagacuguuuuuagcaguugccaaaucuaggaaacuaacauuuauauugcuguaucuauaaguauuugccuaaaaccauaaaauaggaauugccuuaaggaucuaguaguuu

SEQ ID NO: 18345 - RNA, 3927 nt, Homo sapiens
uauauuuguuauauuuuguuggcuauuuuuauagcugaccauacuguuauaaaguuagaaaacuagugaccaaaaacuuaaucuaacugucugaaaguauuauuucucugcucuacaauccaauguaauccuuaguaauguagguaaugguaauccuacauuaccaaggauuuuaccauuguaguaccaaucuaaaacccagcacagaaaauacauguuuuauuuuuuccaaguguuacuaguaccucagccuuucuugauuugucagcuuauuuaaggccucuucauugcauacuucuuuuuucuuuuaaucaucugcuucgaaggagacuaagcugaaacugcugcucagcucccaagauggugccacccaaauugcaugugcuuuucugccucugcggcugccuggcugugguuuauccuuuugacuggcaauacauaaauccuguugcccauaugaaaucaucagguaagagguguauuuguucaaggucuugagcaacugaucugucgccauacuucaagugggccccaagaaguugcacaucugcacaucuaaacaaguccuauuuaaaggcuuauggagauccuguauucuccuggaguaggggagagguucucacuuuuuccucauuucaacugaaauugaagaagcacuuguguucuucaguaucaggacugcaggacagaaccaggaugggacauuuuaagauauacuggacgcucagcuugcaaucaccacggagaaccuccuuaaugccaccccuucucucucugacugcccuaacgcaugcccacacaagcauaguaaugcaacuggucuggaguccacuccaagacagccucaaaaccugcuuccaugaggugaaaaagaagcaggugucuuguucaacaggcauacuccugguuaauaguggaaagucaugugagauaacaauuucaggucuugggauccaaaaggaaacaaucuuuccuaccugauaauagagagaaguagggacaaguaggugcuagggaguuccagaugagaauggaugugaucacucauucuuucuugccuugugguaaguggggaaagaaagagguggaaggcauagacuaacccaggaggaguggccaaaacgggacagccaucuuuagacggcuacauuuaaugucacuaagagagaccuuaauuggaaaaagauuguuucuggagcuuugcaaauuccugcucaucccagaggauugugaugcauaaacuucucuuuccagucuccuauggagagcaguguagguggcuucugaauggugucauacugacuauaccuacagagcugugcaccuggauaguugugggucacucuggaucuaauuguucaagcuugaugggugacuccuuacgauagcauuugcaaaagagcuuucauaauucaguaccuuaaauuuugcccuacuacauaagcaggaaaaugaaugcauuaggagagguuuuauaucuuauaucuacauuugcauaggaaauagaauaauaucucacagguccauucauccuauaacgcaucaggaaguuaagucaucaaggauacacuggugacuaagacaauaaauguguagucaaauucaaggguccugcauccuagaugacauuaaguucauuuuuccuacuaccuuuuucauggauugagaacagguaauaucuuagauggugggaaaaucaucauucgggaaacauuuauauccuucacuuuuaauugguacaggguaaaaauuuaaacauuuuuaaaaucccuuugucuuuaaaaauaauuggaaggcuguugcuggacugacagaaacuugaggacagggacguugcuuuaucuuuauagucccagcauugagcccaaugcaaugcccauucuaaauguucaaaaaugaaugcaggccgggcaugguggcucgugccuguaaucugagcacuuugggaggccgagguggguggaucacuugaggucaggaguucgagaccagccuggccaacauggugaaaccccgucuauauuaaaaaaaaaaauacauaaaauuagcugggugugguggugcacaccuguaguccuagcuacuugggagacugaggcaggagaauugcuugaacccagaagaaggagguugcaguaagcugagauugcaccacugcacuccagccugggcuacagagcgagacucugucucaaaacaaacaaaaaaagaaugcauauauauugguuuaaaguauuagaaacaguuuauuaaauaagauuaaaauaauaggugauucuuuauaauuucuuacuaaaugaauacacagaaaauauggcuaugcagguuaaaagguuuguaggaaugggcuagagauauccucuuuacuaauggaggacauaaagccauauaagaguguaauuguccuagcauguauacaguucaucuccaaacccaagacugaacaucaggaauauuugacaaaugaaaaccaccaaaaauauguaauaaaauuaauagcaugccauagguuccaauccuccuauuaaaauaaaguugaagaaaacuaagaagagacauuuauaaauucugaaccacaaaacugugugaguggucauuugaucugaugagucuccuccuuccacuuccuuaaugaugacuccugacagaugguuagagaaugggaaauccaggcccauaaccgggucagcuguaggcuauggagccuguuccacagccacccccaggcacccuggcacuggugcauaggaccccauagaccuauaccaaaaccuggaucagccugaugauuccugaggucuucucagaggucagguguccuggaacaggcagaccucaccuugaccugaaugcuccugaaugcugagugaggaaacuucccagggagaacagguguuggacaaccagggcacuccuaacuuauuggaaaauguuccccuguccuuuggaauugagaucucacaagcggaggcuuguguugggugaaacccucccaugccuccagaacugagccuccaauucuagagguagugucuccaacagcagcuguggcccuggggcuccuuagcgaguugugugagccagaggucucccugcagcaagcccugcacaggcacaccaugccugccuaggggugggguugcaguagcaccaggcugcuuaccacagaagaagaagcaggugucccuaccuuaagguccuccuccuugggacuucacaucucccuguuacaccagaagcauggcucaguagauacucuuuuaauggaagaagagccuuuuguaauucaaaauagacccugaaaguucaccuugcagguaaaguuuaaaaaaaaaguuucugggguuugaaucuaccuggggagagguuagaccugcuaaaacuucccuaaggacucagcacagauuuaccuagcaagaguaaauggacucuggggaaggaguaaacagcauuauuugucuaccccuuaugugucauguuuuguacuaagaacuugaccuacauucucaccucaucuuuacaacuguacugugggcuggucaagugcuuuuaugucauuuuacgaauguggaucagagaggggagcaacuaggccagaggauuauagcuuguaagagguacaccugaaaucugaaauagaaccaugucccuccaauucacaggguuuguucaucuccauccccucuccccuugccuuucuugaaacuaccuccuaccauuugaccauggauugcugaccugugugucaggcagguggucuggaacuucagcccagugucucuuaaacuuuaaugggcacuccuuuucugauugaguggaauuguggugaaguccaggagccugcauuuccaagcuccagcuggugccagugaugcugguccauggaucagcuuugaguagcugagccuuauguauugaaaggcuuca

SEQ ID NO: 18346 - RNA, 10990 nt, Homo sapiens
cuaucucugcagcagccaauagaagccaggaggcggggcggggaagcggcgcggucaggugcuccgcuccagaguugagcgcaggugagcuccugcgcguuccgggggcguuccuccagucacccucccgccguuacccgcggcgcgcccgagggagucuccuccagacccucccucccguugcuccaaacuaauacggacugaacggaucgcugcgagggugaguccaggggcguggguggcuucccucccgggaacccacacugcuccucugggucccuaaagcaacguccccuccuugccacugcacaucuaagaagcccaggccucggugggcgggaugacugggaauugggaacauaaccuacgccgcgaccauucuggguggcuaggauggaauccugguggagaagauggacacccccgcccuugacgucuacccgagcuacacaaaccuacuccuucugcacuuucccucuuccguuuaaucggugccccguccuuccugcucuccaagucuguuuguggaggaaggguuggaggggagaaagaacuggaaaguacucaaugaaauguggagccagauccagggauuccacuguuuugugcagcauuuugugcacgaaaaaaaaaaaaauucugauuguuuucauuccccaccccccaccucuguuuauugcucugugucauggaugugauguugagucuucuugccaaacauuccuaagcuuuagacaacacuuaaucuuugcuuacuuuuguuggucccaagaaagcaguuuucuccugcuuacacaugugccgaauuaauuugcuaagauagaugaaaaugagguguuccauguaguuuauuuccucugcuuuuagccuuaaauuacauuugguugauacuagccuuccuuguuuuaaaaaggugggagagaaaauuagggggagaaaggacagagagagcaacuaccauccauagccagauaggugaguaaauauauuugcaguaaccuauuugcuauuccuugcugcaacuguguuuaauguuccuuccagaaucagagagaguauugccauccaagaaaucguuuuuaaauaugacauuugagcuaucaucuugagaccaauaccuaaaacaauuucaguuuaagaaaugucuagguauggugaaaacacaguuuaaaaccagcaaaacagaauuuauugcccucagcgaauacccacaauguacauauaccuuguauuucugaaagcaaagcaagcaugccaaguaguuuuuauuuaccuguaccuauaauacagcaaggugaaacaggauauauuuuugaaguuuaaaaaugucuucaggccggcugcgguggcucaugccuguaaucccagcacuuuggggagccgagaagggugaaucaccugaggucagcaguuuugagaccaggcuggccaacauggcgaaacccugucucuacugaaaauacaaaaauuagcugggugugguggcgggcgccuguagucccagcuacuugggagacugaggcaggagaauugcuugaacacggaaggcggaaguugcaguaagcugagaucgugccaccgcacaccagcuugggcaacagagugagacucccucucaaaaaaaaaaaaaaaagaagucuucagcuuaggaagauaucaaaaggcaguuucaagagauuuauuuguacaagugugguuugaucuaaguuuugguggguuuauaaauaccuucaugcaggaauggguagaaaaaugagagaacaaaagaucccugcuggaugugcacgccugaugaaaacugacaaaauuuacauaucuauuguuuauccauacagcgucuuauuagcuuucuucaauagaaugaaaguauuuuagaaauauacacagauuaggggaaaagaccagcaaccuugauucacagagcuuuaaaccagggaagugcuuuuacuacaccuaucaaugauaagauuaaauuuugacaaauuuuaacauuaggaaagucaacaacaaauuucagaauuauauuucuguuaauauuuaguuuagaaucuaauuauuuaguucaacgaaugcugugauuugauuauuaauaaaugaaugcagauuacuuuucaauaaauauaucuggaugucacaaauguuauuucacuucaagaaaccaaauucaucuauuuuccucucucuuuaguaauacaucuuuugucugugauuaaccaaacauagggguugaaaauagaagugugcauauacauauauauauaauauauauguauaugcaccauuauucgauuugcuaaugauacuucauuguugcuagguugccauaguugcucuagccauaauguuaaggauguucacagguauuugacuauaaaaaaguuucugaccagaagucaaaagucuggaucaaccugaaaauguuucuaaaaguuuuauguaaaugaugucauauuuuaaaaugcuguugaagagcucacuuaaauaauuccuuugagggauauuuagauaaauucucagaagugaaaaaguuguuuaaaugcagcuaaacuuauuagcuuuauuauucauuuagccccaggucucuuaucuaauacggaguucugugacauaauucuuccaggcugugauuuaugaauauaacuaggauugcuaagcacuguuacucugaguuugggguaaaguauacaaaacaaaauuauugccuuuaauuucuauauguuuauucuacagauuaucuuacacugaacugaucaaguacuuugaaaaugacuucgaaauuucucuugguguccuucauacuugcugcacugagucuuucaaccaccuuuucucuccaaccagaccagcaaaagguucuacuaguuucuuuugauggauuccguugggauuacuuauauaaaguuccaacgccccauuuucauuauauuaugaaauaugguguucacgugaagcaaguuacuaauguuuuuauuacaaaaaccuacccuaaccauuauacuuugguaacuggccucuuugcagagaaucaugggauuguugcaaaugauauguuugauccuauucggaacaaaucuuucuccuuggaucacaugaauauuuaugauuccaaguuuugggaagaagcgacaccaauauggaucacaaaccagagggcaggacauacuaguggugcagccauguggcccggaacagauguaaaaauacauaagcgcuuuccuacucauuacaugccuuacaaugagucaguuucauuugaagauagaguugccaaaauuauugaaugguuuacgucaaaagagcccauaaaucuuggucuucucuauugggaagacccugaugacaugggccaccauuugggaccugacaguccgcucauggggccugucauuucagauauugacaagaaguuaggauaucucauacaaaugcugaaaaaggcaaaguuguggaacacucugaaccuaaucaucacaagugaucauggaaugacgcagugcucugaggaaagguuaauagaacuugaccaguaccuggauaaagaccacuauacccugauugaucaaucuccaguagcagccaucuugccaaaagaagguaaggcugacugaaugaauggugagcugagacuagaugugcauuugcccagugugaucaaaugaacagggauuucuguugcugcgccuuuaaaguagacuuugccugugucaugguaauauucugggauuuaauccucagacucugaaaagacaaaaucucuuuuuucaaagccuaauuuuuuuuuccuuuuuccuagaauacugaaauugaugugcucuauguauguauggcaguagguuuuaaccauuuuggauccauagaauauuaugaaagcuauagccucccuucucagaaaaauugagauggaaagauacauacaaaacuugaaugcauguacaguuauuucauagaagccccaaagccuuuuauagguuccuaauuuggaccugcuuaacaaggaagcuguggaagauaagaaggagaaagagcuuuggucaaucugagguuuauuuuccuuauaaauguggaaaguaauaacaauaccuuaaacuuuuuacaaaccucuccuggaauccuuauaccaaaccugucaccucaguauugucuccauuuuaaagagaaguaaaugacagguaagugaccucaaaagguuuaacauccugaggucacaaaauaagugacaacaugacucagacaugcucuuugacauauuuuaucacuuugcaggguuggucuuagguaucaaaugagagaacagauuuugaaaagcuauaauauuucacaaaugagaauuccaucccucagaggggaauuagaaucauaugaaacagcgaauguuaaaauauguguguguuuuacacacacaguuuucagcaaacagcacuuuuuuucugguuuaagaaaauuagcuaggagugguugcucacgccuauaaucucagcacuuugggaggcugaggcagcagggucacuugaggccaggaguuugaggccagccugggcaacauagcaagacucuguugcuaaaaaaaaaaaaaaaaaaaauagccugguguggugacacaugccugugucccaggcugagguggaaggguugcuugagcccaggaguucuagguuacagugagcuaugaucauaucacugcacuccuccuugggcgacagggagacacagucgaaagaaaaaaaagaaagaaaaagagagacugagggggaaagagagagagagagggagggaagagaagggggugaaagagagagagaggagggagggaaggaggaagggaagagggaagggaagaggaaauggaaggggagaaaauuacauuaacccuucgauuuccuuuauaaaauuggaaugauguccucuuguugcggugcagaagauaaggaugcaaccucagcaauggauuugaaaaacaggaggaugaaagacagugccuggguaaccgcauuuguaguuauagggaguacuuuggcaacaccuccaguguuuucagauguuuccauuuuacaaacugcuuuccaccuccagccucuuuucccagcccucacccaccccucaccauguuuucuugucuggagauucuucgugucugcacucacaacuaccagaaccuagccauuuuuauuuggguauugcaguacccuagacauuuuacauagugucacuaauuaauauguguguguauugaagucuuuagagguuucugguucuauaaaaugcccuuccuuaauucuauaaggugaacuuacaacagaagauuauuuccuaguuuccccucccaaaauuguuuuccccaaggggaaaaagaauuuuuucuuauguucagcucucugguuuuucaccuccguagcaagucuguugcccauggcugaugguagcuaugaguauuuuguucugagugccucuccucccuucucuuuagguaaauuugaugaagucuaugaagcacuaacucacgcucauccuaaucuuacuguuuacaaaaaagaagacguuccagaaagguggcauuacaaauacaacagucgaauucaaccaaucauagcaguggcugaugaaggguggcacauuuuacagaauaagucagaugacuuucugugugaguauguuacaguauuucuuuccauucugcauuacuuuuugcuaaaauacaacaguuuaaauacauaauacagcaguuuauugauugauauuuuuacugucuguuacuugaauauuaaggaacuacaauguuuucguacuuaucuaaaaaugcuuuuuuuagauauugguccuugauauguaaaagauauauacaaaaugucccuuuagguagaauuggguuucuaucauguuuauugauuaaaagaaaagcagaugccugaacaauggcauuuguagugugcucgugacucauaguggcagauguauacagauacaugguuucugguucuuaaaacgguuuuuggccaggugcgguggcucucgccuguaaucccagcacuuugggaggcugaggcggguggaucacgaggucaggagaucgagaccauccuggcuaacagggugaaaccccgucucuacuaaaaaaauacaaaaaauuagccuggcaugguggugggcgccuguagucccagcuacucgggaggcugaggcaggagaauggcgugaaccugggaggcggagcuugcagugagccgagaucgugccacugcacuccagccugggcgacagagcaagacucugucucaaaaaaaaaaaaagcaaaaaaaaaaaaauaaacaguuuuuacauacagauaaugauccauaaaccaauguucauauuuuuaugucuugugcagguagcucuuauguuagagggcuugcucaacaaaggacugcuaucuuuggcaagauuuguauuuuaaaguuaauauaaauucaaagggcccucuagaaaugguuugcugaacuacaguuacacaauagauuggucaccucuauuuuugauagaaaaccuuaauaauacucaauuuauauuauguuuaaugauucaauaauuaauuaaagauugaccacuguauaccuaagccagaauaguuaagcccuaaugccccaaagcaguggcucucaaaguguguucccuggcccaccagcauccacaucagcugagagcuuguuagaaaugcaaauuauuggcugcauaaaugucuucuuuugagaagugucuguucauguccuucgcccacuuuuugaugggguuguuuguuuuuuucuuguaaauuuguuugcguucauuguagauucuggauauuagcccuuugucagaugaguagguugcgaaaauuuucucccauuuuauagguugccuguucacucugaugguaguuucuuuugcugugcagaagcucuuuaguuuaauuagaucccauuugucaauuuuggcuuuuguugccauugcuuuugguguuuuagacaugaaguccuuguccaugccuauguccugaaugguaaugccuagguuuucuucuaggguuuuuaugguuuuaggucuagcguuuaagucuuuaauccaucuugaauugauuuuuguauaagguguaaggaagggauccaguuucagcuuucuacauauggcuagccaguuuucccaucaccauuuauuaaauagggaauccuuuccccauuucuuguuuuucucagguuugucaaaaaaacacaugaaaaaaugcucaucaucacuggccaucagagaagugcaaaucaaaaccacaaugagauaccaucucacaccaguuagaauugcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuggaaauaccauuugacucagccaucccauuacuggguauacaugcccuacaaaggacauggaugaaauuggaaaucaucauucucaguaaacuaucgcaagaacaaaaaaccaaacacugcauauucucacucauaggugggaauugaacaaugagaucacauggacacaggaaggggaauaucacacucuggggacuguugugggguggggggaggggggagggauagcauugggagauauaccuaaugcuagaugacgaguuagugggugcagcgcaccagcauggcacauguauauauauguaacuaaccugcauaaugugcacauguacccuaaaacuuaaaguauaauaaaaaaaaaaaagaaaugcaaauuauugggcccaaaacagaccuacugaauuugaaacugugaggcccuggugaaacacacaaaaguuugagaaccauugcccuuaggcauacuuuauaaauaccaucuacuugaucaagcauuuaugaucggggcuaccacuacaaaacaaagucccuauucauaggaaagcuuuuacauaagucacaaugacuuaauuuuaagucugaauuucuaguaagaagugugauauaagauaauuaucuuugccuucaugagugagagucuaggucccaacuucucauagaaaugaacacagcaaucauccagucaauuacaaaguauauaaugauauauucccagugcgacuaucaauuaaugaaauagcauaguacccugucagauaauuacuagugauucauaauuucagugcuauuuuuacuuaaauaaaccuaaaagaaucauggcaucuagaaugacuucuuuagauacgcuuuuccugguagauuucaaauuacuuugaaaugacuaggggucaguuuaugacuuuucgaaaaacugauuuaggauuuuuucgagguggauggggcagggagcguuccuauugcauaguucccugaagcaaguauaaguauuagagauggauuuacuagucauucuccuugccaccuuuaagauaaagccugucaguuuugcuugggugccaucuuaucagcaguagcuccuuugccuuguaccuugauaccaugcuaagcacacaugacuuugaaauccagcuauuaucaauuucguauccauuuuaugucacuugacacaugugucagaagacccccaaguuuuuaccuuauuuguagccacacuaaaagcacauaaugcuaaguuggauccugauuagagcuaccaaaaucaggaguuuccuacucuccuccacucugaccuuuguuuuuuaguaguagauuauagcuguaaguacagguuugauuuuuaugguuucuuuugcuuuucuuuauguaucguauuuucccuuuuauugguaacuaugaguuuauuggcuucagauuaagacuaagagcaccuuuaucucuuuaucuuuagaauaauaauuggaacauaguagguaccccauaaguauuugcugaauauuacuuugccaccaguaaaaaacaaaaacaaaacaaacaaacaaacaaaaacucuaauuuuucccuaacuuggcucugcuuuguucuuuacccuucuuccccugcugcuuaagccacuguuggccuguaagaaagauucacaaccauuugacucuucaauuccugaagagaauugugauguggacaacagcagagauuguuugucaaagauuguuuuauguuuacagucaaacuagauaagaugugcauuuaaguucagaauuugaccauacaacaauuauguccauuuuaaugcauaguuggcuaacuuuuucacauauuuucucuuuacaguaggcaaccacgguuacgauaaugcguuagcagauaugcauccaauauuuuuagcccaugguccugccuucagaaagaauuucucaaaagaagccaugaacuccacagauuuguacccacuacuaugccaccuccucaauaucaccgccaugccacacaauggaucauucuggaauguccaggaucugcucaauucagcaaugccaaggguggucccuuauacacagaguacuauacuccucccugguaguguuaaaccagcagaauaugaccaagaggggucauacccuuauuucauaggggucucucuuggcagcauuauagugauuguauuuuuuguaauuuucauuaagcauuuaauucacagucaaauaccugccuuacaagauaugcaugcugaaauagcucaaccauuauuacaagccuaauguuacuuugaaguggauuugcauauugaaguggagauuccauaauuaugucaguguuuaaagguuucaaauucugggaaaccaguuccaaacauuugcagaaaccauuaagcaguuacauauuuagguauacacacacacacacacacacauacacacacacggaccaaaauacuuacaccugcaaaggaauaaagaugugagaguaugucuccauuguucacuguagcauagggauagauaagauccugcuuuauuuggacuuggcgcagauaauguauauauuuagcaacuuugcacuauguaaaguaccuuauguauugcacuuuaaauuucucuccugauggguacuuuaauuugaaaugcacuuuaugcacaguuaugucuuauaacuugauugaaaaugacaacuuuuugcacccaugucacagaauacuuguuacgcauuguucaaacugaaggaaauuucuaauaaucccgaauaaugaacguagaaaucuaucuccauaaauugagagaagaagaaggugauaaguguugaaaauuaaaugugauaaccuuugaaccuugaauuuuggagauguauucccaacagcagaaugcaacugugggcauuucuugucuuauuucuuuccagagaacgugguuuucauuuauuuuucccucaaaagagagucaaauacugacagauucguucuaaauauauuguuucugucauaaaauuauugugauuuccugaugagucauauuacugugauuuucauaauaaugaagacaccaugaauauacuuuuuuucuauauaguucagcaauggccugaauagaagcaaccaggcaccaucucagcaauguuuucucuuguuuguaauuauuugcuccuuugaaaauuaaaucacuauuaauuacauuaaaaaucaaauuggauaaaacaauguuuucuuucugguagcgcauaauaacagagcacaagcaucuuuuagauuugagcauuugaagauucaaaguugcgaaagagcacaaaccauauuagguaaaauauuggccacucgauccuugaaaagaacuguguggagccuggaaaaaaaaauuaggaccacaugugagauguuuacaagacacccagaacagugguaaagugugcauacuagaaaaagcagcaaaauaacucuuugugguaacagguaucaaaacacgggagccgagaugauauagcucuguuucaagaaauaugugaauacccaccuaccaggugcucaguggaaucaaagaugaauccaaguucacaaau

SEQ ID NO: 18347 - RNA, 1754 nt, Homo sapiens
cgggcuggcggguagggagacccgggaggcgcagaucuuugccggagucuuuggaacacccgggguggcagcugcgaacgggcgcggggguguguuuggccuggggaggcgggggacuugaguuugcagcuuggaauggggucccuuggggcaccgcguccugggugcgcuggcgcccccucccaguuggaguccgguggugaagcgguguggguucagcaguccagccccggggccggcauugccgcgcgcugcccgccaccgccgcgccgcgccgcgcgcugcuacccagcugcaggcggccgcgccuccgcccucccgcgccgccgccuccgcggcggccgccgcuccccccgcgcgggcugcacgcucagauuccucccgcggcggcugccagcccggcuccccggcuaggcuccuuccuuucccuucuuuucuucucgcccucucacagccaccucuuugcauccacucccuccugcaauuugcaaagcuccccugucucucgcgcuucaaggugccaagagguaagucgugggcagcggaucucggggcaacgaaucucgagccugcgaaucgcagccgcugccgccgccagccggccgcgagaaggagccccccgcgcgccgugugcaguuuccgaagccuagaggcggccccagacuaggggcaaucucgccaggucgcguccucuugcucuccccaccccuaggacaaggaacccccucuuuguaggaagagauugaagccgagacaccagagagcccccggcugaucugacugucgcuauuuuucguuguaacuucaggagaggaggaaagaaaauucuugagccucugugcugacuucucagcacucuucacccucccaccucuacccccaccucugucugagcgacucccaagggaaaaagauuuugcaggguuuggguguuuuuuguuuuaagugacacaaaaaaaaugaggaggggggguggagggagaucuagucaaaauaguuuuuaggaacucaagugcauagcuggacauuucuuuuuucuuauauauucaaucuugucauuccuagagaacaagaaugagguguuuguuuguuuguuuuuguuuuaaggacugaaaaacugucagcuuugugauuaaaauaaguugcaaaacccuugcuggggaaaagcaccagccguuuuccaugaauuuaaauauuuuauuaagucuauucuacaucuaagacuaaguuucgugucugucuuccccagcgcucacggggaaaaauuaaaaauacgaacuaaaaaauucaaaaugcuuccguggcuguuuauuuauguauuuauuuccuaguguggguuuaaaaagcgacuuuggaucccccaaaaaguuguggucgagaggaugaaggagcgcggaaaaaaagcggcacuuuuuaccuaaaaugugguuuuuggaggcugggauuucuaaugauuagguuuuugugguuuauauagacacgacucuggcuaagucgaucauuacgcugaugagagucagagcacgugggugucuacgaccagccucaaacucugagccuucaaaacaaauaaaacaaugugcugcgcccgcagaagccgggaaauccgcuugaggcuauuacaccccaagaagggggcacagggccguuuuacccucggcguuguguacuacuacguuucuugcuuauuaccaaacucuuuaaagccuuccaaagcuugaaaacguguuugcgaaaaaaaucaucaguugcca

SEQ ID NO: 18348 - RNA, 2217 nt, Homo sapiens
guggcuuaaaacauuuauucuucacauuucuggagggugggagcccaacucaagugugggcaggccauuguccgacccgaaggccauucuuccaccggagcucuaagggaaaaguggaagguuuuucucagcuuggcuccagguguuccuuaucucauggcugcaucacuccaaucucuaucucucucucucucucucucuuuuuuuuuuuugagacaaagacucacuccgucacccaggcuggagugcagugucucgaucccagcucgcugcaaccuucaccucccgaguucaagugauucuccugccucagccucccaaguaacaguacaacaggugcacaucaccaugccuggcuaauuuuuguauuuuuaguagagaugggguuuuggcacguuagccaagcuggucucaaacuccuggccucaagugacccuccugccucagccucccaaagugcugggauacaggcgugagccacugugcccagccuucugccucugucuucacauggcuuucucuguaugucucucauaaagacacuugucacuggauuuagggaccacucagacaguccaagaugaucucauuucaauauccuuaacuucaucugcaaagacccauuuuccaaauaaguucauguucacagguccuagagauuaguaugugggcauaucuuuugggggggaccacuguccagccuauuaugguggcuuacgugcauuauaucauuuaauccucaaagggugguugcccugugggguagguaauaucauuaccuugauuuuauagauaaggaaacugagacucaaaagagguuaaguaaccuguucaaagucauauggccagcagguggcagaguugagauauaaagcccuccagucuggcucaggggucuguguacugguaaccgucaugcuagucugccucuuugugaugugugagagagcuaucauucuagguaauuaaaaaacaaacaaaacccucccccaaacccaggaauuuggaaucuucccuuggcauguaagaggauaggggguaagaaaucuuagaaaggacagaagauguggucguggagauguagcucugacaggaagaacagaugcagccaggccuaaggggaaggacagcccacaggaaacuccucugcaucccagcuacucgggagaccaagcuggaaggauugcuugaggccaagaguucaagacuagccugggcaacauaucgaaacccugucucuacaaaaaauaaaaaaucagccaggugugguggugcgcgccuguagucccagcgacucaagaggcugaggcaggaagaucgcuugagacugggaguucaagacugcaaagggcuaugaucaugccacugcacugcagccugggugauagagcaagaccccaucuuuaaauaaauaaauuaaauaaauaaauaaauaaagacuccuuugaguguugugugaccgagugugagugugaguguguguguguauuggcauucagccccucuggagcagcgagggcucauacuggaugugguguugguuccuguugcauccugggcugguaucuuuucacguucaucugccacccauggcaggcagggauucgagguaggcugaggaagggaggaggagcugggggagucacaugaggggucccaaaagaagaccacagccccgggaggguagcccugggagggaagcccugaggauggacaccucccaggagucucuggaacuuaggaacaaagcaacauuuuccacauuccucuaggaugagccuggagccauuucauucauucggcuguuagaggaaaagggucugcagagggccgcagggcucagguggucugggccacaggaggucagagaggucaccugagauguggagggagggcaguccucccacacucacugacagaaaccaccccguccacaggagaggaagcagccccuagcagcugccguccuggggccagccagcagcugcagcccuaggaggagggaaagcugccuuccccacccaucucuuuccuccaaggcuauucugggaaggaggggcugugaggacugaagcugggagggggugggggacagaauuugccuggacuuucucugcuguaucuguuugacauguugguuucuuguuucucaccuacacucuuggccuccaaaugggaaagugcccuuggcagacagagggacagccuaaggaagga

SEQ ID NO: 18349 - RNA, 5696 nt, Homo sapiens
auaaacaugcauaauaauuuaaauaaaaauacuguccugcuuugcaaaugcagucaugugucaaugacagggauacauucugagaaacgcaucguuaggugauuucacuguugugagaacaucacaaaauguacucacaccaaaucuagaugcaguagucuauuacacaccuaggccauaugguauauauaacccuuugcuccuaggcuacaaaccuguacagcauguuacuguacugaauaccauaggcaauuguaacacaauggcauuuguguaucuaaauacagaaaagguacaguaaaaacauuuaucaguaaaaugucuucuaauaauuguuaaaagacauuugcaaaacaauaaaaaauaaagaaaagauacaguaaaaauauggaauuauaaucuuaugggaccaccaucauauaugcaguuuagaguugaucaaaaugucguuaugcauugcaugaugauaucauuucaagacagguccucuagcccaacccauccaccagauugccauccauaagccccuccuucccauuuagaaauuccucaaccagcauugggaaaagcuaauguccuggugucaaguugcuacaaaaugauuuccaagcauccuaaauccugauaauucauguuguauugcugaaaacaucaccuaaauuggcuugaguuucauccauugacaauuccuugugguggauccaguugugguuuuauaguucuuucucaggguucaccuuuguggguguucucuagggaguccccugugcccugaaguggagaaaugaucccaaggagaauuugcuuuugcucaggcccugagguuugagggucuuuuugagcucguugcucaguuugggauggauauuccaauuguguaauuuauaucuagccccugcaucuacaugucacaggcuuagaauauacauuucucacaggggacuuuauuuuucacaugcguauauccagaccccagauuuauaugcccgacuacacccuagauaguuccaccagugucacaaguuccucaaugucaaauugcccaacauugaccuccugccaaaaaaucuguacuuccccagcaugccucauuucagcaaauagcacaaggcugcugcauaugguuguguaagaaguucacugcacaacaaggacauggggauuuaaauccagcuugcacacagcucacuaagcugugcauccacagggcuguguccaccaagagggcaucauucucuaguuguacaaagaugcuacaugagguccagauggcccuggcaacuacaccaucauccauccaguugccauuucuccuucucguauauuuuuaccccacccauucccaagucaucccagagucucaccaccuugaccuccuacuuaguccucaaaucuaucuccuuugugccaccugcacuauaaguugccaguucugacaaauaaaaaugcagagcucggccgggcgcaguggcucacaccuguaaucccagcacuuugggaggcugaggcgggcggaucacaaggucaggagaucaagaccauccuggcuaacacggugaaaccccgucucuacuaaaaaaacaaaaaaauuagccgggugugguggcgggugccuguagucccagcuacuugggaggcugaggcaggagaauggcgugaacccgggaggcagagcuugcagggagccgagauggcgccacugcacuccagccugggcgacagagcgacacuccaucucaaaaaaaaaaaaaaaaaugcagagcucccauuuaaaugaauuuuaaauaaagaacaaacaauauuuaguauaacuaugccccuaaauccauucugucuaacagaaucccaacuuuuacuccagcccaaacugugcucagacaaaagaacacauuucuagccagauaagcauacccuugcucacagcuucaccacuggaagcuggauccgucugcugcccccacaccacauuugguggaggcagacacauuuccucagaaaauaagacauugggauauuuuggcugcuuguuugauauaaggcuaggacccuucaugcacaccacaaaauguuuacuuuucauguaaguguuauagccuggauuuaggagccucaguguuggcucccaggugagucaguaguggccuccccauuccugaggguggcaucaggccacaguaccucuuggggcuccccagcaugggaaggacaccagucaucucaaaugggcucccacauccucucccagagugugccgggaacuuggcucguagaccccguaaaaaggugcgccauccugcaucaggcauguggcucaguucuggguagagguaauuauauacccaaguacucucuccugauuucccagccaggaaagaaaagccucuuuaggacagagacaugaucuugaaggacuccaacucuaaaauacuucaccaagucaaguccuguaaacaauguguuuaccugccuagauuuugagaccaaaaugccuaagaacaaaacaaaacuaaccaaacugagugccucguauuagaaauguggacaauuaguggaauccuacaguauauuccuaaauuccuuguggaauuuuagaaguuuaauauccuacuaucuuaacauuuugguaacuuggaguucagagaucacuaauucgaacguuggugccacuagcugaauaauacaauguuucuucauguccacagaggucauuuuucauuuaucccaggauccaaaauuagaauaccucugugcaauauaaaauugcacacuaagaaauuuacuuguaaaguuucacauauaguuuauuucuauugaacuucaguuauugaaaguaagaauugaacacacacacaccucugcacccacauguuuuuauuuaccaaagacccuacagugaggugaaggggaucuuuacaucuaacagguucaaccucuuucuagcuggaaagaagcaaaagcuggaacagcuaugauaugcacauauuuuucccauguggccuuucucuaugccuuugucuccccacacacguagacauacucaugcuguccaaaguuggcaguggaacucuaccugacagcuauugaggugccguggaauaaggccugggcaucgagauguacccacagagaacaccagauccagcgaaaacugcccugauuuucaggggaugaaauguagcucugcaacuccagaaguucaaucaucuaacaguuguguaggguuuuuuuguuuuuuuguguuuuuuuuuuuuacucaugguuuuugcggccuggauuaaaagaaaaaggaaucaaaucauaucuacuuagagcagcaccuaggaauuauauagaccucuuugaaaccuagagacuacuccaaaccuucuaaaacuguauuuugguuguuuuucuuucuuucuuucuuucuuuuuuuuuuuuuuuuuuuuuuuuuuuugagacagagucucacucuguugcccaggcuggagugcaguggcacaaucuugggucacugcaagcuccgccucccagguugacaccauucuccugccucagccucccgaguauaguacaguccugggacuauaggugcccaccaccaugccuggcuaauuuuuuuguguuuuuaauagagacaggguuucuccauguuagccaggauggucucgaucuccugaccucgugauccgccugccucggccucccaaagugcugggauuacaggcgugagccaccacgcccagccgguuguuuuccuuaauauauuuaugguguaggacucccuccuuccaaaacaccagggaaccuucugagagcaguuuccugugccaccuagauaaucucaccaggaaaucucugcagaaucuuuuuuuguucuauauuguguccuccauuacuaacccaccuggugguugcaguugacuuuuuuuuuuagggguggggcauuguuuuugacuaggggaaagaagacuuuuuuacauuuaaguaauagaggcacaaaaaauuauuaucuuuucagaaguuaauguguccuggaaaaucucuuggcagccucugucuuuuuaaaaauuauuugguguuuuuuuaaauuauuauguugggagcaggggugggccugugacccaggggccagaggauuagcacggauguaugcugauguuaacccaaggaguggucaggcacagcagcuggcagucggcaccaugcucucugccaguuagucuagaggcacauaugaaggugccaugaaugcauugugguuuuuguuugcuucuuuguuuuugggauggaguuucgcucuugucgcccaggcuggagugcaauggcauggucuuggcucacugcaaccucugccuccuggguucaagagauucuccugccucagccucccgaguaccagggauuacaggugcccaccaucuugccuggcuaauuuuugugauuuuaguagagacagguuucgccauguugaccaggcuggucucgaacuccugaccucaagugauucgccugccucggccuccaaaagugcugggauuacaggcaugagccaccacaccuggcuaaauguaucguguucuaaaccugcuucauucacuuuggcugugacuggagacaacaaacauuuugggaaauaaaucaugcucaugucauagacauguggagucucagcauggaccccaaucucuuuccacuuuaagguuuuggagauacuagaucugcagccuucauuagccagccaaggggguucccuaguggagaaagagauuggcuguaaaaaugccgugagucacuaguuugacugugucaaagccugugaggcagcuuuuguuuucaccuuuuccuccaaauguuugcuucuugucugauugacaggaggcccuaaaacucaugacugguggucacugagcucucacccugcuuggcuauuguagauaggcaauacuaaacuggggaaugcagcuacagggcaauaguauuacuuaccugguauagauccagccuucauguuuuucugacauguaccaaguuaacauuagagaaacauuccaaaagguauuaauaaaaugaaaaguuuuaccaaaagcaaugaaaguucacugcuauggucuaaauguuuguccuccccaccccaaaaugcauaugucgaaaccuaauccccaaggugaugguauuaggagguaaggccauugggaggcgauuaggucaugagaccagagcccucaugaaugagauuagugcccuuguaaaagagaccccagaggacuagcucacccuuucuaucauaugaggacacagcaagaagguacuaucuaugagccagaaggcuggcccucagcagacacugaaccugccagcacccugcgcuuggacuucccagccuccagaacuguaagaaaugaauuccuauuguuuauaagccauucuguuuauggcguuuuguuauagcagccugaacaggcuaagacacucacaucaugucuguauuuuaugauugauuugagggcauccuuagaaaacuaaauauaauugacuaaaauugaauguggacuaaauguuaauaauauuuuaucaguguuaaauucugugaguuugguauuuguguugugguuguuagacaacauccuugaccuuagaagauacaugcugagguauguagguauacagguguaaaggguuacaauaucugccacucacucucaaagaguucagca

SEQ ID NO: 18350 - RNA, 5696 nt, Homo sapiens
ugcugaacucuuugagagugaguggcagauauuguaacccuuuacaccuguauaccuacauaccucagcauguaucuucuaaggucaaggauguugucuaacaaccacaacacaaauaccaaacucacagaauuuaacacugauaaaauauuauuaacauuuaguccacauucaauuuuagucaauuauauuuaguuuucuaaggaugcccucaaaucaaucauaaaauacagacaugaugugagugucuuagccuguucaggcugcuauaacaaaacgccauaaacagaauggcuuauaaacaauaggaauucauuucuuacaguucuggaggcugggaaguccaagcgcagggugcuggcagguucagugucugcugagggccagccuucuggcucauagauaguaccuucuugcuguguccucauaugauagaaagggugagcuaguccucuggggucucuuuuacaagggcacuaaucucauucaugagggcucuggucucaugaccuaaucgccucccaauggccuuaccuccuaauaccaucaccuuggggauuagguuucgacauaugcauuuugggguggggaggacaaacauuuagaccauagcagugaacuuucauugcuuuugguaaaacuuuucauuuuauuaauaccuuuuggaauguuucucuaauguuaacuugguacaugucagaaaaacaugaaggcuggaucuauaccagguaaguaauacuauugcccuguagcugcauuccccaguuuaguauugccuaucuacaauagccaagcagggugagagcucagugaccaccagucaugaguuuuagggccuccugucaaucagacaagaagcaaacauuuggaggaaaaggugaaaacaaaagcugccucacaggcuuugacacagucaaacuagugacucacggcauuuuuacagccaaucucuuucuccacuagggaacccccuuggcuggcuaaugaaggcugcagaucuaguaucuccaaaaccuuaaaguggaaagagauugggguccaugcugagacuccacaugucuaugacaugagcaugauuuauuucccaaaauguuuguugucuccagucacagccaaagugaaugaagcagguuuagaacacgauacauuuagccaggugugguggcucaugccuguaaucccagcacuuuuggaggccgaggcaggcgaaucacuugaggucaggaguucgagaccagccuggucaacauggcgaaaccugucucuacuaaaaucacaaaaauuagccaggcaagauggugggcaccuguaaucccugguacucgggaggcugaggcaggagaaucucuugaacccaggaggcagagguugcagugagccaagaccaugccauugcacuccagccugggcgacaagagcgaaacuccaucccaaaaacaaagaagcaaacaaaaaccacaaugcauucauggcaccuucauaugugccucuagacuaacuggcagagagcauggugccgacugccagcugcugugccugaccacuccuuggguuaacaucagcauacauccgugcuaauccucuggccccugggucacaggcccaccccugcucccaacauaauaauuuaaaaaaacaccaaauaauuuuuaaaaagacagaggcugccaagagauuuuccaggacacauuaacuucugaaaagauaauaauuuuuugugccucuauuacuuaaauguaaaaaagucuucuuuccccuagucaaaaacaaugccccaccccuaaaaaaaaaagucaacugcaaccaccagguggguuaguaauggaggacacaauauagaacaaaaaaagauucugcagagauuuccuggugagauuaucuagguggcacaggaaacugcucucagaagguucccugguguuuuggaaggagggaguccuacaccauaaauauauuaaggaaaacaaccggcugggcgugguggcucacgccuguaaucccagcacuuugggaggccgaggcaggcggaucacgaggucaggagaucgagaccauccuggcuaacauggagaaacccugucucuauuaaaaacacaaaaaaauuagccaggcaugguggugggcaccuauagucccaggacuguacuauacucgggaggcugaggcaggagaauggugucaaccugggaggcggagcuugcagugacccaagauugugccacugcacuccagccugggcaacagagugagacucugucucaaaaaaaaaaaaaaaaaaaaaaaaaaaagaaagaaagaaagaaagaaaaacaaccaaaauacaguuuuagaagguuuggaguagucucuagguuucaaagaggucuauauaauuccuaggugcugcucuaaguagauaugauuugauuccuuuuucuuuuaauccaggccgcaaaaaccaugaguaaaaaaaaaaaacacaaaaaaacaaaaaaacccuacacaacuguuagaugauugaacuucuggaguugcagagcuacauuucauccccugaaaaucagggcaguuuucgcuggaucugguguucucuguggguacaucucgaugcccaggccuuauuccacggcaccucaauagcugucagguagaguuccacugccaacuuuggacagcaugaguaugucuacguguguggggagacaaaggcauagagaaaggccacaugggaaaaauaugugcauaucauagcuguuccagcuuuugcuucuuuccagcuagaaagagguugaaccuguuagauguaaagauccccuucaccucacuguagggucuuugguaaauaaaaacaugugggugcagagguguguguguguucaauucuuacuuucaauaacugaaguucaauagaaauaaacuauaugugaaacuuuacaaguaaauuucuuagugugcaauuuuauauugcacagagguauucuaauuuuggauccugggauaaaugaaaaaugaccucuguggacaugaagaaacauuguauuauucagcuaguggcaccaacguucgaauuagugaucucugaacuccaaguuaccaaaauguuaagauaguaggauauuaaacuucuaaaauuccacaaggaauuuaggaauauacuguaggauuccacuaauuguccacauuucuaauacgaggcacucaguuugguuaguuuuguuuuguucuuaggcauuuuggucucaaaaucuaggcagguaaacacauuguuuacaggacuugacuuggugaaguauuuuagaguuggaguccuucaagaucaugucucuguccuaaagaggcuuuucuuuccuggcugggaaaucaggagagaguacuuggguauauaauuaccucuacccagaacugagccacaugccugaugcaggauggcgcaccuuuuuacggggucuacgagccaaguucccggcacacucugggagaggaugugggagcccauuugagaugacugguguccuucccaugcuggggagccccaagagguacuguggccugaugccacccucaggaauggggaggccacuacugacucaccugggagccaacacugaggcuccuaaauccaggcuauaacacuuacaugaaaaguaaacauuuuguggugugcaugaaggguccuagccuuauaucaaacaagcagccaaaauaucccaaugucuuauuuucugaggaaaugugucugccuccaccaaauguggugugggggcagcagacggauccagcuuccaguggugaagcugugagcaaggguaugcuuaucuggcuagaaauguguucuuuugucugagcacaguuugggcuggaguaaaaguugggauucuguuagacagaauggauuuaggggcauaguuauacuaaauauuguuuguucuuuauuuaaaauucauuuaaaugggagcucugcauuuuuuuuuuuuuuuuugagauggagugucgcucugucgcccaggcuggagugcaguggcgccaucucggcucccugcaagcucugccucccggguucacgccauucuccugccucagccucccaaguagcugggacuacaggcacccgccaccacacccggcuaauuuuuuuguuuuuuuaguagagacgggguuucaccguguuagccaggauggucuugaucuccugaccuugugauccgcccgccucagccucccaaagugcugggauuacaggugugagccacugcgcccggccgagcucugcauuuuuauuugucagaacuggcaacuuauagugcagguggcacaaaggagauagauuugaggacuaaguaggaggucaagguggugagacucugggaugacuugggaaugggugggguaaaaauauacgagaaggagaaauggcaacuggauggaugaugguguaguugccagggccaucuggaccucauguagcaucuuuguacaacuagagaaugaugcccucuugguggacacagcccuguggaugcacagcuuagugagcugugugcaagcuggauuuaaauccccauguccuuguugugcagugaacuucuuacacaaccauaugcagcagccuugugcuauuugcugaaaugaggcaugcuggggaaguacagauuuuuuggcaggaggucaauguugggcaauuugacauugaggaacuugugacacugguggaacuaucuaggguguagucgggcauauaaaucuggggucuggauauacgcaugugaaaaauaaaguccccugugagaaauguauauucuaagccugugacauguagaugcaggggcuagauauaaauuacacaauuggaauauccaucccaaacugagcaacgagcucaaaaagacccucaaaccucagggccugagcaaaagcaaauucuccuugggaucauuucuccacuucagggcacaggggacucccuagagaacacccacaaaggugaacccugagaaagaacuauaaaaccacaacuggauccaccacaaggaauugucaauggaugaaacucaagccaauuuaggugauguuuucagcaauacaacaugaauuaucaggauuuaggaugcuuggaaaucauuuuguagcaacuugacaccaggacauuagcuuuucccaaugcugguugaggaauuucuaaaugggaaggaggggcuuauggauggcaaucugguggauggguugggcuagaggaccugucuugaaaugauaucaucaugcaaugcauaacgacauuuugaucaacucuaaacugcauauaugaugguggucccauaagauuauaauuccauauuuuuacuguaucuuuucuuuauuuuuuauuguuuugcaaaugucuuuuaacaauuauuagaagacauuuuacugauaaauguuuuuacuguaccuuuucuguauuuagauacacaaaugccauuguguuacaauugccuaugguauucaguacaguaacaugcuguacagguuuguagccuaggagcaaaggguuauauauaccauauggccuagguguguaauagacuacugcaucuagauuuggugugaguacauuuugugauguucucacaacagugaaaucaccuaacgaugcguuucucagaauguaucccugucauugacacaugacugcauuugcaaagcaggacaguauuuuuauuuaaauuauuaugcauguuuau

SEQ ID NO: 18351 - RNA, 9246 nt, Homo sapiens
agacaaaaggcggcggcgggagcgggcgggaggcggagcggcgccgcgagggccucaaggugacacccgcccccggccccggccccccccggcccggccccccagccugccucccacccucagcccccagccccuuacucccggugcccuuuccgggcccccucccccggcgggggguggggagcagcgagggccccgcccccucccguccucuccccagggcccgcgcaggaugcccccggccccuggcagccccccgggagguccugagcucgacgcgcccccucuacgccaugucccccccuggcucggccgcgggagagagcgccgccggcggcggcggcggcgguggcggccccggggucucggaggagcucacggcggcggcggcagcggcggcggcggacgagggccccgcccgagaggaggugagagucuagggcgccccuuccccgggcgcggccgcagccuggccccccaucccccaucgcacgcgucccccgcugguuccgccgcagcgcggccggcgccccgcaccccgagccggccgcugcagccgcaguccgcgccgccgcccccacccggcggccggagcuguccgcggugccggggaaggggccgcgccgggggcggggcucaggggucccgggcagggggaggggccuaggggcggagccucgcggauccugggcuuaugagagugggggcuaugcucuaccgggguggggacgguggcggggauccugucucacagaggaggaugcuaccuugaaggccaggaagggcggcuuguacgggcuacagaacgaggaggguaccauggggaagugguggugguaccugaucugggacccuaaggaggucagauguguacggggggucccgccuguggucauugggagugugugugugugugugugggggggggugugcaccucucucucacgaggcuccugcugcuuccucauaucccuaguuggggucccuaguacucaguccucugaaccugaagacaaagagacggaggaaaguaccaggagcacccccacuccagccucccaugcacacuugugcacacgcaugcacccuguacuagggcagaggcacacaagcggggaugggccugcagguaaagccccuuucagagguacccacauggggacaagcacauaaccagguaggcacacgaaggggcccguauguucauaccuccuaaggacaaggcuccccgaaaggcacauguacccuaaucuccuuguccacauguacugugugcuauuuccuagcucgccuaacuauccauacuucuagauccagggaccgaugccuauuacuguacccuucuuuuccacucuuuuccucucuuuccuggcuggccucuaggucaggccugaggaauugaggggguaagucaggaucccagcaggagguuguguguguguguguguguguguguguggugggggauggguuccuaaagcuagacagcacagaggaggggugggaaaacagaggccacuacaagaaauuaaacucaacacucaauuaggauguggcugcugggggccagcaccaugguaggcaccuaggaugcaaagagaaugaagcaugggcccucaggaguacccaguguaguggggagccagacauguaaacaacuccugggccaacccugggacagaaugugccaggagcuuuaacagacaggcuccaggagaguaccaaaaauaauuuucucuugauaaauugcugggcuucaaacguuguccucgcuaccccagucccacauccccuaugccuguccucuccucagccacaugccucugcccuucuggauaccuccuccuggacugccugccgcucagggaccccagcccccucccucccauccuaggacaaagggaaggaugucagggugcaggagggagacucacaggggaaccaggguccagaacauggggaaugagacugggccugggguucucuggaggcccuuauccaaaggacguguuaggcuaauugugaggguuagggagguggaugggucagaggggaguagcuccucuagaaccuaggacugaaaaaaaucuggaagugagggccccacuuguuaaguggggaagugaugucagugggucccucccccuuuucuagaggaccuggaaggggucugggcuggggaccuuccuucgcugaugccugucugucuguccuccccugucuucccuguccacaucuucuguuucauugccauuuuuguguuugucuucggaugcucucuggguaccauccuauccaucuguguuugcugccugggccucuaucucuggcucugauccuucucugccucuuggggugucucucucugcacucuccuguacuggcauuccgguccccuuuccuguccucuggcuugcucugugucacuucuguuucuaccucuggccccuggcucccaucuuggucucaccuuuucucuccauaucccuguuucucucugccuguuaucucuggugcuggccucugccccuccauccccguauccaucucugugcuggguccugccugcucucacuucccacucaucuuggccccucucccugcccaccugagcagcagcgucccauccagcccucuuucaccaagucccucugccgugagucccacuggaagugccuccugcucucgcugcucauguacggcugccugggggcaguggccuggugccacgucaccacagugacgcgccucaccuucagcagcgccuaccagggcaacagccucauguaccaugacagccccugcuccaacggcuaugucuacaucccccuggccuuccugcucauguuguacgccgucuaccugguggaguguuggcacugccaagcccgccaugagcugcagcaccguguugaugugagcagugugcgggaacgugugggccgcaugcagcaagccacgcccugcaucugguggaaggccaucagcuaccacuauguccgccgcacccgccaggucaccagauaccgcaauggagacgccuauaccaccacccaggugaggagcugguggggagugcaggacauucaacaugggagguggcacuuacgugcugccucacucccuccccaccucccuggggggaaggugggaggagcaaaaggcagcagugagcucccaugagcauugcaacagcagggcaauagcaacaaccauaaucauaacagcaaaaaccgaccaggagccaggcucugcucuaaguauuuuacacacaucaaaucauuuauuuaacccucauaacaacccuaugauguaggcagguauucccauuuugcagaugaggaaacugaggccuggagaguuuaaguaaugugucuaaggucaaauaggcaguaugugguggagaugagacuugaacucaaucaaucuggcuccaggaucucuauacuguuuagugcuuaauggaucuacuuagugauuaauggcagagugugguggcucaggccuguaaccucagcacuuuggugaggcagaaggaucucuugagccaggaguuugagaccagcccacccggcagcaacauaguaagaccccaucucuauaaauaauaaaaagaaguagcugguguggugguaugcaccuguagucccggcuacucaggaaacugaggugggagaaucgcuugagccugggcaguugaggcuguagugagcugugauugccacagugcaagaccccaucucaaaaaaaaaaauaaaaauaaaaauagugcuuaauggcuggagauggcuucacaugcccaguaucauagcaugcucuuaccuguucagugaggugacugcuacugaguucuuucacagguauggacaccuaaacucagugacuuguccaaagucugcugcucuuaagugguagugcuaggcucaaucccagcuuccuggaugucaaguucaagggucuaagaggaggugggcguaggaagucucacugagggugggcaggucaaucagcacuuuguggacucgccaggaugagacauauugggguccuggaggagacguucccagaugcaggccaucugucucaguauaaggaucaauagacagaagccuggggcgggugagaagcaggaaggaggcugaugauagcuacagcgugaacaggcagacuagagauagagggguucuuuagggagugcuucuggggaacccauugggaaacacaauuguaaaagggaagaaagaagaagaggaggcuguuuguggugaugugggggcacuuuggaaaacagaggcaguggcaaauggaucaggcaggccagaggggcaguucauggccagggccugaccccuagaggaagcagggcuuaguuaaaauuuaaaugcgcggccgggggcgguggcucaugccuguagucccagcacuuugggaggccgaggcggguggaucacgaggucaagagaucgagaccauucuggccaacauagugaaaccccgucucuacuaaaaacacaaaaaauuagccuggcgugguagugggcgccuguagucccagcuacucgggaggcugaggcgggagcauggcaugaacccgggaggcggagcuugcagugagccgagauggcgccacugcacuccagccugggcgacagagccagacuccaucucaaaaaaaaaaaaaaaaaaagaaaaagaaaaagaaaaaaaauuuaaaugcgcacagguagggcugguucuaguccggucaucacgucugauuacacagagggcgucaguugcccuguaagucagacggaaagauccuaaccagcuccagccggcaccuaaaccaagacagacuuaggguccgaccaggcaaccagagcacagauggggcgggaaagggugagugggcagaagcgggcaccaaugacgggcuccccgcgaccccgccgccugccccccgcgccgcaggucuaccacgaacgcgucaacacgcacguggcggaggcugaguucgacuacgcgcgcugcggcguucgcgacguguccaagacgcugguggggcuggagggcgcgccggccacgcggcugcgcuucaccaagugcuucaguuucgccagcguggaggccgagaacgcguaccugugccagcgcgcgcgcuucuucgcagagaacgagggccuagacgacuacauggaggcacgcgagggcaugcaccucaagaacguggacuuccgugaguucaugguggccuucccggacccggcccggccgcccugguacgccugcucgucggccuucugggccgcggcgcugcucacgcugucguggccgcugcgagugcuggccgaguaccgcacggccuacgcgcacuaccacguggagaagcuauuuggccuggagggcccgggcucggccagcagcgcaggcgguggccucagccccagcgaugagcugcugcccccgcucacccaccgccugccgcgggucaacacaguagacagcacggagcucgaguggcacauccgcuccaaccagcagcuggugcccagcuacucugaggcggugcucauggaccuggcggggcucgggacgcgcugcggcggggcaggcggcggcuacgcgcccucgugccgcuacggugggguaggcggcccgggcgcggcgggcguggcucccuaccggcgcagcugcgagcacugccagcgcgccgucagcagcucgucuaucuucucgcgcagcgcccuaagcaucugcgccagcccgcgggccggcccggggcccggugggggcgcgggcugcgggggcagccgcuucucgcugggccgucucuacggcucccggcgcagcugccuguggcgcagccgcagcgggagcgucaacgaggccagcugccccacggagcagacgcggcuguccagccaggccagcaugggggacgacgaggacgacgacgaggaggaggccgggccgccgccgcccuaccacgacgcccucuacuuuccgguccucaucguccaccggcaggaggggugucugggccacagccaccggccgcugcaccgccacggcuccugcguagagaccucacugugaccuccggccccggaguggcccgcgccguccucccgccugccccucgccggacugugcucccucugcgacgcagggcgagucaccacggugacugaggccgcgcggggggcagggaaagggaggugagggccgcaagacaggcccggauggggccgagacccccgcugucccuguacauaaagagaccgaugggugggagggggucggcugcuccccgagaucccccuggcagagucauucuuccagccccaacccugaguuccuaaagggacaccucccuccuguccagcccuucaacagaucuucuguuagaugacaaccgugccgugggccccgcguugggccuugucugaagggagaggcccuggcaugcggaugggagauuuagaggcuguggagaagggaacuuggggcuuuccuuccuucguggccucacuccccuggggccucucucuauggagggggcaaugguuuggugaccagcaggcuggauuccaacuagcuaaugcauucagcaggucugaggcuggggccaggugucagcccuaggccuccauccaacaccguggaaauguugcugcccucuucuuggcgcugaccccaagauugggguuuccuuucugccgcucccuccacuguuguuuaucuaacugggcccccacuccagguccagagggacugugcucacugcacagacaucacucaccuuccgcuccccaguccugcagagcuguugccagggugcaguggggaggggagugaaauguggaggacuguguaccucaguccucucucuaaacuccucagccucccaacaggggccuccucaccuggguucugaguguauaccccuuuuagagagugagaugccacccgggcagcacucguuaaagcuggccagcacgagugacuaaggggagagagcaugacauagaccuggguggcaacggggaccucuggaagcaggugggaguaagagaggagagggcaguggaggguagaggaaaaggaccuccagagguggggugucugugggggcggccuuugccucccuaaaccugugcggaggaguggagugugcuugucgcucaaacacaucucugggggacugaggacguugucacaagccccaacuggagaaauaauuccaauggcagggucagaggcaagcauucucuaaaucuugcccaacccuuccauccuucccuauccuaugagcugaagcccugcugugugucgcagggucuucaaaggggcauccugccaccaccccagggcgcuggccccacguccuguuccccuaaagcucugacaccgccuucucuccgugugcuccccccaccaccuccacccugaugugcuucagugugcaugucugugaacagcccuccugcccugccaacuccccuggcuaaagucuccccagcagauuuagcacccagggauugagcucacauuucaggcuagagaggauaacccuugggccacccacaucucucaccccugaugcuucuuacuucgccugagccaucagaacuccuccuuacccuccuucagccccucucaucuuccuucagcccagccaggccugcaccaccaacuguguggccuccaccuaugcaacaucgccucuggcuccccuucccuucuuccuagcggggagugcgaggggcccaaauuguggggauaccauggcccauggcuucuaaaggguuuagcuuuacuuucagguagagauggcugagugaggagggagaagaggcuagagagagggaggcuugggcaggggaaacagcugcccaccagguuuuccuggacagcagugcccaccugccuacuagcacugaaccugccuggacccugagucugugcuccuugggggccuggcguuuggagcacccuucuuuccucugaauggacaucugugagguacagguggugagcugcagccucaggcuccauuucuuagccagcuggcaccuggaugucaugcuuuguguggggacagccuggccaccucagggcuccaaggaaggaggaacguggcuccuccucccucaggccuguuccugagacagagccuggucucacaagaggggaagggggaccucuauuauuauuuuugccuguauugaccauuucugccuaggucgucucagacagccucaucucccacacaugcacagacuuagagagaaaccaauucuuuggucuauuuucuugguagcuuuacugauugccagggaaaaugaaaaccagaaaauuaauuaaucucuaaaauuaaacuuuacacugaauguucuuguuucucuaauuagaacuucugcuagcagcuguggcuauacacacacacacacacacacacacccucacaccuacacguuugcacuccggaacugucagagggugucaggcacagacagacucuagguugccuagacaggcacacacaugcagucacucccaagcccccuuuggugcucugcucagcgccugcuuagcggaaggagucccuggagagcaggcacuccuggacugggguuguagcccaugaccugcccuuuggggacacaguucuggaggcucugggccaaugaaucagcccaaggaggaugggcaauggcgcucagccugaaucagucagcuaggucucuuguggcccugggggcugaugugauuccuguagguguggccccaggguggacagcuacagagugaugggggacucauguagggcaccuggaaggcuccauguguccuggggacaagggcuuguggggugggcugggccuggcuggggagaagacaggucucugucaauugggugcaucacacuguggccuuuuugucguggauuuaagcgcaaagauuguacaaaucaaacugguggauaauaaagucguggaugacucacugacuuccugucccaguguggcacuucuuucccucccucccagggaagcucucugggguggguggcagggauugugucauccuucccuggaaguugucaucuacaguugccuccccagaggaguccacugggucugagccccuggugucagcucauuguccccuucccagguugggaguuggggaacuaggggauggcguggccuguagaacuggaucacuuaaagcagagucaagcaacagggaaaugcaucu

SEQ ID NO: 18352 - RNA, 7424 nt, Homo sapiens
uugguccggaggggcggggcgaggaggaggacccgcuugggcgguucggcugcccacaguaaccgcuggguggaccuggccagcgcuccgaaccuuguccucgcugcgcgccggccccucggagccccacagcccgggaaggaggccgccgcgggccgggcgcccgcucugccaagcggacccgcaacccggaaaggcggcgcggcggagccuggagccggauccugcucagaccgggccccggccggccagagccgcgggcaugucggaggcgcggaaggggccggacgaggcggaggagagccaguacgacucuggcauugagucucugcgcucucugcgcucccuacccgaguccaccucggcuccagccuccgggcccucggacggcagcccccagcccugcacccauccuccgggacccgucaaggaaccacaggagaaggaagacgcggauggggagcgggcugauuccaccuauggcuccuccucgcucaccuacacccuguccuugcuggggggccccgaggcugaggacccggccccacgccugccacucccccacgugggggcgcugagcccucagcagcuggaagcacucacuuacaucuccgaggacggagacacgugaguaugggggcuaggcugaaucgggaugcuaacucugggccugcccaagagccgcaacaggucgggcacccccacucccccgugaagauccuucaaguccccauucgcucuuccaaacuccagacuuaacucucagcccacuuuugagguccagcuaggccauggaaucaucucuguccucccauuucggggugggcagagcuggcaggacccuuaacccagccagcaucuuggaaaucuaccaauaauccacccuuaggaagagaaaauuccccugaccaaguccaguuuuuuuguuucuucuugcuggggaaggggacauccuuauuugcucaauaucugggauucccaguuccugaccucagaaugcucugucucaaggaacaacaggugccaguuacagguugccagucggggccaggaagcuaggcauggggggugccaccaggguguagguuugggacugguccucaggaggauggggugagccaggcuggggcacucuugccccagcagacagacaggcggcuggcugccccagcuuacuuccuccucugcuaagaaaggggaagugagggcuagagucagcgucccugacauccucuaccuccagagcccccagucccacuaacugucgugucucacucccucacuuaacccuuccuccuccagacccagauggaguuuggugggagugggccagagggcaguugaaguaaaaggcaguugugugggauggguuggccaguugaggauuuagccccccaggaagaagaaaacauugacagaggagggaaagguugggaacuggggaugagaaauagaguuggggagggcuggaaucccuggucaagggugcucauauaaauaggaguaggggaggcaggagguggcuguccuaaccugcuuuuuggagaugcaggguccuaauccuggguggccauugauaaagacagcugguggacccagugggugggagaggagugacccaguccuuucuguacucugccuggaucaccagcccucaggcccagaaccccaagguuuugggggcugcacgcaagauaccucugaugaccuuugauccaaggagaggggacuuuugacauugccgucuuuuguuagccucucagccccagccuuuuccaucucuaguuagaagcagguguuguguccagauuggguguguguguggaggggagaaauguccgggcuccccagcgaguccccagagagcagggggcacuuuccucccucuguuggaggugucugggcugugggagguauggaagugggaagaggaagugggaggaggggauacugggggagagagggagguggcugcaagaaugugacccagagagcaggcccuggccuaggggauuuccagagcaguuccucccucccuccgucacucuccugggccucuccugcugccugcugcuaaagccugccacccuccugcccaagcagcccccuccccagcccagacgggccuuuuagccaaucuaccccccucacuaaugccccaaggcagcugucccggccuagacccuccaucacuggcuuucguuuuccccaccugacguggggaaaccccaagacuggaacuuccccucccaacugcccccauuaccccuagauuaagguucuuggcccccucaacaaauacauuuucugcacuacaaagaccuccucuuggaggugcacacaggaauggagggccucuguuaggcccgaccuggucugugcuaucugagaggugccucuugacucccagggaagggcagcaggacaggaugcugcacugucuccuugcuccucuuccaagaguuucugugucucucccuuggaauguguaacacugaguugcuuggggguacggggugacccugcaacugucuccuucuuuccugugugcuggggugguggggugcuuagcccuggaaacccccucuggacuacuucggcagcuuucaauuuggcuuugagcugcagcuggcucggcagagcccugagggcaaagaggagugggugugggcaggcuggacaggaaggcuguuguccugucagcacccugcccacaugcccacccagccaaggcccuccugaaggccagcagugggaacuuggagcuccaacccuaggauccuggcuucccacaccaacccucacuuccuggcccacacucucacuuccuggaccuacccuauggguagcuaguuaaaguuugauguguuccuucuaacuccaagaccccaacccacucccucuggccugggcccuuaacucuaagccccgccucugcuccccuaggcugguccaccuggcagugauucaugaggccccagcggugcugcucuguugccuggcuuugcugccccaggagguccuggacauucaaaauaaccuuuaccagguugguggcgagagaauguuaugcccagauaccuguuugugcccuggcagccauucccagcagccauaccaguccaaaggcugcucacuuaggaaaccauaugccagacacugagcuagaaacugaggagacagacccaaguaagacauggccucuguccugaggugcuugcauccugggcugggggacuuguaucaacagcuaaauacacagccuggugacaagaguugugauagagacacauaccagcugcuauaggguccagugucugugugcagcagccagggaaggcuuacagaggagaugccaucugaauggagccuaacagagaguuuugccagggagagacugcccggugccucuaucuuuccuccugcagccuaaccccuggggguaacagaggucuccucacagggugaggggcuagacucuccuccuacauguccuuucuccagggccuaaggugacuuacaagaaaagcagagagcuacuuucuucaccuugcuuccagaauugggaucccaagagcuuggugggggaggggugugacaggggaagggcucgguaguauuuccuuggaagaacagguuauggccuuuauaagcugcuuucaaagaagaugcuggcagcuggugauucuugagcccaagcauguucccagaggugggagcaugcugcaguggccccaugacccucuauuugugccuccagacagcacuccaucuggcuguacaucuggaccaaccgggcgcaguucgggcacuggugcugaagggggccagccgggcacuacaggaccggcauggugacacagcccuucauguggccugccagcgccagcacuuggccugugcccgcugccugcuggaagggcggccagagccaggcagaggaacaucucacucucuggaccuccagcugcaaaacuggcaagguguggacagucuuuaagacugcccuuagggccugugggaugaggagggcauaggagauagggaccucacucuuggggaagggagggucccagcuuguccauuggugccccucccacuguaagcacauagauauucaguacaucuuugccaaaugaaugaauggaugauuugauuucgaauuuaaccaguaccuacugccugcugagaagaaaacuaaaucuugcccuuaagauacuuaguuuaauagagauuagaugaccugauucauucauucaacagaaauguacugaggguuuucuaugugccagacguuauccuaggagcuacacuugcaucugugugcaaaauagagaaagauugagaugagcaauaaauguaagaagugaacuauguaauauguuaaaaggaaguaagugcuguaguaaaaagcagagcagagugagaggaaggaauguggggaguaggagaguugauaugauuguuaaauagggugguccgggaaggccucauggagccagugacaucugaauagcgcccugaggaaggugaagaauguaaauuugaaucgaaaucucuauuacuaagcaagggucgggaguguccagacuagaaaggagagcaaaaaggccaggggagcacagaaggaagcggccccugagaaagggcugggggcaugaggaucuuagguggcuuuucagaaaagguggcuuucagacugggcuugaaggcagguugugugugugugugugugugugugugugugucuguauguguguguguguguguguguguguguguuguaguuuguguauaggaggaggguguucuuugggggugucacucagcagccugaccccugaagcaugaaaguuucaauaacaugacucugaaaagguggaaacuuugaguuccuuuccccuuagacuuuugaggggguuuugggguuugcauuuuaacagucuugugauuagagacauugagugggcugugagucccuuggggcugagugguagggaggucccagaagagagggaguugguggaugcagaucagcagcccucacccucacucucaccccaucccaggucuggcuugucuccacauugccacccuucagaagaaccaaccacucauggaauugcugcuucggaauggagcugacauugaugugcaggugagacagccagcaaagcacugcccggcccagggccugcccccaccugacacauccccaaguccccugcccagcagucagaagugguggcauucacuuccuuauccagagcccaggcccagcacacugccucugagggccuuggcugacauccuuauuccuccccaggagggcaccagugguaagacagcgcugcaccuggcuguggaaacccaagagcggggccugguacaguuccugcuccaggcuggugcccagguagaugcccgcaugcugaacgggugcacaccccugcaccuggcagcuggccggggucucaugggcaucucauccacucugugcaaggcgggugcugacucccugcugcggaauguggaggaugagacgccccaggaccugacugaggaaguaaguggcauaugcuuugcucuccagggccuugcacacccauagcagagagagguucugucauuagcugaaagggccagggagccaggaguccugggguauaaccaggacucugccacugaccaacugugggaacuugagccuguuuccuuaguugguccaaggagccaaauuuggacucuuacagggacccugcaguuaaagugaaucagugaaguuggccagauaugagaccaugguguggugaggccuauaagaacccagagagccaucccugagggucucuguacucagcuucagcaaaggcuuacaaagcaggaguguaggcccaguuuuuccuggucuuggacuuucuugagaggugaaacucagauuuucuguacagucuuuccuauuuuuaaauguucaguguaaaaaagaaaccuaaauguucugcgaguacccagcagcccccccaccccaucccccaacaacaacaaacaacuccagguccaugggcuggaucaccucuaagggucccuccuaacucggauauucuggcauuaucuuagaaaaggaaggcuugucuaaguccucagggcucugccaagcccagaggggccacuauuuugaggauucgugugaagauuuguucccugauggucuucaacugucauuugguggggagggaguggcccaacagguuucccuggguccccuuucccaagucaccuuuucccauguccucugaucuugcuucucuccauucuccuucucagucccuuguccuuuugcccuuugaugaccugaagaucucagggaaacugcugcuguguaccgacugaagccaggcagggucugggauccucagggcuccaccucuccaucuggaagccggagccauaacugcugcaguuugggcccaggcuaugugcucuucuggugcccuagggacugcuguggccagagccuggggccagccaguacaguccugagccgaggaggagggacugcaaguggaagagagccagucuggaaggaagagcuuuccagguggacagggcuucuuggaagacccccaaagccccagguauccugggugaagccuguuugccucucuugaaaauggcaggugcucuuguuuuacccauguugggucagccugaaacugccaaccaguaggaagcauggacucuccugagugagaagagacugaaauaggagcaagcagaacccugagaggugucccaucuuauugcuguugaggacccugaaacaccguuguuuaaagacuucacacagaaggcucugaacugagccacuggggaagggaaguuucaguaacaugacacuaaaauggcagagacguuaaaaaaaguuuuucccuucuagagcuguuuugcgcgcaugcaugucugugugcauuggggcuuuuuagacaggccugcccugugacuuugugguagaggcagagagaaggaaauuguccccugagcacgguagggccuugcuggguggggucagaggccaguaguuccaggccuuucucuguguccagcacagacccuuguccuugcuguggaaaugaugagggauggagggacaagaggaagaaugagaggacacacgcccuggagcccucaccacugcccuggggguugccaucuggaggagccuggggauaaggguaacccagggaggcugggcacgagggagcugacuccacguuuuuccccccguuccucaccuucgagggcccugcuaggucaccccuaugcuggcaugaagagcauggggcaauaaaccagcacagucucugaccacuuggagcgucucauccagugagagagacagccguuaaaagcauaaacauccaaau

SEQ ID NO: 18353 - RNA, 3532 nt, Homo sapiens
acaggaccaaguccacugcaguaauuuaauuuaauaaaauaaaauuauaagagcaaaaaguuacauuucuaaaguaccaaaaccugcaacaggcucauggaacagagccuagggauccaggagcauaggaggugguggugcugggcagggcucugcauccccuuuccucagcacagcaccaucuucacccuccugggaaagcagcauuggagccuacaccgcuugugcuuuucucaccaggguaagaaaugcagguauuugcagaggggagugagucuggaagguggcagagcacagcuagggcaagacuuaagggaacuugugggaagaguaacuggaaccuaccuaugcucucuugaccccaaacuccccaaaaccccucacugaggacugucuacccccggggcucagaauaaacugcuuacuggaagaugggugacuuaaggcaaaagggaaggcugccuccugggcuccccaauccccugcugcagagcuggucugugauacugagaaaacaccugcauuuugcccuuucagccagcucccucagagguuacagcagaaggggauggugggaggguccuauuucacuucaccccucaggcccuuuccacccucaaaccuucugcacaggagacucaacaggcacagccuucuuuccccguugcuuuagacggccccgcgcguagacucugagcaggagggcagcaaagaccacagccacccccagcccucccaccacagugacaguguggccauagagaaggcaggaaagaaggauggcaaaggccuggcggagggucaugaugauggugaagacggcagccccaaacugcccaaugguguaaaagaugaagagcuggccacaugcggagcagauggagaguagcagggcaugggcagcaaacucacugugucgccccaugaagcggguucccuccaguagggcccccuguucuagcagugagcccacugugaagaggcaggagaagaaauugaccccaaacaucaucugcaccgaugacaucuuauaggcaaacagggcauccugccaguuugaggugaagcugucaaaagcaauauaaccugccaguaagaugaggccugagagugugguggcuggggagcugcggggcucugguccgcuggauagcagaaacaugcugaccccaauggagaugaggguggcugucagguacucccaguguucguagcugcgccgagacacaagcuuucccaucagcaugacagggaucaccuuagaggccuuggccagcaccuggguggggaagcugacgaacuuaagagcuucguauuggcaccagcugcuaagcacauuggacaggcuggcaaaggaguaccgguacaugggugccccaugccggggcugcuugcagagaacacaggagaggccagccacaaucagugccagcacucgguucauuagcaccaggaacugcgaguccguaaagcgcucacccggugauguggcuguggccccauagcugcgggucaucacucuuuccugcagcacaccccaagucagauaagacaccuguuggggaagguagagacaaaggagacaauaagcaagauaaugaaaagguagacaaaaauugaccucucucucuucaggauuaugccuaagugauucaaaggaaaauauacacuuuuugguuccucuguagaaguuucuucuccccuccuaagucuggauucaccuuguagggaaucaacugugugugaaaaaccuauucagggaggcaagaacucucagaauuggguaucuguaguucaacaugauauucaagguggaacuaguacccacugcaaaaugccauggggucagcauguuagcacucucucacaugcaguacugggggaaggcugaauggcucccccacaauuuuaucaguggguuuacaguaugugagacaccagugcaggaaggaaguauaauaacggcacaguagaaaucacagagaauagggcaagaggaguccucucuucugcacuagacaucuugaaauaacagcaugaacuuucaguaccagugcuggagaggagaaaaggaagaaacaaaagggcauuucccccaaacaccucaaagauggaggugcagugugccccugggaggaggacacgaaacacaccagccagcaaagcucugggacugguaaaauggaaaccuucacagaaucccugcccaccggcauccaacccaggaagagaggcugagcccaccuacccaccuggagcccuguggcacagaagagcagcuucagggccugccacaucgggguggucucugccgccucuguucggggcgccaggggaaccucaucagaggccuugggcucauugccaaacacacaagcuuucaccaggggaaagcagaggccccuaccugaagaaagcacacaaagucaagccccaaaucuucuccauagcacuucaucuuccccagagcagccagccugcccugcuguccggccuaccgaccucccgcccucuccaagucauaucccguuuggacugcuggccaaauacccucuuucccgaccuagcucacuuccccgcccuuucuucacacaccggucuccagguaguucuuccgccugaaguacugcaccaggagguagccagguaccauaaagcuggcauagccagcagcauucaccacaaaucggaagaaccauagcuggguccaugacuccggaggggcuucgggagucuccccaccugccccuagggaggggaacgcagccagcaccaccacugcccaccaucuguaaggaaagcggacauaaggauuagggcgcagcuccucauccccuccgcccuccagaggggaccacacuggaguagugcccggagucuccuccccgcccccuccgcugcagcuccggcccggacaaagagccucucucucucucucucucucggggagggggugcgccggcgcuggccaggcagagcuuccucccuccccgggggcggauccgccccucuggccacacaggucuccucuguucccuccaacgcuagccggcugcucaggucagaggaagcgccccuucccccacacuccccuccacgauccgggacgucaggguccccagccccuccgcccgaagcuccccaaggagcacaaaaccaagccgcagcucccauccccgcuggcuccgggcagcgauaugcuggccgacggccgagcagccgggaccccacccggcccccgugcugaggcgcggcagucacguggcccgggggcucggucacgugagcucgcugcugcccuagcccccaccuggcguccaugguccaggccgcgugggguggagggggaaccggggaaugcgaguccccgggccgcgcgcccccugcgcucccgccgccgccuccaggagcggccagcgagccagcggccagcggaagugccgcgcucuucccgccucccuccccgcggcccccuccgccccugccgcgaccacgcagcgccccgggccgccgccggaccacagcgcccccg

SEQ ID NO: 18354 - RNA, 8739 nt, Homo sapiens
auccagacuuaggaggggagaagaaacuucuacagaggaaccaaaaaguguauauuuuccuuugaaucacuuaggcauaauccugaagagagagaggucaauuuuugucuaccuuuucauuaucuugcuuauugucuccuuugucucuaccuuccccaacaggugucuuaucugacuuggggugugcugcaggaaagagugaugacccgcagcuauggggccacagccacaucaccgggugagcgcuuuacggacucgcaguuccuggugcuaaugaaccgagugcuggcacugauuguggcuggccucuccuguguucucugcaagcagccccggcauggggcacccauguaccgguacuccuuugccagccuguccaaugugcuuagcagcuggugccaauacgaagcucuuaaguucgucagcuuccccacccaggugcuggccaaggccucuaaggugaucccugucaugcugaugggaaagcuugugucucggcgcagcuacgaacacugggaguaccugacagccacccucaucuccauuggggucagcauguuucugcuauccagcggaccagagccccgcagcuccccagccaccacacucucaggccucaucuuacuggcagguuauauugcuuuugacagcuucaccucaaacuggcaggaugcccuguuugccuauaagaugucaucggugcagaugauguuuggggucaauuucuucuccugccucuucacagugggcucacugcuagaacagggggcccuacuggagggaacccgcuucauggggcgacacagugaguuugcugcccaugcccugcuacucuccaucugcuccgcauguggccagcucuucaucuuuuacaccauugggcaguuuggggcugccgucuucaccaucaucaugacccuccgccaggccuuugccauccuucuuuccugccuucucuauggccacacugucacuguggugggagggcuggggguggcuguggucuuugcugcccuccugcucagagucuacgcgcggggccgucuaaagcaacggggaaagaaggcugugccuguugagucuccugugcagaagguuugaggguggaaagggccugaggggugaagugaaauaggacccucccaccauccccuucugcuguaaccucugagggagcuggcugaaagggcaaaaugcagguguuuucucaguaucacagaccagcucugcagcaggggauuggggagcccaggaggcagccuucccuuuugccuuaagucacccaucuuccaguaagcaguuuauucugagccccggggguagacaguccucagugagggguuuuggggaguuuggggucaagagagcauagguagguuccaguuacucuucccacaaguucccuuaagucuugcccuagcugugcucugccaccuuccagacucacuccccucugcaaauaccugcauuucuuacccuggugagaaaagcacaagcgguguaggcuccaaugcugcuuucccaggagggugaagauggugcugugcugaggaaaggggaugcagagcccugcccagcaccaccaccuccuaugcuccuggaucccuaggcucuguuccaugagccuguugcagguuuugguacuuuagaaauguaacuuuuugcucuuauaauuuuauuuuauuaaauuaaauuacugcaguggacuugguccuguguuuugguugacugaaagggcauuauuauaugguaguuuuuccaaacugccuuuagcuucagugugugaacucuuaagacucacugguauucuguuauuuucacuacaaaaccagcucaacuugcugugcucaugaaaacagcaagagcuggagggaugaagaagcuagggaaggauaacauccacuucacaagggaaagcagaacuguauaaaaacggcauauucuuuauuuugcauacuuuaauuucagaacaaaaugaagaaaauaaaauaaaccacaauacacaacauccaauccugcugucaagaguagagagggaauggggcuugacacccuuaguuuacugccuucaacacaaggacaggagagggaaaaaaacacuagacaccagcagggggagccaggugggacaggggcacucgaggcugcagugggagcccauggggacacuauacaagggcacaaguuuuccaacuaugaacuccuaaccuaaucgacuucuuccaugcgagacgcauccucaucgcccucgagaggggggaucucaucaggaacugcagcauuggguuccucugcugccacuucaucuucaucaauaccugaaguaaaauuaagccaugugagacuugaccaaauagcauuaagucaaauccauagaggagacgaguugcacaaacuccuugccacaccaaguaccaaagcuacuuaccuagaccuagcuugaucaugcgauagaugcgguuggagugggucuggggauccucaagggaaaagccagaagauagcagggcgguuucaaacagcagcaccaccagguccuuaacugccuuaucauucuugucggccucagccuucugccgcagcgucuccacaaugggguggucaggguugaucuccaggugcuuuuuggccaucauauagcccaugguggaguugucccgaagugccugggcuuucaugauccgcuccauauuggcuguccagccguaggugcuggucacaaugcagcaaggugaagacacaagucuauuggagauugucaccuguggacgaucacaaaagccuuagauugacauuaccacuuugaaagagaaaacaggcauugucaagccuaauuccagcagggggaggagguggacagaccacuugaguuugagaccaugcuggccaacauggcaaaacccugucuacaaaaaauuaaccgggugugguagcacacaucuguaaucccagccacucaggagacuugaguuugcagugagcgagauccaguccaaaaaaaaaaaaaaucggccaggcaugguggcuugcgccuguuaaucccagcacuuugggaggccgaggugggcgaaucacaaggucaggagauggagaccauccuggcuaacgcgaugaaaccccaucucuacuaaaaauacaaaaaauuagccggggugugguggcgggcgccuguaguggcagcuacucaggaggcuaaggcaggagaauggcgugaacccaggaggcggagcuugcaaugagcagagaucgugccacugcacuccagccugggugacagagcgagaccccaucucaaaaaaagaaaaaaaaaagaaaaugaugguauuuuaucuacucucagaaguuaacugaagcaaugccuaaucugugccaaauuuuauuaaaauagccuuaaaccugacuagagaagagaacaagaggcaagaaggcaugaaacaguaaauaggcugccucaaaccacuaauuguauagaaacaugcuugugagggagcccaccucgaagauguuacaaaauauauccuagccccagaauggcuuaccuucucaaccuucuuaucuaagauuucuuucaugagcuugcagagguucucaaacuuugccuugcucucuuccaucuucuucuucuccuccucauccucaggcagcuccagacccuccuugguaacugagaccaggcucuucccaucaaauuccuugagcugcugcacacaguacucgucaaugggcucggucauauauaccaccucgaagccccguuuccgcacucgcuccacaaaagcugaguuggccaccugcucuuugcucucaccuguaggguaauuaaaugaacucagugacuaaaaugccucauacugccaguucccaggaagcccuaauugugcuccccacuccuccaaaaaggcuucaaucagagucaacgcaccagugauguaauagauggacuucugugucuccuucaugcgagaaacauacucugacagagaugucaucucaucuccagacugggagguaugauagcgcagcagcucagacaggcggcggcgguuaguggagucuucguggauuccaagcuugaagggugggaagaggaaaaacaauccagcuuaacuacaauaacuucacuuucaaugugaauggaauaauuuauuguuauuacuaagaaagugguaaagggaauaagcauuauuugccuuuuuaccuugagauuuuuagagaaugccucauagaauuucuuguaauucuccuugucuucugccagcucagagaagagcucaaggcacuucuuaacaauguuuuugcgaaugacuuucaagauuuugcucugcuggagcauuucucgggagauguucaggggcagauccucagagucaaccacaccacggauaaaaucugccaucaaccagggugagaaagcucaguaaaaaacagcuagaccagaccugguccccagauucaaacagaaggcucuaauagccuccugaacccuuacaccuacuauguauugcagaaaacuguuaccuuagaauauccuagcagaaugccuaaaaccucccaagacuucacccaacuaaauuaggccaaggagauacucacugagauacucugguaucaacucaucacagcuguccaugaugaacacacggcggacauagaguuugauguuguucuuuuucuucuuguucucaaaaaggucaaagggagcccgacgaggaauaaauagcaaugcccugaauuccaacugaccuucuacagaaaagugcugaaagaaaccaaaaauaagugguacauuucaaaagaggaccuuuuagccccaacaccaaauuaucuaaaaguggaacaaugauccucccuaagccuaagggauagagcacacacaacaagcagcuccugagaaaacugagccuuaaugcccuccacgaucuagauggguacuagcuguauguagaaaacaguccccucugaucagaacccuggauguguaaggcugccaauagacauuacccagauuuccauaagaagagaaagugaggucauuagaaaugauggcacuucacuaugacaggguaaucaguaagugaaaucacauggcuaucacauuucuguuaucaguuggacaaguuccgugugucuauuacccaacacucuuccaccuaacucauuccucuccauaugugcauguugagccaacaugcaaaggcuucucacaccuugacugccaaguggucuucccagucauuagugaggcucuuguagaauucuccauacuccucuugggugaugucaucaggguuucugguccaaauaggcuuggucuuguuuaguucuuccugaucaauguauuucucuuugaucuucuuaguuuucuucuucuuauccuuaccgcugucauccuccucaucugaacccacaucuucgaucuuggguuuuucuucaucaucuuuaucuuccucuucuuucucaccuuucucuuccucugccucaucaucacuaauuuccuucucucguuccuucuccaacuaaguaacaaaaacagaaguuagccuuggaguacaaaacacuaccagggaaagcaaaagccagggacaaugagauucuccagaacaggaaacauccugcacguuaaguguaaaagauuuaaaaguccauacucacauaaagggugaugggauagccuaugaacugagaaugcuucuucacuacuucuuugacccgccucucuucuagguacucugucugaucuucuuuaagauggaggaucacuuugguaccccugccaaugggcucaccuagaagagucaauuacaagcguguaacaggguaaaaaguauaugcaguugagaccagcaauuaguaaguaucagcagaacugcugugaagaacugcuuuacagacaggaugcccaaaauuucugcuacuggugugagcccagaaaauccuaacccaacuaccuuguaacagaaaagcuaacuuaccauggucagcacgcacagugaaggaaccuccagcagaagacucccaagcauacuguucaucaucguugugcuuugugaucacaaccacuuucucugccaccaaguaggcagaauaaaagccaacaccaaacugcccaaucauggagaugucugcaccagccugccaacaaguuuaaagucaaucacaaguuuuaaagaagcaaaaaaccaaagaacacagauaaguaugaaugccuacagaacugcaauaccugaagagccuccaugaaugcuuuaguaccagacuuggcaaugguucccaaauuauuuaugagaucagcuuuggucaugccaaugccugugucuaccaaagucaggguacguuccugaggguuggggaugaugucaauuuucagcucuuuaccacuguccaacuucgaagggucugucaggcucucauagcgaaucuuguccaaggccuggaaauacaaacagcaacuuacuuuugcucuuuccaagacagacucuugcucuguugcccaagcuacagugcaguggcaaggaugacagcucacugcagccuugaccucccagguucgagccauccucccaaccccagcuucccaaguagcugggacuacaggcacaugccaccgugcccaacuaauauuuaauuuuuugcagagacaaggucucgcgguugcccaggcugcccucgaaauccuaggcucaagugauccuccugccuuggcauuacaggugugagccaacacgcucagccacuuuugcuuucuuaaagcccguaucuucaaagaaaaucuugguuuaccucucucagccucaaaucugauugcccccuaucuugaggcuuuagaaccaguuaguuccaugagcccacuuauucuggacauagucccuuccaaguucaagauggccagaguaaaacccaucuuuuuggaauagcugcaaguuuacccccuucaauaguaguccccaacaaaggccaaaccacuccuuuccccuccuucuagaguaucaaaaaaaaaaaccaugccaaauguggaaaccagagcaccuacaucagaagcauuagagaucaacucccgaaggaaaaucuccuuguuggaauagaagguauugaugaugagggacaugaguugggcaauuucugccugaaaggcaaaagucuccaccuccuccucuccauggugcacuuccucaggcaucuaaaauaaaaaucucauuaauuacaaaagaacacuaaggccccauguuuaaaaauccuaaaggucauaucauuuguuaggaccuuagacagugaguucagacugguuuaaccggaguacuaucccuucccaagacuaaaaaugcauucucuuaaagaucucagacuacacacuaagugggaggccugaaaauucagaaggaaaaagaaaauaagcuaaauauucuucaaccaaaugucacagaacccaccuacuuaaagaauggugaccagcagccucagcaucaucugguaguauggcagaaaaaucauaauguugguccaacccagguaucuagagaucccaaguaauccuuacacaaauuuaaaugugaaaaucacuaccuacaguucuuuauuugggggagaucaaagugacuaguuuaagauaaaaauggcacuaacuuuaaacugcucccccugaggugucaguuccuaagaccaguccaagggcgggacacuccugccccauagggcagggaggaauaaccugggauccauacgauacccaccggaggagcaauuaaauccggacaaagaauucuuaagccaaaagcuccaccacgacccuuucacagcacaaaauuacagaacaggaccaaacccaagaaagaugguggccguagccaccaggccgacacucgucacugccggacaugcgucggccaggaccacgcgaggagggggcgccgcagugcacccucccucgccccagcauccgggcacuggggcggggcgccagaauccagaagcuuccagaacaaucucagcucucgaggaagggcggaggaaggagcccaugaaucuuccagaaccugcuccccuccccgccccuccuccaccgggacugcaagaaagaucuggaaggagggaguaucgggugcuggagaccgaaagcucucuucccacaccgucaacccucccucacagaaacaaagcacccaagaaggcuuuaacaacgcguccgauaagagaggugacaaagccagucccacaaggccgugcugagucacccgagcgggcacccccgccacccugcggucccccuccgacgccccguagccgcguccggaaguggaggggcaaaaauggcagcgucccgggccgcgcggccaccacgugcagcugccagccgcccacugccccaaccccacagcccaccucgcuacggccagcaggcgccgagagaaagccccaccccccaaacacacuagagaaaaccgaggaggacucaaaaaaccucacccaccacuacccucacccuauaaaaauccagagcguuauccacaagccaccccgacaucuagacuaaggcucccuaaaggacagaaaaaaacaaaaacaacacgaauacagcacuaaagggaaagaagccuagcggagaucucagccuuaccuugaaaagaaaaggauuauacguaauagugagcaacguaggcuugcuuuccgauacccagacagucccaacacugcgccggagugacucgagagagcuacugcgugccccaagucgcccuauauaag

SEQ ID NO: 18355 - RNA, 14599 nt, Homo sapiens
gccauggagaaaaaaacaagaaagguuuauuuaaaucagagagccucugaaggcaccugguuucugucaaauauauuuuuaaaaaaggcaguaacguggcaacuguacagggugcaugauggguaagaacugggcauggggaguugggagggggacauggagagaacacagaggaggaggcgcaggggagaauggaguauaucaggucaaaccauacaacggucagacccagcuccuagccaccccaggacaggcagacagucugacagacacggacgcagacacacagacacauacacagagacacacguguucuccaagcccaagagccuccacuggccugcacaagcagggaucagucagagccaagaguggagaaacucaagcaaaugccgaggcuacaccccgucccucgacucugagccccaaacccacaauguccccacuguccguccagaggcucccuccccagggccuggagauccgggcccagcacacgccguggaaagcagaagucaguuagaagaaaaaaccgccagaccacucaggaucaccccuggcagaaggaaggggcaggaggcagacagggagggaggcaggcaguccuucuguccauccuuugucacacaauugcccggaacaggaaggagaaaacagcccccagugccagacccagacacaggaagaaggccaugauggcuccugcggucucugccucagcuggcuucacuuuccuaagcggggaaggaagggcaaggcuaccucagaauggcuguaccccagcccagagccucuggguggaaggaggggugggguggagcaacuugacugucgaaccucauucuguugaucaacccauccuggcugccuaaccccaaccuggcuucuccuccuugagggaacguguauggugggguugucuuucacuccuuccugcaaaccugucuccaccuccacccaaguaagcuuggcgccccccuccacuacagucacuauccccucagccugggagccccuccugagccaucucuccucucagcucugggagcagggacucuccuuuugcccucccucuacugagugucccccacuggaacucuagauccugucugaugccaccaaguucccugccagcccuacucacuugggcccgaagcacaugcagaggcuggcgagguagccguuggagaaggcaaaggcagccaugaagaagaugaaccaggcaucgugcucgaagaccacagucagguagcggcggggcuuaauguugcacagcagcagcaguggcacaaacaccagccgggccagcaccaggcuuggcagccagcggcuguccuucccaggcugugggcaccaggcagggccucagcccaggccgccaccccagggcacagccaggcccccaaggauccaucuggggccccucaggaucugaacugaaaccucaaagccugguucuccuuaggggguuacucuugaaaggggcaugguggagccuucuggagugcuggaaauauucuacaucucgaucugggcagguauguguauauacauauauucauuaaguuguacacuuaagacuuguacuuaacuauacauaaauuaugccucgacuuuaaaacaaaugguccccuuacuaccauacuuucuuggguucccucucuggguccaggcuggacucuuacuucccacaggggccuggggcccucuuccuccacuuacccacaugaauacagcugugaggcuccggcccaaccagucaaagauauugaaagucaagaaacaggacacaggaaugaaguaacguucuggaagaggagaugaacgggugguuaucaggcucacagaggcagguauagcaagccuaaccuucacugggccucagcuuccccaacaguaaaauggagaagaugcuuccagcccagggaagggcaaauggacccaggaaacggggagaaggugacccaggcucccucccuuccccacuuccagcccaacucaagauccugucuguucccauccuggaaaccuguggcauccucaccccaggugcugcugccugcgaugcuggacuugaccucaacagucacggcuggaaacaucccaauggugauagugaagaugaagcagacagagaaagccaggacugagaucuagauagaagggguagagucacccaaaugccugugucuucaugguggcugugcauuaaagaaccacgaauccaggccaggcgugguggcucacgccuguaaucucagcacuuugggaggccgagguggguggaucaccugaggucaggaguuugagaccagcuugaccuggugaaaccccaucucuacuaaauacaaaaaauuagccgggcaugguggcauaugccuguaaucucagcuacuugggaggcugaggcaggagaaucacuugaacccaggagauggagguugcagcgaguggagauugcaccauugcacuccagccugggcaacaagugugaaacucugucucaaaaaaaaggaaccacgaauccccacccccggcacgcacgcaugggcacgcacgcacacacaaaagaauccaggagugaccacucucaggucagaaagggaggagauggguggcagggggagggagcaaaaggaggagagaaagaggacaagggguagaagauaggauaaccuccccuacguacauuuuucaggauggcuuugauagaguggcuuucauuggugggcugagaguuggagacugaaacuccagauuccucuuugccugcucuuggcuccucuccugcgggauggaagaaaucuccaaguuguggggaagacagagcaacagaagacaacauaaacauuccccaaaacggcugggauuacuugaaaguagacgccuccuuaaccagucccagccguacucuaacccuaacccagaccucgccuccaaaucccuacaacucaagacccgggggccuggccucucccaggagccucaggucauguuacuccucacucaagaaucugaaauugcuucccacugccuuuaguccaaacaccucaggcauucaaggucauccaggaucugcccccauuuuaucauugccggcccuuauuuccuauugucccccucucccugcuguaguccuucaguccuccucuggcucagggcugcuagcuaacacagggcacucaucuuuguucucuuugcucaugcuaucccccgccugguauaccauccuccaccccagcuuccucaggcucuucggaccuuugcuaaugagguccaacuuggucuccugcuccccggguccuucaagcuugagcugcugguaguagcgguagaauuccuaucaaguaagggagacgggggagguggauuuagaggcagaaucuccagaaucccggccuccuucagguuuuguccucagaacacccguggucuggaaccccagaccccuauaccccaaaccccagcucccuccauuuacucaccaggcggggcaggcccagguaacagaugauggucaaaaugauaacagcacaggcugugauaaaguagccgaaggcacuuucugauagcuccgagccaccugggguggugucagugaucagagacaggccccauccccucuccccaccacaccagggcacugggcagguagauagccggacuuacuggcaauagcgcagaucauggccacggaggcaaagaagccugcuaggcccuggccacucaugaugggggccguguagcuggcaggcagaaggccagccagaccaaacaggcugcccugcaggauggcaccaaaugcuggggaaacagggcgggcaugagcaggggagcuagggcuggugguugggggugcccaagaagacagaucccugucauuccuacuuuacucuuggugagccuugaggcugagcugcccuucucucugcccccucccagcccugguccaggcccacucaggccucugaaucccagcugcucacagcauccacucccuccaggcggaggcugggcuucucucuggcuaacgcugggucugaaaaaagaguggggguaguugggcaugccuccucccauaggcccccuccuggcccagcuuacaauuaaugagcacgaucuugaucauggugaugacaaagaagggcagagcauccagcugcaccuucaccaggauggcagugaucagaaacaccagcaggauggccaccaggcugcccaggauccguacggacugggggauccugccgggagaggccaaggguggcagagacaagugggcaaagcuggggcucagccaagggggugcaggacacagugagggucaggcugggggcuggggagggggugggcacucaccucugaugcaggaaggaguugagguaggugaauaacagcaggggcagcauggcacauagggucaugacauuguugaagauggcacugagagaguuccgcucaggcaagggugcugcaggggcggcugacgccugggcguccuugcucaguucagcagugaccaaggacacauucugggacauguccaggcgguuugugaaauacugcagggguugcagagaggaguguugaaaucucuuucccugugccuaccagcacagagucagauccugcaagcacagugggcacugccccauggagcccagucccuccagccucaccugaguggccgucaugaaaaaauuccacgggagcagcguucccagacccagcaugaagaagauaagccagacagcuuuguaucugcaauggaggaggaaagaugggccaaaugacgcaccauccugccccacuccacaaugagccccaggaaagccccuguccguugucagucucucuaggucccagggcacagggcgucuguguuuguguccguuugcauguguccucuuauggguguggggggagaaaaggguacauugcucguuggaauuugggguggggauggggucagggucauaggacugaauggcauggcugacaggaccaugguuaucagcccuggaaggcucgggggacucugcaggcugggaaccagugugacccacacauccggagaugguuuuggaaauccugccgaagggcaggggguggguggaugagugagaaagcaagcagcaagugucuuccacucccaccaggcaggcuggaaguaauuaugcugucuggucagggacuguguuacuccccagagaggauucugaaguuaagaaacucccauacuauucuggaccuacagggcaggugggcagggugccucagggccgcugugaagagagggccuuagagccauuuucuuccuggccaaauagaacuuuguaguucauaccacccagggcaggccaggagguauggggccacuggaggccaucugggccucaggguguaaauaaggacuguccaccuuuggccagggcaaugccccaagcccuauaccucaaggcccuuccgggucacgccagcuucucccagauaggccuugccugaaagcugaguaaccccagcccggcccauguagaucuccaguuggguuugcacacccuccccagagccaacaccagcucucuucagagauggcagggauaaagcccaaggcagugagaagacaggccuggccagagugcaggagccuggaccgcuggcaggccucauacagggauggcguggugagcacaccacgugagcagguccgaguuaaugcaacugcagcccccccaacccccucacauacaugcuucccuuggagaagcuaaaggcuugguucggaggcccagagcagaaggaaaaacucccaaagucacauaggacagaggaucgggguuggggggaguacgcugggaaaugacugagcugugcaauaaggcaaauggagccggcgaggccuucagggaacugcccacaggagagcggagguggggacagaaugggcaggcagccugggaauggagcacaggaggcagggaagcaaccuggggccuggacuuauugccaugccuccuuaaauucccuuacuucuagauccacuuccugggaaguagauacuuuuagcuuauuuuacagguggaaaaacagucccagagagauuaagcuacaugcucaaagcccccacaggcaaaaguggccuaguuucauagccuuuggcacaggagggagaugggguggguagggcagacgugauggguuucuggggccugaguuggagggcaggacagagccugacgcuuugaaggagcuuuggaucucagggaucacuuccucagccuucuugggucccagaucccuuugagaaauugaauuaagcuacagccucuucuuccaaaauacauauucacagucauaacugcaagucuaacuugacugggaguucacaggcuccagaggcagggaauugagaggaagaucagaucaagaaccagggugggccaggucaucuaaggcagaggccccagggcaguucugccagaugugcauuggaaggaggggugcagccaaguaucuccccacagugguggcgggaggagccgaaagccgcuaacuggcuggagagcaacaguggaaacacagacaggccagggaaggacugcugcccacgcacccugcccuucccgcagacaccccagccagcacccagccaaggcacacgggguccccaccccugaugcagaccugacucauagcuaccuggcuggaaggccagccagcaauggcaacccccaauuccaaaggacaccacacccagcucccugaaaacccauucccuggauccacagcccagccccuuaccccuuaccuguccugaggcuggugacugguugucauggugaugguguucucgguuuucccuggcugacagcucccucccucaggggccugcugggggcaggaacagugugaggcccugucuuggcccugccauaggccuccucaggcucuuagggggagagggggcagggcugacagaacaggccaguggaggaguccaguaagacccccucugcacccugccccucaggacgacucaacuugacccccacccagcccccuggcccagcaggccaguccugcgcggccccccugccugcucagacucuaccuggcucccggccuggccgcugccaccgcuauuuuuauccagcagccgaagcaguuuauaagcugggaaacaggaggguggagagcaggagggaaggaggaggaaagaugaugggagggagggaaagacagucaaagaaggcaggcaagaggacgagaggggucagggacagugaugacaagggaaggagggagacaaauggaggagacacagcaaagaggucgggggaggaggaggaaggacacggaacaggcagaucugcagcagcugcgacaacaucgaugaugacugaggucaaaccagaggcuccccaggccccucucugcaagucuggucucuccacccucccuggggagccccuggauucauggcuagaguggggcuguccucuccugaaggcaacccagauuccagucucucugcuguuggcaccuuaaccuuucuuuccagccacugcccaggggcuuccuaguugcuggccgguuuuccaagaaaauauuucauaauggaugugggggcacagcccuucccccuccccccucccgaccccagggucaccuaguccucccuuaguuccucucugucacaggcuccuguccgcuuccccuuucuaagagugaccuugaaaagaagauuggagggguggaucccaaagcaccuauccuucugccucagcgucccucuccugcuccccauuuguguagggggagacccccuggcaccagcagauuaaacagcuuucccauuggguggcaugggaagccaggcagaugugcacugacacauuccccacacucaggccuagcugggcccaggccuugcuguuuggggugaaaggacagcuucccuucccucccuuucugggcacucaccaggugcccagacuggccagcagaagggucagagcagagcaagccugggcagucccuaggaggugcuccuaguucaggcucaggcagugggccuuguccacgggcuccugggugcggauccagaaugaaaaagguggcacaggguguuaucaggagagagucccucaggcuucauggggccccauucugagaagccuugcaagcaaagaagcagaagcacacccaggagauaaaaagccaccccugucgcucgggagauaagagaacagggagucucagcaggggagcucucgcaggugcagcauugcuucuggccccacucagacaaacagaagcagcugggcaccaugagaccuuccacgggcucucccaccucccuguaguuccucucaacccuccccagggaaacuccaagcucucagagguccuccucagccccucagccccacaccuccagauagaggcagaaggauuccuccauucaggccuucgacaaauauuuacugaggaccugugcaugcuagccaggcacuguccuaggcacgaggggugaauaaucauauuuacauuuucuagagagaugaaggcaagagggcauuacuggagugggggugggggaaagccucaggucucagauuuuuucuuuuuuuuuuuuuuuuugagacggaguuuuugcuccuguugcccaggcuggagugcaauggcaugaucucggcucacugcaaauucugccucccagguucaagugauucuccugccucagccucccaagaagcugggaauacaggcuccugccaccacccccggcugauuucuguauuuuuaguagagacaggguuucaccauguugaccaggcugguuucgaacucccgaccucaggugacccacccaccuuggcuucccaaagugcugggauuacaggcaugagccacugagcccugccuaggucucagguuuucuauuagguaguagggacucuuccucuagguucuuacuucauacccgcauaccccguacuccaccccacaggcaagauuccuggcaguuaagagcagguguagcuucaaagcagaugggggccuaggguggggagaauagcuccuguucuccuggguaaaacuggcuuaggcuuagagaagaaguauuuauuucuucccuggcccccugcuacaccccugcucucucuguucucaggaguucccauaccagucuugggcacaauucaacuccagcccucuccuccugcccauauccuaacauucagcuggccagccuucguguuuugcuuuugucugccuuugcccagcggcaaacagggaucugauaccagcucagagcaucuggugucccuccaacuaugccuuggccugcugaggugggccccugaaaguagccaccaaauugaguaccucccugccuccagacucccaacaccucuccugcaauucuccacucccaggauuucauauggggcuagccacuaccugcagaucucuugucuuuucuucacaaccacccauaagcuaguacuagcacugaauagauggggccagcugagguucagagggguugagucacuugccugaagucacagagcuggugaguggaggagcuagaauccauauuaaauguucaagcuccuuuuggaauggagagagguauaaaagcugcuucucaguuagcccuguagacugggagguggggggaacucugauucaacuaaagggaaaaaugagguggagaccaagaucauucccagccugacuugagugucaggcagcucagccccgccccaucacacacauccuggcauggggagcuuacacaagcaggaggaaaguuggagggucuggaggccaccgagaggaguaggcaaagggacuaccacagggcugcagagagaccccuagaggugugagggcaggguuggagccagccuugaccuacgacugcucucuccugguaagcaaagccgaggacuguuugucuucacccucucauauacccucacaguaaaucaguaaaugaagacgugcgcaggaaggagacgccagggauacgaguuuagccaguaaaagaccgggguuaaagagacagccccgcaccuccgcucgcgagccugcaccuccgcucgcgagccuccauccccauccccauccccauaccccuccgccagcgcagucagcggcacggccccucccugauaccgaccagaucgauggggaucacccguccacucgccugccccuugcggaggucaacgugaccgcagccuguuuuaggcccgggagccaggccgccccgcccagcuugggucccgguccccgcaggguccucaggcucccuggcccgugcgcgccacgugcugcgcggcuccgcacgcuccgcacuggggccccacccggcgucccuucuccgggcugcggagccgucaggcccgcccucccugcccuccguggcaggcgggcagcggcgucuuccgccccggcaguccccaguccccaguccccggccccgggcagcaccugccgcagaagcacugcucccgcgcugagauccgcgcgcucucgcugcagcuucccucucccgccggggcacauucaaacccgcccuccgcugagcucgccccgcccugcgcccacugccaccuccccgacgcccgcggccccgcccccggcccaccccugccaccccgcggcgacuccgcgcgcuccgccgcucccaccccgagccccugcgcccccagggccgccuggucguguuauugcgguagauaggaccucuuugggcccugccacaccaaggcugucuguccaucgugugggguacauggggcuggaggguacagccacacauuaaggaccugcgcagacucccauaaaauucaucucgggacuguuccauuuacacacccgcugcucagaccggccccgacgcuccacggcccacuccaccucagauauuccguuaucccuucccaagcccugcccacgccgcgcuuccuccacacugcaccuuuuuccucccagcgcccucccuuucagcgcccccuucuuucuuucagucccccuccucuucuuuuccuucaaaacugcuucuguccccaccgcgcauuuucugugaccagcaugauggguuuucccaucccugacacauccagucccagccacagacgcgcaaacaccaccccacucacaacuuugacuuggaggggguaugugccucugccugugcuugcgugugcgcgcggagggggguggggcaaagcccuccagcucccucauaauucacccuuucuaaauccagcacuuuggaaaacugaggcacaggugggaaugggaagagaaaaagcuaggaacagccuuauauccucagugaauccuauugucccagccauccugacaggcggaagccuugcugaguaugucuuucacuagcuaaggaggaaggugugggcgugcugaggggugguccagcaagucccuccaagggagggggagggaggcccucucuuuggucgggcaauaaauggggugggguggggggcacucccugcccuuccagcaguacucagugcuagaggaugauccuaaggcuggaaagguccugaggagaaaauccaacccacgcugcccaccccaugcccacugacccgaagggcuuguccccuagagaagccacagacacugauuaacaacuggcaguaccucacaucauagggauaagguaguccuacccuguccccagagaaacagacagggcccuaaggagagagguggcuuuucuaauuagggucaguggcucuccccaagcuacuccagaauggguguccccagccuucuguuuccaugccccacagagaugacacacauauuccuucccaacccucccccaccccacccccaucccccacauccccgccagcccuaaccagagggcaggaagauggguuuaggugguauuuuuccaggcacagccccaugacuugagaguggcuucaugucuguccacaacccccuaauuccugcccucauguuuguccagucucucucucuuccucuccuagcccuccucugcccucugccuuggcccccuuccucgcuccccacccuccuuuccuggucucugggucuguggggguggcagggcuaguggucagaagaucugccaggcauggcaaggcugguggccaguggcugcaguuguguacagagggggcuggagguggaagaaaacuggagggaaguggugagggucucaggccagacugggaaaggcugguuccucuccccacccaaacuggggcccugccagcucgguggauggcaacagccagggcuguuauuguuggagagaaguccgucuggcauccauccugcugggccccuagccaacacccacaccccucuguagccaccucccaagcagagguugcugggugccagggcccccugcuggacagccugggagccccaacuuacacaggccuugccuggaguuuuucuagccaggccuugccagcucucuucagucucugccuggucuucuggcuucucucccucccugagcucccucaggucccugucgaagggguggggugggaaggguugguccugcugcaccucuacucuacaccuuauucaccacccuauaugggaccguggcuuggcccagacucccuccccaacuuggcaggccccaugcaugccucaccaccucacacacaguccucucucuccccaggcauguguccucucagcugucaccaacaagucauguguguuugcuggaaguguguuugcuuggccuggggguugguaaccagcacaugucucaugacugucuguguucucaguuguguuugugacuguaucuccauggccuugugacagggcugggacuagggagaggccagugaggcacuugccagggguguaaaauguaagggggagccaaaaaacucaugaaucaagauaaauuuuaggccaggagugguggcucaugccugaaaucucagcacuuuuggaggccgaggugggaggaucacuugagcccaggaauucaagacuagccugggcaacacagugagaccccaucucuacaaaaaaaauuaaaauaaauuagccaggcaugguggcucgagccugugguuccagguacuccagaggcugaggccggagguucacuagagcccgggaggacaaggcuucagugagccaucauccugccauugcacuccagccugggcaacagagcaagaccuugucugaaaacacaaacaaacaaacaaagauacauuuuaauguaaucaaaauaaguuuguuuuuuuuuuucuuuucuuuaagauggagucucacucugucacccaggcuggagugcaguggcgugaucuuggcucacugcaaccuccaccuccuggguucaagcgagucuccugccuuagccuccugaguagcugggauuacgggcacgugccaccacgcccagcuaauuuuuguauuuuuuuuuuuuuuuuuaguagagacgggguuucaccacguuggucaggcuggucucgaacuccugaccuugugauccgcccgccuuggccucccaaagcacugggaugacaggcgugagccaccacacccagcccuuaccaaaauaaguuuuaaugcaaugucuacaaaucaagacuccaugaugccaagugcaguggcucacaucugucaucccagcacuuugggaggccaagguagaagaaucacuugagcuuaggaguucaagaccagccuggucaacacagggagacucugucucuuaaaaaaaaaaaaaaaaaaaaauuagcugagcauguugacgcaugccugugguccuggcauuuugggaggcugaggugggaggauggcuugaguccaugaggucgaggcugcaguaggcugugaucgcaccacugcccuccagccugaacaacagagcgagacucgguuuuuguuuuuuuuuaaagacuccaugaugaauaaaacaucaagauuuuuuaaguaaagacagguguguucacaguguggguacuggcucgggguucgagaagacuaaauucuuuguucaguuaggucugggcuggucuucuaggcuaauuuuccagaccucuucccccuacccuauguuccugggacaucuguaaguggcuggggaguuuggggaggcagucaucuaauaauggccuucgaaggcccagaaaaguggccccgcauccagaaaccaaagauucugacuccccugagacacuguagcccagcgggucccccuacuggcccccugucccgcccggcagcgugagaacggcgcagaccucgcccccaccccaccccgccccgccaggccccccggccccgccccgcgcaccugcugagacuuuggagugagcauccggacuuggugggggacggaaauucccaggccugcgggccccuaguucucucccuccucaucucggggcuggggccauagccacagcuggagagcgcagcccgcgccgggccugaccggugugggccgccgggcggaagagaggcugcaacaggcgaccccagcgcccgcccagagcuccgcagccagcugcguccaguccucgcg

SEQ ID NO: 18356 - RNA, 1317 nt, Homo sapiens
auauuuauugagcacuugcugagugcugggcuuugcaggcaggucugccuccauaagcaacucagauauuauuuuaagguagguccugagucuggaagacagucuggauucaaaucuugccucucugcuaaauugucacuugucccucaguuaagcacugggaaccuugauguucccauuugcagggagggcagggguggguggguguuaguuccccucccgccugaggccagaggugauuaggaguggucuuugggaggaacugcuggaggacagaggggcaauaaucaguuuugugcuagaugcaaggcauucuuccagaaagacauuucuguugggaguggagaggcaugucuguggcagaucccucucaugcacaacccucacuauaucuucuguccacugggcaggcuucggucagugcuggugccaggauuauccuacuccaaaagaaagcauuuuguggauacagcugcugccaggacuuguggccucacuuuugggggccuaaccucucccuccucuccaggcgguccacucuugaggccuccccagcgucuggcgagugucgcuggcugagaaugaacagcagacagcccagcaaagccucucgcauguccugggagcccaggcggcgggccaaucggcgcagcaggggcaggagguauuggcgggccaggcgggcagcaggcagcagcaggcaggacagcagcaaucgaagcagcagcgggagcaguggcgugggcauggcagggccagugagucagugccugggaagacaacacagacuuuaggcuugcauguccugguucugccucaccuggcaaggacauggggugggcaggaguucccccucccuucaguuuacaccuuccugcuccugaccucaauuuguaggucauuuuugcuuucaugaagcccuuucucuuggcaaggcagcugaggcaggaagguucucaccauagcacagauggggagacugaaccaaggcaagaguaaaccaagaccuacagcuugccguucccagcuccaggcauuccuacugcucccuggccccucccuuccucuagucacccccuccucuugcacagccucaaugccccuggaguucccuaacccuucucccucagucuagcaggaguucuucuccaggcaauucucaauuuuucuuuuggggcuccugauccacccugaccugacacucccugaccucucaguccccuacccccaccaauccacggcagcucucaccgggcagaacugcugcucagaaucagucucuggcuggauuugccuggaguggagauagccccacug

SEQ ID NO: 18357 - RNA, 1317 nt, Homo sapiens
caguggggcuaucuccacuccaggcaaauccagccagagacugauucugagcagcaguucugcccggugagagcugccguggauugguggggguaggggacugagaggucagggagugucaggucaggguggaucaggagccccaaaagaaaaauugagaauugccuggagaagaacuccugcuagacugagggagaaggguuagggaacuccaggggcauugaggcugugcaagaggagggggugacuagaggaagggaggggccagggagcaguaggaaugccuggagcugggaacggcaagcuguaggucuugguuuacucuugccuugguucagucuccccaucugugcuauggugagaaccuuccugccucagcugccuugccaagagaaagggcuucaugaaagcaaaaaugaccuacaaauugaggucaggagcaggaagguguaaacugaagggagggggaacuccugcccaccccauguccuugccaggugaggcagaaccaggacaugcaagccuaaagucuguguugucuucccaggcacugacucacuggcccugccaugcccacgccacugcucccgcugcugcuucgauugcugcuguccugccugcugcugccugcugcccgccuggcccgccaauaccuccugccccugcugcgccgauuggcccgccgccugggcucccaggacaugcgagaggcuuugcugggcugucugcuguucauucucagccagcgacacucgccagacgcuggggaggccucaagaguggaccgccuggagaggagggagagguuaggcccccaaaagugaggccacaaguccuggcagcagcuguauccacaaaaugcuuucuuuuggaguaggauaauccuggcaccagcacugaccgaagccugcccaguggacagaagauauagugaggguugugcaugagagggaucugccacagacaugccucuccacucccaacagaaaugucuuucuggaagaaugccuugcaucuagcacaaaacugauuauugccccucuguccuccagcaguuccucccaaagaccacuccuaaucaccucuggccucaggcgggaggggaacuaacacccacccaccccugcccucccugcaaaugggaacaucaagguucccagugcuuaacugagggacaagugacaauuuagcagagaggcaagauuugaauccagacugucuuccagacucaggaccuaccuuaaaauaauaucugaguugcuuauggaggcagaccugccugcaaagcccagcacucagcaagugcucaauaaauau

SEQ ID NO: 18358 - RNA, 28708 nt, Homo sapiens
ccugccucagagcuuuucuuuguuuuuauuuuaaaggaaaaaaacaaaaaagaacaaaaaaaccaaaaaaaaaacagugcaaaaacccauuuuccagugucagccuugcccacccccacccccaggccaccccagcugugagccugacucuuccucccacucagcacccccuccccccucaugcauccccuaggggcuggaggcuccacuucccuggagggccagaucccaggaggaacugugggguggaaaaaacggaggggggggaacagccccagauccaccugccccccaggucuccagccaccggcaccaggugcaccagguacuccucuuggcucucauuaacccucuccuggucaugcuacuagcuggggaggggugggggguacugaucugggggaacucccucugcaccccucuuugccccggggccggcucggggcucuccucacugagguuggggggcucccucccuccaucaugggggagagcagugaaacccccaaguuuaaauaccuuaaugaaagcaggggcuggggaggaaggggcuuuagaucuaauaaauuauuagcguuuuaguguccgugggagugggggugggguggggcaggauguggccuccagggccccucccuccccuuacuggugaaucucauucucuaugaggcuguccucgcaagacuggaagucuguguccgugagggcgucggguggcaucagcaacuccucaucuugggaugaggaugaugggggcucauccccugagcucccaggagccccauccccauccccguccaccucugaguccugcagcaccugagcgauguauuucugaaggaggagaggaaaugggggcaaggugaacagcugccccucauggauugcgggaacaccagggcauguaggacagcagagugggcagggcccuggggggcgggggcagcccuccagggagaccagcucucuucccgcccccauggggucuggcacagguuccccuuucugcaggacuaagggaacacugggcuuugaggcugagucugucagaggccccucccaacccuugagggcacucaccgcagauuuggggacagcagcagcaguggggggccguccauugcuucugggguccacaguaucugucuccgugugcucaaucuugaggggcccagaaugagucaggaagugggggcauguccucagcccugaucaugaccccacgcccgcuuggcccuguuggcgcugcccucagcccucgccagcccuguggcccucugcauuccuccccuugagcuccugcccgcagccauccgccugccacccuugccccacaccuuguaguugugggcacugagguauuugaaguguccaaagcagacguggcagagacagaugacgauggugaugaccaggaccacaaaugugaacauagacgugggagcuaggaacccugguguuggggggcaaagaaugggguugcuaucuccugugggccuccccaccccagcuucugauacccucugaaugcaguccucacucucccaggugcuacagacuggccccagccucucccaggccccuugccugccacccccagccaugcggcuucuccuguggccugcucuggcuggaauccacucugcucgccaccccccguucccuggguagggaucccucacccgugcgcaugguggaaaagaagagcagccagaagaggcagaggaugggcgcggccaccaccugguucacagcccccgaguggaucuucuuguccagcuuggccggcagguaggcguaguagagauuguaccugucuaccaggugcuucagcagcauguacaugagcccuaagggaagccacaugggcccugaccucggaaccagugcugccgaaccuuuugugugucugucacagguuguucugguccugagagugcugaaggguuggcccccuccuccugcccgggccccaggacgggauagugccccgugccccagcgugaucacagaacuucagcuuccuccgcuacaaccccucauucuacucuccucaucaggaauucuacuauuggaaaucuagucauuugaaucaacaagcaucuucuuaaaacccguaucauuuuucucuaacccugucccuaaacagauacguauaaauuaagggacaaguucuauuuccccagaggcugagggauagggaguuucuaaugaggacaaggaaguuaguuugggaacuuggagccuucaauaaccagggaggguugguuaaggaguuaggauguuauuagggaggaaaguagaggcuaccagugggggugaugguuaaagagaaacuuugcuaaacuucaaaaaggaagagagaccuggccaagucacauagcucagauacagcagacuaucuccaugaguggcaaggacccaucccacccuggaauccaagucuuuccugaguuuacagggugguguaaaagugugcacauggaugccugugugggagugugugugugaacaugucagcacguaugugaucuguguccaagcacaucccgcugagggaaggcacagguguggguaaguauggccauguuggugugacuuugcccuggggcccacaugccagcugggucuggccugagcugauggcucucccccuccuccccacaggccaggccccagacugagccagggaccgggcgggagccccgaggggccggucucccagccgggcccuguccacucgggguggccugcauuccuagaguggagagggugaaguccuggguccccccgagcagggcccaggucccggcgcggcggugccuaccgaagggcacgaugauggggcaggugauacuguaggucaugaccaccgugaagacgcacaucauccaggcguaggcugcgccaaacuggaacucguaggccugaugcugggggggagacgggcaggaggauggcucagggaggcagggacugaccagaggggcagggaaggagggagggggaagggagccaggaccucuggggccggaaaagaagccauggggaacaggaccuaaugucuaggguaggguagggcagagcagauggagagaggggcuauggccgagaggagggucagggcgguugcagugauggggcacggagaggggccuucaagggucggggccuggcagguagggggcaagaguuggguggacuugagagugggaugcccagagcccucuuauuaagacagagggacccuagcgcuagggacccagaucuccccaacucccaucauagaaugcuacugucagaacuggcaggggccuucaggguuaccuauguccacccauggcagaauacgaaggccccagauaugggaaggggauggcccggauccaccgugagucaacuguacuccccaagucucagcccuccugugccccucaacccuagcgcgauggcugcuguuucuuguugggccaccagggggcgcugugcgggccgcugcugccccaggcggccguacccgcuucacguugcgccucucggcggccgagcgcgccaggcagagccggaucauguacaugagcaggccugggaugcgcagcagguccauggcguugccgauaaaggcugaggcaaugacguaguucacgaagaaggcgccguugucgggcaggaacacacaccugcgggcaccaggugcuccagcacugcacccuuggggugacccgguggccgcccgcccacugccagaacuacagcacccaacaccuccaccaccaacaugcuucuuccauguggacacccccagcuuagcgccccaagcaccugugcccuguuccccccagagacauacagaguggcaacagacagcuccaagaacuugugccccauaaagacccauggagagagugcucaagaccaccuaaggcugcuagaauguucaggggagaacuguccaggacccccaaagacaacccaaugagacccucaaagaacccaaaggcugacagccccaggaacacccagaagauucccccacuuagaccauaacucgaguuacccccagagugugacaugagccucagauaccuccacaaacaagcuuugagacccuucccgcaacaucucugggggagcccaggaaccuuuaucagugccugagaugccccaagugugacucaaagaucaccacagauggccuacagcaaaaccccuagaguuugugcccacagccauggugcaugaccuucaauauauccucacaugauucccagagaagaugcccauacagaacuccacaguuacaucucugaauaaaagccugaaauuuuagagauguucccagaacuuguacugcuaaacaucccaaagugugaguccuuuagccuccccgcccacagacacccccagaguuauaaggucaagagccuccuacacauacccaaaaauaugggcucuagagaccuucagggauaccccuaguagccuccaagacacucccuaaguaucaccaagaccucccuagagaugguuccccaaaccucccaaguggaacuccagagacgcccacaguuagucccagaauaugggcacaagacacccccauagaaacuaccagaauguggagccccaagccccaaauauaccuugaggaugaucuuagcauccaaacagguuaccagagagugaacaccaacacagaccccagggacuucuaccauguauacacacccaagacaccuugugggugccuuugggguaaccccgccagauccucucucuucugcccccuccaggaguuggaagcuuuguugcacccucccauggggcuggcaaugucucucaagcauacccaccccugcugucuggucucuuucccuaggggccccagucacucacucaaaccgaauagcugccucagccaagaauuucuuaucaaagagccagcggaagaagagguccaggcuggagggaagcagaggagagauggggugggagcuggagugguacagaacaccaggggaggggaagucccuccucugugagccacuggggagacucccagacaugggguggguagcucaggaggccuggggguggccaggcuucccaucuugggccccuugcuuuguaggggagguagggaggcugaacugcucuccucucccuauccugcugucccccuacccuggcuccugccccauccuucucaacucaccugcucagucccagcgaggguaggagcagcaccaugaagaugaggaaaguguagcacuugugcaugguuguccuguucuccccagagcuggagggaggggagcagggaacgguacaggucaagugagcccaggccccagacuugcucccccaacaaggacaauguccaaggaguguccccugggaagggugggccucccaaggugagggugcugggcacuaccccuucccuaccagcugugggacugcccagggccaggagccugaagggcaaagugcugcccagagaggaugggucauugagggcaggccacagcgagguguggugugaguggaggcaccuuaccguguccagugggcuucaaagaaggcugaguaguagacgauggugggaaggagggccgagaagcaccacagcagcaggguggggaagaacugggugaugaugggguucugcagcagggcacaggggggcgucaggcagggcagucuagggggcccagguggcuuugcuuaugugccuccuccccagcugggcccuuggccucacaacucucagggcucccauguuggaagcccagaacauccggagggcuggggugagggugggggccagggccauauguauaaccccaggguggauaauacugauagucagcauuugcugaacaucuacuauguucuaagcagugcugauguacuugccaugucuuaauccucacaauaaugcuguuaccccauuugacagaugaguaaacugaggcaaaaaaaagauucaauagcuucccuagcuagcaagccaugagguagggauuugaauccaugcagucugggucuuaucuauuaugguauuaucacuccaagugauuugcaaacuguccuucuucaaacucugagguucuaaagagguaugcucuaugcgugggaggagaggugaggggaggccaggcagacaugcaugccacccuacugucaucggagcagcccugcuuuuccacacuggguuucacaccgauaaagagaucagaauccaaguccaaagccacugaucuaguugaaccuuuccauuuuuucaguuagacugaggggugagggaaggggacuucucugagaucaggacuaaaugcaggcucucucucuucccuggguguuucuccagguguugcacaccugaggguggccucucucagggggaagguggcagggagcccaagggaagugcacacagggguuuuugggagcugguugguggcacgggguuggaacaagcagaacgggcugggcugggcaaguggaagagggaucagggccugguaucuguguguugugacccagcguggaaagugacaggggcaugaggccucacguugagguacuccacaggcuuggugacguugaacuuguccaugguggugaugaugauggcuggaguggugaggaagaagaggaggaugaagaggacgacauugaugaccaggcagcgcagccaccagaugaagccucggauggagaggugcucccuggcaagguggggaaccggucaguccaggaaccaagggcaggauuggcccccagugacaccaagacacucccucuccuccgccuaccuacugagcccaucccaggcccuggaaagccugcccugacaccuguuugcucaccaguagauguucugagggucaggggcauaggacacgguccaguuggagaugugcagggacucgcugcaggaugaggggcguggcuccccacggcaggugcagcccuggcauuuacacacguugaaguccuucaggaugcuagaaagaugggcacugguuaccacaggcccaccuggaggccacacugcuggcagaaggccaugagcacaggggucagggagcccuggagggcugcucagggccgagggccgaguuggggacucacauggcggugauagucucauuguggaaggugacaaaggccaugccaagaggcuucucauucaccuucuccuucucccgcuuguagucuuccuucagcuucugcuccagcuuuguguaguacucaauggccuccaccuuugugggaggguuagggacagggccucuaguuggaaagccaggcuggggccugcagcauccagcccacgcugacuuggggcuuccuacaagccaggcacugcuccucuaagcauuuuuuuuuuuuuggaaacagcgucucgcucugaugcccaggcuggaguguagugguggaaucucagcucacuggagccucaagcucccaggcuaaagugacccucccaccucagccucccaaguggcugggaauacaugugugcaguaccaugccuggcuaauuuuuguauuuuuuguagagaucagguuuugccauguuucccaggcuggucucaaacuccuggcucaagugauccaccugcuucagccucacaaagugcugggauuacaggcauaugccaccgcacccagcaccucuaagcuucuuuauauguauuacucacuuuacccucacaacacucucauaagguggguacguuaaccccaugaggaaacugaggcacugagcaguaagcaacuugcucaaguccccagagucaguggguacagcacaacauuguccuuuuggcugacauuuucuaauuugagguuugaaaaccuggucacuguagggacauuagacaaacccaacagugggaacugaggcuucaaggauuccagggacagguggggacucacugagggcagggccccagccuugccugcccaggaccuguccaacuucucccgacucaacagccagcccgcgucauaccugcucacagccucgcaccacacagcagcagagguggccacagggcuugggguugaucaugguaggcacguucuccuugcucuggagguuugugaaguacagcuuuccccgcucggccuucuuccugugggacccagaugccuggucaccuacaucuggggcuggggcuggcucagcuugggggucaucuagcucacuccccaaggacaggagcugucuuguucuuguuuaggauacauguuucagauguggccacaucccaaggucuccccacccaucccuagagggccagaaguucuuccugcaggcugaccuaaauuucucauacuguagccaaagaagggcauguccucagaugcaguggggaccaugggccccccuuccccucacaacaaacucuaaccuccaggccuugcucuuuccagagcugaauuaacaggcacaccaacgaguugaauuaaaaucaaaugcccuaggaaaaaaucuagaaggggagccugugugguagccaagauguccuccacaauggcagggggcccuuggugucacccuccucugcccccagucccuuaccucucugcaucgaggaacauuaggcgagccacguuguaacacgggcgggcuucgagaacugugcaguugggguaggcuucccugaaacacaguucauguaucaucuugugcagggaccccacccaccugccccugacuuucauccaugaccccaucaccuucaagaaacacaucucuggcuggacgugguggcucacaucuguaaucccagcacuuuggggggccgaagcgggaggaucaccugaggucaggaguucgaaaccagccuggccaacauggugaaacccugucucuacuaaaaauacaaaaauuagcugggcaugguggcacgugccuguagucccagcuacucaggaggcugaggcagaagaauugcucgaacccgggagguggagguugcagugagccaagaucgcgccacugcacuccagacugggcgacagagcgagacuccaucucaaaaaaaaagacaaaaaaacccacaucuccaauucaagcugccuuuuucuuagucuacaaaacugagaguuccccaagaauaaagcuuuggaguuccuccucaugcuuaucugaguggggaagugggagcagaaggccugagcacugugugacugcaggcugggcuaacaaaccaggauguguagggacauacugcaugcagguagggaagccagggcuauggucugauuccuguccagggcugugaccuuuagguugaaaaaaauugcaucuagucauaggcuauauaauuccuuaacccuguucccagaagaccuggucacagcccaacacuuagccuugaccacagacugaccucaaccaacccauaacccagucuacaaaaugaucucuaacuuuggcccaagacagacaagagauugauccugaccccugaccagggugagacugaccuguaacccuggccaaagacugacccuuaagcccacccuggccaaagacugaccccagaccuguugcccagacccaagacugaccuccuaacccugaccccagauucauccuuaccuugacuuaagacugaccagagagaaacuggcacugacucacuaguaccugguaccaggcaaggcuugaagaaugcuugcugagugaaggaauaguucauuuuuuuguuuguuuguuuguuucaaauauucugagauggggucuuguuguauugcccaggcuggucuugaacuccuggguucaagugaucauccugccucagcuucccaaagugugggcauuacacuagugagccaccauggcuggagggaauaguuucuuuuuguuuuuuguuucguuuuuguuuuuguuuuuguuuuguuuuguuuuugagacggagucucacucugucacccgggcuagaaugcaguggugugaucugggcucacuacaaccuuugcuucccggguucaagugauucucgugcuucagccuucugaguagcugggauuacaggugugugccaccacacccggcuaauuuuuuuuuuuuuuuuguauuuuuaguagagauaggguuucaacauguuggccaggcuggucucgaacuccugaccucaggugauuggcccgcccuggcuucccaaagugcugggauuauaggcaugagcugccauacccagccuaauagcuuuuuuuuuuuuuuuuugaggcggagucuugcucugucgcccaggcuggagugcaguggugcaaucucagcucacuguaaccuccaccucuuggguucaagugauuccccugucucagccucuccaguagcugggauuauaggcacaugccaccacgccuggcuaauuuuuauguuuuuaguagagaugggguuucaccaucuuggccaggcugguccugaacuccugaccuugugauucacccaccucggcuccccaaagugcugggauuacaggugugagccaccgcaccuggccaguaguucguuuuuaaaucugaucaugcacuguucuuugauccuaauccuuaaucuagacugaguccccaucuuuuuauauuuuauuaaaauuuuuagguugaacacaguggcucaugccuguaaucccaaaacuuugagaggcugagacaggaggauugcuugaggccaggaguucaugaccagccugggcaacauagugagacccugucucuaaaaaaagaaaaaaaaauuagccaggugugguggugagugccuguaguuccagcuacucgggagucugaggcaggaggaucgauucagcccaggaggucaaggcugcagugagcuaugaccacgccccuguauugcagcacuccagccagggagacagagugagacucugucucaaaaaaaauuguuuuuuuuuuuaaaugaaggaccaccaaguauugaaugcaugaguuacuguucuaaaguauuaagauaguccucauaaacccaugagaauuuagaaacuuaaaucugggauaggguccuugagauguacuucccaggaggcuagagaccuuuccucugauauuguuccucaaaccauuugagguuuccccuuuggaagggugagcucucauucucacuaaacucaucucuaauccucuaaauccaaccacacaggcccguugauuugcaugcaagauauuuccuaauugugcugagacagucuuccaauccagacagacugcagacuuggaccacaagcccugccuaauccugacaaugagcucaagcgcugucucuuaguccucaccauauacccagcccugucccaacagcuuguauauagcagguguucaauacacaugugguaaaugagcggaucaaugaaauggcuacuccauaaugcucaucccagugauccaaaaaacuccaauuaggacuagagucucccuuaccccugcuuauaggcugaccucuccuaaacaaaacuauagaccaaccccugaaacacaacuaggaucuucagcuucccaagggcacugaucaggucugauuauacucugucucccaggcaugaagcacauaguagguauacaauaaaugugggcugaaugaauagacaguugacuaguaggguucacucaggucucuguucaaaugccacgcugucagagucccucccugucuaucccaucagaaauagcaacccuucccaaccccucuuacccugccugcuucccugcugugguuuucuuagcaccuaccucuucuugacacagucucuauuacuaguucauccggucccuguccaccccuccccacuaaaaugaaagcaaaugagggcaggccuucugucguuuacugcuauacccccagcuccuccccaagcaggcacauagcaggugcucacuagauauuuguaucaaaaaacaaaaacaaaaacaaaaacaacaaacaccagauuucaauacaagcugacaacugauuccaacuggaugguaauauuaagaugucaccuaauucauuguuacaaaagaugguaugagaaaaaaaaaagaugucacuaauucugaguacacacuguccuuaauccugacccagagugcccuuuaaugcugaugacagcuugaaccucagauaggaccccaaauaguucucucauacugacaagaaugaucuaauuuugacugcuguuuuauagccuguauaagggcugggcuuguuucuaauuuauuugugccuggcacauagaagguugucaauaacugcauguaguaugaaagaguauccaucuacuaaugcugaucacacaccaguccuuaaucuucuaacacaggcucuggaaucugacccugaccagauagauguucacucucaauccugcccaaacacuaucucugauuggaucacacacuggccugacccaggacaaugagugaacucugauucuggccaacugacaggucuggaccucagauuaaaccuugauucuuuacuuucuuucuuuuuugagacagggucuugcccuauuacccaggcuggaguacaguggcgcaaucaguucaccacagcauuagccucuugggcucaagccauccucccaccucagucaccugaguaguugggacuauuggugcaugcuaccaugucuggcuaauuuuuauauuuuuuguagagauggaguuucgacauguuguccaggcuggucuuaaacucccgggcucaagcaaucuucucaaggggauuacaggcaugagccaccacaccuggccuaaacccugauucugaugguagacugagcccaaaucucaaccucagucugggccaugauccagaccaccagcauccuuuaucaugaccacuggccagcuccugauucugaccacagacugaccucagagcaaucucugaucagacccuggacuagcuccuaaagccgacugccauacuaugaacccccugagaacucaaugauuuuuuuuucuuuuuuugagacagucucgcucugccgcucaggcugaagugcaguggcacaaucucggcucacugcaaccucugccuccuggguucaagcgauucuucugccucagccuccugaguagcugagacuacugguacgcgccaccaugccuggcuaauuuuuguauuuucaguagagacaagguuucaccaguagagacgggguuucaccauauuggccaggcuggucucaaacucccggcccucaaugauuuuuuuuuuuuuuuuuuuuaagacauggggucucauuauacugaccaggcuggucuugaacuccuggccucaaguaauucucccaucuugggccucccaaaguguugggauuacaggcgugagccaccgugccuggccucuucuauuuuuuauuuuuugaaacauuugaaacagggucuugcucugucacccaggcuggagugcaguggugcacaggacucacugcagccucgaccuccuggguucaagcgauccucccaccucagccucccaaguagcugggacuacaggcgcacgccaccacaccuggcuaaguuuguauuuuuugguagagauggggucuugcuauguugcccaggcuggucuucaacuccugggcucaagugaucugcccacuuuggccucccaaagugcugggauuacagccaugagccaccaugccuggccucauucauuuuuuacagucccaaagcccaccacaguaacuuaugacuaacagcacuugagaaaguuugcugagugaacagaugccugugugagaguagcccuaauccugugguauagagacugucccuacacacccccauggaggggcccuucacugauuccccacccuaugagcugcgccccaaggugcaucccuagccauggggugaccagguaaguucccucuuugccucauuauaccaccucccuuuucucuaguuucuggccauaggucugcucuacccaccccaaaacauaauucuagagcugaaaaagccucagagaauacacaguucaaguucuccuggacuccuuggaauccacuggaaaccaaggagcuucucccugucauggcugcacacaaacuccagaaugcugcuuuuaauuuugaagaagauauguacuccaauggaccugggucaacaaccuaugacccagucugagccaggaggagguuuggggguuaggggguuugaaugacucacucuucagguuuuugucuuauuuuuccuguucuuaaaggggccuaucacccgacccaagugcuaaaccacccuggaaucggacauuucuuccuggaucuaaucucuaucccacccacggcagagcuccaggcuaggguauaaggauguucuuagaguucaaaggcagagaaggcucugcagcagggcuugaggguagggggaagcguggcuuacucacucaaaaugcuucuugaucuuuucugacucugcauauuuggagauuccauugaugaagaggguccgcuucaccugggugacaggggaguggguuugccuucugaggcuugaccccaguggagccaggggaugugagggguggggggcacuagagaaagaggcuuuguuuugaguggguagagaaguaggugagcagaggggaacagauggggugggaggaggccuuaguuauggauaagccaggucccagggaaagcaggggaguguuuccaacagaaaucaggcagugagccuaacaaaagagccacgccgucccaugcucuugagggguuauagaggcagaaggggguacuacuuucagcuccuuagacccugagaacccagcacaguggcuggcauggaguagguguccgguucuggcuuggugagugcauguagaaggggaaggaauauuacuauccuaggaucagccacugcuauuuucccaagugcugggcacagcacggcuguuucuguguauuccccacaaccuugggggagguacuguuguuauuccauuuuacagaugagaaaaucauggcuugggagguuauguaacuugcaggaugggagcuccugagcugcugugccagcauucaaaccuagcugacaccucuuggggcugagacaaaagaggccugcagggaagggaagggaagaggcuggggauggggcaggaccugggcucugcuccacgcaccagaucauccuccuuguagcgcaucuuggaggugugucuacgcaugcuguagacggugagcagcagauacaggaaggcgaaggaggugugcagccauagcagguuguuccugggagaagcagagaggauacaugggagccacuggggcuaggacacacucagaggagacaccucagccugucaguguuaaacccuugauacagacagggcccucuacugccaccagccuucuggcacugacuccucgcaaggcaggcccacaucccacauccccuagacaccaaaauucuucgauuccaaugaaaauaucccugauaggucaccuuucuacgcccuacccacugguuacagugucuccaacugccccagcuggcccucccugguuccugagauuucacccuccucuucuguauccucuucauccuugggggauccucagcaggcauuucccucuucugucuccaacccaagcccucagggacccauagccaucccuguaggcucugcucccaucaacgcagcugccuuuccucccugucccacaucauggcccagacucuggucguagaccuuggccuggccgaccagcuucgcaucuuacccugauuucaaguuggcaauggugguucucccaaagcuguaggcauuguucucuguggggugggaagagggagaggaugaugguggggucagggcacauccccuccagccccauccucucuccacccuagccguccuggcccucacugacccagcagguccccugagaaguugacaggcagcacgaugccuacggagaggacgcccacaaccaccagcagcccgaugaugugccgcugaaaggacagguagugcacggcaucgcccccacauuugucccggaucucaucaucccugcagccauacggguuggacaaaggaauuagguuaggaccagggcaagaagggggcugcaacuugccugcccucacccacucccaccccaaacccacccuagcuccagcugaucuggcaguaguauagggcugaaaugggacuucuugguccccuauuuucugugaagggagaggggagaaagggagaagagagggggagggagaaaaaggagaaaugcauggagaaggggagggaugaaggcagagggcuagaaggaaaagauagguaaaagaaagaagagacugcagagacaggaaggggaagaagaaaaaugaggaaugcagagaaaagggaagaaaaaagagaaauaucugaggagggaggaaggcaagagaggaggaggaccagcaggaggaggaguggugaaagaggcagaagugaaggaaggaugggaggaggggcagcagcaccucauggguguggcugagccuggcguagugaagcccggguacccuugggggaggccugggggagugguggcggcagugcugaccuguccuggcuuccugccuuucucagcgcucacugccugccugcuggacucuggcuggaucuccugaguucugccugcagcuggcuggcugcucccagccuacugcugcccccacucacuggcugcacagagguugaggcaggggcuccacccccucccucaagguggggcagggcagggagagaagcgggggggccggcagggggucacagaggagauuauggggucaagugaguguucaggguacagcagaggcucaggcacccgaggcuuggccuuugagagcagggaggagggugcugugcuggcgaggagugcuaaggcccugaaagcugcuggcuucugaauuuuguagggagaugccagguucugaaguuucucucuuucuuuagagcuugaagaugguccacuuacuuuauccugaagauggcugucagccaggaacagaaacccugggggaacagagggcugucagcgggaguccccagcccaccaacccgaaccucucuccucccucaagucccacccauucucauaauuaccuccaggcauagcuuccacaccccucacuaaaaaaaaauccuuauacccucagaacuagcuuauacccaaaaagggagagagagagggaaggucucagcccucaaagaaaaaagaccaacacuaaacagguuuaucugugaauccccauguccagaucuacagauuucugcaaauacccuguggcugugugggccagggugggauggguggggcuugggguucuaagguuagcaggaccuccagaccuccggcuaauaaguuugcaacauggcugccaaaagcagagaagagggccuugcugccugaauuccagcuauuuauccucuagucuaccccagaaggacaaaagcccagggucacuaugagcugcaagguaucuccccaccuccggccaggugcgguggcucacgccuguaaucccagcacuuuuggaggccaaggcgggcggaucaacugaggucaggaguucgagaucagccuggccaacauggugacaccccgucucuuacuaaaaauacaaaaauuagcugggugugguggugcgcgccuguaaucccaguuacuugggaggcugagacuggaaaauugcuugaacccaggaggcggagguugcagugagcugagaucacaccacugcacccuagccugggcgacagagcaagacucugucucagggaaaaauuaaaaaaaaaaaaaaaucucuccccuccacccuccaggcauguaaaggcagagaauggggauauucaggggagggcugcgcagagggcacccugccccaaacuccauccagcagaagguccagacauaacacaggaugggguagaaaggugccuuucggccgugauucaggaccaugcuaccuguugccaacaucaccugagucuggggaccaucuggacacuucuggcuagcagaugugacaacuuugccaccuaccaguaugaguccaacucaggaagcugaaggccaucuucugcuggaauugcuggaagagcugccaccccuaggacuugcagcccaagagggacugaccagggccacaccaugucugaggauuagaguucugacuaggcuccuuacccucauggaauuaaugauggagagccaggcagguaacaccuguguguuaggucugauaugaaaggggucuggagucuguuaugaauugccauucauaugccuuguuaaaagggaccacugccacucagcuccaauccacaagcaggucaaccggccccacauggccaggggccacccaccugcaaccuccgagcaacaugacagauucuguuuuucuaggcagggcuggagggcuuauuauuucuuuuuuuuguuuguuuugagauggagucucgcucugucacccaggcuagagugcaguggcgccaucucagcucacugcaagcuccgccucccgcguucacgccauucuccugccucagccucccaaguagcugggacuacaggcgcccaccaccacgccuggcuaauuuuuuguauuuuuaguagagacgggguuucaccguguuagccaggauggucucaucuagugaccucgugauccucccgccucggccucccaaagugcugggauuacaggcgugagccaagggcuuauuauuauuucuaaaaccaugacuacggaaaaaagguggccuuaggauuaaucagcagaagugggcacaaaacucuuuauggcaaacaaaguugggaauucaugaauguuaaggcugugcuaguuuggagacugugacauagaggacagcagccaggaguucagggccuggggggucauccuguggcuccuugguugaaucacuuucuuugcugaggaggaggccaaaccagcaucccugacuccacaucacugaaagugagggacuucucagcccaugugcccuggggguggggugggggacuaagaaguuuggggggagggcacucacauugucccuuuggucaaagucaacggagcuggagacagaggugagacgcucauaccggucauggcuguccccgugcauagcugaagccacacugggggugagggagaugagagaucagagagccuggugagucugagcccccgggaagcugggcugagugcuccagagcuccagggcuacagaaggcacagaaggcacaggaagcgcagaggcugaagcagagaggaaugacugcccucuacccugcuucccucaaauaugccucuuccuuucagggggacucagggugggagcggaggugggcacugauggugggcaguggggacuugagggaggagguaaucuucaucaucucccuaaggaggcugaagcgagaaugccagagggcccugcaguuccagaguugacuggcaggggccgggggcgggcaacggagccaacauuaugcaaagagcaaugaggagguggaggaaaggauggaccaggagaaccuggaagggcuggggagacuggaaggucuccugggugggacccuacccuccgcuccccucccucuucccugacuccaacagcuguuacaacuccaacuccaauccuauagacagagaugacaaagugacaaaaaagcccagacuggggggcuccuugggcagcccuccucccaggccuccagaagaggugagcagggaacccuggaauaugaagaacuagcuguuagcggacaagaagcugcuggugacacccaaucuugucucuacgugauugugcugaggauuuccuggaggacagccccuccccuccagccaacaagggcugcauaggcaggggcacacagggagggacuucucccaggcagggagccagagggagagaugaaggggaggugaggcagagacaagcuggggagcccccugcucugcaaagcacaccgccugcguuaauccgaaacaugagccugcagaggagaaaacugcaaaaagaaaccagcaacuuggcaggaagagaagagaagcgugagagaagaaaagggaaagcugguuuagugggaaugagggggcuggugccccacauacuauuccuguuccacucggucccucuccugccgccgaagccuggggacagagaacagacaggguuagcaggggcgggggagagucccuggggacaggugaggaacaggggcccaacuuagggcccucaugcccccaugcccacauuggggcuagucccuucucauccccccagcaaaggggaaugagagagggcuggcuccuuccuauuccugaggaguguggaacaagauguguguguggagagcuagagggagggucccagacccuuaccugucugcaucugucaccaaggccagccgcccauagucccaggccaccuuccggaggauagagaauaagaacagcagugccugagggaagagggggcaguuggcaagugcagaggcugucuguccaccugcuggacuagggggcagaagcagaggguccaaaaucuugucuuagaaggggaugacccuggcuugggugaauggucaaaggcgaggcuugggcuggaugauggggacuccuccugcuuaagccugggaaaccggggcaggugggagagugguuagagcuggaaguguuugccagguguguacagggcauggaugccaagguaagggguggcagcaggcacuuacaaggaagcacaugaagucgagagccagcacgguggggacgcccccaaagggcaggcccugcaggacagugcugcggaugcgggcgcuguagcaguaguccuugggguugcuguuguugagggcuguggugcccaguguggccagcagaaagggcagcauggcugcuacugccgcaugguccuccugggcagaggguggagcagucagcugggcuugcccccauccccuucauggcccaguagggugggcguggggagggggcagugaggacagaucaccaggcugccuggguggauggaagcucuggccucuggagauaagggccuagggaggggagaguugagucacauggauuuaccuucacuggcucucuggcuaugaccccacccugggucuggggaacucagucuagaugccaggccuggacuggggaggcugguuucauuaagcuggaagguaucugugauuuucuaacaucuaucuaaauccccccugccgccgccacccccacacucucauucucucugucuuagggcagggggcggagcugagccugggaagacagggaggggucuuaggccugaggacucaaggguaagaugaggggucuccacgucaggggagaaugggucaggagccagcugccucauccugaucuuuucuuucuaugccuauuagaaaaaauggcaugauuucauuugguuagaguuuugaacucaauauaacuggcuuagguucgacgaugggucagaguaggaagucaaguaaauaguaggacuucuggguuugaguuaccugccuggccccagccacuccugcuuauucucauuucucuuccccauaccauaguccucucuccaguuauuugcacagggaucgccugaguguuaugagcacuacaacucccagagugccaugcuccugccucugaagcagggaaggcugggaaagcuaugcccuacggcaagcuuuuccacuggcaaaggaggggggagugggugggggccucuuagccugccugggcagccagggugcugccugguugccugcaacuggccggcugcauugaugcucagaguggauggggugggcaggaggagaaaagggacagccagccugagugccuggguucucaaagugcuuggggacagagcagaguggggcccuggggaggaucccaggauagcggagaaguguggccucaacagaugcagcacugccccacccauuuuacuggggggucccugggggacccuucugcugacaacacugaagcucugccucgggggcgggcuguggagcaggggaggagguccucagggaagaaaaaggaaaaccaaagagaacaacaaaacuagaaacagugacugcaacuucgggagcagcaucccuuagcccccagggggacucagaggguuucuccugccucuuccuaacacuucaaccacagggcaagaggcagaagcccucagauggaggggaggauggaguuguuuauguguuucacuuggucccagggagucucugcaaagccuggauuaggaagacuaaaggagugugugcugguguguuaugccucuuccuuuuccaguccaagcugccuuuaaaaacacacuaauuuaguaauuguauuggguaccauuuguccagugcccucaguuucaagaauaauauauuacaugauuucauuuaauccucgacgauccugaauugagugucacugacauuuuagggugggggcacagggccucagagguuaaguaacuuucccaaggucacacugcuaauaaaaugagggaccuaggacucaaaccuagcucaccuucuuucuaaagcuagaaugauuuucagggcaccacggugcuuuucugauguuccuagaacaggacucggcagaccauggaagcuuuauaaaugcucauuaaauguucucaggccagagaaccugugggugcuguggaaauguguguguccagguauguaaauguguguugauguguggaccuguguccaggaggagcuaggugacugcauggcaguccacggaaaugaagggaguuguuggcuucgaagugggggugugaacaugggugugucugggagcccggguauguaaacauaagaugcacagaacccuggggcacuaugggagguuaaagguagguauagguaucuuggguuggggggacucuaacuagucccccuuucucaauucucaacuccaauguacuccagcaaucucaacacucuauucccaccccuugccuguuucucucucugaauuccaaggcuccaucagaucagaaugaaaugagaacaagccccagaguaccauuccuaucaacuccugucuucuccacaccaaagaaagguagagcauuuuggaagcuucuacaugaaguggccccagcaggguggacaggaucuagcuagaugguuaguaacugaaaucaccaugcuccucugcuguccgccuccuuggggucacaaaguacucuccccuccacaacagcauuaaucuucccaccugcaugggaggaaggcagggcacacucagaucacuauccccauuuuacagggaggaagcaggaacccaguaggggaagcaacuugcacagugacaggacagguaagggguggagccugggcuggcagcucugccaguugacagggcugcuccaagcuuuuaauugugggggugggguugcuggguugaguuucaucaagggcagcugcucucaaagccagcacugggcugagcaacugagaagagggaagacauugaggcagaauaccuuggggaugggagguggcaguucuuccacuccacgaggugccugcaccagcuauaucccaguuucucuagucugauauugagguuuugguugagguguguccagagagugauggagcauuuuacuucuagcuaacuuuuuaauuuuaccauuaaggagugugugcaugguggggguuggagagcuauaacuuauaagcuuuuuuuuggggggguuguuguguauuuuuuugagacggagucucgcucugucaccagaguggagugcaguggcgcgaucuuggcucacugcaaccucugccuccuggguucaagggauucuccugccucagccuccugaguagcugggacuacagacacaugccaccacgcccagcuaauuuuuguauuuucaguagagacaggguuucaccauguuggccaggauggucucgaucucuugaccucaugaucugcccaccucggccucccaaagugcugggauuacaggagugauauaagcuuuuucaguggaguuacugggcaagauuuaaguuagggcuuuggaucaaagcaaggccauguggucugaggggaggaggggaagauggaagcgagcucuguuacuacgaaaccugagucucagucuuccaaucuguaacaaagagauacaaauauccuuacucuaccccuacccacuucagagagaaaggcaagaauauauccacaagugagcauaaaaguaguaguaggugccaggcacgguggcucacaccuguaaucccagcauuuugggaggccgagcugggcagaucacagggucaggaguucgagaccagccuggccaacacagugaaaccccgucucuacuaaaaaaauacaaaaauuagcugggugugguggcaugcgucuguagucccagcuacucgggaggcugaggcaggagaaucacuugaacccaggaggcagagguugcagugaccuuagaucaugccacugcacuccagccugggcgacagagugagacuccaucucaaaaaaaaaaguaguaguaggcagggugggguggcucaccccuguaaucucagcacuuuugaaggccaaguggggaagauaccuugagccuaggaguuggaggcugcagucagccaugaucaugccacugcacuccagccugggcaagagagcaaaaccuugucucgaggggaaaaaaaaaaaaaagccaggcaugguggcucacaccuguaaucccagcacuuugggaggcuguggugggagaaucacgucagcccaggaguucgagaccagcuugggcaacauagcaaaaccccgucucuacaaaagauaccccccaccaccaaaauuuagcugggcaugcuggugcaugucuguagucccagcuacuccggaagcugaggugcgaagaucaccugagcccagggaguuccaggcugcagugaaccaagaucaugccacugcacuccauccugggcgacagacagagaccgugucuaaaaaaaaaaaggaaagaaaaaagaaaaacagaaaaagaaaaaaaaguaguaaaauaauaguauuaaauguuuauuuaacucuucuuuugugccaagcacuguucuaagcacuuuacaaauguaacucauuugcuccccaucacaaccccaggaggacacugagauacagagagaguauaugagcugcucaaggucacacagccagucugugguagacccagauaaggacccaggcugccuggcucgaguguaugcucuuaaccacugcacuuugcagaguuaucugcaaacaagagccacuuccaccagggagccggaggcagucaguuaccacacuggagaaaugccauacccuauuucuaccugcuugccuuuccucuugcuuguagcuucccuccacucaggccuuggguuugugauuucagguucugaggcaggcauaggggacaggcaccauagucuggugguuaaaagcacagacucuaggaugugacagaccaggcuucuaaccugggaaaauuacuuagucacccugggccucaguuucuucauuuguaaaaugggacaauaauccaguuguguuguuguucuggggauuaaacaagaugacuuauguaaagcucuuaauauaguucaaggcauauaaugggcucuaggaauuaguuauuguuauuaauaagguauggaauaaaagggguugguuuagagaaagaaaauugguaaaaacaaaaauaagauaaaaacacagaauguaacaugauagaaauauaacagagccccucagucagguugggcuucuuauuuagaccuaaggguuuacacuguguuagggacucugccacugagugacagggaauauucucacucuuugaacauaccccauccaucugugguagccugggagguggaggcaugggagaguuaugggucagaaguucagagaugauaacccauuauugaucaauuaccaggaaggaugccaagcucuuuacuucuguuaccuuguuugauucccaugauaaaacuuguaaggaggugguaguaaccacacuuuuuuucuuuuucuuuucuuucuuuuuuuuuuuuuuuuugagacagucuugcucugucacccaggcuggagugaagugccacaaucucggcucacugcaaccuccgccucccagguuuaagccauucuccugccucagccuccugaguagcugggauuacaggugugugccaccaugcccggcuaauuuuuguauuuuuaguagcgaugggguuucaccauguuggccaggcuggucucgaacuccugaccucaagugaucuguccgccucagucucccaaagugcuggaauuauaggcauaaacacuuuuuaaugaaaacugagguucagacagguuaaguaacuugucaaggucacacagcugaagaauaguagagcuagaauuugaacgcaggucucuaagacucugcuauacuuggagagaacuugaaugauguccaaggggguucuuaguuacccacugccugccuucugccuugccauguccccauccacccacaggccaagacugcacugagugagccaacagcaggccccagcaugugccaccuggggcaugccaaggccuggacccucuggugcccuggaggacaaucacgcugccagcacacccccacuugaagccuggcugacacucccacuccccaccucacccuggccugggaggcaggaugggccccucuucagcagguguugggcacagccucauugcuccccggcugcugcagacugguaauggguaggcaagccccagccccccagggcgguggagugcucaggcuugccccgagcggccagaccucugcccaggggacccaggcagggggcagcacagcgccccaagggcagccagccccucugaccucuccuccccacuucccaagcguccuuuccuuuucuggggaacaaggugccaagcuuugggacuguccgccuuaggcggucaagacagccaggagggacaaagcggcgcccccuccccacaacagggccuuugccccacucucgguuucgcgucugaaucuuuuccccaccgcacccuccaacgcaggcccgggcggcucaugaaugaacugcacuguguggggcgcaaggagaggacacgcucccggggccggccgccucuccagcccgccgaccagucaguccccagagccgggggcagcggccggccucgugccagcaccugcgaacccugcccuugcccgagcccgagcccuuaccccggaccggcuucggguguacucgcccccgggagcagcagaaaaaauaaaaggcacagaaggcaucggacuuggcgaccccgggguccaaaacucgggggcgggggcggcuaguuccccaaacggcggcggacaggcggggcgcagcuggcacccccgagggucgcgcaggggacgcgcaccugcaccgggcaggugggagaagaguggcacucgggggccgggggcgggggucccacccuuugggaucuccccggggcuggggagagccggcggcgcguaucuggaccuccggcagggguuggaggacucacauuuggcucgggauggugcgggguugggggcagcgcgcgccaccccugggucccgcgggcccgggcaccucugggucccgcaggagguugaagggaggggacgcgcagcugaguccagguuuuuucuuugggugguggugggaucuucgaagaaaagagcgagggcuggguaggggucgcguacucacccccaggcgcagacucggcuccggcucggagccccggguuggggcggggcggggcugggggagggggagggggagucgcugggcggcucgagcuccgggcuccugcggcggccgcggcaguguaugggggagggggagcggggggagggagggggagggggcggagccccgcaggucccgccccgcacgccggcgcacgcaaggugcgcgcgcacucucagaucgcguccgccgggcugggccuggcgcgcaggcgcuaggaagaggccgcguggggcgaaggcggcgcuuggcugguggggcccgcggcgggauuuucccgggcggcgagagcgguaugguggggggcaggggugggcguuaaguccucauucccuccuucuccucuuccuuucucugcaguaggggaggcccacuccccggggugagugaggagaggccagagugggaggcagagcgucagugggaggggucccgacggggaggggggggucccgacggggaggggggucccgacggggaggggaggccccuuacccggauccuccucccuuccgcucuccgugggcugcuucugcgacccccaaguccguggccggcgcucaccugcuuuccccggguugcggcgucgacuuggggagggcgggcugcguucagccgucgcuggucacuccggagcgucuccuccggcuucuccgcuuuccgcgcuccccuccccuuucccaacuuaggucuggagaugaguuagccagacgccucuguggugugaggauugaguuuuugcuuucacucugucaacgcugaugagugcgcccucccccaggccaggggguucccugguuucuuauuucaccagagacu

SEQ ID NO: 18359 - RNA, 28708 nt, Homo sapiens
agucucuggugaaauaagaaaccagggaacccccuggccugggggagggcgcacucaucagcguugacagagugaaagcaaaaacucaauccucacaccacagaggcgucuggcuaacucaucuccagaccuaaguugggaaaggggaggggagcgcggaaagcggagaagccggaggagacgcuccggagugaccagcgacggcugaacgcagcccgcccuccccaagucgacgccgcaacccggggaaagcaggugagcgccggccacggacuugggggucgcagaagcagcccacggagagcggaagggaggaggauccggguaaggggccuccccuccccgucgggaccccccuccccgucgggaccccccccuccccgucgggaccccucccacugacgcucugccucccacucuggccucuccucacucaccccggggagugggccuccccuacugcagagaaaggaagaggagaaggagggaaugaggacuuaacgcccaccccugccccccaccauaccgcucucgccgcccgggaaaaucccgccgcgggccccaccagccaagcgccgccuucgccccacgcggccucuuccuagcgccugcgcgccaggcccagcccggcggacgcgaucugagagugcgcgcgcaccuugcgugcgccggcgugcggggcgggaccugcggggcuccgcccccucccccucccuccccccgcucccccucccccauacacugccgcggccgccgcaggagcccggagcucgagccgcccagcgacucccccucccccucccccagccccgccccgccccaacccggggcuccgagccggagccgagucugcgccugggggugaguacgcgaccccuacccagcccucgcucuuuucuucgaagaucccaccaccacccaaagaaaaaaccuggacucagcugcgcguccccucccuucaaccuccugcgggacccagaggugcccgggcccgcgggacccagggguggcgcgcgcugcccccaaccccgcaccaucccgagccaaaugugaguccuccaaccccugccggagguccagauacgcgccgccggcucuccccagccccggggagaucccaaagggugggacccccgcccccggcccccgagugccacucuucucccaccugcccggugcaggugcgcguccccugcgcgacccucgggggugccagcugcgccccgccuguccgccgccguuuggggaacuagccgcccccgcccccgaguuuuggaccccggggucgccaaguccgaugccuucugugccuuuuauuuuuucugcugcucccgggggcgaguacacccgaagccgguccgggguaagggcucgggcucgggcaagggcaggguucgcaggugcuggcacgaggccggccgcugcccccggcucuggggacugacuggucggcgggcuggagaggcggccggccccgggagcguguccucuccuugcgccccacacagugcaguucauucaugagccgcccgggccugcguuggagggugcgguggggaaaagauucagacgcgaaaccgagaguggggcaaaggcccuguuguggggagggggcgccgcuuugucccuccuggcugucuugaccgccuaaggcggacagucccaaagcuuggcaccuuguuccccagaaaaggaaaggacgcuugggaaguggggaggagaggucagaggggcuggcugcccuuggggcgcugugcugcccccugccuggguccccugggcagaggucuggccgcucggggcaagccugagcacuccaccgcccuggggggcuggggcuugccuacccauuaccagucugcagcagccggggagcaaugaggcugugcccaacaccugcugaagaggggcccauccugccucccaggccagggugagguggggagugggagugucagccaggcuucaagugggggugugcuggcagcgugauuguccuccagggcaccagaggguccaggccuuggcaugccccagguggcacaugcuggggccugcuguuggcucacucagugcagucuuggccuguggguggauggggacauggcaaggcagaaggcaggcaguggguaacuaagaacccccuuggacaucauucaaguucucuccaaguauagcagagucuuagagaccugcguucaaauucuagcucuacuauucuucagcugugugaccuugacaaguuacuuaaccugucugaaccucaguuuucauuaaaaaguguuuaugccuauaauuccagcacuuugggagacugaggcggacagaucacuugaggucaggaguucgagaccagccuggccaacauggugaaaccccaucgcuacuaaaaauacaaaaauuagccgggcaugguggcacacaccuguaaucccagcuacucaggaggcugaggcaggagaauggcuuaaaccugggaggcggagguugcagugagccgagauuguggcacuucacuccagccugggugacagagcaagacugucucaaaaaaaaaaaaaaaaagaaagaaaagaaaaagaaaaaaagugugguuacuaccaccuccuuacaaguuuuaucaugggaaucaaacaagguaacagaaguaaagagcuuggcauccuuccugguaauugaucaauaauggguuaucaucucugaacuucugacccauaacucucccaugccuccaccucccaggcuaccacagauggaugggguauguucaaagagugagaauauucccugucacucaguggcagagucccuaacacaguguaaacccuuaggucuaaauaagaagcccaaccugacugaggggcucuguuauauuucuaucauguuacauucuguguuuuuaucuuauuuuuguuuuuaccaauuuucuuucucuaaaccaaccccuuuuauuccauaccuuauuaauaacaauaacuaauuccuagagcccauuauaugccuugaacuauauuaagagcuuuacauaagucaucuuguuuaauccccagaacaacaacacaacuggauuauugucccauuuuacaaaugaagaaacugaggcccagggugacuaaguaauuuucccagguuagaagccuggucugucacauccuagagucugugcuuuuaaccaccagacuauggugccuguccccuaugccugccucagaaccugaaaucacaaacccaaggccugaguggagggaagcuacaagcaagaggaaaggcaagcagguagaaauaggguauggcauuucuccagugugguaacugacugccuccggcucccugguggaaguggcucuuguuugcagauaacucugcaaagugcagugguuaagagcauacacucgagccaggcagccuggguccuuaucugggucuaccacagacuggcugugugaccuugagcagcucauauacucucucuguaucucaguguccuccugggguugugauggggagcaaaugaguuacauuuguaaagugcuuagaacagugcuuggcacaaaagaagaguuaaauaaacauuuaauacuauuauuuuacuacuuuuuuuucuuuuucuguuuuucuuuuuucuuuccuuuuuuuuuuuagacacggucucugucugucgcccaggauggagugcaguggcaugaucuugguucacugcagccuggaacucccugggcucaggugaucuucgcaccucagcuuccggaguagcugggacuacagacaugcaccagcaugcccagcuaaauuuugguggugggggguaucuuuuguagagacgggguuuugcuauguugcccaagcuggucucgaacuccugggcugacgugauucucccaccacagccucccaaagugcugggauuacaggugugagccaccaugccuggcuuuuuuuuuuuuuuccccucgagacaagguuuugcucucuugcccaggcuggagugcaguggcaugaucauggcugacugcagccuccaacuccuaggcucaagguaucuuccccacuuggccuucaaaagugcugagauuacaggggugagccaccccacccugccuacuacuacuuuuuuuuuugagauggagucucacucugucgcccaggcuggagugcaguggcaugaucuaaggucacugcaaccucugccuccuggguucaagugauucuccugccucagccucccgaguagcugggacuacagacgcaugccaccacacccagcuaauuuuuguauuuuuuuaguagagacgggguuucacuguguuggccaggcuggucucgaacuccugacccugugaucugcccagcucggccucccaaaaugcugggauuacaggugugagccaccgugccuggcaccuacuacuacuuuuaugcucacuuguggauauauucuugccuuucucucugaaguggguagggguagaguaaggauauuuguaucucuuuguuacagauuggaagacugagacucagguuucguaguaacagagcucgcuuccaucuuccccuccuccccucagaccacauggccuugcuuugauccaaagcccuaacuuaaaucuugcccaguaacuccacugaaaaagcuuauaucacuccuguaaucccagcacuuugggaggccgaggugggcagaucaugaggucaagagaucgagaccauccuggccaacauggugaaacccugucucuacugaaaauacaaaaauuagcugggcgugguggcaugugucuguagucccagcuacucaggaggcugaggcaggagaaucccuugaacccaggaggcagagguugcagugagccaagaucgcgccacugcacuccacucuggugacagagcgagacuccgucucaaaaaaauacacaacaacccccccaaaaaaaagcuuauaaguuauagcucuccaacccccaccaugcacacacuccuuaaugguaaaauuaaaaaguuagcuagaaguaaaaugcuccaucacucucuggacacaccucaaccaaaaccucaauaucagacuagagaaacugggauauagcuggugcaggcaccucguggaguggaagaacugccaccucccauccccaagguauucugccucaaugucuucccucuucucaguugcucagcccagugcuggcuuugagagcagcugcccuugaugaaacucaacccagcaaccccacccccacaauuaaaagcuuggagcagcccugucaacuggcagagcugccagcccaggcuccaccccuuaccuguccugucacugugcaaguugcuuccccuacuggguuccugcuuccucccuguaaaauggggauagugaucugagugugcccugccuuccucccaugcaggugggaagauuaaugcuguuguggaggggagaguacuuugugaccccaaggaggcggacagcagaggagcauggugauuucaguuacuaaccaucuagcuagauccuguccacccugcuggggccacuucauguagaagcuuccaaaaugcucuaccuuucuuugguguggagaagacaggaguugauaggaaugguacucuggggcuuguucucauuucauucugaucugauggagccuuggaauucagagagagaaacaggcaaggggugggaauagaguguugagauugcuggaguacauuggaguugagaauugagaaagggggacuaguuagaguccccccaacccaagauaccuauaccuaccuuuaaccucccauagugccccaggguucugugcaucuuauguuuacauacccgggcucccagacacacccauguucacacccccacuucgaagccaacaacucccuucauuuccguggacugccaugcagucaccuagcuccuccuggacacagguccacacaucaacacacauuuacauaccuggacacacacauuuccacagcacccacagguucucuggccugagaacauuuaaugagcauuuauaaagcuuccauggucugccgaguccuguucuaggaacaucagaaaagcaccguggugcccugaaaaucauucuagcuuuagaaagaaggugagcuagguuugaguccuaggucccucauuuuauuagcagugugaccuugggaaaguuacuuaaccucugaggcccugugcccccacccuaaaaugucagugacacucaauucaggaucgucgaggauuaaaugaaaucauguaauauauuauucuugaaacugagggcacuggacaaaugguacccaauacaauuacuaaauuaguguguuuuuaaaggcagcuuggacuggaaaaggaagaggcauaacacaccagcacacacuccuuuagucuuccuaauccaggcuuugcagagacucccugggaccaagugaaacacauaaacaacuccauccuccccuccaucugagggcuucugccucuugcccugugguugaaguguuaggaagaggcaggagaaacccucugagucccccugggggcuaagggaugcugcucccgaaguugcagucacuguuucuaguuuuguuguucucuuugguuuuccuuuuucuucccugaggaccuccuccccugcuccacagcccgcccccgaggcagagcuucaguguugucagcagaagggucccccagggaccccccaguaaaauggguggggcagugcugcaucuguugaggccacacuucuccgcuauccugggauccuccccagggccccacucugcucuguccccaagcacuuugagaacccaggcacucaggcuggcugucccuuuucuccuccugcccaccccauccacucugagcaucaaugcagccggccaguugcaggcaaccaggcagcacccuggcugcccaggcaggcuaagaggcccccacccacuccccccuccuuugccaguggaaaagcuugccguagggcauagcuuucccagccuucccugcuucagaggcaggagcauggcacucugggaguuguagugcucauaacacucaggcgaucccugugcaaauaacuggagagaggacuaugguauggggaagagaaaugagaauaagcaggaguggcuggggccaggcagguaacucaaacccagaaguccuacuauuuacuugacuuccuacucugacccaucgucgaaccuaagccaguuauauugaguucaaaacucuaaccaaaugaaaucaugccauuuuuucuaauaggcauagaaagaaaagaucaggaugaggcagcuggcuccugacccauucuccccugacguggagaccccucaucuuacccuugaguccucaggccuaagaccccucccugucuucccaggcucagcuccgcccccugcccuaagacagagagaaugagaguguggggguggcggcggcaggggggauuuagauagauguuagaaaaucacagauaccuuccagcuuaaugaaaccagccuccccaguccaggccuggcaucuagacugaguuccccagacccaggguggggucauagccagagagccagugaagguaaauccaugugacucaacucuccccucccuaggcccuuaucuccagaggccagagcuuccauccacccaggcagccuggugaucuguccucacugcccccuccccacgcccacccuacugggccaugaaggggaugggggcaagcccagcugacugcuccacccucugcccaggaggaccaugcggcaguagcagccaugcugcccuuucugcuggccacacugggcaccacagcccucaacaacagcaaccccaaggacuacugcuacagcgcccgcauccgcagcacuguccugcagggccugcccuuugggggcguccccaccgugcuggcucucgacuucaugugcuuccuuguaagugccugcugccaccccuuaccuuggcauccaugcccuguacacaccuggcaaacacuuccagcucuaaccacucucccaccugccccgguuucccaggcuuaagcaggaggaguccccaucauccagcccaagccucgccuuugaccauucacccaagccagggucauccccuucuaagacaagauuuuggacccucugcuucugcccccuaguccagcagguggacagacagccucugcacuugccaacugcccccucuucccucaggcacugcuguucuuauucucuauccuccggaagguggccugggacuaugggcggcuggccuuggugacagaugcagacagguaagggucugggacccucccucuagcucuccacacacacaucuuguuccacacuccucaggaauaggaaggagccagcccucucucauuccccuuugcuggggggaugagaagggacuagccccaaugugggcaugggggcaugagggcccuaaguugggccccuguuccucaccuguccccagggacucucccccgccccugcuaacccugucuguucucuguccccaggcuucggcggcaggagagggaccgaguggaacaggaauaguauguggggcaccagcccccucauucccacuaaaccagcuuucccuuuucuucucucacgcuucucuucucuuccugccaaguugcugguuucuuuuugcaguuuucuccucugcaggcucauguuucggauuaacgcaggcggugugcuuugcagagcagggggcuccccagcuugucucugccucaccuccccuucaucucucccucuggcucccugccugggagaagucccucccugugugccccugccuaugcagcccuuguuggcuggaggggaggggcuguccuccaggaaauccucagcacaaucacguagagacaagauugggugucaccagcagcuucuuguccgcuaacagcuaguucuucauauuccaggguucccugcucaccucuucuggaggccugggaggagggcugcccaaggagccccccagucugggcuuuuuugucacuuugucaucucugucuauaggauuggaguuggaguuguaacagcuguuggagucagggaagagggaggggagcggaggguagggucccacccaggagaccuuccagucuccccagcccuuccagguucuccugguccauccuuuccuccaccuccucauugcucuuugcauaauguuggcuccguugcccgcccccggccccugccagucaacucuggaacugcagggcccucuggcauucucgcuucagccuccuuagggagaugaugaagauuaccuccucccucaaguccccacugcccaccaucagugcccaccuccgcucccacccugagucccccugaaaggaagaggcauauuugagggaagcaggguagagggcagucauuccucucugcuucagccucugcgcuuccugugccuucugugccuucuguagcccuggagcucuggagcacucagcccagcuucccgggggcucagacucaccaggcucucugaucucucaucucccucacccccaguguggcuucagcuaugcacggggacagccaugaccgguaugagcgucucaccucugucuccagcuccguugacuuugaccaaagggacaaugugagugcccuccccccaaacuucuuagucccccaccccacccccagggcacaugggcugagaagucccucacuuucagugauguggagucagggaugcugguuuggccuccuccucagcaaagaaagugauucaaccaaggagccacaggaugaccccccaggcccugaacuccuggcugcuguccucuaugucacagucuccaaacuagcacagccuuaacauucaugaauucccaacuuuguuugccauaaagaguuuugugcccacuucugcugauuaauccuaaggccaccuuuuuuccguagucaugguuuuagaaauaauaauaagcccuuggcucacgccuguaaucccagcacuuugggaggccgaggcgggaggaucacgaggucacuagaugagaccauccuggcuaacacggugaaaccccgucucuacuaaaaauacaaaaaauuagccaggcgugguggugggcgccuguagucccagcuacuugggaggcugaggcaggagaauggcgugaacgcgggaggcggagcuugcagugagcugagauggcgccacugcacucuagccugggugacagagcgagacuccaucucaaaacaaacaaaaaaaagaaauaauaagcccuccagcccugccuagaaaaacagaaucugucauguugcucggagguugcagguggguggccccuggccauguggggccgguugaccugcuuguggauuggagcugaguggcaguggucccuuuuaacaaggcauaugaauggcaauucauaacagacuccagaccccuuucauaucagaccuaacacacagguguuaccugccuggcucuccaucauuaauuccaugaggguaaggagccuagucagaacucuaauccucagacaugguguggcccuggucagucccucuugggcugcaaguccuagggguggcagcucuuccagcaauuccagcagaagauggccuucagcuuccugaguuggacucauacugguagguggcaaaguugucacaucugcuagccagaaguguccagaugguccccagacucaggugauguuggcaacagguagcaugguccugaaucacggccgaaaggcaccuuucuaccccauccuguguuaugucuggaccuucugcuggauggaguuuggggcagggugcccucugcgcagcccuccccugaauauccccauucucugccuuuacaugccuggaggguggaggggagagauuuuuuuuuuuuuuuaauuuuucccugagacagagucuugcucugucgcccaggcuagggugcaguggugugaucucagcucacugcaaccuccgccuccuggguucaagcaauuuuccagucucagccucccaaguaacugggauuacaggcgcgcaccaccacacccagcuaauuuuuguauuuuuaguaagagacggggugucaccauguuggccaggcugaucucgaacuccugaccucaguugauccgcccgccuuggccuccaaaagugcugggauuacaggcgugagccaccgcaccuggccggagguggggagauaccuugcagcucauagugacccugggcuuuuguccuucugggguagacuagaggauaaauagcuggaauucaggcagcaaggcccucuucucugcuuuuggcagccauguugcaaacuuauuagccggaggucuggagguccugcuaaccuuagaaccccaagccccacccaucccacccuggcccacacagccacaggguauuugcagaaaucuguagaucuggacauggggauucacagauaaaccuguuuaguguuggucuuuuuucuuugagggcugagaccuucccucucucucucccuuuuuggguauaagcuaguucugaggguauaaggauuuuuuuuuagugagggguguggaagcuaugccuggagguaauuaugagaaugggugggacuugagggaggagagagguucggguuggugggcuggggacucccgcugacagcccucuguucccccaggguuucuguuccuggcugacagccaucuucaggauaaaguaaguggaccaucuucaagcucuaaagaaagagagaaacuucagaaccuggcaucucccuacaaaauucagaagccagcagcuuucagggccuuagcacuccucgccagcacagcacccuccucccugcucucaaaggccaagccucgggugccugagccucugcuguacccugaacacucacuugaccccauaaucuccucugugacccccugccggcccccccgcuucucucccugcccugccccaccuugagggaggggguggagccccugccucaaccucugugcagccagugagugggggcagcaguaggcugggagcagccagccagcugcaggcagaacucaggagauccagccagaguccagcaggcaggcagugagcgcugagaaaggcaggaagccaggacaggucagcacugccgccaccacucccccaggccucccccaaggguacccgggcuucacuacgccaggcucagccacacccaugaggugcugcugccccuccucccauccuuccuucacuucugccucuuucaccacuccuccuccugcugguccuccuccucucuugccuuccucccuccucagauauuucucuuuuuucuucccuuuucucugcauuccucauuuuucuucuuccccuuccugucucugcagucucuucuuucuuuuaccuaucuuuuccuucuagcccucugccuucaucccuccccuucuccaugcauuucuccuuuuucucccucccccucucuucucccuuucuccccucucccuucacagaaaauaggggaccaagaagucccauuucagcccuauacuacugccagaucagcuggagcuaggguggguuuggggugggagugggugagggcaggcaaguugcagcccccuucuugcccugguccuaaccuaauuccuuuguccaacccguauggcugcagggaugaugagauccgggacaaaugugggggcgaugccgugcacuaccuguccuuucagcggcacaucaucgggcugcuggugguugugggcguccucuccguaggcaucgugcugccugucaacuucucaggggaccugcugggucagugagggccaggacggcuaggguggagagaggauggggcuggaggggaugugcccugaccccaccaucauccucucccucuucccaccccacagagaacaaugccuacagcuuugggagaaccaccauugccaacuugaaaucaggguaagaugcgaagcuggucggccaggccaaggucuacgaccagagucugggccaugaugugggacagggaggaaaggcagcugcguugaugggagcagagccuacagggauggcuaugggucccugagggcuuggguuggagacagaagagggaaaugccugcugaggaucccccaaggaugaagaggauacagaagaggagggugaaaucucaggaaccagggagggccagcuggggcaguuggagacacuguaaccaguggguagggcguagaaaggugaccuaucagggauauuuucauuggaaucgaagaauuuuggugucuaggggaugugggaugugggccugccuugcgaggagucagugccagaaggcugguggcaguagagggcccugucuguaucaaggguuuaacacugacaggcugaggugucuccucugaguguguccuagccccaguggcucccauguauccucucugcuucucccaggaacaaccugcuauggcugcacaccuccuucgccuuccuguaucugcugcucaccgucuacagcaugcguagacacaccuccaagaugcgcuacaaggaggaugaucuggugcguggagcagagcccagguccugccccauccccagccucuucccuucccuucccugcaggccucuuuugucucagccccaagaggugucagcuagguuugaaugcuggcacagcagcucaggagcucccauccugcaaguuacauaaccucccaagccaugauuuucucaucuguaaaauggaauaacaacaguaccucccccaagguuguggggaauacacagaaacagccgugcugugcccagcacuugggaaaauagcaguggcugauccuaggauaguaauauuccuuccccuucuacaugcacucaccaagccagaaccggacaccuacuccaugccagccacugugcuggguucucagggucuaaggagcugaaaguaguacccccuucugccucuauaaccccucaagagcaugggacggcguggcucuuuuguuaggcucacugccugauuucuguuggaaacacuccccugcuuucccugggaccuggcuuauccauaacuaaggccuccucccaccccaucuguuccccucugcucaccuacuucucuacccacucaaaacaaagccucuuucucuagugccccccaccccucacauccccuggcuccacuggggucaagccucagaaggcaaacccacuccccugucacccaggugaagcggacccucuucaucaauggaaucuccaaauaugcagagucagaaaagaucaagaagcauuuugagugaguaagccacgcuucccccuacccucaagcccugcugcagagccuucucugccuuugaacucuaagaacauccuuauacccuagccuggagcucugccgugggugggauagagauuagauccaggaagaaauguccgauuccagggugguuuagcacuugggucgggugauaggccccuuuaagaacaggaaaaauaagacaaaaaccugaagagugagucauucaaacccccuaacccccaaaccuccuccuggcucagacugggucauagguuguugacccagguccauuggaguacauaucuucuucaaaauuaaaagcagcauucuggaguuugugugcagccaugacagggagaagcuccuugguuuccaguggauuccaaggaguccaggagaacuugaacuguguauucucugaggcuuuuucagcucuagaauuauguuuugggguggguagagcagaccuauggccagaaacuagagaaaagggaggugguauaaugaggcaaagagggaacuuaccuggucaccccauggcuagggaugcaccuuggggcgcagcucauaggguggggaaucagugaagggccccuccauggggguguguagggacagucucuauaccacaggauuagggcuacucucacacaggcaucuguucacucagcaaacuuucucaagugcuguuagucauaaguuacuguggugggcuuugggacuguaaaaaaugaaugaggccaggcaugguggcucauggcuguaaucccagcacuuugggaggccaaagugggcagaucacuugagcccaggaguugaagaccagccugggcaacauagcaagaccccaucucuaccaaaaaauacaaacuuagccaggugugguggcgugcgccuguagucccagcuacuugggaggcugaggugggaggaucgcuugaacccaggaggucgaggcugcagugaguccugugcaccacugcacuccagccugggugacagagcaagacccuguuucaaauguuucaaaaaauaaaaaauagaagaggccaggcacgguggcucacgccuguaaucccaacacuuugggaggcccaagaugggagaauuacuugaggccaggaguucaagaccagccuggucaguauaaugagaccccaugucuuaaaaaaaaaaaaaaaaaaaaucauugagggccgggaguuugagaccagccuggccaauauggugaaaccccgucucuacuggugaaaccuugucucuacugaaaauacaaaaauuagccaggcaugguggcgcguaccaguagucucagcuacucaggaggcugaggcagaagaaucgcuugaacccaggaggcagagguugcagugagccgagauugugccacugcacuucagccugagcggcagagcgagacugucucaaaaaaagaaaaaaaaaucauugaguucucaggggguucauaguauggcagucggcuuuaggagcuaguccagggucugaucagagauugcucugaggucagucuguggucagaaucaggagcuggccaguggucaugauaaaggaugcugguggucuggaucauggcccagacugagguugagauuugggcucagucuaccaucagaaucaggguuuaggccaggugugguggcucaugccuguaauccccuugagaagauugcuugagcccgggaguuuaagaccagccuggacaacaugucgaaacuccaucucuacaaaaaauauaaaaauuagccagacaugguagcaugcaccaauagucccaacuacucaggugacugaggugggaggauggcuugagcccaagaggcuaaugcuguggugaacugauugcgccacuguacuccagccuggguaauagggcaagacccugucucaaaaaagaaagaaaguaaagaaucaagguuuaaucugagguccagaccugucaguuggccagaaucagaguucacucauuguccugggucaggccagugugugauccaaucagagauaguguuugggcaggauugagagugaacaucuaucuggucagggucagauuccagagccuguguuagaagauuaaggacuggugugugaucagcauuaguagauggauacucuuucauacuacaugcaguuauugacaaccuucuaugugccaggcacaaauaaauuagaaacaagcccagcccuuauacaggcuauaaaacagcagucaaaauuagaucauucuugucaguaugagagaacuauuugggguccuaucugagguucaagcugucaucagcauuaaagggcacucugggucaggauuaaggacaguguguacucagaauuagugacaucuuuuuuuuuucucauaccaucuuuuguaacaaugaauuaggugacaucuuaauauuaccauccaguuggaaucaguugucagcuuguauugaaaucugguguuuguuguuuuuguuuuuguuuuuguuuuuugauacaaauaucuagugagcaccugcuaugugccugcuuggggaggagcuggggguauagcaguaaacgacagaaggccugcccucauuugcuuucauuuuaguggggagggguggacagggaccggaugaacuaguaauagagacugugucaagaagagguaggugcuaagaaaaccacagcagggaagcaggcaggguaagagggguugggaaggguugcuauuucugaugggauagacagggagggacucugacagcguggcauuugaacagagaccugagugaacccuacuagucaacugucuauucauucagcccacauuuauuguauaccuacuaugugcuucaugccugggagacagaguauaaucagaccugaucagugcccuugggaagcugaagauccuaguuguguuucagggguuggucuauaguuuuguuuaggagaggucagccuauaagcagggguaagggagacucuaguccuaauuggaguuuuuuggaucacugggaugagcauuauggaguagccauuucauugauccgcucauuuaccacauguguauugaacaccugcuauauacaagcuguugggacagggcuggguauauggugaggacuaagagacagcgcuugagcucauugucaggauuaggcagggcuugugguccaagucugcagucugucuggauuggaagacugucucagcacaauuaggaaauaucuugcaugcaaaucaacgggccugugugguuggauuuagaggauuagagaugaguuuagugagaaugagagcucacccuuccaaaggggaaaccucaaaugguuugaggaacaauaucagaggaaaggucucuagccuccugggaaguacaucucaaggacccuaucccagauuuaaguuucuaaauucucauggguuuaugaggacuaucuuaauacuuuagaacaguaacucaugcauucaauacuuggugguccuucauuuaaaaaaaaaaacaauuuuuuuugagacagagucucacucugucucccuggcuggagugcugcaauacaggggcguggucauagcucacugcagccuugaccuccugggcugaaucgauccuccugccucagacucccgaguagcuggaacuacaggcacucaccaccacaccuggcuaauuuuuuuuucuuuuuuuagagacagggucucacuauguugcccaggcuggucaugaacuccuggccucaagcaauccuccugucucagccucucaaaguuuugggauuacaggcaugagccacuguguucaaccuaaaaauuuuaauaaaauauaaaaagauggggacucagucuagauuaaggauuaggaucaaagaacagugcaugaucagauuuaaaaacgaacuacuggccaggugcgguggcucacaccuguaaucccagcacuuuggggagccgaggugggugaaucacaaggucaggaguucaggaccagccuggccaagauggugaaaccccaucucuacuaaaaacauaaaaauuagccaggcgugguggcaugugccuauaaucccagcuacuggagaggcugagacaggggaaucacuugaacccaagagguggagguuacagugagcugagauugcaccacugcacuccagccugggcgacagagcaagacuccgccucaaaaaaaaaaaaaaaaagcuauuaggcuggguauggcagcucaugccuauaaucccagcacuuugggaagccagggcgggccaaucaccugaggucaggaguucgagaccagccuggccaacauguugaaacccuaucucuacuaaaaauacaaaaaaaaaaaaaaaauuagccgggugugguggcacacaccuguaaucccagcuacucagaaggcugaagcacgagaaucacuugaacccgggaagcaaagguuguagugagcccagaucacaccacugcauucuagcccgggugacagagugagacuccgucucaaaaacaaaacaaaacaaaaacaaaaacaaaaacgaaacaaaaaacaaaaagaaacuauucccuccagccaugguggcucacuaguguaaugcccacacuuugggaagcugaggcaggaugaucacuugaacccaggaguucaagaccagccugggcaauacaacaagaccccaucucagaauauuugaaacaaacaaacaaacaaaaaaaugaacuauuccuucacucagcaagcauucuucaagccuugccugguaccagguacuagugagucagugccaguuucucucuggucagucuuaagucaagguaaggaugaaucuggggucaggguuaggaggucagucuugggucugggcaacaggucuggggucagucuuuggccagggugggcuuaagggucagucuuuggccaggguuacaggucagucucacccuggucaggggucaggaucaaucucuugucugucuugggccaaaguuagagaucauuuuguagacuggguuauggguugguugaggucagucuguggucaaggcuaaguguugggcugugaccaggucuucugggaacaggguuaaggaauuauauagccuaugacuagaugcaauuuuuuucaaccuaaaggucacagcccuggacaggaaucagaccauagcccuggcuucccuaccugcaugcaguaugucccuacacauccugguuuguuagcccagccugcagucacacagugcucaggccuucugcucccacuuccccacucagauaagcaugaggaggaacuccaaagcuuuauucuuggggaacucucaguuuuguagacuaagaaaaaggcagcuugaauuggagauguggguuuuuuugucuuuuuuuuugagauggagucucgcucugucgcccagucuggagugcaguggcgcgaucuuggcucacugcaaccuccaccucccggguucgagcaauucuucugccucagccuccugaguagcugggacuacaggcacgugccaccaugcccagcuaauuuuuguauuuuuaguagagacaggguuucaccauguuggccaggcugguuucgaacuccugaccucaggugauccucccgcuucggccccccaaagugcugggauuacagaugugagccaccacguccagccagagauguguuucuugaaggugauggggucauggaugaaagucaggggcagguggguggggucccugcacaagaugauacaugaacuguguuucagggaagccuaccccaacugcacaguucucgaagcccgcccguguuacaacguggcucgccuaauguuccucgaugcagagagguaagggacugggggcagaggagggugacaccaagggcccccugccauuguggaggacaucuuggcuaccacacaggcuccccuucuagauuuuuuccuagggcauuugauuuuaauucaacucguuggugugccuguuaauucagcucuggaaagagcaaggccuggagguuagaguuuguugugaggggaaggggggcccaugguccccacugcaucugaggacaugcccuucuuuggcuacaguaugagaaauuuaggucagccugcaggaagaacuucuggcccucuagggauggguggggagaccuugggauguggccacaucugaaacauguauccuaaacaagaacaagacagcuccuguccuuggggagugagcuagaugacccccaagcugagccagccccagccccagauguaggugaccaggcaucugggucccacaggaagaaggccgagcggggaaagcuguacuucacaaaccuccagagcaaggagaacgugccuaccaugaucaaccccaagcccuguggccaccucugcugcuguguggugcgaggcugugagcagguaugacgcgggcuggcuguugagucgggagaaguuggacagguccugggcaggcaaggcuggggcccugcccucagugaguccccaccugucccuggaauccuugaagccucaguucccacuguuggguuugucuaaugucccuacagugaccagguuuucaaaccucaaauuagaaaaugucagccaaaaggacaauguugugcuguacccacugacucuggggacuugagcaaguugcuuacugcucagugccucaguuuccucaugggguuaacguacccaccuuaugagaguguugugaggguaaagugaguaauacauauaaagaagcuuagaggugcugggugcgguggcauaugccuguaaucccagcacuuugugaggcugaagcagguggaucacuugagccaggaguuugagaccagccugggaaacauggcaaaaccugaucucuacaaaaaauacaaaaauuagccaggcaugguacugcacacauguauucccagccacuugggaggcugaggugggagggucacuuuagccugggagcuugaggcuccagugagcugagauuccaccacuacacuccagccugggcaucagagcgagacgcuguuuccaaaaaaaaaaaaaugcuuagaggagcagugccuggcuuguaggaagccccaagucagcgugggcuggaugcugcaggccccagccuggcuuuccaacuagaggcccugucccuaacccucccacaaagguggaggccauugaguacuacacaaagcuggagcagaagcugaaggaagacuacaagcgggagaaggagaaggugaaugagaagccucuuggcauggccuuugucaccuuccacaaugagacuaucaccgccaugugaguccccaacucggcccucggcccugagcagcccuccagggcucccugaccccugugcucauggccuucugccagcaguguggccuccaggugggccugugguaaccagugcccaucuuucuagcauccugaaggacuucaacguguguaaaugccagggcugcaccugccguggggagccacgccccucauccugcagcgagucccugcacaucuccaacuggaccguguccuaugccccugacccucagaacaucuacuggugagcaaacaggugucagggcaggcuuuccagggccugggaugggcucaguagguaggcggaggagagggagugucuuggugucacugggggccaauccugcccuugguuccuggacugaccgguuccccaccuugccagggagcaccucuccauccgaggcuucaucugguggcugcgcugccuggucaucaaugucguccucuucauccuccucuucuuccucaccacuccagccaucaucaucaccaccauggacaaguucaacgucaccaagccuguggaguaccucaacgugaggccucaugccccugucacuuuccacgcugggucacaacacacagauaccaggcccugaucccucuuccacuugcccagcccagcccguucugcuuguuccaaccccgugccaccaaccagcucccaaaaaccccugugugcacuucccuugggcucccugccaccuucccccugagagaggccacccucaggugugcaacaccuggagaaacacccagggaagagagagagccugcauuuaguccugaucucagagaaguccccuucccucaccccucagucuaacugaaaaaauggaaagguucaacuagaucaguggcuuuggacuuggauucugaucucuuuaucggugugaaacccaguguggaaaagcagggcugcuccgaugacaguaggguggcaugcaugucugccuggccuccccucaccucuccucccacgcauagagcauaccucuuuagaaccucagaguuugaagaaggacaguuugcaaaucacuuggagugauaauaccauaauagauaagacccagacugcauggauucaaaucccuaccucauggcuugcuagcuagggaagcuauugaaucuuuuuuuugccucaguuuacucaucugucaaaugggguaacagcauuauugugaggauuaagacauggcaaguacaucagcacugcuuagaacauaguagauguucagcaaaugcugacuaucaguauuauccacccugggguuauacauauggcccuggcccccacccucaccccagcccuccggauguucugggcuuccaacaugggagcccugagaguugugaggccaagggcccagcuggggaggaggcacauaagcaaagccaccugggcccccuagacugcccugccugacgccccccugugcccugcugcagaaccccaucaucacccaguucuuccccacccugcugcuguggugcuucucggcccuccuucccaccaucgucuacuacucagccuucuuugaagcccacuggacacgguaaggugccuccacucacaccacaccucgcuguggccugcccucaaugacccauccucucugggcagcacuuugcccuucaggcuccuggcccugggcagucccacagcugguagggaagggguagugcccagcacccucaccuugggaggcccacccuucccaggggacacuccuuggacauuguccuuguugggggagcaagucuggggccugggcucacuugaccuguaccguucccugcuccccucccuccagcucuggggagaacaggacaaccaugcacaagugcuacacuuuccucaucuucauggugcugcuccuacccucgcugggacugagcaggugaguugagaaggauggggcaggagccaggguagggggacagcaggauagggagaggagagcaguucagccucccuaccuccccuacaaagcaaggggcccaagaugggaagccuggccacccccaggccuccugagcuacccaccccaugucugggagucuccccaguggcucacagaggagggacuuccccuccccugguguucuguaccacuccagcucccaccccaucucuccucugcuucccuccagccuggaccucuucuuccgcuggcucuuugauaagaaauucuuggcugaggcagcuauucgguuugagugagugacuggggccccuagggaaagagaccagacagcagggguggguaugcuugagagacauugccagccccaugggagggugcaacaaagcuuccaacuccuggagggggcagaagagagaggaucuggcgggguuaccccaaaggcacccacaaggugucuuggguguguauacaugguagaagucccuggggucuguguugguguucacucucugguaaccuguuuggaugcuaagaucauccucaagguauauuuggggcuuggggcuccacauucugguaguuucuaugggggugucuugugcccauauucugggacuaacugugggcgucucuggaguuccacuugggagguuuggggaaccaucucuagggaggucuuggugauacuuagggagugucuuggaggcuacuagggguaucccugaaggucucuagagcccauauuuuuggguauguguaggaggcucuugaccuuauaacucugggggugucugugggcggggaggcuaaaggacucacacuuugggauguuuagcaguacaaguucugggaacaucucuaaaauuucaggcuuuuauucagagauguaacuguggaguucuguaugggcaucuucucugggaaucaugugaggauauauugaaggucaugcaccauggcugugggcacaaacucuagggguuuugcuguaggccaucuguggugaucuuugagucacacuuggggcaucucaggcacugauaaagguuccugggcucccccagagauguugcgggaagggucucaaagcuuguuuguggagguaucugaggcucaugucacacucuggggguaacucgaguuauggucuaagugggggaaucuucuggguguuccuggggcugucagccuuuggguucuuugagggucucauuggguugucuuuggggguccuggacaguucuccccugaacauucuagcagccuuagguggucuugagcacucucuccaugggucuuuauggggcacaaguucuuggagcugucuguugccacucuguaugucucuggggggaacagggcacaggugcuuggggcgcuaagcuggggguguccacauggaagaagcauguuggugguggagguguugggugcuguaguucuggcagugggcgggcggccaccgggucaccccaagggugcagugcuggagcaccuggugcccgcagguguguguuccugcccgacaacggcgccuucuucgugaacuacgucauugccucagccuuuaucggcaacgccauggaccugcugcgcaucccaggccugcucauguacaugauccggcucugccuggcgcgcucggccgccgagaggcgcaacgugaagcggguacggccgccuggggcagcagcggcccgcacagcgcccccugguggcccaacaagaaacagcagccaucgcgcuaggguugaggggcacaggagggcugagacuuggggaguacaguugacucacgguggauccgggccauccccuucccauaucuggggccuucguauucugccauggguggacauagguaacccugaaggccccugccaguucugacaguagcauucuaugaugggaguuggggagaucugggucccuagcgcuagggucccucugucuuaauaagagggcucugggcaucccacucucaaguccacccaacucuugcccccuaccugccaggccccgacccuugaaggccccucuccgugccccaucacugcaaccgcccugacccuccucucggccauagccccucucuccaucugcucugcccuacccuacccuagacauuagguccuguuccccauggcuucuuuuccggccccagagguccuggcucccuucccccucccuccuucccugccccucuggucagucccugccucccugagccauccuccugcccgucucccccccagcaucaggccuacgaguuccaguuuggcgcagccuacgccuggaugaugugcgucuucacgguggucaugaccuacaguaucaccugccccaucaucgugcccuucgguaggcaccgccgcgccgggaccugggcccugcucggggggacccaggacuucacccucuccacucuaggaaugcaggccaccccgaguggacagggcccggcugggagaccggccccucggggcucccgcccggucccuggcucagucuggggccuggccuguggggaggagggggagagccaucagcucaggccagacccagcuggcaugugggccccagggcaaagucacaccaacauggccauacuuacccacaccugugccuucccucagcgggaugugcuuggacacagaucacauacgugcugacauguucacacacacacucccacacaggcauccaugugcacacuuuuacaccacccuguaaacucaggaaagacuuggauuccagggugggauggguccuugccacucauggagauagucugcuguaucugagcuaugugacuuggccaggucucucuuccuuuuugaaguuuagcaaaguuucucuuuaaccaucacccccacugguagccucuacuuuccucccuaauaacauccuaacuccuuaaccaacccucccugguuauugaaggcuccaaguucccaaacuaacuuccuuguccucauuagaaacucccuaucccucagccucuggggaaauagaacuugucccuuaauuuauacguaucuguuuagggacaggguuagagaaaaaugauacggguuuuaagaagaugcuuguugauucaaaugacuagauuuccaauaguagaauuccugaugaggagaguagaaugagggguuguagcggaggaagcugaaguucugugaucacgcuggggcacggggcacuaucccguccuggggcccgggcaggaggagggggccaacccuucagcacucucaggaccagaacaaccugugacagacacacaaaagguucggcagcacugguuccgaggucagggcccauguggcuucccuuagggcucauguacaugcugcugaagcaccugguagacagguacaaucucuacuacgccuaccugccggccaagcuggacaagaagauccacucgggggcugugaaccaggugguggccgcgcccauccucugccucuucuggcugcucuucuuuuccaccaugcgcacgggugagggaucccuacccagggaacgggggguggcgagcagaguggauuccagccagagcaggccacaggagaagccgcauggcuggggguggcaggcaaggggccugggagaggcuggggccagucuguagcaccugggagagugaggacugcauucagaggguaucagaagcugggguggggaggcccacaggagauagcaaccccauucuuugccccccaacaccaggguuccuagcucccacgucuauguucacauuugugguccuggucaucaccaucgucaucugucucugccacgucugcuuuggacacuucaaauaccucagugcccacaacuacaagguguggggcaaggguggcaggcggauggcugcgggcaggagcucaaggggaggaaugcagagggccacagggcuggcgagggcugagggcagcgccaacagggccaagcgggcguggggucaugaucagggcugaggacaugcccccacuuccugacucauucugggccccucaagauugagcacacggagacagauacuguggaccccagaagcaauggacggccccccacugcugcugcuguccccaaaucugcggugagugcccucaaggguugggaggggccucugacagacucagccucaaagcccaguguucccuuaguccugcagaaaggggaaccugugccagaccccaugggggcgggaagagagcuggucucccuggagggcugcccccgccccccagggcccugcccacucugcuguccuacaugcccugguguucccgcaauccaugaggggcagcuguucaccuugcccccauuuccucuccuccuucagaaauacaucgcucaggugcugcaggacucagagguggacggggauggggauggggcuccugggagcucaggggaugagcccccaucauccucaucccaagaugaggaguugcugaugccacccgacgcccucacggacacagacuuccagucuugcgaggacagccucauagagaaugagauucaccaguaaggggagggaggggcccuggaggccacauccugccccaccccacccccacucccacggacacuaaaacgcuaauaauuuauuagaucuaaagccccuuccuccccagccccugcuuucauuaagguauuuaaacuuggggguuucacugcucucccccaugauggagggagggagccccccaaccucagugaggagagccccgagccggccccggggcaaagaggggugcagagggaguucccccagaucaguaccccccaccccuccccagcuaguagcaugaccaggagaggguuaaugagagccaagaggaguaccuggugcaccuggugccgguggcuggagaccuggggggcagguggaucuggggcuguuccccccccuccguuuuuuccaccccacaguuccuccugggaucuggcccuccagggaaguggagccuccagccccuaggggaugcaugaggggggagggggugcugagugggaggaagagucaggcucacagcugggguggccugggggugggggugggcaaggcugacacuggaaaauggguuuuugcacuguuuuuuuuuugguuuuuuuguucuuuuuuguuuuuuuccuuuaaaauaaaaacaaagaaaagcucugaggcagg

SEQ ID NO: 18360 - RNA, 1422 nt, Homo sapiens
ccuugguuucuucuuugugauaaugggcuccagugauaagaauuggacaaaaugaugccugcaaaguguucaguggcacuugagggaagaguagccacuguccugcuuuuugccuggggcaggccuggugcugcaggaucugggcagaggccuccuugaucguccccacccaucaggcaagugaagcccuuagagguggaacuucggaggguggaguccccggggaguggccaccccugaggcuccccagggcccugacagggaguugggagguguagggaaagugugaagaauggcuuccuugcacacucgacuucaugcacuuccagguggcggugacaauggucaggauucugcaguuauaugaauggccaccaggagucacccucagcucaugcuugaagugaaggcagcacagaaaaagggaaaggagcuguaagggagaaaaggaggaggacaccccaccacagaguggaugagccuggaggggacccaaggcugccagaguggcugcuucauuucugcaggaaggugcaggacagaacucagacuggugggcaccgugccagcaggcagaggagggagcaaaggcucauuugucugccuucggaauucuccuucccaugcugaugucaaaucacaauucaacagauucuucauggggcaccugcugcacacagagggacaggaaucuuacugaacaccuaguauaugccagagccuacacacacagugggcuacucaacauucacaacaacucuguacaguaaguacaaauauuggucccaagauacagauugggaaacugaggcuuauaccaguuauguguugugcccaaggucaccaagcuggaugaggacugacgccugucuggagccuaaauucuuucuccuacaccagauugacuuccagagaguucuaggauacaaagcuggcaacagacuuucugccacguagagggauauggcaggugacaacccugucuggcucugcuaaucaggauccaguaagaagcucaagacagguggccacucugcugguaggcagaggagggagcugugcucccugggguggguagaaguaagguuugugugggugcuggguguuggacacgggcaggcugcagacauagcagcaaugaggggagacucucucaaccugcccauguccuccucugagcaaucuccccgccccagaauuauuucaguuuccucaucugucaguucuagggguggacuucauucauucaauacugugucccugaccucugcucccugccaggcucugaacuagucaugugucaggcuggauacuuagauggacaagacaagccauccccugcccacagcugccccaccugaagucuaggccagugaccuccgaaguuuuuuugaucaugugcccuuagcaauaaaaaagauu

SEQ ID NO: 18361 - RNA, 1422 nt, Homo sapiens
aaucuuuuuuauugcuaagggcacaugaucaaaaaaacuucggaggucacuggccuagacuucagguggggcagcugugggcaggggauggcuugucuuguccaucuaaguauccagccugacacaugacuaguucagagccuggcagggagcagaggucagggacacaguauugaaugaaugaaguccaccccuagaacugacagaugaggaaacugaaauaauucuggggcggggagauugcucagaggaggacaugggcagguugagagagucuccccucauugcugcuaugucugcagccugcccguguccaacacccagcacccacacaaaccuuacuucuacccaccccagggagcacagcucccuccucugccuaccagcagaguggccaccugucuugagcuucuuacuggauccugauuagcagagccagacaggguugucaccugccauaucccucuacguggcagaaagucuguugccagcuuuguauccuagaacucucuggaagucaaucugguguaggagaaagaauuuaggcuccagacaggcgucaguccucauccagcuuggugaccuugggcacaacacauaacugguauaagccucaguuucccaaucuguaucuugggaccaauauuuguacuuacuguacagaguuguugugaauguugaguagcccacuguguguguaggcucuggcauauacuagguguucaguaagauuccugucccucugugugcagcaggugccccaugaagaaucuguugaauugugauuugacaucagcaugggaaggagaauuccgaaggcagacaaaugagccuuugcucccuccucugccugcuggcacggugcccaccagucugaguucuguccugcaccuuccugcagaaaugaagcagccacucuggcagccuuggguccccuccaggcucauccacucuguggugggguguccuccuccuuuucucccuuacagcuccuuucccuuuuucugugcugccuucacuucaagcaugagcugagggugacuccugguggccauucauauaacugcagaauccugaccauugucaccgccaccuggaagugcaugaagucgagugugcaaggaagccauucuucacacuuucccuacaccucccaacucccugucagggcccuggggagccucagggguggccacuccccggggacuccacccuccgaaguuccaccucuaagggcuucacuugccugauggguggggacgaucaaggaggccucugcccagauccugcagcaccaggccugccccaggcaaaaagcaggacaguggcuacucuucccucaagugccacugaacacuuugcaggcaucauuuuguccaauucuuaucacuggagcccauuaucacaaagaagaaaccaagg

SEQ ID NO: 18362 - RNA, 1847 nt, Homo sapiens
aaugagacagggucucacucuguggcccaggcuggagugcaguggugcagucucggcucacugaagccucgacuuuccagaccuaagccauucccccaccucagccuccugaguagcuggaacuacaggcacacgccacuacgccuggcuaauuuaagaaaauuuuuuuguagagguaggguuucacaacauuguucaagcugauaauuuagauuuaaauggccacauguggcuaguggcucccauacuccguggugaggucuauaauguuucacaagggaggccuugaacggguggugaacagauuuaugcaaaacaacccucuaaacugcaaucccauugguaggucagagcccauuuucucacccuugcaggcuugaaggggcccaagguuauuuuccuuggagauggcuccuggaagccuggguggguuuccucacuaccucccuacaaaagccccuagguggcugaggggcccagaggaacagggaucuggcuagaaagcaccuguucuuaacaaggguccccagcagccaggcagcccucccuccacagggcacggggcugucgcugccugaaugagggagauuuauggaaaauccccucacacaacaggcggauuuuccaagccucauugguuguucuggucugagccuucauuaaggggaacaggggacaauggaggagguaggggugaggcccuggguccauucagcucucuauccuuuggcacugggaacuccaucaaggcccccccaacccuuuccuggcuugaggaaaggucacacucucuccccuuucaauaguaauaaaaggccccaaauauccagcaaagucagacucggccuuugaggaauaucuuucuugcauuuuaaaagauuuccagaagagauauucuuugguuuugcuuuacaauccucugugccuuguaaugcacggucuuggaaguuccucccuacagcuaaccuaauuuuauuacgcuuuaggccugccucaguaggacuucuccuuuaaaguuacggcaacauuucaaaguagcaagaucaauugugugacuucccaauaaaaauccuugauuggaaggagaaaccacuggcuacuagagcuggagggacccuagagauuugcaguccguuccucacugcgcauucagagaguguaccgcccaagcagguggugccacacuuagagccagaauucaugcuccaggugguacccaccuguauaccagcugccucugcugcagcacagucacauagagauccagagacccauugagacaacccuuccagaggaaagagcacugcuugacccaggggaauggauuucuaagagugaauauuaggucucaucccaaaggcuuuuugucuuaaagccccuuccagaaaguacucaguauguaguaaggagaucagugggagugucuuagagguaagaccgagaguggcccuuugaagguggcgagggaagagaagggugaggcauucccaggguugcaaagacucaggagggcuauggcaggggccuggggcgcuuccccuguguuggggaugugacugaggcugggcauugcucacugaguagagucgaugaguacagccaguucccuauaaugguggguguccagguccugggaggugacucgccuugucgagggaaacuggugggagcaggagguguuuaugguuuucccucuccugggggcagcuggagugagccaaguuuacaguugcccagaacucuauaaacacacuuggugagcaugugugcguaugugagugccugugcgggugaguguccccugacaucugacugucaccccugcugggcggcccugaccuuccuga

SEQ ID NO: 18363 - RNA, 16282 nt, Homo sapiens
cuuugagaucagaauuaaauucuuuaauacaaaaugcuuuuuuuuuuuuaagauauaucuguauuucuuugucguuguuuaaaaauaaauauguacuacggaauaucucgaaaaacugcacuagagacaaagacgugauguuaauaucuuuuccccacaauuauuacggauaaacaguagcaccaauaaauaaaugauaacaaauauuaaaauuaaaaaaggagagagauuuaguauguagaauucucuauuuuuucuuguuuuguuuuuacauauaaaaaacagaauagcaaugucuauuuuaucagaaucacauauauacauaaacauauauauauauauauacacacaaauacaaguugccaaauauauauauaguauguagauguauauugaaaccuuauuucaaaggaaugugugcuggggagccaggggaucggggagggcagagcugaguguuagcaaaauuaaauaucuguucaagauaagcuagugacugucaccgaucagggagagagagauuggaaacaugaauuuuauauacaaaaaccgguacaaauaagagagcaagagagagcaaaagauacaucucauaaauaguugaaauuaaauauuaaccaagaauacugaaaaaaaacccuacucuuuaauuaaauuaacuguuuuaauuucuaauuaaaaagggauauuaaauaaguaccguauauaaaacacuuucucuuuucucugccuccacaaugggcacguggauccugcccugucucucugugccucgggaagggaagggaaggaccaggggauggaggaaggucaaccacucacacacacacaaccaggucuccuggggggacagaacuagugguuucaauggugugaggacauagguccuuuuaggcugcaccccaggaaggggagcaggaagaggaugagggcgagucccaggaaggggagcugucaugggcugcuucuuccaacaaugugucucuucucuucgccgggacaucugccaguggucuccugggcaacucagaagcaggugagaguaagcgaaggccgcccaggcuccugaaucuuccaggcagugccccugggggcgagaugcgcgugcagcauguggagggaauccccaaagcacagcaauguccugaagcuccccaaacuccuggucagagccgguguccucaucccuguaccugugaucugucuuucuguccgucugaccugggguagagaggcucagcgccagggcuggguuugucgguguucccaaaacugggucauauuugcccccaugcccuggccuugcacauuccugggcaggggagaggacccuggccccaccaagugggacaaaaaaaagaucaugccagagucucucaucuccuccucuucccugucaggaucugagugggaacauuccccucccaacucaaguccacagcagucaaauacauccagugaagacaccaauaacauuagcacuguuaauuuaaaaaaagaauauauauauuuuauauauauaaaauagagauauuuauuuuuauauauauauaauauauauauauauaaauguauguaugugggugggugugucuacaggaaucccagaaauaaaacucucuaaucuuccgggcucggugauuuagcagcaagaaaaauaaaauggcgaauccaauuccaagagggaccgugcugggucacccgcccgggaaugcuuccgccggagucucgcccuccggacccaaagugcucugcgcagagucuccucuuccuucauuucagguuucuggauuaaggacuguucugucgauggugauggugugguggcggcagcgugguuucuguaucgaucguucuguaucagucuuuccuggugagagaucugguucccgaaacccugagggaggcuccuuccuccugcccggcucaccgccucggcuugucacaucugagggaaauggaaaacaaaggcugggguuagggccaagugaggaggccuggcgaugaggcaggcggccuccccauuccugggggccccugggucacugcagccuccggcaccauaagagcagagaggacaggaaggugugguccuggggcagaaagccccaguaugagaacagccccagcccugcccucagggagccccggccugagcagcagcuccacucaggggcucccagucuacccuccugagcuugcaaucuacuugagacaagacaaggacaugggaacacuuuacaaagcaacaaaugaacggauaccaaagaacaguccccacuugacauuuuaagagcugaugggugaccagagcuggaugaaguuaaucagaagaggcucccugcugaggaggguuuucaguucagucucuaggggcugguguggggaagagagugggcagaucuucugggagaacgccugaggcagagaggcuuggccgggugaccaacaauggcaagggccugcccuggggacaggaggcucccgaggggguagcguagagcaggaggccccaggaaggugagggaccaucuccauuccccauguccccucccacuguggcuguaggccucaucucucuugagcugccuggagguugcaggcccagguaacagguugucuuuccuuucaaauaugcugcuucacuuaggauggggagagacaauucggcggcuucacuacuccagcugaagcaaagggggccuccaagaacuuucucagcaugccccugccccugggugauugugagaaggaggcagaacaggcccuacccuucuggggagccccgaaacggaguccuaagccuccaauuuuggaaacugauauucccagauacagccagcuuggggguuggguaaagguauugggagguuagaguaacuucaguuagcucccaggucacuucacacaaacccccaucagcagaauaaucaccuaaaaacccuaaaaugucaagucccuuaucuuucccaaggaccccuggggaacugagacuccccucauccagcccugaaguuaggcagagcccccaccccagcacuaauauacgcccucuugguuucacauagggccaagacagacagcaccccacaccaacuacccaggccugguucccagcauccccugagcacacacaagccacaagaacauugcugggggaggggagacacuccaaggacuucccuaacacagccucggggugagcugggggugccuuggcccugucuaggaaauccccacaaagucuugccucccugacugacgcuuacccugacccccagggccucccucacucugagcacaggccaaguugguauaaagaacauaagcuaaggcauuaaaagaugccagccaccugucccgacccugugcuccugaccucacccucugaacugagucacacauucacucaugcacuugacacuuccuugguccccaguaugggcaaaggaaagagguacagaugcccggggcucacaaagguacguaaacgaggcccgggcuuacggagcucacaggcuaaugucaggagaaugggcacagaccccucccuccacgcauccugggggcacuugaaaaugugugggcugcuugggguugucaccaugacugguggaggauuaaagguaucuaguauucuuggaugcuacagcuccuucaguguguaggcaaaagugccccauccuaaacgaacagccagaccccuugcccucagagccccagucugaggagggagacauagcccuggccugagggagccucagucugagcggggagacagcccuaucagggagcccaggucggaggggagagacacagcccuacccucagggaaccucagucugaguggggagacacaacccuuuccucagggaggcccagucugaagugggagacucaauuccuucccccagcaagaaacacugagugagugagaagcccagccaugcagacuucaaagggccgaggcaaggccccagcgagagcaucugugcuuuguugacauuguccacaccuggaaucggcuuucagcuucucagcauuacuaccagagguaguaauaacaucaggaccaacagccacuaugagcagaaggaccacaggacacaacacacagcuugcguccacaccacuacacuaagccacaccagccuaccacucaggcaaccagggcaaccucggaacaggccccgccaggcuggaccagugccugcagcccaccacaggggccuuaaaagcagagaaggcagcagucaccaggcaggcagcuagaaacugagcaagcagcuggccccucucaggcgcucucccgcucgcucgcucgcucacucucuuucucucucucucuccccaucucugugugaugccccucucugacuugcuugcccucugggaaccaaccugcaaguacguucguuuaacucaagcugccucgccuugcaacgcgagucuguguuuuugcaggaacauuuacacgucugcggaucuuguacaaacaaaugcuuucuccgcucugagcaaggcccacagggacugcaaaaaggcaaaaggaaagacaucuaagcuagagcaucagcagagagagagaaaaaaaaucaccaugcaacacccccuaacauguccgcagcugcacccccacccagccggucagcccccaggcccuggaaggauccgagcgcuacagcaaaagacagagagagcggcggaaagaggcagcacuggcuaggacaccugccgcaggaagaggcgggcacagacgggcagagagugcagggagaggcugccauaaggggcaaugcugugucucugggagacaagggugagucucaggccacagggacccaacugcuguugcccccaucggagcacgccuugacucuucaccugcuggggauggcaaucaggggccaccuucuccccgugcaaggcucauguccaggcccuuccaccaaggugggcuaaaguagggugugaugggaggcuaagcccggaggcgguguccccaggccaggccgcugguggccagagggcccagggcagggcccaccacagccuccgacccagaggaagaggcugcccugcaaggaggccucugugggugccauggguugggccggaauagggggcuccccuccagaggccccaccuccgugaggagccagggcacuuccaccagaugaagggaggccgccacauggugucugaucccacccaagcuccuccuucagccaaggagucauucagcaagcugccuccagucauucacagcccuucuugggccaugucugcccuccccaccacccucagcuuccagacgagugcagaagccuagagcaauggaaaccaguugggugagcaggcaccugugccaacaugggcccgccaccagugcccagugggugagagaaaaucggugcccagccaagccaggguccccucccuuaauccuccaggccaagucggcacccccauucaccccaacccuggaccagcaaugccaccaccaaaucuacccguuggugccaauuaguggagugagagagugagagagagacacgggccaggaggaugagagccagggaaggaccaggggagggaggcaggguuacagggaauggcaggcggagguuguacugggggccagggaggcuccagggcauuagacagcagcgggcaccaacguacacgcuccaggacuuauaccgggauuucuugcgcuuucguuuuugccccuuucccuuuccucgaacugauuuucuggaaaauaaaaaaacagagacagagagagagcgggggcgguggggggaguaaaagaagugguaaggugggcagggaugggggaacgaccaaagcaaagccacacagggccgcuucccggaggaagugucaggaggcagguggucucuggggaggcaugcgcgggcgcacacaggcgugucugggcagcaagcacucgauggcucuuucuucuccucacgcugcccaccaugggauggcaaacccagccccugacaaggcuuuggugggaagccgagacuggguggagggcacaggacccaaaggucuccacacucacaguggcucccaguccccggcagggggcaaagccugagggaaggcucuuugcccagcagcccuguccaagucugacccugaagguccgggggugauaaaagguaggccagacuuuggggagaaggucagagaccugccuggauggggagcaggagugggagggagggcuguguaucaggccuugugccuucauuugcaacugcgacagaaccucugggaaucccggugugggggaagcggcuaccuugggagcuggcacggaaccaagagcaacaccagccugcucagcacgaccuggacugggaggcagggcuggguguccuggagcccugggcaggcagcaggauggggugggaguuaaggaggucuggggaggagaggcuugggcgguacuuggcagggaguucucuccccagccugucaaagccugcuacaccaucucaccagacacucuuccgagcccaggcgagcccccuacucuccccauggcagagcagucauuuggggaaacaggaaggggggcaggcuguagccuguccccuucaagagaaccagagcucuccaugccugccaagcccaagagaacacaccucaggaugucugucacagggaagaaaggagggggagaagggaccagagagggcaagucugucccccuuaggagaaagcaccaaaggguggaaggaagguuuccgcauccccucgcucuggaagcugggagcugagggaagaggcaagggguugaggccuggugggggcuucaauguccgcacagcacuggaggcagacaagauggugugggggaaagggcagggcacaggugcucucucucagucucucuuucccugcaagcucuugcugaugccagccgcccacccugucuugaaggguuacugccgccagaccuugucccccaccccauccuaccugccccuuaacacggagcacucacaagccucugaaaaugaccaacauucaacuuuuucucccuggccaagagggcugugugucugccgccugccgccuacaggagggcaugcacugagaaaccacccuccagccggccucgcauccaacugcaccgucacagcagccaccaaaagaggccauuuccucugacacacaaaagcuggccucucugccacccacucccucuccccacuguggguguccuagagcaagccagugagccaguguccacagugcccccugacacaccgaaacagcaaguccuggucaggaaugaucuggagacccagaaggcauugucccuuccaaaggaagugccaggcuccuggcuauguuuucucacuagcccuagagccaucauccuggaguuggcuccaucccauuguugcugccaccacaagucccccacaagaccaagucccugacccagggaggcuaugggagcccccaacagagguagccaagagccccaaaccaagacaaccggccauggagagggagaagugcuaaagucagggccacuuacuuuucuugucuugcucuaucuuucuuuggucugcaauggguagggagagagaaaagagcaaaacagggaaggguuaagauggugaugauaaugauagggauaacaacaauaauaaucacaguaaaaacagcauuuauuauggagcaacacuguuuuaaucuuuucauauauaacuuguuuaaucauuauaacaaugcuaugaaguauacuacuauugugcccauuuuacagauguagaaacugaggcacauugaaguaaaaugccaaaggucacauagcgggaagcuggacgggggccaaaaaguacagcaugcuuaacccuggcacagaucaggcacccugcagccacuugcugauaaugaauccgugacuacauccucaccugcauucacauuuguugugcuguaggaagcucaucucuccuaugugcuggccuuggugagguuugauccgcauaaucuggaaaggaaggaagcagaucacagagguuagugacccagccagccauacccagaugggacaacccuggggcuccugccacucagcacccagggguucugcagagcagggaugggugguggaggcagggaggaccaagagcucuagcaggaaagaggcucaggcccaccccaacucccccaacccugcuggccucaaggagcccuuguuccacuugaggccaagacauggcugcaaggguuggccaggcugggaauucaaauccuagguucuuaccacuccccauccccuccccuucuuucauccucucuaggcuucacccugacuccuaguagauacccgaaagcaacccccucccuguguuucacagcucccucccacccuaucugggcugagaugugccccauuaccagguaacaccaaaagacuuuuuaaacucuccauggaccaggcucauccagcuucccaaacaaagcccccaagaagggggggcacucaggacucucuccaagagagggagagaggggcuccugacacaggcauccaucuguccccuccugagcccaugggcaaccaucagggagaaggagaugguuggggcuugcugggaaccugggcugggaaugaagcaucuucuccacagaaggcaagaccccaccauaccuccccugugcaacucaggggcaggagccagacaaggcaaaucuagccaggaaacgaccugggaccaccuguucccaaaguguuaccccccucccuaucccccccuugccccacuucccaaagaugcccaccugcauggugauguuggacuccucagugggcacacacuccaggcccucgucauugcagcagcccccgcaucgcaucaggggcacacaggauggcuugaagauguacucgaucucaucaggguacuccuggaagauguccaccagggucucgauuggauggcaguagcugcgcugauagacauccaugaacuucaccacugcaugagaggcgaugacacaugagcccggugggcgacacaaaagauggcuagccccucucuccacccagcucuguaaugccacucuuuggagcuuccgaaucaggcaaguccuuccaaaaucuaacguaagucccuccuacuguguuugaagcacuucccuaagcuuuccaccaucaacacuggugaaggccuguuuucauuccagagaucacacgauguacucaaguuccaagggacauggccugccacaucugaucccgccaccucacugugacagcugaacugaauccugggccaaccucgaugccagaggacagucugaguauggguauaccccauggggaugcucuaagcuuucccuaaaaggaggaagagccagcuuugccaagcuagucuccaguuuccuacguccuccccacaaccacuaccauaacgucaaccauaccaacagcuguuuauugagcacuuacuacauccugaguacuguguacaguaguccacagcuaucauuucacacaaguuucuccacaugguacuauuagacacuauugagauuccauuuuacagauggggaacaggaggcucaaagaggcuaaguaaguugccccaaggccgcacagcuaguaaguaaaggagucagaauuagcugacaucaaaguguucccaagccuauauuaggcaaaaacagaggaggcaccuuucaggaggaggcaccuuucccccugccaguccucuuccccagacaugagcugagaagguggugggcaucagcacaggggcugggcccuccuggaacccacagguggcagugggcggacacgcugugccagcccugccagccacugauaaccccgcccaagagggcaaacugcuugcaucauggaaaaaacagugcugccacuguagccacgaaacauuucuagaagcugaucugaagggagaccaggguagagacaguuucccaggcuggccacgaagccuggggugcacuggagcaugaagggguaauucugggccacagaggcggggcccuugagaauaaauaaaugcaggacucuggcaugacuacuccaaauuguggcccagccugccacgccuaucgcaccccaccaccacuaccacauagcaauccugucccugaaauagguucccuacccagagggaagaaauaacaccuggccagugaggaggcccaggcucuggccaugaguugguaugaccuugggccagucccuccccucucuaggccuccaacucugcucaacuguguaaguggguugggcugaucucuaaagaugcugaaacaggcugaaaaaggugguguuuuggcuuccauuuccagcccuaggaacaagugcucuuuuuucagccuggguaauaugaaguuuagaacuucaccaaagcaucuuaaguguaugcuucguggacuuccaccccagcucccaacccccaccccccagagaccacagcugagccucccccucacuccucccuccaaggucugcuuuccagaagaauaaaggacaaugaggggggcuauguacacaauagguugauugggaagaagguggggagaaggccacaggugugaaaacagaaagaacaguggggaaacaggccaguccacugcuuccugugaggucucuauuucuuuuauccagaccaccaaugggcacagaauccuucucuacccacgaaggguuacggcaaagcaucaucaaaaagagugaacgagacuagaagucugaaaaggucauuuuuuaaagccaagucgauaggggagaagaugacuaaucaagaaguuuugaacugccccuucaucacaauugggacagaggagggccaggcuuguggcccaggaggggauagcaggaaggucuggccugggcaagggguugguaacugaggguaaaaagaccugggguaggaauucccccaaaaagcuuccccuuggaaugaauccccaagucccaugggagguggaggcggggaaccucacccgcauccuucaucaggcagccgccccuccaaggagggcuggccuccacugccugggggagcacacacguacacuccaacaaccaggcuuucgugguuuuccuuauuuaucgcagacaaccuuuucuccagcaaacaaagaccuuuguccugccucucccagaccagagaccacugggaagcuggaagggguaaguggcgcacuggaagcagggggccggucaguggcugagaagccagguccuaggccaaggaaagggcuccugggguggggaaggaggaggcagaacaggcugggcaucaccacugcuggccacuacccagccacgccagauuuaggucagggaaacucgcgggaaggaagaccccagggccuucccuccccagagguggagagcacaggccacagucagugguggggagagccaggguguccccagagaaaugggaggauccaaaccacaacggaacaaaaggcaggcggacucgggguugggcaggggggcggggcgccugggagcuacagccagcccucugcuggccugggagggaaguucacagcacccgaacauagucaaaugggguuuucuccacccccaaaggaaugcaaaccagggaagggaggagagaucccauuaggcugagcccucugugccuccagcucacacaggaagggucacaguucccacaaaugggacaugucuauauaggaaaugacacuaaauguccacucuccccugggagcuaggggaaacaagggacacuucccccaacaccuaggaucccugaacacugucuuccugcucugugcgcacgacuccuucuccaaauaaaauuuuacuggaaagagcagaagaaaaaggcaacaaguccuacuucuagcagagaccugaacagcggagaguccucacgaaacugagggugaaccucguggugcccagcucuuucuuucuugauccuuauauuccugugccccuuccccuuccuccccacaguucugaagaaaaaggaauuaggccauccacccauccccugagaggacagggaaccccauccaacagccagggggacucaccuucgugaugauucugcccuccuccuucugccaugggugcagccugggaccacugaggacagaaagagagcaaggcaugggcaugggcaggggcuggggugcacaggcccagccacccagccccuccucccuccucacuucccucccaccaacagccucuggcuucuccaagucuucugagucgaacaggacacaaccggggguccccacgggcacagaauaugcccaccacuccuggacugcuaugguuaugaacccgaggaaguuaaagacuaaccagauguugggggcuggggagcucgaaaugcaggaggaaaaccccagaaugcuucacugucgagguccccuguaccuuccccacacuucccucucccugcucucacuaucccccuaguucccugguccaaagccaugguaaguauuaaggucaaauaggaggacaaauuuggacuggggcaggaaggaaggacuaggggcgagaaaaacaacauggugaccuucuccugcugacaugacaaauaccagggugagcugguguuggagacggaggggggugccgaggaccgaagggcaccaaccacccucccccauccaagcucuucuaguccuuaggaauaacccagcaugcccacagguugcuuagaggguaaaaacccaggaggagacccugggggagaaccacauuuuccucucuacacaaaucucuccagagccucaauagauuuccaaagccucaccugucucccacuccuaccuguucccugguuucuucucccucccagggugaggaggugccaagccccucucaccugggcaccuucaaaugccaccagggaccagggaaggcuuuuaugccuuggcacugcccagccccuagggggcccccugcaccaccuuaggccugaggccuccucuaacccuccccacccgcaucagaucauuccuccccucgccagaagcugugaaggucaacacgccaagacaugcggaccugacagcacccaaaaggaaaggcuucugccagcccuuccugggggucuccagcucucaccaacuccccucccgcccagcacucgcagagcagaggggcacucuagccuacggaacaccagacccugcuaggggagagucccacuguccaucuuucuuucccucuccuucccacacaccccaaaugcaccccacucagguaccccagcccugcucccagagacagccaaggucacaggaagccccucucaagagaaaacaacaguuaccaggcuuccagcuggacagcuuaccacugcggcuccugcagggacccccuggauucugcaccucagcccccucacccauucccaugacacccccugccuucccccugacaauauucucccgggacccuccacuccuccugggccccaaggaggaaaggggacggaaauuucauaccccuuccaaggccagggagcacaggaggggcgguucuaggcaggcaggggccagguguccuucucugggggccucugaaggucacacuguggccaggcagccacuccucccccuccucccuacuuggaggccuguagccaaggccuuugugccagggucugaggaacuugcgguguuagcagcgaccccuguccauggcuuuccucuugccuccucuccaagggaauucuggcugagggaaggcgucagagaggagcggaaagggacccuuuagagucccuuucagaagcaaguugggugggcagguuuggaguuccaaaaaaacaccugcuccagggcugccuuucaccaggacaaagugugugcaaggcuggcaggagcuccuuuccaggguucaggaaggacuauucccaugcugcccgugucacagcaaauuucaagccauuucuccaaaaggguaaaguggggcaaugacucuucaaauccucccuugacccacccccacgagagcuaaagcacagcucacucggaacuguuggcgagggaagggaagcacacugucaccaagucgggacuuucgguggaaugugacaaagcgcccagugggcucccgcgccacgacuucugacagugaucauccuuucccuggacucuggggccagaaagggguuagauggaucuucuccgcagagagaaaugaaaauaagcggggugacaggggcuucucuccaggcuaaaaaggaaaugggugaagagaaggggcgucaggaaauuccuccuagcacugggcagagguagggucuggagacaguaggaagggguagggaugguucucuggauccccgggcuggggcuaccucgagaggucaccuucccgcggagggcuggcggggggaggggugccgcucgccacucugggcuccccauucgggcagccgaggcuccgggaacacgcggccggccaggcccgggcugauguaaucggcuccgcgccgcgcgcacccggccgggcgggggagggcgggcaccgagcgggacgcgagcggggacgggcgggguuggcgcggcgcagguggcccagcagggaggggggguccccgcagcaauccaccccaaaacuuuucccaaacucgcggcgagggcugaagagaccgaguggcagugacagcaagcccccucucccuccugcgcccugcccccuccacgcucucugcccucccgcgguccaagguccgagcacccccugcccacuggucucuggcucccgcccccgcugcucagacuuccaguucguccgggaccagcggccgggagcaaacuucagccggcagcggcaacgcaagcccagcccccucggccuccuccuccggcucccgcccucggcuggucggcccagaucguacgugcggugacuccggugggugggcagggcccgcgugggcggugagccucucuccggguacccucccaccuagcgcgcgcgcccccucccccugcaccuaagacgacagagggggacgccgcacgccuggugcccauggacccgcguggggcacggagcccccacgcgcgcgcucgcacgcacguccccagccgggagaggcgcucgcagcggcccgcggcgccagcagggcacgaccgcuuaccuuggcaugguggagguagagcagcaaggcaaggcuccaaugcacccaagacagcagaaaguucaugguuucggaggcccgaccggggccggcgcggcucgcgcucccucuccggcucgggcuguggggcggcccgcucuccucggcgccucggcgagcuacucuuccuccccggcccgaggcccgggccagggccuggggagcgcgcgcggcuggagcacugucugcgcacaccgccgccucacccguccaugagcccggcuuccgagcgccgagucgccacugcggcccccucuccucuuccuucucuucuuccuccucccccuccuccggcugcggcuccucccggcccgagcuagcacuucucgcggcuccgcucggcucggcuucccccgcgcggaccacggcuccuccgaagcgagaacagcccagaaguuggacgaaaaguuucagugcgacgccgcgagccccgacccccuccaccccgccuccgggcgcgggcuccggccccugcccgcggcucgccgccgcguccacuguccgccgccggccggggaggaggugguagcuggggcugggggcggugucugucugucuguccgucagcgcgacuggucagcugcgggaucccaagggggagggcucacgccgcgcuccggcggucacccccaaaagcaggucacucacuuugccccugucgcuuucgcugcucgcacgcccgcgcgcucucucugaccccgucucucucuuccucgacuucucucuggagcucuugcuaccucuuuccucuuucugcugguuuccaaaauccacagugauuuggggaaguagagcaaucuccccaagccgucggcccgauucaaguggggaauggcaagcaaaaauaaauuaaaacgagaaacaauacaguuuuaaaaaaaaauguuuaagaaaaaagaagagggauaaaacccggaucaaugaauaucaaauuccagcaccgagcgcccuggccggugaguccgcugaccgguccaccuaaccgcugcgccucccgacagagcgcuggugcuagcccccagcgccacgaccuccgagcuacccggcugccccaagccuccgcgauc

SEQ ID NO: 18364 - RNA, 1258 nt, Homo sapiens
caguucguccgggaccagcggccgggagcaaacuucagccggcagcggcaacgcaagcccagcccccucggccuccuccuccggcucccgcccucggcuggucggcccagaucguacgugcggugacuccggugggugggcagggcccgcgugggcggugagccucucuccggguacccucccaccuagcgcgcgcgcccccucccccugcaccuaagacgacagagggggacgccgcacgccuggugcccauggacccgcguggggcacggagcccccacgcgcgcgcucgcacgcacguccccagccgggagaggcgcucgcagcggcccgcggcgccagcagggcacgaccgcuuaccuuggcaugguggagguagagcagcaaggcaaggcuccaaugcacccaagacagcagaaaguucaugguuucggaggcccgaccggggccggcgcggcucgcgcucccucuccggcucgggcuguggggcggcccgcucuccucggcgccucggcgagcuacucuuccuccccggcccgaggcccgggccagggccuggggagcgcgcgcggcuggagcacugucugcgcacaccgccgccucacccguccaugagcccggcuuccgagcgccgagucgccacugcggcccccucuccucuuccuucucuucuuccuccucccccuccuccggcugcggcuccucccggcccgagcuagcacuucucgcggcuccgcucggcucggcuucccccgcgcggaccacggcuccuccgaagcgagaacagcccagaaguuggacgaaaaguuucagugcgacgccgcgagccccgacccccuccaccccgccuccgggcgcgggcuccggccccugcccgcggcucgccgccgcguccacuguccgccgccggccggggaggaggugguagcuggggcugggggcggugucugucugucuguccgucagcgcgacuggucagcugcgggaucccaagggggagggcucacgccgcgcuccggcggucacccccaaaagcaggucacucacuuugccccugucgcuuucgcugcucgcacgcccgcgcgcucucucugaccccgucucucucuuccucgacuucucucuggagcucuugcuaccucuuuccucuuucugcugguuuccaaaauccacagugauuuggggaaguagagcaaucuccccaagccgucggcccgauucaaguggggaauggcaagcaaaaauaaauuaaaacgag

SEQ ID NO: 18365 - RNA, 4513 nt, Homo sapiens
aaaaucucgcgauauuuaagauuccaggaggcggugcguugccacggagacggagcagggcuacuaggacgcacgcgcgagauagaaccucuagucucguggagagauugaagauggcggcuucucaggcgguggaggaaaugcggagccgcgugguucugggggaguuugggguucgcaauguaagccuuguggccuugagcucgggcgggaggaaugagagcggaacagggaugggucuugggauuggcguggggauagcugugggcucacugucccuucguggacaaauucgucccuuugcucuagguccauacuacugacuuucccgguaacuauuccgguuaugaugaugccugggaccaggaccgcuucgagaagguaaguggggccggaguugucuggggaggguuaugaaggccagaccuuguggucugagcagccugugucugucucagaagcugcucuugggggucgcuccguuuguaaguuuguugagcaaugugcuagacgcuccguuuacaggccaaauuagacacgguuucuacccaguucugcaaagauguucagucuuguugaggaaugguguguauaaacagugaaucuaguguaauauggugaaggugguugauagcgaugaagacggcaggguugggguggggagcauuacgcugagaccaggaagaggggcggagagguacuuaacauuucaagaggaggguacaucucaauugagccuugaaugguaaguaaaaaagaacaggaguuaaauuaugaaggguuuguuucaagucagugaaguucaggauauacagguuuuguguguauuuagucuuuuguauuguuucacuuagcuuaaaauaaggguuaaaauugcauuuaaauagauuacugaauguuaccguuuaggcaacugaccuuugcgugcagcuuauaaacaugaucuguaaaucagugcuugggaaaauuuuacuuuuuuaaccuguugauacaaggaauaaaguaugaacaaugaaaaagguuaaugcuugaaaaaaaauuauggcuugugugaagugugcuccgggcauguccaaguaguucuggcaugagugguaggcaagguugaagugugucuugggcacuguugaugauagggagauugaauaguucuuaagcagacaugaugagauuugcaaccuugguggcugggagggaaugaguuugaggaggaucauauggagcaggcagaucuguuguaagggaagcugagguugaagacaugaacuaagacugaugguagaaauagagcaaagguagaauagaagguaaauuuaugauugcuuugguaaaggcuguggggguagcauaaaaugacuuuuuggcuugggaacugcuuugaugcauugugguaucauuuacugagaggagaaaugggucuggggaacgggaaugaugaugcauuguuuucugcauguggagaaaucuagcaggcuagaagacugcaugcuugaaaugagaucagaagugagauaacauuuugggaguugucagaacagauaguugcuaaaacuguuaguacaguuaaggugaccugggagagagacaagaaccuggcaaauuuagagauggguggaagucgaucaucagagaaggaagaagaguggagcucagagcucagaaaccaggggaauaguucaaaaaaggaggagauuuuuuucuuugcuuuucaugaggcacucuuaugucccaggcuggagugcaguggcgcgaucuuggcucacugcaaccuccgccucccggguucaagcaguucugccucagccucccgaguagcugggacuacagucaugcgccacuaugcccagcuaauuuuuuguauuuuugguagagacgggguuucaccaugcuggccaggcuggucucaaacuccugaccuugugaucugcccgucucagccucccagagugcugggauuacaggugugagugacugugccgggccaggaggggguuuuuuaaucaaugccaagcauaacagaagucuaguaagaggacugaguagugucaacaaaacuaagcacuaugguaguuucuguucuucaguagaauagcuucuguggaugguuugguuggaagccauauugcauaggguuuuaaugaauggacgacaaaaauggagacuuuucaugaaacuuaaaacacugggcgagauagaauauuuaauaagagacauuugggcaaagggagguuuuuggaugagaggauaauacuugagggaauuaucuaagggggagguaugaagagauauuacacagagagcagauuucacuuaaauguuuuuuccugucccucuagaauuuccguguggauguaguacacauggaugaaaacucacuggaguuugacauggugggaauugacgcagccauugccaaugcuuuucgacgaauucugcuagcugagguauuggcaggcauggugacaaggcuggaguugcuuugggaacugcacugacaccucacuuggagaauuaagugucucaagcuguccuucccuccuuaauuuuccuggaauuuugcugagcauuuuaccuucucauucuuuguaaauuucucauuaaacauucuaggaagagagauagcucccuaccucuggagguugggguuacggggauagguagggggucuguuggguuuuugcagauaagugguuauuuuuccuugggcaggugccaacuauggcuguggagaagguccugguguacaauaauacauccauuguucaggaugagauucuugcucaccgucuggggcucauucccauucaugcugauccccgucuuuuugaguaucggaaccaaggugagaaaaugaaauuuugggagaaguggacuaucuggguucaaauccugguugacugugauguuggguaaguuacuuaucuuuguacaucagugucuuucaucugugagaacacuugccuugucucccaaguuugccauaauuaaaugggaaacacguaaagcauucagcauagugcuggcacucagacguuuacuaguucuuaggagcucccuccauuugugcaggagaugaagaaggcacagagauagauacucuacaguuucgucuccaggucagaugcacucggaacccccaugcugcuaaagauuccucugaccccaacgaacuguacgugaaccacaaaggugaguagugguagggugaggaagaggccccaccuguggguagcugcuaguuuuagggacugagaucuucugacauguuuuuccuccaguguauaccaggcauaugacauggaucccccuggggaaccaggcugaucucuuuccagagggcacuauccgaccagugcaugaugauauccucaucgcucagcugcggccuggccaagaaauugaccugcucaugcacugugucaagggcauuggugagaacccugugugccuuccugggaagggggauaguucgguugcaguggggcaagcugacuagggaacucagcugagacauucccggcagguagaaagccaagaggguugugcuuuugcuguuaguagcuuaggaggaguauucuuccuaacccuagaaggguuuccuauaggcacguucccucuuccucuccaggcaaagaucaugccaaguuuucaccaguggcaacagccaguuacaggcuccugccagacaucacccugcuugagcccguggaaggggaggcagcugaggaguugagcaggugcuucucaccugguguuauugaggugcaggaaguccaagguaugguauuugggaugcuguucaaguuaggaccuaaauuauauuuucuuucaaggugacagaaauaaaaacccugggcuccuaaaaguauaaccugguuugcuaccaaguggcaaauuagaaaaaggaauaaaaaaacaugguuuguucucauuagguaaaaagguggccagaguugccaacccccggcuggauaccuucagcagagaaaucuuccggaaugagaagcuaaagaagguugugaggcuugcccggguucgagaucauuauaucugugaguaugaaguggugagaugagugggcagugcucuuuggugcugcagcuuccuuccagucuagaugugaaguuuaugaguaaguuuuacaggcaagcccugccuagacuaaagugucucuuugguccccagucucuguugagucaacggggguguugccaccagaugugcuggugagugaagccaucaaaguacugauggggaagugccggcgcuucuuggaugaacuagaugcgguucagauggacugagcuuggaugcuucugaggcaagcugaagcuuuggguucugacugacccacccuacaggacugcugaacagagagcccagugugacuagggauccugaguuuucugggacaauuccagcuuuaaucaauacauuuuguuaaaugugccauaaaaugagacuuuuuacgccuuuauaaggccuuagauguaaauaaacucacccaaacaaa

SEQ ID NO: 18366 - RNA, 3940 nt, Homo sapiens
agggacccuaugggguacccuucuccccagcagcucaagcuggcucugcccagccguggccccuggggccucccugaugaggccgccaucuuggcgaggagcaagcggggaaguccccaugggccgggaucaccacgcacgcugcgccucgagucacgggggcgggagcgaggcgcggcgcggaugaaagggcccuggggccuuccaaauaggagggaacagugcccuggauuccggcggggguauggaccuuaggaacggggaaggauggaagaaugggcagaagcagcaguaaccgugcccaacgccaucuccacggggcgugccuccauuccgcuccccgucagcccuacccacucagcccugccgccugccgccugccaguuggcugaccccacucccaagggaagagcggccuaucgcucccagcuccuugccccgaaccacccaguguacgcgaaccucgcgggccggcguggccuuggccgggcagggggcggggcgagcgccggugacgcggccguugccaugggaacucgccgcccgcucgcucucuggagcuggagccggagcugccgccagccgcccgccucaggcucucucugccagccgugcggccaggcccgcgggguggucggggggagccgggcggcagagaaggagggagcggguacggccuccuagccgagaccgguaagccgaagcccuugagccgcucgcugccgcugccgccgccgccgccgcgaccgcgagggacaaggacaagcgccgagcagcgccugcccaacccccggaacgcgcacccgccccaacgcccagacacggaccgugcgggccgcccccgccccagcgccgccccacuucagcccggcccgcgcccuggacgccuccgcaccucuggccggcuccggcucagucccgguagcucuucuccgcccccgccgcagccuccgccgcagccgcagccuccgccacagccgccgccuccacccccggccccacuccgcccgcgaccccugccggggccccgaccccggcccuauccccggccccgcccgcggccccaccaaccuccguuccggccccguacccggaggcccagccgugggcacgaugcugcccagcuccauccagauuucgggggagccgcuguccggcgccgaggugcgggacaucugccgcggccuucgcgacaacgccgugcgccugcucucacugcgcggcugccgccucugcgaccgcgacuuuggccgcaucugccgggcccuggccggggccacgucccuggcgcagcucaaccuuaaccugggcgucguguccagccccagccgcaucaagcagcuggcugaggcucugcggaccaaccgcuccauccagucccucuugugagugcgcccccucgcaagggggucccgggcacugcacccuuccauacacuccccuggcaccuccuguuccuccacacuccuuccaguaccauccuaccuucacaugccuuaugcacauacaccgugccucggcccaugccuucacagcacccuccaagcacaugcuuggacuuugcacgcgcgacccuagccguguugggauacccaccaguuccugacaugaggugggggccguaccuccccaccuaaucaucugcauuuacuucacuggggcagcuccuugguucccaagggggaauauccccguggggacgagagcccugcccacugcagaguuccgguccaccacccacccaccccuucucugccccucccugugcaauguccuggaucccugccccagaaaacaaaccgaauucucccucuaucuguauucccugagaaucuagaacuuuccuucuccuuuuccaggccucucaagcgcugugacugcccuccccauaccuagggcugacagaagugaaagugccccuuucccauguagauagugcggaggacugcaguaacccugcucucucacucuccuccagccugcaugggagcccccugacagaugcggggcuggccuugcugaacccagcccuggcccuccacccugcccucguggcucuggaccugggggacugcaugcugggugaugaagccaucaaccucaucuguggccuccugcccccagauggggccaaaucuggugagcaggacccuguugagggcuugggcuaguguggcagugaugaaaaucgaaaugcagagggaaggggguguggccccagagcucugaugaugugggcgagaacaucuuucuacuccucucaggaaggggcaggacggggggcagcauggagacucaggaauccaggcuggggcaggcagaggaagcaugggccuccuuaauggcucuugaccucuaugguggggguaagguggugcccagccacuagggacaccccagagacacagggauuguggggaagggcuggaggagggcuuaacccucccuauucugguuucuugcuaugaugcugcccaggcuugaaggagcuaacgcugagugccaacccuggcaucaccccuaagggcuggagccgccuugccauugccguggcccacagcucccagguccgcguccucaaucuggauuacaacccccugggugaggcucaagaauacccccuugggcugucacugccucaugcccuauccaagagccugggaccaucaguugacaugguaacccguacacugggagagggaagagaaacgggagcccccaggggucaaggagauagcuuuguggcggaccaggugaccaacaaauagaucaaaacaucagucaccacccgugggccuaacuugcuucgugccuucacucaccaaucacaaugaucccuuccugaccaccaccaauuguccauguuuccuuggccagggauuaguaucuaaaguuguuaaggcaauggggaagcuaucuguaaggauuagcaggcauguguaugaaugugugcacguguguugucuccccaggugaccauguggcaggaaugcuggcuguagcuguggccucuagucguacccuagagguccuagacuuggagggcacagggcucaccaaccagucagcucaggugggaagucgucauguuugggcacggccaggggaugggguggagguuaguuuaugugucugaugacauaccuaaggcauggcagguugaggucugaggaccugccuuaacuguguucauccuuuuccauauucuuccccacuucagacccugcuggacaugguagaaaauuaccccacagcuuugcggagccugguguuggcugagaacagcauuagcccagagcugcagcaacagaucugugaccuccucucugagggagaggaggaggaggaaguggcaggaggggcuggcgacacccaggaaugggagagagggcgggagccugcugcccaccagagaggcagcagcuccuggaugugccccagcgguaagaacccagaggguugaucagagccaggucuggaagaggcucgggacaagggagagugggugugcagaaccuaggcucucaccuaucugugguccccauuggaggaaggaaugguggucugaacacuucucugcccuuccacagaucccagcucucagauggugcuaaugacgucaggacuaggggacagucuguuggcugagaccgagaugugacucuccacugggccucugcacaccauuucacuuaucuaugucccgagcaccuugccccagauaucagggucaggcccugggacuugggagggaacuggggucaggggcugcaugggggcucuggcagcuccuggcaguguggugggaaggaagcucuggaagcugugacugagcaacagccuuggggggcacuugaacccacggcaaugccuuugaacuuggcagcucuggcugcaacccgcuggcucggaaaagauuuuaugaacuccacaaccuguc

SEQ ID NO: 18367 - RNA, 3940 nt, Homo sapiens
gacagguuguggaguucauaaaaucuuuuccgagccagcggguugcagccagagcugccaaguucaaaggcauugccguggguucaagugccccccaaggcuguugcucagucacagcuuccagagcuuccuucccaccacacugccaggagcugccagagcccccaugcagccccugaccccaguucccucccaagucccagggccugacccugauaucuggggcaaggugcucgggacauagauaagugaaauggugugcagaggcccaguggagagucacaucucggucucagccaacagacuguccccuaguccugacgucauuagcaccaucugagagcugggaucuguggaagggcagagaaguguucagaccaccauuccuuccuccaauggggaccacagauaggugagagccuagguucugcacacccacucucccuugucccgagccucuuccagaccuggcucugaucaacccucuggguucuuaccgcuggggcacauccaggagcugcugccucucuggugggcagcaggcucccgcccucucucccauuccugggugucgccagccccuccugccacuuccuccuccuccucucccucagagaggaggucacagaucuguugcugcagcucugggcuaaugcuguucucagccaacaccaggcuccgcaaagcugugggguaauuuucuaccauguccagcagggucugaaguggggaagaauauggaaaaggaugaacacaguuaaggcagguccucagaccucaaccugccaugccuuagguaugucaucagacacauaaacuaaccuccaccccauccccuggccgugcccaaacaugacgacuucccaccugagcugacugguuggugagcccugugcccuccaagucuaggaccucuaggguacgacuagaggccacagcuacagccagcauuccugccacauggucaccuggggagacaacacacgugcacacauucauacacaugccugcuaauccuuacagauagcuuccccauugccuuaacaacuuuagauacuaaucccuggccaaggaaacauggacaauuggugguggucaggaagggaucauugugauuggugagugaaggcacgaagcaaguuaggcccacggguggugacugauguuuugaucuauuuguuggucaccugguccgccacaaagcuaucuccuugaccccugggggcucccguuucucuucccucucccaguguacggguuaccaugucaacugauggucccaggcucuuggauagggcaugaggcagugacagcccaaggggguauucuugagccucacccaggggguuguaauccagauugaggacgcggaccugggagcugugggccacggcaauggcaaggcggcuccagcccuuaggggugaugccaggguuggcacucagcguuagcuccuucaagccugggcagcaucauagcaagaaaccagaauagggaggguuaagcccuccuccagcccuuccccacaaucccugugucucuggggugucccuaguggcugggcaccaccuuacccccaccauagaggucaagagccauuaaggaggcccaugcuuccucugccugccccagccuggauuccugagucuccaugcugccccccguccugccccuuccugagaggaguagaaagauguucucgcccacaucaucagagcucuggggccacacccccuucccucugcauuucgauuuucaucacugccacacuagcccaagcccucaacaggguccugcucaccagauuuggccccaucugggggcaggaggccacagaugagguugauggcuucaucacccagcaugcagucccccagguccagagccacgagggcaggguggagggccagggcuggguucagcaaggccagccccgcaucugucagggggcucccaugcaggcuggaggagagugagagagcaggguuacugcaguccuccgcacuaucuacaugggaaaggggcacuuucacuucugucagcccuagguauggggagggcagucacagcgcuugagaggccuggaaaaggagaaggaaaguucuagauucucagggaauacagauagagggagaauucgguuuguuuucuggggcagggauccaggacauugcacagggaggggcagagaaggggugggugggugguggaccggaacucugcagugggcagggcucucguccccacggggauauucccccuugggaaccaaggagcugccccagugaaguaaaugcagaugauuagguggggagguacggcccccaccucaugucaggaacugguggguaucccaacacggcuagggucgcgcgugcaaaguccaagcaugugcuuggagggugcugugaaggcaugggccgaggcacgguguaugugcauaaggcaugugaagguaggaugguacuggaaggaguguggaggaacaggaggugccaggggaguguauggaagggugcagugcccgggacccccuugcgagggggcgcacucacaagagggacuggauggagcgguugguccgcagagccucagccagcugcuugaugcggcuggggcuggacacgacgcccagguuaagguugagcugcgccagggacguggccccggccagggcccggcagaugcggccaaagucgcggucgcagaggcggcagccgcgcagugagagcaggcgcacggcguugucgcgaaggccgcggcagaugucccgcaccucggcgccggacagcggcucccccgaaaucuggauggagcugggcagcaucgugcccacggcugggccuccggguacggggccggaacggagguugguggggccgcgggcggggccggggauagggccggggucggggccccggcaggggucgcgggcggaguggggccggggguggaggcggcggcuguggcggaggcugcggcugcggcggaggcugcggcgggggcggagaagagcuaccgggacugagccggagccggccagaggugcggaggcguccagggcgcgggccgggcugaaguggggcggcgcuggggcgggggcggcccgcacgguccgugucugggcguuggggcgggugcgcguuccggggguugggcaggcgcugcucggcgcuuguccuugucccucgcggucgcggcggcggcggcggcagcggcagcgagcggcucaagggcuucggcuuaccggucucggcuaggaggccguacccgcucccuccuucucugccgcccggcuccccccgaccaccccgcgggccuggccgcacggcuggcagagagagccugaggcgggcggcuggcggcagcuccggcuccagcuccagagagcgagcgggcggcgaguucccauggcaacggccgcgucaccggcgcucgccccgcccccugcccggccaaggccacgccggcccgcgagguucgcguacacugggugguucggggcaaggagcugggagcgauaggccgcucuucccuugggaguggggucagccaacuggcaggcggcaggcggcagggcugaguggguagggcugacggggagcggaauggaggcacgccccguggagauggcguugggcacgguuacugcugcuucugcccauucuuccauccuuccccguuccuaagguccauacccccgccggaauccagggcacuguucccuccuauuuggaaggccccagggcccuuucauccgcgccgcgccucgcucccgcccccgugacucgaggcgcagcgugcguggugaucccggcccauggggacuuccccgcuugcuccucgccaagauggcggccucaucagggaggccccaggggccacggcugggcagagccagcuugagcugcuggggagaaggguaccccauagggucccu

SEQ ID NO: 18368 - RNA, 29043 nt, Homo sapiens
uggggagaaaagugggagaggggaggucauuaagacaaguuaggccauaccaguaaaauaguuuuauuugauuuuaaaauagucaucaaugugaaaauuucucaaagcuuaagaguaacagucuagagccaagguugggagugggggccaggccucacacagagcccagcuugaggccccugagccccacccuccuuuccagagggagggaggagacagcugagggggcccugaaucaguccucucccucguccccaaggccagcugugccaggccccuggagggcaacagcucaugcggaggacuggggggggaagcaaacagguaggaaacggaaaugagguuaacaauuacaccaucacccccaaaaaaaaacaaaauaacaaaacuugugacuaugaaaggauggaagaugaauacugauaaacuccucagcuccccagaaaagcccagucugggcuggguugggcugauuggaggaaaggucuugagacccaacugcauguuaccucugaagaauaaauauucuaagaaaaagggaaaaccaugaggcaagcugcugcagucagucaacgcagcugacaggccuggcauggcccacaaccugaccccauccacacaggaaacagcugugcgggucuggauagaggagaggucaagggcuuggacuggggacccugagcugccaagguguggggacuccuugcaguccuggugcagcaauggcaggaaggccagcaggggcccuaguugagcagguugcccugcuccugggccugggucaggcuguccuugcggugcagguggugaacccccauccucuuggggcugcgcugggggcgacuggagcuggggaguggccaggcccugcccucggugugggaagugccuggccccuccucugugccccuguuaaugggcagcaggcucuggcgcucuuccucaggacugauaggcagguucagcucuucuuccucccugggaaagccagagucagguucuguggguagcaaaagcucacucucuucgggucgggcagaaggugccuggaccaccucaucucugucagcggggcuaugggcaaaauggcgcugcagcucagggagggcaucgcguccaaaggcugugcgcugggccacagcagcaggugguggaguacgguccacaaaugcccgcugccagcugaccagcagguccucuucagagcuggcagagcuagcuggggcacugaguguuaggggugcugggcugggcuggugguggggugaggccugggcugaggcaggggugcugggcacugggcuggggcgggcccgcucacuccccuccucuaccaggcucagggaaauggccuggcggguagcguaagugcaguugggcagggggcuguugcgggggauccgaaccuuauccucagagaacucuauuacccugcggccaggauacagugggugugguggagacgggguuggguagggguucagcuucucaaaggcuggcaggggcagcucuuccuccggggagccccuggcaguacccagagaguggcacuccccauuggguugugggguggggcugccaggggccgggggacuggcuggaucaccugggacacccucacucauguccacaugcacaaagacauccucagccaaggggcgcccggcgcugccugacugggcugaauugagcaguagagacuccggcuucucuaacacucgggcaaugacugagguaggcaccacagccccuggggcuaggcugggagcaggaccugggcuggcggccucuugaccacugugcaaauguuuccgaaccauguccuguagcucacagggcagcugagguaaaagagcaggaaagagagacaucaaugaucgcagccaaagauaacuugacucauggcgaaaguaauggcucccaccuuuaaguaccucuguguacucagcacucugcuaucuccuguucuuacagcaugccaguguguauacccucacuucacagacacauaggccuggagaggggaagacaacucaaagcuuugguuaacuuggccaagauuuaaacccggaucugcugcugcagccagcauguucucaaacuucuaucucccagcuucugcccaaaccauacuuaaguuuggagaaucugcauagaccaguagccuuagaaauaccucuacuucugggccgggcacaguggcucaugccuguaaucccagcacuuugggaggccgaggcggguggaucacgaggucaggagaucgagaccauccuggcuaacacgaugaaaccccaucucuacuaaaaagacaaaaaaauuagccaggcgugguggugggcgccuauaauuccagcuacuugggaggcugaagcaggagaauugcuugaagccgggaggcggagguugcagugagccgagauugugccacugcacuccagccuaggugacagagcaagacuccgucucaaaaaaaaaaaaaaaaagaaauaccucuacuucuucuacuucugcaggccacauaaaccuugggccugaagcuguggggucuagaguuuaccccuugggguaacaugaucagaugggccuaauccucucuuaguacucuuugggcagauagcucugacuacccucuccuuccugcccaggaucuucucucucugucucuguuacagaaaccaacagggcuggccccccagaacuagugaugggcccuggacaguacacgggacaccaaccaguggcagaguugacuggcuugagaggugacauggaggcaagaggagggcaaagugggaagaggaggacagagagaggugcagaaacuggaguuagaggaguccuacaguggccggaauggucuaugugggcagggagggggugaguucuacucacaucggcaaacuugugguuucggaagugggacuuguugcacuugaggagcuguacagccagguugcaguccagccgguaccgcuccuacagacacagaccuguuucagagcccagcccagcccucuccaaggaagcagggccgagccaggacaaagcuagccccaggugaggaaggcccgaguagugaagcgcacauacauugagcucuuccagcuuguugaugguguucuuggcauccagcagcuuguuggucagcuccacaaucucccaguccagcgucuuccuauccaucucagccuucuugaucugaagcacagacuugagguuaacccagcccacacucuagccagcccuuccucucccuccaccuccucccauccuggagacacaagaggccacaggugcuagggcagccaaggcggacagagcagagacaaaugacggacagacagaaggagacugggcaucucucccgcucucuggacuggcuguggggugggggcuuucuuagcaugacuuccugccaccugggcccaggacacaggcaguauaagagcuguccauccccugagguuccaggggcucugggcaccaggcaaggcagcugguaccucaacggcaguaacugcaaaccagggggcugaagccuccuaugugugcagcuguuuccagcaucaggcuaggagagggaagaggaagcagggcgcgguggcagccagggcaccuuguugagcagggagcaagcugcaggcucaaaaguagccuucugaucuccaguucagggacuggaucugcagccuccccuccccacucccacagccugggcuugcugccacuggagccaagaagcuuuggguguucaguggagacaucaaucaguaccucuaccagagccaagggcagagcaggcuaggcuccccaccucucuccugggagggaggcauugacaguuaaacgggccucauacagggaagagaaaggagcggguguacucaaggggcacaggguaacagccagggcccacaaucccagaucucagcugaggagaaggccagggcaagggagaagacacacaaacucagacgcaacugcaaaaauccagcuguggcuaagagaggccugagaggagagugcagcagcaacgguggcagcaugagggggagacgaggaaagaagagaaacagugugagcauuaagacagucuugacuugcagagcacacugcaguacccccaccacugccccaucccaccaucucccucaagccccagggcagaguggcauuccccuggcaaauccuggcccccugcuaugcuaugagcacagugcccaccaagcugcccucccagacagauuaccagugugugcagcuuguccuccaacuccugguugguccgcugggaagccguguagcuguucugcagccugaaaagggauaauacaaggcacaucccugggucaagauccuguucuucaggcucuguucagccuccccgauaggggaucuugaacaugucauucucccucaagaacuucaguuuucuaauaggaauuagaugaucucuaaggcaucuuccagcuaaccuccuaugaaaggagagagagagagagagagagagagagagagagaguguguguguguguguguguguguguguguccccgcauucccacaccugcagaacuuauccaguuuucuaauaagaauuagaugaucucuaaggcaucuuccagcuaaccuccuaugaaaggagagagagagagagagagagagagagaguguguguguguguguguguguguguguguguguguggccccgcauucccacaccugcagaacuuauccaguuuuuuaauaggaauuagaugaucucuaaggcaucuuccagcuaaccuccuaugaaaggagagagacagagacacagagagagagagagacagagagagugugugugugugugugugugugugugugugugugugugugugugugugugucuggccccucauucccacaccugcggaacuuauccuuaaauuuguccagcuccucgcggcucuggcccagcuccagcuccaggcaguccugcccaauuuccagcucacguuccagggccucagugcgucugguggcggaggccaggcgccggcgaagcucuucauucuccuccuguaagagccuggcaggguguugugggaucaagggcagagggguaugagagauagaagggcaugcccuggagcuccagagugggcucaggaaggaagggaugacaugaggacaggcaaacaggacagggaaacuccuggagucuuagucugagucuaaggcagcauauuucauaggccugcuggcccugggaacacagccuggguuggagggucaggggaggaagaggggaugguaggggacaguccagccucccuucacuaucggagaauagaaauaaagaauuggggguagggauauggcucccagccugucucugguuacagcccaugucagcuggccaccaagcccccagcuccaguuuccccacugcacaaucaggcuucuccauuauucaucucuuggaaauccagcccagcacugcccuccucuccagaggccucauguggcuaaagggcuguaaggguggcagcugguacaggagccaggagcuggggaagggcuccuuagcaagaagagcagggcccucagagccauucgccuccugauucuacgcucucuugaagcccauggaacaauaaaaucccauuuuccagaaaaaauauccacaacaucaacacuccucccagagucccuaaaacaacccaucccaaccuuuauuucuaccuaauccaagggaaaguccaacuguaccaacagucuagccuggagcuaagagggacagaguugaggcagggcaguaucucagguagcagauacucacuucauccuuucugcaucagucagggguuccuaggcaaaaaagagaggcuugaggcucagcucuggaccacuggacccccggcuggcucacccuccaaauagccacaagaaggcucaggugugaagcccaaagacucuuauagcagaagagggcugcagggcucucuacggauggaagcaauucaguaaugcugggacaagccucgacuacccucucccaugccaaccagaagauucaagaaccucuuccaaccuucacccuuaauccaauccuaaagccauuuucaaauaaguccuggcacccaagcuaccucuccccaggggcagacagccucucagcuguucacucggcuccugguggguccuguauccacagagguauggcagagaccuuccagaaaagucaggcugaacuauacacacgaguucugagcucugacaaagcccucagccuugagaugaagacaaaggcagaaucaggcucuugcagaggcucaggaagaacaagugcaugggagaagaggacuaauccugacuaaggggaggaagugccuugucugucuuuuaaccuccugccccaucuuccccaaaccccuauggcagucauggcucaagagucaaguucagccaaccacaaagcagaguaggccccugcuaucgcgagagggaaacaucaaggggccuauucuauguggaacugacugcuucagaagagcagccucuggcagaaaauggagguagguggcuuccuuuguccauugacucugacaacuggauuucacccuauucuacugcauacugauuauacagccuucaccucaccgagccuuaguucccucauuuauaaaacugagguaaugcucgcuggguagcaccuagcauaauagcuggcaucuuaauuuaauguucccugaacugaaaugagcaagucauggcuuuucuaccuugaaucugaccaaagcaggcuacaguaugccugaugcucagcacaugcugcgucucagguucuuuaaaugugcuccacgcacugugaccagauggagauauggcugcaagggcaguaaaccacuguggcccucguuucugccugugagugaaguuaauggggcaggagagccaauguuuugcagcugacuauaggccccgaagagcagaguccggaccuaacaguuccuggcagggaguacauauucaacaaauguuagccaaacaaagcaaagcuggaggaagggcuggacuuccuggggacaaugaagagcagcugugcuggugggaaguggcuguagcacugccuccugauaugccccaaaggggccacagguugaauggcucuacuccacuacggaggaccagagucccaaccacuagcagauuaggaccccucagucuacugggcugccucuugcagggagaauaucauaugggaucauuucugcuaagcuacaaagacucagggguucccugacauguggacauauacucacagacagucccccuugagccuacauuacccccaccugcacuacugcggcuaggagaccucaggccugcaacagcaaggcccacucucaccccaacucaggaccagaagcucaggcaggagaagucagccagacacccagccucaggggccuugccucugccggucaggcugugauaccagucuugcugaccuccugcucaagccgggauccaggaauuuccaaacgcagcucccgaugcucugguggugccuuacgguaggguuucuuagcaggggcggcacuagucauucugggaggugacggcuccuccgccugcugagaagcaagaaggaggcaggcucagagauguggccagaaggacucuggacugagaaaaaacaaagauggugaaaggggacauauguugaggccaccacauaggcugacaggccugggccauuacuggagucacuagaggggcaggacuuaggugugucaguccccauaggucaaaggagugcuggaggguggggcauggguccaacggggaacagaugggugggaaaggcagggccuagggccugaacaccuagguucuaagagugggacagggagcuucaaagcagcccaccacccuccuuaccacucuccuuugugggcucugaaggccucagaagguaaaacugcucucuaugcauuaguuuucucaacucuaaauuagcgauaaaacagcaucaauuucuuuuuuucuuuucuuuuuugagacagggucuugcucuguugcccaggcuggaguguaguggcgcaaucuuggcucacugcagccucgaccuccugggcucaaguaauccuccugccucagccuucuguguagcucggaccacaagcaugugccacugcaccuggcuauuuuuuguacacagcgucucacuuuguugcccaggcucaaacucucaagcucaagcaaucccucugucuuggccuuccaaagugcugggauuauaggugugagcuacugauuccaguuaagaauagcaccaauucauaggguuguugggaagaugauguaaaacacuuaggaaauguugaauaaauguuaguuuaaaaaaaaucauaaccaaaaaugugaguuuggggauacaauccaggauccccagugggagucucaaggcccaagagagcucucuggccucagccacugaugaccaaaccccuguggccuccaccacucuuuucaccagcccccgccgagagagaacacuuggcugcccccucaccugccccuccccagaagagagccaggcugagggcacaggccucaucagggacauaccgucuguuugucggcagcucucucuguuccgcuguccgggaguuagcccucggcucuccgcaucccacggccccuccacuuccuuuagccacagcuccugaaaccagagaagggaagaaaguggaaaccaggugucagccgccugucugucagugcuacaggccugcugcccagucugggaccuggaaggccccccagggagaaccacggcaggaaggccaugaaacagagggccugaggggaaagcggcuggaggcagaugacuggaagcacuggguuccugccuuucuccaugacaguacugucacaggcccagaugagauacaugugucuguguguucauggucucagcacauugcccaauucuggaauagguccgguuccguccugucccuacuccacaucgguccucaucucccaagccucucagaguuuggaaacaacuaagagauuuggggaacauggguuacaaaugagaacaccaggaaaaagccucacagagauccaagaagauagagaaaaugauggaaagagagcaccuagcauuuccagaaggaggcccaaggcuauuugguguauaaugauggucaccggccuuugcaaugaggaggcauagggcuaggagaagaaaucugaaaagggagcaacacagagcaguagcucucaaccaggcaacucuguccacccuccuuccccagggacgucuggcgcccacucuccuuccccagggacgucuggcaagugucuggagacauuuuugguugucgaaaccuggagggaaggagugccacuggcaccuaguggguagaagccggggaugcuuuggucaucccacaaccauagggcaacucccaccacaaaugauucccaauagaaaauauccagagugccaaggcugaggaacacucgugaagaaaaccccagucgggggaguuggagacaccugggcuccaggcucagcacugacacuguggggcccuguguaaugcccuuccucacuggauagcucaguuccuuaucuacacagagguggcuggacugagugaccugugagagccccuccggccuccugagguucagagaugggugcacaccccucccuggcccccaccuguaauuagcuggguugcagcacgggggcagcagccaccagugaucaggcaguaaccucagguggccuucugggcagaaaaaacaaucucuucccgcccccaucaaccuaaacagagcuggagguugagggaagccuugcgggcuaaagcauguguucccacugucgggacaugcccuggccaugacuccugucacauuccaacagggcccggggcagggagaauggugagaggguagggaggguggggaagcaggaguggucucccuccucugucuggacagccugggcccugguuugggguucgguggggagcugaggugcggcagcacaggcacggccgccagccuccucccccugacaggaggcagaacguguccccacagggcacaugcaacaugcugugucggcugacucccugcacaggaauccgggugggcgggccugaaaggacggcacauucccgggguguggggagcaaacaaguuaccccaacagguuccuuggggcugccccuccagaggagcccggggugggugcuccuauggccugagggagaggccuagaaaguccuaaacccaccuggguauguggauucugauacucagaggguaaauguguggggugcgugaguuggaaaacaggguauggccagagauggaagagugagagaugcgagcagucaagagcuucuacaaaguaaaggggcagcucagagaguuggucucugccuuuccccuucucuacagaggguccaggucccagcucccuucccccaugugcuccccagucaucucaggaagcccuuucucucugcaggccccuuugugugccccuccucuauuccucuguacucccuugucccuauuccuggcaaggccugugcuguccucuugguaccgaaacaccugcaugaacggcaggcaggcagggaggacacaaacgcacuuggguguccagcaauccuguagggaaggcugcuucacuccacacccugcagcccuggcucuaguugccacacauccucuagcuccuccugccucacccugaccucaagccccacucccuggcccuacagcauguauuuauccccagggcuuccauggccagaggcgaucuggcuugcuaggcaaggaguauccugagaagguagcuggcagugggacaggcaguaaaugcagacagacucucuggggaugggggugguugugaugggagguuauucucucugccagagccuauucuuuccacgcaugucagaguuacagguaugggaaaccacucccaacuaaggaagcagaaggcaaugcccacugggaagacaauccaccagggggcccaugguguuccucaacaccaggcugcgagggagauguguaccaaccacuuccugcccuguguccauaaacacagggugugcccaacacccaggcccuagcuccaacuucugaaaucugcugagugccccagauccagcccauuaggggcccacaguuccagcaaugaacaggaauacaacgggccuggcagcccacaguccuugacuggaggcaaggaaggugugcagggaaaguccggacagacccaaggaggacagugaugcauggugcaguggauaacaaagagagaagcaucgggacacuuggccugcaagcugggagaagguaaaggggugaggcagauggcaucagaguggucccuccaggaagacccagcuaccaggugcagccuccccuggccacaucuccuucacccaaagguuucccaaguugccuuggaguguuucagcccaaggaggacucccaaucccauguggggaagaaaaggucccuaaggagagcagcuggacagcucagaaugggccauggcccaugaugagcaagcggcagccaaggacagccucuggggccuccuggccucuggaugcugagcuggcuccagggcaccucccagaaaauggucuucuggaggaagaucaggaaaucaacagagcuggcccaacaugguggcucacgccuguaaucccagcacugugggaggccaaggcaggcggaucacuugaggucaggaguucgagagcugccuggccaacauggugaaacccugucucuacaaaaauugaacccaggagguggagauugcagugaguccagaucgcgccacuacacuccagccugggagacagagacuccgucucaaaaaaaaaaaaaaaaaaaaaggaaaucaacaaggaagaaucccacucccacccccaccccaaacuaaaccuaagccuugaggaacugagggcagaugacucaggauguuggacuaccagauaacgugcugggucuguucuguaagaacagcuaugcccugggagaaagguugaggccuagguuaaaaccucucgcugaccuagcguggccuggggcuucuugggcuggaccugcaggcaguguugagggagacacccagaguagcagcaacccuuccccaucccaugaaggugaagugagaaggaaaagggacucuccucaacccucccugccccugcugcauccuaccccauccaaccccagcuucugccaugcucugcauagcauucauucuuugcuuacucaaaaaucaguucaaaggaaagacucuacuucauaucugcugggguggagagaggggugauagcuuccuaauugccauguugcaauuugccagucggugcaggccgccuguugccgccugcccuguauuaaauaccuucucccugauuacagcccauggggcaugauuagcugccuucagagaacaaagucuacuuucauuagaaaugggacucggcacgcacagcagagcugcacugugaacccucugaacagcugagcagaguguagacagaauagguguaaggcaugaucuguaccagaagcuggcugagcaguguccuuuaauaaaaggaaaaaaauuugccaagcaucacucuuuaaccaggaggugggacuuauaccugcucccuuuuguggguacgcauauuugaucaggggcuuccaccgugguggaagauugcuguugcuagagacagagugguaugagagagaaaucucuucagaauccugcugcuccccaauauacuaucuuaccguucccagcaagcacccauaggagcaacagcaaaaaguuuccagcccaagagccaaagaugccgucccacuucccuucugccauccuuuccgggguucugccuaaagcucaggcaaagucagagaugcagaagaggaaaggagguucaagcauccauccuucucccagcugaggcugaggccaucccuucaacaccagcccaggagagggagacaggaauccagacuggauaugguucuuuggcuuuuccaacuucagccuuccccaccaaacaucuccagcuccccacguucugcacuacuaccucacuccacaacucuccugauccuggagcagcuagcuugcccuagagagcaacuaccucccuacucuccacaucaccaauaccuacuucagguaauuguggccccaucaguuuaucuggguucagauaauuucugaaccuacuacgaagccuuucugcucucagcugucaaugaaucaagcaagugagagaccuuaaggagucaaugaacacaaccuucugaaucaggaagggcccacacauuaccaugaaaaucauccaagcucuucuucauaauucaaccaagcaaagucaaacggaaguuaguaaucgcuacugcuuuuaaaaugaaaggaacacccagccguuucagaauacaccagcuguguuguaugccaccuuaauucccuuggaacccagcaggguauaaauaaauaauaauaaauacaagcccuuccuaaagccccucaucaaccacuaaaacacaaaugucugaucacacagggacuggggccucccccucaggaacuguccugagcuguaagugcuggauguggagucucugaagucugcaagccugugggaagcugugccccagugggggucagcuacacucccgccacacaagucuggccgcuucucaagccucugaaauccagucucugcccccaacugaugucuaaggaacacaaauggucacccugcaagcguaagcccuggaaccaggugaccuggccuugguccuggggauugcucaugaagauccccacuccuugcaccauuaauacagccccucucccacugacuccccaugaauagcagucccccagagcagugggcugaucccaccaaaacuggguucggccucgcccacaucgucuccgggguaccccuccugcuugccaccagcccccaguuuccggcaugcagcuguuccugagauacaugaguaaagccuucagcaaucccgggcgcguggcaggcaggcagccaacagcucauaggguggggacugggcagagguucugcucugggcugaagacaaggcuagaagaugucagucugugcccagaccagcccugcugccccuccaacagcuaugcccgccaccccucugggcaaguacaaccucacccucuugggacaaguugccugcagcccugaccuggcccccugccuacucuaaaccaaacagauugacaggguuuugaaagccaaaaagagugggaauuauucugccccaaagcaauccugaggacucagaacagugcuggugaccugugagagcucaucuggcucccacaugagcaaacacuuccaagucuauccaccuggccucacauccagacaaacacuucacaggaacaaggggcuaaagagccaggcaaaccaaccccucccugcaaaaaaagagggcaagaaauccccaaggucauagccugcauuugacauuagaccccaugcccucuccuaagaaaggccaaagugaaggaccggcccucaaccaggccucaacuccaggcccuuuugcuuuccuggucagagccaagucaagaaagccuccagcuuguuaacuccccauuuggggucccuaaacaucucugcauuacugcuaguccccaugaauaauauauaguacuauaaauguuuauuuguacauaguacacucauauauaauacauuauaagcucaauccacaugcauauaaauagguauuguuuauuccuuaaucaacuaucauacauucacuauuauuaaucauauaauaaaauucauuuccacauggauauugaucaguacuauaaauccuuaauauugcauaguacauauauucauuuauuggacguagugcauuuucaucaagauauuucucaucgggccaggcacaguggcucauaccuguaaucccaacacuuugggaggccaaggcgggcagaucaccugaggucgggaguucgagaccagccugacuaacauggagaaaccccgucucuacuaaaaauacaaaaugagccgggcgugguggcgcaugccuguaaucccagcuacucgggaggcugagguaagagaaucgcuuaaaccugggaggcggagguugcagaaagccgagaucgugccauugcacuccagccugggcaacaagagcgaaacucugucucaaaaaaaacccaaaaaaacaaacagauauuucuggucaacauggauaucccccaccaacuuuggucucuuaaucuaucaaccuccgagaaaucaucaucccgcucaggagugcuauccuccucgcuccgggcccauaacacacccucucccauuuacaagcucccacccagugcugguaggcugcugccuucucucacccagcccaaggggaacagaauccacuuaggcagccuucuguucucaagcucccccuguccagccucccuagcaccacacugccuccggaagccgaagccacagucuaucuagagugaccuguguggaacaccaggaaacaacaggcaaucaacuuucucaugaucuccagacccgccucuccuucccaagccuggagggagaagggacugcgugggagcuucuccaagccaggcugcacgcacccaucucccagucugaggccaggacuuuuucugagcccaguguggaauccgaagccagguccugcccccacucuacugaggcacccuucccagcuuuucauggcuaaaguccaccagaaacuccggaugugaaaagaggugggggggacaaacuucaccucccagagcaacggucaccaaugggagugacaucucacaugggucccugguuuggggccccagcauucaguuuaaguagcuucacuuuucugcccagggaauuccccagaaccaggucaagguuuuccucuaccuccccaauccuaaagagaaccuugcagcugauccuaacuucuuauccuagggugagaguaacagggacacuauccaaccuucccuucuugauaaagggaggaaaugaucugaucuaggagaaaagucccuucccacucuaguucaucugucucugaggcaugagaagcagcagcagcaugguaauugagggaucuucucaaacucugugcuaaaagcacagauucaacagaaacucgaaccaauucuguaugaagggagaagugaagagcacgcugcugacucggggaagggugacggugggggguggucaguggagcccagcagcaggcuggugaugggcagguggccgugaagggggcacauccccacccacagcaaagggagacugggaaaauagagggacgcaguaguaagaacaagagagcagaggagauggcgugauauaagcuaaggagggaggcagccaggcugcggggaaggauggaggacagaggcccugcugguggcaccccagggcagguuagcuggcugaggucagacucacaggguuagugucuucuccccaaccagccagcucuccugguuagugcaguuagcgacagacucauggcagaugcccuccaggcacuccauauaaacagacagcuugguuugugagcagcccaacuccggagcugcagagagaaagcagaggaauggcaagcugcaggaugcccaaggggacacacugcacacugcacucuccugaugggaagcaucgcagacuuaccaccagacccucaggggcuuucucccauccggaaaccaugccagauggaagccaagcacucccccugccaaccagggaggccagcuugcugaccucaggcaaaaagccucucugguuggucaacagaaagagaggacggcuguuggagaaggggcucagcuccucuaucucgccuguuccccaaacacugcugccaggcugcaccaggacucugaaagcuaggcuguaagaacaaagccacccacagcugcagcugcaacccaucccgcaccagugccagcagaguccaucccaccaccucccacaggcucugaggggcugggagagaagcagcccaaggauuagaggcuaugacaagggcugcgucggaaagcacaguacaauggggcagugugugccuggccuacagcugggccagucaacagcacgggcugcacacugccgccuggccagggguggcacuucccagggaaccagccccagaggagcaacagggacuauucuccccucucagaacaagcaacacgagcaacagagcaagaagcucucccaucaacggcagaaacaacucuuccaugaagccuccagaccacccugggggaagugacaccucuagcucacagacugcaaggcaaaugaggcaaaagcaguggcauuccagagaccccacaagauguguccccuggggcgggaggacaggacugcaacacauauauccacacccacugaugcuuagcagaggguaagauguuggcagggaaaagacaagagagggguccucucuccuguucuaggaagcccugcaggcucucugaugacucagggcaaaaagggaagagucaccacccuggccacagaggugggccuggccuuuucccaagccuaggaucaagauucacgcagacaggaaacacuuccaauaauugccuacacacugggcuccccauguugcucugacuacagcccaagagcucaaauaggccaaggccugacuaugaagaugagacaacugucuagaaaaaaaagacaacaacucuuccgacaggcccugaccccugcucuagacugagcacagccacugacaggugaccuucagaauccucacccacaagaaaacaaaaacaccaacugggucuggugugcuuuuaaaagagcagcaagugacauggcuaauucaagguuucagaaaucagggacucucacugcacuaauauaggauuugagaaaucagauaauuuuucucuuuuccaaggcaaaaaugaaaugagugaaggggagagacacaggugagaugggagugccaaugcccacaucgcuguuauauccauccugauucccacucaaggacacuccugccaauuucaucucagaauaaaaaaaugucccucagagacagccagggugccugcuguggcaagacccucuaguaaaacuucuccaucccucccagggagccagccccagaggaacucacucgacugggaaggaggcuguaaccaggcuccucagcggcuccaacagggaccauuccacuccuuggucacuuaagucaacaaagaaagcugaagaagagucuguauuaauauugaguuuuggugaggaaugucuagacguauaaaaaaagcuauuagaggccaggugcaguggcucaugccuguaaucccagcacuuugggaagcugaggcaggcggaucaccugaggucaggaauucaagaccagccuggccaacauggugaaacccccgucucuacuaaaaauacaaaaaauuagcugggcguguuggcuggcgccuauaaucccagcuacucgggaggcugaggcaggagaaucgcuugaaccugggagguggagguugcagugagccgagauggcaccauugcacuccagccugggugacaagagcgaaacuccaucucaaaaaaaaaaaaaaaacuacuagaaggguacaagauaaauggcgaacagugguucccuaucuuuggggaaacaaguuaggcaggaacaaugggagaagaaagggaggaucuucuuacuuuuuauuuuguauacuuuucuguaugguuagcauuuuacacaagggauguauguuuauggugaaaccaacaguuccuaggcaaacagacaaaaacccugcaucuacacugugcuuuaucaucccagaagcucuuucccuuccaugauauuuccuuugaugcuuaugguccagugaggcacaaagaauagggagcucucccauugugagggucagaaagcacaagugauuugcccaagaccacaagcagaagugggacauaacccaguuccccugucuccaauaccagugcaaagccuggaaagcucuuuuccaggaagccacaggaauaccaggacaauucugcccuaauaucaagacccucaaagacuucugagauucaguucccuacuugggcuaccugugaagguauaaagaggccaaccaccgcuugguacccaaaaugauaagcagaguuuuauccuauugguuagcugaguagaaguccaggguuuuggggucuaggauggcuucuccguaggcggauccuccucucaagggaugguauugaguuccccaccacagcacagaagcuucucacaaagaggggccauguccuuuauaaauucuaaaugucaccuagcacacaauuggcacaagauaguaacuaacaaagaagaggucccacccuucuacucaggaccagucaaggagacuuaguccccuugaagccuaagauauccaacacaauccagucuggcuggcucacucaacccccucucugcuuaacauaaaacgcaguuuauuacuucccgcaaguugccaucugcaaagauaugccacaacgcaaugcacauucucacacccagggacaagggagagaacccagggaaaacuccuucaguccauuuuuagcuauugguuucauccuuuugauuuaucugggcauuaacaagguuguauuaagcucuggcugugagcacugaguacgccuagaugggacuagagauaggaccagaaaagcaagcagguuacagugggcaauagaaagggcagcauagagaauuacaaaggagcagccagcagccaaagaccuuucuagggaugcuaauuaggcaaaaaaaaauagcuacuggagccgggcaugguggcuaacaccuguaaucccagcacuuugggaggcugaggccgguggaucaccugaggucaggaguuugagaccagccugaccaacaaggugaaaccccaucucuacuaaaaacacaaaaauuagccgggcaugguggcaggcaccuguagucccagcuacucgggaggcugggacaggagaauugcuuaaacccaggaggcagagguugcagugagcagggaucgcgccgcugcacucccaacugggcgacagagcaagacuccaucucaaaaaaaaaaaaaaaaaaagcuacuggaaagcuacugguacguacucaccuccuccuuuaacccccuuucugauugcuuagggauguguuauuagaacauaaaccgucuggccgagcauggugguucacgucuguaaucccuacacuuugggagaccgaggugggcggaucaccugaggucaggaguuccagacuagccuggccaaaauggcgaaaccccgucucuacuaaaaauacaaaaguuagcugcgcgugguggcacaugccuguagucccagcuacucgggaggcugagcauugcuugaacccaggaggcggagguugcagugagccaagaucgcgccacugcacuccacccugagcaacagagcaagacucugucucaaaaaaagaaaaaaaaaaaaaacauaaaaaggcuaaaagggagacagcugaagccaagcaccuggaagaugauuuaaccacaugaaugcaauccuggaaaauaauuaguaaugcuauuguuaacacuaucaccuuuuguuuaugcaggaccuuccuuccugagggugcaaaagguuuugccagauagauuccaucuucuuuaaucccacugaggaaggacugaguugggucacacaguaaccaacauugcucagcacuuacucuauagugccuaaaugcuuggccuucaguaaaaaagcuugccccuaagaagcuucagagacagaagaucuuacuccuagugggagagagacagguuaacagucacuuccaguacagugugguugagugcuuugagagcacagaggagagguaccuagcugggacaaggguuuaaggaccagacaaggcugccauccagagaacucagacauaucuuccucaucugauuguaaacucgcacuggaguaucccuggcauuauacacuuaauucuggaaagaaauucauuugguguuuguuagcaauuggggcucuaaggacuacccccaucaacuacacuagaaacaaaaaagcaaagaauggaucaugaugcagcuaucagccccacuugugggaagcauccaaguuaagccuguucuguggcacaggaagaccauuaaagcccuaagaaaaguggggccaagaagucuggcuuccucaaugccuggauguguuccaucagauucacccauuuuucaauccauaaaauauggggaaacauggauauugaaacucuccauccagucauccacugugagcagcuuucugucuauccccagccuuaauuacauuacgaauccaccaccaccaaccucaccagaacuggagaaggccagcauaucacgaucaucaaaggagucaucacaaaacaagagauggggaggcugggcgugguggcucacgccuguaauccuggcacuuugggaggcccagguggguggaucaccugaggccaggaguucaagaccagccuggccaacuugguaaaaccccgccuccacuaaaaauacaaaaaaauuagccaggcacaguggcaggcaccuguaaucccagcuacucaggaggccgaggcaggagaauugccugaacccgggagguggagguugcagugagcugagaucgugccacugcacuccagccuggaugacagagcaagacuccgucuugggaaaaacaaacaaacagagauggggagaaacaccaacaaucucugcacaggcugcucauugaugaugcuccuaaucucaccuuuuuuacugcuuccucacaagaaaggagacuccguuuuacucccaccucaaaaugcuccuggcuaccaggcagaaaucaaaaggcuuauuuuagauuuaauagaacaaagccuuuuccuauuugcagagcuccaaaaugggaaauuuauucauucaacaaauauuuaccaaguguccuuuauuuauuuauauauuuuuuugagaugaagucucgcucuugugccccaggauggaguacaguggcaugaucucagcucacuguaaccuccaccucccggguucaagcgauucuccugccucagccuccugaguagcugggauuacaggugccugccaccaugcccggcuaauuuuuguauuuuugguagagacagggcuucaccauguuggccaggcuggucucgaacuccugaccucaggugauccacccaccucagccucccaaagugcugggauugacaggcaugagccaccgugcccagccccaagugucuuuuauaugccaggcaccaugcuauaugcuaugaacucauuacuccugcaaaaaagaugucacccauauuuuauuuuuuuuuuuguuuuuaauuuuuuuagagauugggucuggcucugucacccauucuggagugcaauggugcaaucauagcucacugcagccucaaacuccuggguucaaguuauccucccaccucagccuccuccugaggguuaggaccacaggcacaagccaccauacccagcuaaguuuugaaugucuuuuguagagacaaagucucauuauguugcucagucagucuggcuucaaacucuuggccucaagugauccuccugccucagccuuccaaagugcugggauuucaggagugagcuacuacacccagccaaccucauuuuagagaccaagaugagaccaagaauccuacugguuaaggaacuugcccaaaguugcacagguggugaguggcagaauuaggauuuaaaccaggucugccuagcuccacaaucagauucuuucacacuauucauuaccauucccaccgacuccucuccaccacauguucugcaaaguccccugucuacaggagaucagcccagugaaagaaacagacaaguaaacagagcccucaccaaacaacaugguaagugccaaaacagagguucaaagaaagugcugcaggggaccaagaggaggaaagaaaagcagcggaggcuucucacuggaggugacaaaggagcugggucuuaggggaugggcaguuucagaggcagaggugagcauuauggacugagugaaguacaugggcaaagaagaugaaacuaaauggaugcccaugauagguuugggagcagugagaaauuugggagcaaugaagcacaggacagaugagguggaauagcagcaacucaggcuaauggucugggucuggaccccaguauaaggagccuuuuggcaugccaagccagacagugugggcuuuaacuuaaguaaggaagaacccauggcauuucuaagggaagacuuuuuuuuuuuuuuuauugagauggagucuugcucuguugcccaguuuggagugcaauggcacgaucuugguucacugaaaccuccaccuccuggguucaagugauucuccugccucaaccuccugaguagcugggauugcagguacgcaccaccacgcccaacuaauuuuuguauuuuuaguagagacaggguuucaucauguucaucaggcuggucucgaacuccugaucucgugauucaccuaccucagccucccaaagugcugggauuacaggcgugagccaccacgcccagccaggaagacuauuuuauaggcaaauaauuuugacagcaccauggaagauagacuggugugagaagagacugcugaccacauuuuauucauucuacaugcaccacggcaucauaaagcaccuauuaaggcccagcacuguccuaaaugcuacaaacacaguagugaauaagacauagucucuguucucagggcacuuagucuuaugagaaucagacaaguaaacaggcaauuaugacacagcauaaguaucggacagaagcacagaagaagggcacucaagggggcaggggugagauacuaaaggaagugacguuuaaacugagaccugaaggacaaaaagguaggcaaaggaguagcaccaguguaugcaaagaucuagaggcuagaaugaggucaguuuggagagcuauuuaagagccugaauccaggugagaaaugaagguuccuucacccagaggucguuggcauucaaaauaugguggugagaaggaagugaagggauuggcuucauaaauaucugaauaaggggcacccugagaauugauuuacacaacaaagaaaacaauaaaggggaagaaucagcucaaaauccaucauccuucaccuugcaacuccauaguuuacuaaaaugugacccgaauccagaaaauuugaggacgucuaccaaaguacaaagguauacucuuuagagauaacacguuucagcacgcugacugccacgcaaugcaagauaaaauacacuauccuaagauauauggcucccaaguucaugaaguggggagcgauacgucugacagauaccgucugcuucucaaaaucacaugugccaaacaaauaggaaaggucaucagagggccagugcagaguucccagggaaagcccaaaguccugagcccgcaauuccccugaaaucuaauuagauggcagacacaugccuacuucaauggcaggguagagagucauuuguugaagaaaaagaagggcccugaagguguguuaaauagacaggacaugacucagaaggaggaggagagugagucuuaaauacagggcaaaggaaagccagucaaugaaaccuugggcacaccucuaccucaaggcuacacugggccuccugccuggcuaaagggagagacugagcaccgcugccagggccuucuucaaacaacauaggcuucagcagcacauuuguuuucuauuuucccauucagcugaggggacgaagcuauuuaaaaugccacuucuuuuuuuuuuuuucuguguaguuugcuacuuccuauuuuuauuauuuauuguuucaaauuuuauuaauuuuauucaggaaagacauugacuguuaaguuuuuuuuuggggggggggugaugucuugcuauuuuuuaaaaauuauauccagacuaugaauuuaauauuuacuacggcuaaucaacugcucaugucaguaaucaaagucagaaaugagccuuauacguacaucuacauuaaacacacacacaccccuuuaaggugugcucaguguagauucuaaugucagucuguccauucaacccaggcccaagguugcaucacaucaccaaguugaaucaugaagacagcccagauuugacugacauggcacagcaggcucccucaccacagcccaugcaccaguuacuauuucugagaggaaggagaggguugugaugaaaaacucagccccuaaacauuuuuuuaaauaaucaaaaaaaauucuacuacaauauggauauacauuuaaccauccugacaaacaaacaugaaccaggauauagucaaacaaacaagaaauacaaauugccacuacgcauauuuaaguuaacuugauaccaaccuaaagaaaaaaaaagcucaacugcugaagcuagaaugccuagguucaaauaccagcucugucacuuacuagcugggugaucuuaagcaaauuacuuaaccacucugccuccauuuucucaucuguaagacagggauaauaaguuaucuacuucauaugauuaugaaaauuaaauuaauuggccaggcacgguggcucacaccuguaauccuagcacuuugggaggcagaaguaggcagaucgccugaggucaggaguuugacaccagcaugaccaaugcggugaaacccccguuucuacuaaaaauacaaaaauuagccaggcaugguugugggcaccuguaaucccagcuaccugggaggcugaggcaggagaaucacuucaaccugggaggcggcgguugcagugaggagagcaccauugcacuccggccugggcgacaagaacgagacuucgucucaaaaaaaaaaagucaaaaauuaaauuaguuaauacaugaaaagcccuuacaacaguccuacgcacagaaugugcucaauaagcaccauuauuguuauuauuaucaucauuacucaacugcaaagauaauuguguagccucacagcuucaaacaggaaaucacuggcauuuuaacauugccuuaaauagccuaaugaggauauucucacgacaaaaaaaucuguauuauccaaaagcucugcuucaucucuuuaacaucaggcuagcagcccaaaccaaugcagaugcuaucuauauaaagagacagcagguucaaccaugaaacagaaauuagugcugagaucugacuaguauaacuaaaacuuacugucaggcacugaguaagcauauuaauguauuaacuaauuuaccuucacaacaacccuaugcgauagauacucuuacuacccacauuugauugauaagaaaacugaggcauacaaagcuaugccauuaauaaaggucacagagcuacaaauggcaaagucaaacagacuuuuuuuuuuuggagacgcuuuuuuucuugagauggauggagucuugcucugucaccugacuggagugcaguggugcaaucucagcucacugcaaccuccaccacccagguucaagcgauucuccugccucagccuccugaguagcugggacuacaggcgcaugccaccacgcccagccgauuuuuguauuuuuaguagagaugggguuucaccuuguuggccaggauggucucgaucucuugaccucgugauccgccugccucggccucccaaaaugcuagaauuacaggagugagccacugcacccugccagugcuuuuuuuguuguuucuuggagacugcaucuccuacgcugcccaggcuggaguacaauggguauucacaggugccaucauagugcauugcagccucaaacuccuggccucaagugcuccucccaucucaguaucccaaguagcugggacuacagguaugugccacuaggccgggcucagagucagugcuauuaacuguuauguguguucaccacacuacccuugggugauuacaauuacaauuugaaagggggcacgaauuguccucagaaaaaggagguucucaaccuucagaaacagagucacagcuacauaucaucaguucuucaaauaccuaaagguacugaagcugaccuaguaacagugacuuggguuguucuguuuggaguaagccuuugauuggggggacagguacagagcagacaguaaaugaagaguucuagaucaaaccauccuaguccaccaugaagcgaugcugauccugaagcaggcuucaauaagaaggcuacucccaacucuggcuagggcaaaacacucaccaaaggaagugaaggccacauucacuguguucucuggcuccagucccuuuccuuucucuccaacaccaaauccacuaccucucaggccaugcuuaguuuggcuacugagacugauauuuuucaaaagugguuugaugggaagauuacaaaggagagaaaaaaacuaccagaaaagaaaagagcaaguuccaugauccuuucuuugcaucaccacacuuguccaacuguaaaguagcucucaaauauuaggggucucaaggauaggcagugcggugcuaaacauucccagagcuuuacaucaguccacuugaucucuuaccagaaacugaucuacauuuuuucucucuaaucccaaccugccuuucccucaccucugauacccccaccaaaauccacauccccagaggaacacuaaugagcccuucuuaccaaaaaagcaaaaguagacacacagcgagaaugaauucaggagucagugacagcagguaccuaaauggucagugaacacgaucagaauuuguuuucucgugacuccccaccaucugucacccacaaaucuccacuuccaggcaggacgccaaagugaagaagugauggggauauugaagcagaaacaaugagcauguaggaaacugcuugugacagggauguguuaacauccuucggccuggucucuaggccucuguccagguuuacuugcauaggugaaggcacacaaggcuuaauucuacaccaacucucaaaagucagccugcaaucuacgccaaacacuaacuuaaggaccucagacaaaggacaaacucuauaaaagugagcccuuuucagaccaaauguuucuuggcaucacucuaagcccaugcauccuccucccagggagcaugccagccagaaaccugucacuggaagccaccuuacccgcucugggguuggacuggggcaagucgcuaucucuucuucuuuccaaguaggcacuguaauuucuuccagucccuggggcaccugaaucuucagcugaaauuggggcagaugcugcuaacagcuguggaaaggcugaucuaagccuagaagagggucauuugacuggcuuuaguucccuccuuagcagaucugcccggcauccuccagaucucucuuccucacuaucccacucuacuagaaagaucccuuuccccucuggccggccagauacagucgggccucuaucccacgcuccaggcuucuuuauucgcggcuaagaaauuuuccuccaacuugugacucugcuucuccagggccugcacaacaccuacuucuggcugccccgcccccaaaucccccuccccuagggcugccacuggacccuagggccccgguccgccccagcuccuuuuuuuccucuccgccucggaccuuacuccauuccaucuccucuuuucaacccuggagccaguacccccuucgccccuacuacaggcuagggcccccgcaauccuccccaacucuggcuuccccgcccgacuacuccaaccccacaacaaacuuuccgccgcugccagcugcguucaggccgccaucuugccgcggggcaggccggguaguggccagggccg

SEQ ID NO: 18369 - RNA, 29043 nt, Homo sapiens
cggcccuggccacuacccggccugccccgcggcaagauggcggccugaacgcagcuggcagcggcggaaaguuuguugugggguuggaguagucgggcggggaagccagaguuggggaggauugcgggggcccuagccuguaguaggggcgaaggggguacuggcuccaggguugaaaagaggagauggaauggaguaagguccgaggcggagaggaaaaaaaggagcuggggcggaccggggcccuaggguccaguggcagcccuaggggagggggauuugggggcggggcagccagaaguagguguugugcaggcccuggagaagcagagucacaaguuggaggaaaauuucuuagccgcgaauaaagaagccuggagcgugggauagaggcccgacuguaucuggccggccagaggggaaagggaucuuucuaguagagugggauagugaggaagagagaucuggaggaugccgggcagaucugcuaaggagggaacuaaagccagucaaaugacccucuucuaggcuuagaucagccuuuccacagcuguuagcagcaucugccccaauuucagcugaagauucaggugccccagggacuggaagaaauuacagugccuacuuggaaagaagaagagauagcgacuugccccaguccaaccccagagcggguaagguggcuuccagugacagguuucuggcuggcaugcucccugggaggaggaugcaugggcuuagagugaugccaagaaacauuuggucugaaaagggcucacuuuuauagaguuuguccuuugucugagguccuuaaguuaguguuuggcguagauugcaggcugacuuuugagaguugguguagaauuaagccuugugugccuucaccuaugcaaguaaaccuggacagaggccuagagaccaggccgaaggauguuaacacaucccugucacaagcaguuuccuacaugcucauuguuucugcuucaauauccccaucacuucuucacuuuggcguccugccuggaaguggagauuugugggugacagaugguggggagucacgagaaaacaaauucugaucguguucacugaccauuuagguaccugcugucacugacuccugaauucauucucgcugugugucuacuuuugcuuuuuugguaagaagggcucauuaguguuccucuggggauguggauuuugguggggguaucagaggugagggaaaggcagguugggauuagagagaaaaaauguagaucaguuucugguaagagaucaaguggacugauguaaagcucugggaauguuuagcaccgcacugccuauccuugagaccccuaauauuugagagcuacuuuacaguuggacaaguguggugaugcaaagaaaggaucauggaacuugcucuuuucuuuucugguaguuuuuuucucuccuuuguaaucuucccaucaaaccacuuuugaaaaauaucagucucaguagccaaacuaagcauggccugagagguaguggauuugguguuggagagaaaggaaagggacuggagccagagaacacagugaauguggccuucacuuccuuuggugaguguuuugcccuagccagaguugggaguagccuucuuauugaagccugcuucaggaucagcaucgcuucaugguggacuaggaugguuugaucuagaacucuucauuuacugucugcucuguaccuguccccccaaucaaaggcuuacuccaaacagaacaacccaagucacuguuacuaggucagcuucaguaccuuuagguauuugaagaacugaugauauguagcugugacucuguuucugaagguugagaaccuccuuuuucugaggacaauucgugcccccuuucaaauuguaauuguaaucacccaaggguaguguggugaacacacauaacaguuaauagcacugacucugagcccggccuaguggcacauaccuguagucccagcuacuugggauacugagaugggaggagcacuugaggccaggaguuugaggcugcaaugcacuaugauggcaccugugaauacccauuguacuccagccugggcagcguaggagaugcagucuccaagaaacaacaaaaaaagcacuggcagggugcaguggcucacuccuguaauucuagcauuuugggaggccgaggcaggcggaucacgaggucaagagaucgagaccauccuggccaacaaggugaaaccccaucucuacuaaaaauacaaaaaucggcugggcgugguggcaugcgccuguagucccagcuacucaggaggcugaggcaggagaaucgcuugaaccugggugguggagguugcagugagcugagauugcaccacugcacuccagucaggugacagagcaagacuccauccaucucaagaaaaaaagcgucuccaaaaaaaaaaagucuguuugacuuugccauuuguagcucugugaccuuuauuaauggcauagcuuuguaugccucaguuuucuuaucaaucaaauguggguaguaagaguaucuaucgcauaggguuguugugaagguaaauuaguuaauacauuaauaugcuuacucagugccugacaguaaguuuuaguuauacuagucagaucucagcacuaauuucuguuucaugguugaaccugcugucucuuuauauagauagcaucugcauugguuugggcugcuagccugauguuaaagagaugaagcagagcuuuuggauaauacagauuuuuuugucgugagaauauccucauuaggcuauuuaaggcaauguuaaaaugccagugauuuccuguuugaagcugugaggcuacacaauuaucuuugcaguugaguaaugaugauaauaauaacaauaauggugcuuauugagcacauucugugcguaggacuguuguaagggcuuuucauguauuaacuaauuuaauuuuugacuuuuuuuuuuugagacgaagucucguucuugucgcccaggccggagugcaauggugcucuccucacugcaaccgccgccucccagguugaagugauucuccugccucagccucccagguagcugggauuacaggugcccacaaccaugccuggcuaauuuuuguauuuuuaguagaaacggggguuucaccgcauuggucaugcuggugucaaacuccugaccucaggcgaucugccuacuucugccucccaaagugcuaggauuacaggugugagccaccgugccuggccaauuaauuuaauuuucauaaucauaugaaguagauaacuuauuaucccugucuuacagaugagaaaauggaggcagagugguuaaguaauuugcuuaagaucacccagcuaguaagugacagagcugguauuugaaccuaggcauucuagcuucagcaguugagcuuuuuuuuucuuuagguugguaucaaguuaacuuaaauaugcguaguggcaauuuguauuucuuguuuguuugacuauauccugguucauguuuguuugucaggaugguuaaauguauauccauauuguaguagaauuuuuuuugauuauuuaaaaaaauguuuaggggcugaguuuuucaucacaacccucuccuuccucucagaaauaguaacuggugcaugggcuguggugagggagccugcugugccaugucagucaaaucugggcugucuucaugauucaacuuggugaugugaugcaaccuugggccuggguugaauggacagacugacauuagaaucuacacugagcacaccuuaaagggguguguguguguuuaauguagauguacguauaaggcucauuucugacuuugauuacugacaugagcaguugauuagccguaguaaauauuaaauucauagucuggauauaauuuuuaaaaaauagcaagacaucaccccccccccaaaaaaaaacuuaacagucaaugucuuuccugaauaaaauuaauaaaauuugaaacaauaaauaauaaaaauaggaaguagcaaacuacacagaaaaaaaaaaaaagaaguggcauuuuaaauagcuucguccccucagcugaaugggaaaauagaaaacaaaugugcugcugaagccuauguuguuugaagaaggcccuggcagcggugcucagucucucccuuuagccaggcaggaggcccaguguagccuugagguagaggugugcccaagguuucauugacuggcuuuccuuugcccuguauuuaagacucacucuccuccuccuucugagucauguccugucuauuuaacacaccuucagggcccuucuuuuucuucaacaaaugacucucuacccugccauugaaguaggcaugugucugccaucuaauuagauuucaggggaauugcgggcucaggacuuugggcuuucccugggaacucugcacuggcccucugaugaccuuuccuauuuguuuggcacaugugauuuugagaagcagacgguaucugucagacguaucgcuccccacuucaugaacuugggagccauauaucuuaggauaguguauuuuaucuugcauugcguggcagucagcgugcugaaacguguuaucucuaaagaguauaccuuuguacuuugguagacguccucaaauuuucuggauucgggucacauuuuaguaaacuauggaguugcaaggugaaggaugauggauuuugagcugauucuuccccuuuauuguuuucuuuguuguguaaaucaauucucagggugccccuuauucagauauuuaugaagccaaucccuucacuuccuucucaccaccauauuuugaaugccaacgaccucugggugaaggaaccuucauuucucaccuggauucaggcucuuaaauagcucuccaaacugaccucauucuagccucuagaucuuugcauacacuggugcuacuccuuugccuaccuuuuuguccuucaggucucaguuuaaacgucacuuccuuuaguaucucaccccugcccccuugagugcccuucuucugugcuucuguccgauacuuaugcugugucauaauugccuguuuacuugucugauucucauaagacuaagugcccugagaacagagacuaugucuuauucacuacuguguuuguagcauuuaggacagugcugggccuuaauaggugcuuuaugaugccguggugcauguagaaugaauaaaauguggucagcagucucuucucacaccagucuaucuuccauggugcugucaaaauuauuugccuauaaaauagucuuccuggcugggcgugguggcucacgccuguaaucccagcacuuugggaggcugagguaggugaaucacgagaucaggaguucgagaccagccugaugaacaugaugaaacccugucucuacuaaaaauacaaaaauuaguugggcgugguggugcguaccugcaaucccagcuacucaggagguugaggcaggagaaucacuugaacccaggagguggagguuucagugaaccaagaucgugccauugcacuccaaacugggcaacagagcaagacuccaucucaauaaaaaaaaaaaaaaagucuucccuuagaaaugccauggguucuuccuuacuuaaguuaaagcccacacugucuggcuuggcaugccaaaaggcuccuuauacugggguccagacccagaccauuagccugaguugcugcuauuccaccucaucuguccugugcuucauugcucccaaauuucucacugcucccaaaccuaucaugggcauccauuuaguuucaucuucuuugcccauguacuucacucaguccauaaugcucaccucugccucugaaacugcccauccccuaagacccagcuccuuugucaccuccagugagaagccuccgcugcuuuucuuuccuccucuugguccccugcagcacuuucuuugaaccucuguuuuggcacuuaccauguuguuuggugagggcucuguuuacuugucuguuucuuucacugggcugaucuccuguagacaggggacuuugcagaacaugugguggagaggagucggugggaaugguaaugaauagugugaaagaaucugauuguggagcuaggcagaccugguuuaaauccuaauucugccacucaccaccugugcaacuuugggcaaguuccuuaaccaguaggauucuuggucucaucuuggucucuaaaaugagguuggcuggguguaguagcucacuccugaaaucccagcacuuuggaaggcugaggcaggaggaucacuugaggccaagaguuugaagccagacugacugagcaacauaaugagacuuugucucuacaaaagacauucaaaacuuagcuggguaugguggcuugugccugugguccuaacccucaggaggaggcugaggugggaggauaacuugaacccaggaguuugaggcugcagugagcuaugauugcaccauugcacuccagaaugggugacagagccagacccaaucucuaaaaaaauuaaaaacaaaaaaaaaaauaaaauaugggugacaucuuuuuugcaggaguaaugaguucauagcauauagcauggugccuggcauauaaaagacacuuggggcugggcacgguggcucaugccugucaaucccagcacuuugggaggcugagguggguggaucaccugaggucaggaguucgagaccagccuggccaacauggugaagcccugucucuaccaaaaauacaaaaauuagccgggcaugguggcaggcaccuguaaucccagcuacucaggaggcugaggcaggagaaucgcuugaacccgggagguggagguuacagugagcugagaucaugccacuguacuccauccuggggcacaagagcgagacuucaucucaaaaaaauauauaaauaaauaaaggacacuugguaaauauuuguugaaugaauaaauuucccauuuuggagcucugcaaauaggaaaaggcuuuguucuauuaaaucuaaaauaagccuuuugauuucugccugguagccaggagcauuuugaggugggaguaaaacggagucuccuuucuugugaggaagcaguaaaaaaggugagauuaggagcaucaucaaugagcagccugugcagagauuguugguguuucuccccaucucuguuuguuuguuuuucccaagacggagucuugcucugucauccaggcuggagugcaguggcacgaucucagcucacugcaaccuccaccucccggguucaggcaauucuccugccucggccuccugaguagcugggauuacaggugccugccacugugccuggcuaauuuuuuuguauuuuuaguggaggcgggguuuuaccaaguuggccaggcuggucuugaacuccuggccucaggugauccacccaccugggccucccaaagugccaggauuacaggcgugagccaccacgcccagccuccccaucucuuguuuugugaugacuccuuugaugaucgugauaugcuggccuucuccaguucuggugagguugguggugguggauucguaauguaauuaaggcuggggauagacagaaagcugcucacaguggaugacuggauggagaguuucaauauccauguuuccccauauuuuauggauugaaaaaugggugaaucugauggaacacauccaggcauugaggaagccagacuucuuggccccacuuuucuuagggcuuuaauggucuuccugugccacagaacaggcuuaacuuggaugcuucccacaaguggggcugauagcugcaucaugauccauucuuugcuuuuuuguuucuaguguaguugauggggguaguccuuagagccccaauugcuaacaaacaccaaaugaauuucuuuccagaauuaaguguauaaugccagggauacuccagugcgaguuuacaaucagaugaggaagauaugucugaguucucuggauggcagccuugucugguccuuaaacccuugucccagcuagguaccucuccucugugcucucaaagcacucaaccacacuguacuggaagugacuguuaaccugucucucucccacuaggaguaagaucuucugucucugaagcuucuuaggggcaagcuuuuuuacugaaggccaagcauuuaggcacuauagaguaagugcugagcaauguugguuacugugugacccaacucaguccuuccucagugggauuaaagaagauggaaucuaucuggcaaaaccuuuugcacccucaggaaggaagguccugcauaaacaaaaggugauaguguuaacaauagcauuacuaauuauuuuccaggauugcauucaugugguuaaaucaucuuccaggugcuuggcuucagcugucucccuuuuagccuuuuuauguuuuuuuuuuuuuucuuuuuuugagacagagucuugcucuguugcucaggguggagugcaguggcgcgaucuuggcucacugcaaccuccgccuccuggguucaagcaaugcucagccucccgaguagcugggacuacaggcaugugccaccacgcgcagcuaacuuuuguauuuuuaguagagacgggguuucgccauuuuggccaggcuagucuggaacuccugaccucaggugauccgcccaccucggucucccaaaguguagggauuacagacgugaaccaccaugcucggccagacgguuuauguucuaauaacacaucccuaagcaaucagaaaggggguuaaaggaggaggugaguacguaccaguagcuuuccaguagcuuuuuuuuuuuuuuuuuuugagauggagucuugcucugucgcccaguugggagugcagcggcgcgaucccugcucacugcaaccucugccuccuggguuuaagcaauucuccugucccagccucccgaguagcugggacuacaggugccugccaccaugcccggcuaauuuuuguguuuuuaguagagaugggguuucaccuuguuggucaggcuggucucaaacuccugaccucaggugauccaccggccucagccucccaaagugcugggauuacagguguuagccaccaugcccggcuccaguagcuauuuuuuuuugccuaauuagcaucccuagaaaggucuuuggcugcuggcugcuccuuuguaauucucuaugcugcccuuucuauugcccacuguaaccugcuugcuuuucugguccuaucucuagucccaucuaggcguacucagugcucacagccagagcuuaauacaaccuuguuaaugcccagauaaaucaaaaggaugaaaccaauagcuaaaaauggacugaaggaguuuucccuggguucucucccuugucccugggugugagaaugugcauugcguuguggcauaucuuugcagauggcaacuugcgggaaguaauaaacugcguuuuauguuaagcagagaggggguugagugagccagccagacuggauuguguuggauaucuuaggcuucaaggggacuaagucuccuugacugguccugaguagaagggugggaccucuucuuuguuaguuacuaucuugugccaauugugugcuaggugacauuuagaauuuauaaaggacauggccccucuuugugagaagcuucugugcugugguggggaacucaauaccaucccuugagaggaggauccgccuacggagaagccauccuagaccccaaaacccuggacuucuacucagcuaaccaauaggauaaaacucugcuuaucauuuuggguaccaagcggugguuggccucuuuauaccuucacagguagcccaaguagggaacugaaucucagaagucuuugagggucuugauauuagggcagaauuguccugguauuccuguggcuuccuggaaaagagcuuuccaggcuuugcacugguauuggagacaggggaacuggguuaugucccacuucugcuuguggucuugggcaaaucacuugugcuuucugacccucacaaugggagagcucccuauucuuugugccucacuggaccauaagcaucaaaggaaauaucauggaagggaaagagcuucugggaugauaaagcacaguguagaugcaggguuuuugucuguuugccuaggaacuguugguuucaccauaaacauacaucccuuguguaaaaugcuaaccauacagaaaaguauacaaaauaaaaaguaagaagauccucccuuucuucucccauuguuccugccuaacuuguuuccccaaagauagggaaccacuguucgccauuuaucuuguacccuucuaguaguuuuuuuuuuuuuuuugagauggaguuucgcucuugucacccaggcuggagugcaauggugccaucucggcucacugcaaccuccaccucccagguucaagcgauucuccugccucagccucccgaguagcugggauuauaggcgccagccaacacgcccagcuaauuuuuuguauuuuuaguagagacggggguuucaccauguuggccaggcuggucuugaauuccugaccucaggugauccgccugccucagcuucccaaagugcugggauuacaggcaugagccacugcaccuggccucuaauagcuuuuuuuauacgucuagacauuccucaccaaaacucaauauuaauacagacucuucuucagcuuucuuuguugacuuaagugaccaaggaguggaauggucccuguuggagccgcugaggagccugguuacagccuccuucccagucgagugaguuccucuggggcuggcucccugggagggauggagaaguuuuacuagagggucuugccacagcaggcacccuggcugucucugagggacauuuuuuuauucugagaugaaauuggcaggaguguccuugagugggaaucaggauggauauaacagcgaugugggcauuggcacucccaucucaccugugucucuccccuucacucauuucauuuuugccuuggaaaagagaaaaauuaucugauuucucaaauccuauauuagugcagugagagucccugauuucugaaaccuugaauuagccaugucacuugcugcucuuuuaaaagcacaccagacccaguugguguuuuuguuuucuugugggugaggauucugaaggucaccugucaguggcugugcucagucuagagcaggggucagggccugucggaagaguuguugucuuuuuuuucuagacaguugucucaucuucauagucaggccuuggccuauuugagcucuugggcuguagucagagcaacauggggagcccaguguguaggcaauuauuggaaguguuuccugucugcgugaaucuugauccuaggcuugggaaaaggccaggcccaccucuguggccaggguggugacucuucccuuuuugcccugagucaucagagagccugcagggcuuccuagaacaggagagaggaccccucucuugucuuuucccugccaacaucuuacccucugcuaagcaucaguggguguggauauauguguugcaguccuguccucccgccccaggggacacaucuuguggggucucuggaaugccacugcuuuugccucauuugccuugcagucugugagcuagaggugucacuucccccaggguggucuggaggcuucauggaagaguuguuucugccguugaugggagagcuucuugcucuguugcucguguugcuuguucugagaggggagaauagucccuguugcuccucuggggcugguucccugggaagugccaccccuggccaggcggcagugugcagcccgugcuguugacuggcccagcuguaggccaggcacacacugccccauuguacugugcuuuccgacgcagcccuugucauagccucuaauccuugggcugcuucucucccagccccucagagccugugggagguggugggauggacucugcuggcacuggugcgggauggguugcagcugcagcuguggguggcuuuguucuuacagccuagcuuucagaguccuggugcagccuggcagcaguguuuggggaacaggcgagauagaggagcugagccccuucuccaacagccguccucucuuucuguugaccaaccagagaggcuuuuugccugaggucagcaagcuggccucccugguuggcagggggagugcuuggcuuccaucuggcaugguuuccggaugggagaaagccccugagggucuggugguaagucugcgaugcuucccaucaggagagugcagugugcaguguguccccuugggcauccugcagcuugccauuccucugcuuucucucugcagcuccggaguugggcugcucacaaaccaagcugucuguuuauauggagugccuggagggcaucugccaugagucugucgcuaacugcacuaaccaggagagcuggcugguuggggagaagacacuaacccugugagucugaccucagccagcuaaccugcccuggggugccaccagcagggccucuguccuccauccuuccccgcagccuggcugccucccuccuuagcuuauaucacgccaucuccucugcucucuuguucuuacuacugcgucccucuauuuucccagucucccuuugcuguggguggggaugugcccccuucacggccaccugcccaucaccagccugcugcugggcuccacugaccaccccccaccgucacccuuccccgagucagcagcgugcucuucacuucucccuucauacagaauugguucgaguuucuguugaaucugugcuuuuagcacagaguuugagaagaucccucaauuaccaugcugcugcugcuucucaugccucagagacagaugaacuagagugggaagggacuuuucuccuagaucagaucauuuccucccuuuaucaagaagggaagguuggauagugucccuguuacucucacccuaggauaagaaguuaggaucagcugcaagguucucuuuaggauuggggagguagaggaaaaccuugaccugguucuggggaauucccugggcagaaaagugaagcuacuuaaacugaaugcuggggccccaaaccagggacccaugugagaugucacucccauuggugaccguugcucugggaggugaaguuugucccccccaccucuuuucacauccggaguuucugguggacuuuagccaugaaaagcugggaagggugccucaguagagugggggcaggaccuggcuucggauuccacacugggcucagaaaaaguccuggccucagacugggagaugggugcgugcagccuggcuuggagaagcucccacgcagucccuucucccuccaggcuugggaaggagaggcgggucuggagaucaugagaaaguugauugccuguuguuuccugguguuccacacaggucacucuagauagacuguggcuucggcuuccggaggcaguguggugcuagggaggcuggacagggggagcuugagaacagaaggcugccuaaguggauucuguuccccuugggcugggugagagaaggcagcagccuaccagcacugggugggagcuuguaaaugggagaggguguguuaugggcccggagcgaggaggauagcacuccugagcgggaugaugauuucucggagguugauagauuaagagaccaaaguuggugggggauauccauguugaccagaaauaucuguuuguuuuuuuggguuuuuuuugagacagaguuucgcucuuguugcccaggcuggagugcaauggcacgaucucggcuuucugcaaccuccgccucccagguuuaagcgauucucuuaccucagccucccgaguagcugggauuacaggcaugcgccaccacgcccggcucauuuuguauuuuuaguagagacgggguuucuccauguuagucaggcuggucucgaacucccgaccucaggugaucugcccgccuuggccucccaaaguguugggauuacagguaugagccacugugccuggcccgaugagaaauaucuugaugaaaaugcacuacguccaauaaaugaauauauguacuaugcaauauuaaggauuuauaguacugaucaauauccauguggaaaugaauuuuauuauaugauuaauaauagugaauguaugauaguugauuaaggaauaaacaauaccuauuuauaugcauguggauugagcuuauaauguauuauauaugaguguacuauguacaaauaaacauuuauaguacuauauauuauucauggggacuagcaguaaugcagagauguuuagggaccccaaauggggaguuaacaagcuggaggcuuucuugacuuggcucugaccaggaaagcaaaagggccuggaguugaggccugguugagggccgguccuucacuuuggccuuucuuaggagagggcauggggucuaaugucaaaugcaggcuaugaccuuggggauuucuugcccucuuuuuuugcagggagggguugguuugccuggcucuuuagccccuuguuccugugaaguguuugucuggaugugaggccagguggauagacuuggaaguguuugcucaugugggagccagaugagcucucacaggucaccagcacuguucugaguccucaggauugcuuuggggcagaauaauucccacucuuuuuggcuuucaaaacccugucaaucuguuugguuuagaguaggcagggggccaggucagggcugcaggcaacuugucccaagagggugagguuguacuugcccagagggguggcgggcauagcuguuggaggggcagcagggcuggucugggcacagacugacaucuucuagccuugucuucagcccagagcagaaccucugcccaguccccacccuaugagcuguuggcugccugccugccacgcgcccgggauugcugaaggcuuuacucauguaucucaggaacagcugcaugccggaaacugggggcugguggcaagcaggagggguaccccggagacgaugugggcgaggccgaacccaguuuuggugggaucagcccacugcucugggggacugcuauucauggggagucagugggagaggggcuguauuaauggugcaaggaguggggaucuucaugagcaauccccaggaccaaggccaggucaccugguuccagggcuuacgcuugcagggugaccauuuguguuccuuagacaucaguugggggcagagacuggauuucagaggcuugagaagcggccagacuuguguggcgggaguguagcugacccccacuggggcacagcuucccacaggcuugcagacuucagagacuccacauccagcacuuacagcucaggacaguuccugagggggaggccccagucccugugugaucagacauuuguguuuuagugguugaugaggggcuuuaggaagggcuuguauuuauuauuauuuauuuauacccugcuggguuccaagggaauuaagguggcauacaacacagcugguguauucugaaacggcuggguguuccuuucauuuuaaaagcaguagcgauuacuaacuuccguuugacuuugcuugguugaauuaugaagaagagcuuggaugauuuucaugguaaugugugggcccuuccugauucagaagguuguguucauugacuccuuaaggucucucacuugcuugauucauugacagcugagagcagaaaggcuucguaguagguucagaaauuaucugaacccagauaaacugauggggccacaauuaccugaaguagguauuggugauguggagaguagggagguaguugcucucuagggcaagcuagcugcuccaggaucaggagaguuguggagugagguaguagugcagaacguggggagcuggagauguuugguggggaaggcugaaguuggaaaagccaaagaaccauauccagucuggauuccugucucccucuccugggcugguguugaagggauggccucagccucagcugggagaaggauggaugcuugaaccuccuuuccucuucugcaucucugacuuugccugagcuuuaggcagaaccccggaaaggauggcagaagggaagugggacggcaucuuuggcucuugggcuggaaacuuuuugcuguugcuccuaugggugcuugcugggaacgguaagauaguauauuggggagcagcaggauucugaagagauuucucucucauaccacucugucucuagcaacagcaaucuuccaccacgguggaagccccugaucaaauaugcguacccacaaaagggagcagguauaagucccaccuccugguuaaagagugaugcuuggcaaauuuuuuuccuuuuauuaaaggacacugcucagccagcuucugguacagaucaugccuuacaccuauucugucuacacucugcucagcuguucagaggguucacagugcagcucugcugugcgugccgagucccauuucuaaugaaaguagacuuuguucucugaaggcagcuaaucaugccccaugggcuguaaucagggagaagguauuuaauacagggcaggcggcaacaggcggccugcaccgacuggcaaauugcaacauggcaauuaggaagcuaucaccccucucuccaccccagcagauaugaaguagagucuuuccuuugaacugauuuuugaguaagcaaagaaugaaugcuaugcagagcauggcagaagcugggguuggaugggguaggaugcagcaggggcagggaggguugaggagagucccuuuuccuucucacuucaccuucaugggauggggaaggguugcugcuacucugggugucucccucaacacugccugcagguccagcccaagaagccccaggccacgcuaggucagcgagagguuuuaaccuaggccucaaccuuucucccagggcauagcuguucuuacagaacagacccagcacguuaucugguaguccaacauccugagucaucugcccucaguuccucaaggcuuagguuuaguuuggggugggggugggagugggauucuuccuuguugauuuccuuuuuuuuuuuuuuuuuuuuugagacggagucucugucucccaggcuggaguguaguggcgcgaucuggacucacugcaaucuccaccuccuggguucaauuuuuguagagacaggguuucaccauguuggccaggcagcucucgaacuccugaccucaagugauccgccugccuuggccucccacagugcugggauuacaggcgugagccaccauguugggccagcucuguugauuuccugaucuuccuccagaagaccauuuucugggaggugcccuggagccagcucagcauccagaggccaggaggccccagaggcuguccuuggcugccgcuugcucaucaugggccauggcccauucugagcuguccagcugcucuccuuagggaccuuuucuuccccacaugggauugggaguccuccuugggcugaaacacuccaaggcaacuugggaaaccuuugggugaaggagauguggccaggggaggcugcaccugguagcugggucuuccuggagggaccacucugaugccaucugccucaccccuuuaccuucucccagcuugcaggccaagugucccgaugcuucucucuuuguuauccacugcaccaugcaucacuguccuccuugggucuguccggacuuucccugcacaccuuccuugccuccagucaaggacugugggcugccaggcccguuguauuccuguucauugcuggaacugugggccccuaaugggcuggaucuggggcacucagcagauuucagaaguuggagcuagggccuggguguugggcacacccuguguuuauggacacagggcaggaagugguugguacacaucucccucgcagccugguguugaggaacaccaugggcccccugguggauugucuucccagugggcauugccuucugcuuccuuaguugggagugguuucccauaccuguaacucugacaugcguggaaagaauaggcucuggcagagagaauaaccucccaucacaaccacccccauccccagagagucugucugcauuuacugccugucccacugccagcuaccuucucaggauacuccuugccuagcaagccagaucgccucuggccauggaagcccuggggauaaauacaugcuguagggccagggaguggggcuugaggucagggugaggcaggaggagcuagaggauguguggcaacuagagccagggcugcaggguguggagugaagcagccuucccuacaggauugcuggacacccaagugcguuuguguccucccugccugccugccguucaugcagguguuucgguaccaagaggacagcacaggccuugccaggaauagggacaagggaguacagaggaauagaggaggggcacacaaaggggccugcagagagaaagggcuuccugagaugacuggggagcacaugggggaagggagcugggaccuggacccucuguagagaaggggaaaggcagagaccaacucucugagcugccccuuuacuuuguagaagcucuugacugcucgcaucucucacucuuccaucucuggccauacccuguuuuccaacucacgcaccccacacauuuacccucugaguaucagaauccacauacccagguggguuuaggacuuucuaggccucucccucaggccauaggagcacccaccccgggcuccucuggaggggcagccccaaggaaccuguugggguaacuuguuugcuccccacaccccgggaaugugccguccuuucaggcccgcccacccggauuccugugcagggagucagccgacacagcauguugcaugugcccuguggggacacguucugccuccugucagggggaggaggcuggcggccgugccugugcugccgcaccucagcuccccaccgaaccccaaaccagggcccaggcuguccagacagaggagggagaccacuccugcuuccccacccucccuacccucucaccauucucccugccccgggcccuguuggaaugugacaggagucauggccagggcaugucccgacagugggaacacaugcuuuagcccgcaaggcuucccucaaccuccagcucuguuuagguugaugggggcgggaagagauuguuuuuucugcccagaaggccaccugagguuacugccugaucacugguggcugcugcccccgugcugcaacccagcuaauuacaggugggggccagggaggggugugcacccaucucugaaccucaggaggccggaggggcucucacaggucacucaguccagccaccucuguguagauaaggaacugagcuauccagugaggaagggcauuacacagggccccacagugucagugcugagccuggagcccaggugucuccaacucccccgacugggguuuucuucacgaguguuccucagccuuggcacucuggauauuuucuauugggaaucauuuguggugggaguugcccuaugguugugggaugaccaaagcauccccggcuucuacccacuaggugccaguggcacuccuucccuccagguuucgacaaccaaaaaugucuccagacacuugccagacgucccuggggaaggagagugggcgccagacgucccuggggaaggaggguggacagaguugccugguugagagcuacugcucuguguugcucccuuuucagauuucuucuccuagcccuaugccuccucauugcaaaggccggugaccaucauuauacaccaaauagccuugggccuccuucuggaaaugcuaggugcucucuuuccaucauuuucucuaucuucuuggaucucugugaggcuuuuuccugguguucucauuuguaacccauguuccccaaaucucuuaguuguuuccaaacucugagaggcuugggagaugaggaccgauguggaguagggacaggacggaaccggaccuauuccagaauugggcaaugugcugagaccaugaacacacagacacauguaucucaucugggccugugacaguacugucauggagaaaggcaggaacccagugcuuccagucaucugccuccagccgcuuuccccucaggcccucuguuucauggccuuccugccgugguucucccuggggggccuuccaggucccagacugggcagcaggccuguagcacugacagacaggcggcugacaccugguuuccacuuucuucccuucucugguuucaggagcuguggcuaaaggaaguggaggggccgugggaugcggagagccgagggcuaacucccggacagcggaacagagagagcugccgacaaacagacgguaugucccugaugaggccugugcccucagccuggcucucuucuggggaggggcaggugagggggcagccaaguguucucucucggcgggggcuggugaaaagagugguggaggccacagggguuuggucaucaguggcugaggccagagagcucucuugggccuugagacucccacuggggauccuggauuguauccccaaacucacauuuuugguuaugauuuuuuuuaaacuaacauuuauucaacauuuccuaaguguuuuacaucaucuucccaacaacccuaugaauuggugcuauucuuaacuggaaucaguagcucacaccuauaaucccagcacuuuggaaggccaagacagagggauugcuugagcuugagaguuugagccugggcaacaaagugagacgcuguguacaaaaaauagccaggugcaguggcacaugcuugugguccgagcuacacagaaggcugaggcaggaggauuacuugagcccaggaggucgaggcugcagugagccaagauugcgccacuacacuccagccugggcaacagagcaagacccugucucaaaaaagaaaagaaaaaaagaaauugaugcuguuuuaucgcuaauuuagaguugagaaaacuaaugcauagagagcaguuuuaccuucugaggccuucagagcccacaaaggagagugguaaggaggguggugggcugcuuugaagcucccugucccacucuuagaaccuagguguucaggcccuaggcccugccuuucccacccaucuguuccccguuggacccaugccccacccuccagcacuccuuugaccuauggggacugacacaccuaaguccugccccucuagugacuccaguaauggcccaggccugucagccuaugugguggccucaacauauguccccuuucaccaucuuuguuuuuucucaguccagaguccuucuggccacaucucugagccugccuccuucuugcuucucagcaggcggaggagccgucaccucccagaaugacuagugccgccccugcuaagaaacccuaccguaaggcaccaccagagcaucgggagcugcguuuggaaauuccuggaucccggcuugagcaggaggucagcaagacugguaucacagccugaccggcagaggcaaggccccugaggcugggugucuggcugacuucuccugccugagcuucugguccugaguuggggugagagugggccuugcuguugcaggccugaggucuccuagccgcaguagugcagguggggguaauguaggcucaagggggacugucugugaguauauguccacaugucagggaaccccugagucuuuguagcuuagcagaaaugaucccauaugauauucucccugcaagaggcagcccaguagacugagggguccuaaucugcuagugguugggacucugguccuccguaguggaguagagccauucaaccuguggccccuuuggggcauaucaggaggcagugcuacagccacuucccaccagcacagcugcucuucauuguccccaggaaguccagcccuuccuccagcuuugcuuuguuuggcuaacauuuguugaauauguacucccugccaggaacuguuagguccggacucugcucuucggggccuauagucagcugcaaaacauuggcucuccugccccauuaacuucacucacaggcagaaacgagggccacagugguuuacugcccuugcagccauaucuccaucuggucacagugcguggagcacauuuaaagaaccugagacgcagcaugugcugagcaucaggcauacuguagccugcuuuggucagauucaagguagaaaagccaugacuugcucauuucaguucagggaacauuaaauuaagaugccagcuauuaugcuaggugcuacccagcgagcauuaccucaguuuuauaaaugagggaacuaaggcucggugaggugaaggcuguauaaucaguaugcaguagaauagggugaaauccaguugucagagucaauggacaaaggaagccaccuaccuccauuuucugccagaggcugcucuucugaagcagucaguuccacauagaauaggccccuugauguuucccucucgcgauagcaggggccuacucugcuuugugguuggcugaacuugacucuugagccaugacugccauagggguuuggggaagauggggcaggagguuaaaagacagacaaggcacuuccuccccuuagucaggauuaguccucuucucccaugcacuuguucuuccugagccucugcaagagccugauucugccuuugucuucaucucaaggcugagggcuuugucagagcucagaacucguguguauaguucagccugacuuuucuggaaggucucugccauaccucuguggauacaggacccaccaggagccgagugaacagcugagaggcugucugccccuggggagagguagcuugggugccaggacuuauuugaaaauggcuuuaggauuggauuaagggugaagguuggaagagguucuugaaucuucugguuggcaugggagaggguagucgaggcuugucccagcauuacugaauugcuuccauccguagagagcccugcagcccucuucugcuauaagagucuuugggcuucacaccugagccuucuuguggcuauuuggagggugagccagccggggguccagugguccagagcugagccucaagccucucuuuuuugccuaggaaccccugacugaugcagaaaggaugaagugaguaucugcuaccugagauacugcccugccucaacucugucccucuuagcuccaggcuagacuguugguacaguuggacuuucccuuggauuagguagaaauaaagguugggauggguuguuuuagggacucugggaggaguguugauguuguggauauuuuuucuggaaaaugggauuuuauuguuccaugggcuucaagagagcguagaaucaggaggcgaauggcucugagggcccugcucuucuugcuaaggagcccuuccccagcuccuggcuccuguaccagcugccacccuuacagcccuuuagccacaugaggccucuggagaggagggcagugcugggcuggauuuccaagagaugaauaauggagaagccugauugugcaguggggaaacuggagcugggggcuugguggccagcugacaugggcuguaaccagagacaggcugggagccauaucccuacccccaauucuuuauuucuauucuccgauagugaagggaggcuggacuguccccuaccauccccucuuccuccccugacccuccaacccaggcuguguucccagggccagcaggccuaugaaauaugcugccuuagacucagacuaagacuccaggaguuucccuguccuguuugccuguccucaugucaucccuuccuuccugagcccacucuggagcuccagggcaugcccuucuaucucucauaccccucugcccuugaucccacaacacccugccaggcucuuacaggaggagaaugaagagcuucgccggcgccuggccuccgccaccagacgcacugaggcccuggaacgugagcuggaaauugggcaggacugccuggagcuggagcugggccagagccgcgaggagcuggacaaauuuaaggauaaguuccgcaggugugggaaugaggggccagacacacacacacacacacacacacacacacacacacacacacacacacacacucucucugucucucucucucucugugucucugucucucuccuuucauaggagguuagcuggaagaugccuuagagaucaucuaauuccuauuaaaaaacuggauaaguucugcaggugugggaaugcggggccacacacacacacacacacacacacacacacacacacucucucucucucucucucucucucucuccuuucauaggagguuagcuggaagaugccuuagagaucaucuaauucuuauuagaaaacuggauaaguucugcaggugugggaaugcggggacacacacacacacacacacacacacacacucucucucucucucucucucucucucucucucuccuuucauaggagguuagcuggaagaugccuuagagaucaucuaauuccuauuagaaaacugaaguucuugagggagaaugacauguucaagauccccuaucggggaggcugaacagagccugaagaacaggaucuugacccagggaugugccuuguauuaucccuuuucaggcugcagaacagcuacacggcuucccagcggaccaaccaggaguuggaggacaagcugcacacacugguaaucugucugggagggcagcuuggugggcacugugcucauagcauagcagggggccaggauuugccaggggaaugccacucugcccuggggcuugagggagauggugggauggggcagugguggggguacugcagugugcucugcaagucaagacugucuuaaugcucacacuguuucucuucuuuccucgucucccccucaugcugccaccguugcugcugcacucuccucucaggccucucuuagccacagcuggauuuuugcaguugcgucugaguuugugugucuucucccuugcccuggccuucuccucagcugagaucugggauugugggcccuggcuguuacccugugccccuugaguacacccgcuccuuucucuucccuguaugaggcccguuuaacugucaaugccucccucccaggagagagguggggagccuagccugcucugcccuuggcucugguagagguacugauugaugucuccacugaacacccaaagcuucuuggcuccaguggcagcaagcccaggcugugggaguggggaggggaggcugcagauccagucccugaacuggagaucagaaggcuacuuuugagccugcagcuugcucccugcucaacaaggugcccuggcugccaccgcgcccugcuuccucuucccucuccuagccugaugcuggaaacagcugcacacauaggaggcuucagcccccugguuugcaguuacugccguugagguaccagcugccuugccuggugcccagagccccuggaaccucaggggauggacagcucuuauacugccuguguccugggcccagguggcaggaagucaugcuaagaaagcccccaccccacagccaguccagagagcgggagagaugcccagucuccuucugucuguccgucauuugucucugcucuguccgccuuggcugcccuagcaccuguggccucuugugucuccaggaugggaggagguggagggagaggaagggcuggcuagagugugggcuggguuaaccucaagucugugcuucagaucaagaaggcugagauggauaggaagacgcuggacugggagauuguggagcugaccaacaagcugcuggaugccaagaacaccaucaacaagcuggaagagcucaauguaugugcgcuucacuacucgggccuuccucaccuggggcuagcuuuguccuggcucggcccugcuuccuuggagagggcugggcugggcucugaaacaggucugugucuguaggagcgguaccggcuggacugcaaccuggcuguacagcuccucaagugcaacaagucccacuuccgaaaccacaaguuugccgaugugaguagaacucacccccucccugcccacauagaccauuccggccacuguaggacuccucuaacuccaguuucugcaccucucucuguccuccucuucccacuuugcccuccucuugccuccaugucaccucucaagccagucaacucugccacugguuggugucccguguacuguccagggcccaucacuaguucuggggggccagcccuguugguuucuguaacagagacagagagagaagauccugggcaggaaggagaggguagucagagcuaucugcccaaagaguacuaagagaggauuaggcccaucugaucauguuaccccaagggguaaacucuagaccccacagcuucaggcccaagguuuauguggccugcagaaguagaagaaguagagguauuucuuuuuuuuuuuuuuuuugagacggagucuugcucugucaccuaggcuggagugcaguggcacaaucucggcucacugcaaccuccgccucccggcuucaagcaauucuccugcuucagccucccaaguagcuggaauuauaggcgcccaccaccacgccuggcuaauuuuuuugucuuuuuaguagagaugggguuucaucguguuagccaggauggucucgaucuccugaccucgugauccacccgccucggccucccaaagugcugggauuacaggcaugagccacugugcccggcccagaaguagagguauuucuaaggcuacuggucuaugcagauucuccaaacuuaaguaugguuugggcagaagcugggagauagaaguuugagaacaugcuggcugcagcagcagauccggguuuaaaucuuggccaaguuaaccaaagcuuugaguugucuuccccucuccaggccuaugugucugugaagugaggguauacacacuggcaugcuguaagaacaggagauagcagagugcugaguacacagagguacuuaaaggugggagccauuacuuucgccaugagucaaguuaucuuuggcugcgaucauugaugucucucuuuccugcucuuuuaccucagcugcccugugagcuacaggacaugguucggaaacauuugcacaguggucaagaggccgccagcccagguccugcucccagccuagccccaggggcuguggugccuaccucagucauugcccgaguguuagagaagccggagucucuacugcucaauucagcccagucaggcagcgccgggcgccccuuggcugaggaugucuuugugcauguggacaugagugagggugucccaggugauccagccagucccccggccccuggcagccccaccccacaacccaauggggagugccacucucuggguacugccaggggcuccccggaggaagagcugccccugccagccuuugagaagcugaaccccuacccaaccccgucuccaccacacccacuguauccuggccgcaggguaauagaguucucugaggauaagguucggaucccccgcaacagcccccugcccaacugcacuuacgcuacccgccaggccauuucccugagccugguagaggaggggagugagcgggcccgccccagcccagugcccagcaccccugccucagcccaggccucaccccaccaccagcccagcccagcaccccuaacacucagugccccagcuagcucugccagcucugaagaggaccugcuggucagcuggcagcgggcauuuguggaccguacuccaccaccugcugcuguggcccagcgcacagccuuuggacgcgaugcccucccugagcugcagcgccauuuugcccauagccccgcugacagagaugaggugguccaggcaccuucugcccgacccgaagagagugagcuuuugcuacccacagaaccugacucuggcuuucccagggaggaagaagagcugaaccugccuaucaguccugaggaagagcgccagagccugcugcccauuaacaggggcacagaggaggggccaggcacuucccacaccgagggcagggccuggccacuccccagcuccagucgcccccagcgcagccccaagaggauggggguucaccaccugcaccgcaaggacagccugacccaggcccaggagcagggcaaccugcucaacuagggccccugcuggccuuccugccauugcugcaccaggacugcaaggaguccccacaccuuggcagcucaggguccccaguccaagcccuugaccucuccucuauccagacccgcacagcuguuuccuguguggauggggucagguugugggccaugccaggccugucagcugcguugacugacugcagcagcuugccucaugguuuucccuuuuucuuagaauauuuauucuucagagguaacaugcaguugggucucaagaccuuuccuccaaucagcccaacccagcccagacugggcuuuucuggggagcugaggaguuuaucaguauucaucuuccauccuuucauagucacaaguuuuguuauuuuguuuuuuuuugggggugaugguguaauuguuaaccucauuuccguuuccuaccuguuugcuuccccccccaguccuccgcaugagcuguugcccuccaggggccuggcacagcuggccuuggggacgagggagaggacugauucagggcccccucagcugucuccucccucccucuggaaaggaggguggggcucaggggccucaagcugggcucugugugaggccuggcccccacucccaaccuuggcucuagacuguuacucuuaagcuuugagaaauuuucacauugaugacuauuuuaaaaucaaauaaaacuauuuuacugguauggccuaacuugucuuaaugaccuccccucucccacuuuucucccca

SEQ ID NO: 18370 - RNA, 6886 nt, Homo sapiens
cuucauuauccauuugggagaugaacagacugaggcccagagagggaaagccacaugcccaaggucacacagcaaguuaauggugaagguuuuaucagagcccagggcagacucaguggcuuccuauccagggcucuucccacagcucgucaccacugccccaacccaaggggcaccuuuauuuacagaauccuccccaaccgugagaggggugcccagcagcccacugcauucugggaagucaacuguuccuagaagccaaauaaucaaggauggaugagcagagggagcggguacuggcagcaacuccggcccuaggcagaggguucgauacucccagccugaguugcagggccugcccuucugcucucccagccccugcugcagagcuucuguggagggccugccuccacucccacuuaguucuggaccugcuucaugggcaucucuuccuccugaagacugguuggggcacuagggaggaaggaguugugagcaauggugggguuuaauccccgagccuaccaccccagccugccccaucagggcugucccagggcucaccccaguuccugguauacaaacgccuguacaagugacucacacacaugcuuguacacaccccugauguguaggcauacuugagugugcacacauacacaucuuccugaacaaccuuauguauuuguguucauacacucauguacacauuuaugcuugcaguuuacaugcccccaaucaugcacccugaaacacucaccugugcacgcacacauacaugcaccaaguacacaugugcagauauaguuuccugucugaauccuaaggugucagguaucugagcaccugcauccauaugcauguuaucacacguacacagacacaguccugugcacacaccucuuucucuccacguccuggauggucucuggcagcugugccugccucgucucuggcagcaggagggcggugccggcagccagcagggcgauccccccauaaguaagcuugggcagugacagccacacuccauccagcaaggccgccaguggggccaaagagccccccagccggcccaccagugcagucagccccaucccugucugucuguucagagaaagaggaugagggaggcagaugguguucacaccuaccuggagucaugccccacagggcuucccuccagggcuggcaggcccugauacucccuucuccccauauagcuaagaaaacuaggacuucuuucaguuggucuucccacccaccuucaggccaggagaccucaagccagcacccaccagaggacagggcccccauucugacagaguaccaauuagguaucacuaaaggagaagacaagucaccagacugggagauaaggaaagggugauguggaaggaagaaggucaguaguuuguacaggcccugccauguuguucgaggaggcaaaccucuuucuaaacaugaccagaugccuagaauuuuccucuucccaccucucaguagcuagcugaaagacccccccaaccccgggccuuucaagggguugcucuugggacaguccucaagggcaucucugccuuccaggggugaaugggaugggggugggcaggauggggcuucuuggggcuguuuucuucuucuuauuauuauuauuauuuaauuuuuuucuuuuauuuauguauuuauuugagacagaguuucucgcccaggcuggagugcaauggcaugaucucagcucacugcaaccuccaucucccagguucgagcgauucuccugccucagccucccaaauagcuaggauuacaggcauucgccaccacacccagcuaauuuuguauguuuagcagagacaggguuucaccauguuggucaggcuggucucgaauuccugaccuucagugauccgcccgccuuggccuuccaaaaugcugggauuacaggcgugagccacagugcccggccuugggguuguuuucuuaaggaggcccagagaggaugucugacguggcucagggucacauaguacagaagauaagaugcucugccuucuccaagacuagggcaaacacagagggcccugauuagcucuguauucuggguguaguguggagaacgagugagaggcugggugcgguggcucaugccuguaauagugccuguaauacgagcacuuuuggaggcugaggcgggaggaucgcuugagaccaggaguuugagaccagucuggguaauauagcaagaccccgucucuaccaaaaauuaaaauuaaaaaaaaaaugagugagagaccagguuguggugcguguauguagaaguguugguuaagacacgugacuaacaagccccauacccccagaucaguugcaggcuuccucaccugagcaccguaggguacaacucugaagugaacagguaggcaguggugaaggcagcuucagaaaaagcuuuccccaucacugccaggacagugcuccaggacuucauaucuggagggaagcggguucagguagugagagggccuuggaggagagccagggguguucuggauagggugcggagucuccagagugggccaaacuuaagugguggagagucugagcucacuggguaagagcagggaucugggggaggaguggguucuuggccaggagguggggucuccggggagugggcaggguuccuggcccggcuucuggggugggcagaaccuaugggacugggcucaccggaggacacuagcagucuagugccgaacgccagggccgugcccagcagugucccagcuugcgugaggcggcguccugcguagcgcaccgacaaguagaccagcagcuuggagggcaguuccacagccccgaacaacagcugugucugguacacguucagccccagccccgacacauccagacucaggccguaauaggagaaguucacuccgaaccugaaaggagucucagugccacuuggcggacccuccuucccaucccucuuuggccucucuucucaggaagacuuggcauuuuacaagggcaaucuccuucugucucugcaacccccgguccccccgccaggaccuucccugacauccauaaugcccucugugcagcaugcgccaguagucaaagcgccuuuacccuaauuuucacagcaacccugacauggaacugacaacaguccguuuuacagaagggacacuggggcucugaguggcuaagucaucugucccuuuccaaguaaggaagugggagucugagcuugaacccaugugucucugcuaccugcuucauuuucugacuuccccaggcagaucgcccauggagguuuauccuccugcccuccacagugacacucuacuugucccucagagcccuucucacacucagcaccagccuggaguuugcuccucccucccaccacacccaugccagacccaagccagccuccucaccacaccaccacgcagcacagugagaugugucggagccguggugugcggaacaggucuagguaugaaggucuucggaccacccguuccccggcggccacuuugcucacagccugguagggaaggaggugagguuguaacaucagaguuggcuaugugaucucaaugggacacaguacucuccccccaccccucucuauuccucccaucugcagugguggggauggagaugcucauggcagcugagacgagugggucucgaaugauggauguggcccacuggagccagguaggacauccuaaagaguucggaacucucugugggggcccaggggcuuuuccugccauauauggugggcucugggagggaggcacuugacacagcccacuccccaccacacacauauaugcaugcucacacacacguucacccucaccuccuggcugaagcuguccucacacacuggccgcccauugagccuggcacaguggagcaaguaccugugggccucuuucacauggccuugggucagaagccagcgugcagacucaggcacccaccuaggaauaggcagaagguccaucagccagaaagucaugacccuaagccacauguuccuggacauacuacaggcucucaacuuccaggcucuugcucauguaguccccuuagccuggaacaucaucuccuccccaagcccuccacacuugaugagcucuuauucaucuuuuaaugcccaguuuaaaagccaccucugggcugggugcaauggcccaugccuguaauccaaacacuuuuggaggucaaggcgggaggguggguuugagcccaggaguucaagaucagccugggcaucauggcaagacccugucucuacaaaaaaucaaaaaauaaauauuagcugggugugguggcacacgccuguagucccagcuacucaggaggcuaaugcaggagaaccacuugagccugggagguugaggcuucagugagcugugauugugccacuguacuccagcgacagagcaagaccuuaucucaaaaauaauaaaaauaaaaauaaaacaccucuucccacacuuccuugcccaggcccagguccuccauagccugggagucccuuauucaacugaauuguccuuacccucaagaccagcucccagcaccagccacucacuucucccauggguggcaggagggaaugagaugaaggagggacagacauguagacauauccagaagggucauccaaggccaagucaucuuuaggaggcaauguagugcccacccugccuguccucccacucuccggccugagcuccccacccccaugcuggcccugccccuauccccaacucuccaaggggccagccucaauuuauguuuggcucugucuuuaucucugacucucuguaucuuguucucuguuucucacuuuuccuugccaucuucuuucuguugaucucugucucucugucucuuuuucucugugucucuuucugucucuuggucacuucguuucucuuucccuucaucucucaaucucucuauccucaaaucucaggcucugauuaaucucaucuuucacuuccuguaucucccgcuccccagcugccugcaguccucaccagaggcugaggaugccuggggcacaaggcagggugacagcuagcagaagccaucgccagucccguaucagguacccaaccagugccagcagcaucacgcccccuguccagaaggugcugcucaggacuccagccacggugcggugcuccacauccagccacuccagcucugggccaggacaggagacaggaagaugguuagugaggaccagaugggcucagccucacucugacaacugccuucuuccagcccucuagguccugccuguuucuugccugccucacccaguggcaucacgaugaugguaaaaccagccagggcugagccaguaagggugcgggugauggcaaacauuacauagcugacggaggcugcagaugccaggcccagcaccaggguacucacguaggcuaccagcagcagacgccgccgcccaaaccugcaaaggggucaugcagggucaguucccuguggaaggagguucuaaggcauagguagacuaggcucauaccccagcuagugggagaaaguucccccagccaguuucuuauuggcccagugccucaccccaccugucggacagauauccaaaggccacagcccccaccagcacaccggcgaagaagaaaguggacgcagcucuguucagaccuuucugcucacacaccagaucccacugcaaggacaggcagaaagggaccuccuaugaacaucagccccucuccagcaggcaccagcuccuccucuccagacccuggagccuucugaggcgaacucugccauucugguaccuccaugccagauaauaaaccucccaacgauucacgccagcuuggggaauaggaaacuuugucccuccccaguccugcagccucagcuucuucccaaggaaggccucgaccugcugccucccagggagacugccuccaccgacauuccaccuccagauggauuauguaaauaccgaccugggacuggaaaagaggaagggagaaaagaaggccucuauuguuucuccaccucuugcugcagaaauugccuucucagcucuuugucucaacucccugaagccacuuuagcccuucccugccuuaaucaccucccaauuaaugaugaugauaacaguucuuguguaggauccuguuacuacaagccaugaacuaaaagugccuuauauucauagcccccaucuacagauugguaaacugagacuuuaagagguaaaguaauacaucuaaugccuacacaguaaccacccaaggcaauggcaggcccaucccucucacaugucucucaacuucugggcuuaaguaccucaguugcaaugguagaggagaauucugaguggucguacucccagcccugagagcagggcacuguggcagguucauccuccagcuccccacggcucugccuuucuucccccaacgugguguuggggagagccuggggauaggcaaagcggaggcaggagcugagcgugccaucaggcucccggggaagaugggccuccagccacacauccugauggcugaaguuggcaggggcacccggcagggcacaucggugggcaggcacggcagccaggaagaugggcaggaggaagugcagugguagcagcacucggggcagggccagcagugccacauuccgcaguuggaagggcccaaagccgcccaccugcuccagcagcuccucaaagcccaugcugcucacccaccaaaugcuucaggugcagccucccucuaguauccagccagcucaaacugcccaccacauagacccuuggacucuggaggugggagug

SEQ ID NO: 18371 - RNA, 607 nt, Homo sapiens
uucucuuuuuuuuccaccaaaaacuuuuuauuggccuuuuugauggaaacggguuuauuugucaggaaggaugaucccaucauacuuaugcuggaagcaacgcaucaucuccucuuugcugagucuguguuuggccccagugcagccuguccugugcuucuugucugugaugcugaaaccuggccuacccagcaccacagagaaguccaggccguagauaccaaugcuugggucauauaugauacccaaaucgauguguuccuggaucccaaaaccaaaguuucuaguaucugagaaguuauuuuuucuuaacucauacuucugcaccuuuagauccuucuccaggauuucuucugccuuggauccuugaacugugcaguggacagcaaucuuuucauuucucugcaugccagaggaucugauuguaucuagcucuggaaaacacaggacucugcccugugagcugcuccaaugccuuggcugcucggguuagucugucuccacucuccuccacacagauguugaggcagagcuugcagaugugaaguuucugcaugggguucuccuuuucaccuugauccgccaugauagagaacaggaagagcuc

SEQ ID NO: 18372 - RNA, 607 nt, Homo sapiens
gagcucuuccuguucucuaucauggcggaucaaggugaaaaggagaaccccaugcagaaacuucacaucugcaagcucugccucaacaucuguguggaggagaguggagacagacuaacccgagcagccaaggcauuggagcagcucacagggcagaguccuguguuuuccagagcuagauacaaucagauccucuggcaugcagagaaaugaaaagauugcuguccacugcacaguucaaggauccaaggcagaagaaauccuggagaaggaucuaaaggugcagaaguaugaguuaagaaaaaauaacuucucagauacuagaaacuuugguuuugggauccaggaacacaucgauuuggguaucauauaugacccaagcauugguaucuacggccuggacuucucuguggugcuggguaggccagguuucagcaucacagacaagaagcacaggacaggcugcacuggggccaaacacagacucagcaaagaggagaugaugcguugcuuccagcauaaguaugaugggaucauccuuccugacaaauaaacccguuuccaucaaaaaggccaauaaaaaguuuuugguggaaaaaaaagagaa

SEQ ID NO: 18373 - RNA, 16341 nt, Homo sapiens
gaaggaggugcugcgucgccaagguggcauccucggcuccgccccggcgcucucccagggccccuagcuuuccgcugggucgggcggaaaugagccguggcuuuuggcuggcggagccgcuggcagggaccgggccccacccugccccaguggcugccgacucacgcgggugcagcucuguuccgcggaggcacgcccccucccgucucuccgucucgacccccucgcggggcccagguggggcccaagucgccgccagcgucugugccgcgucccuugcucugugaaggacaggccucgcgccaggaccccgguggacuucugagguggccagagccccaccgcggccccuugcuucuccuucccugcccacuagcccaucgagccucgcgcucacccaaccucgguccccauccuaccgugccucgggguucuagcuuauggggccuaauccccucucccccaccuuaccgcgcgccccuggcuucuccagucuccaaccucgguccccaagccccucgccuaccuggucugugcacccugcccugggucucgcggcgcccucaccagcccucuuguuccaguugcuccagucggaggcgccuccaacccaccagugccuccuccuaguccaucgcgccuugcccucccacuccaccaccaguucucaggucucuuaacucugcgaucucgggacucuuaacuugggucucgcacucccaugcuccaauccuuagagacagcaccccuuuucacacacacucacgaucucccucccaaacauaccccucugggcuucacauaccccauagguugcugccuguuccaaggccuugggauucacuuguaacuccaaggcugcccugcccccacuaguccgcccacuguuccauaucaacccacuccaggccacagggucuuggggaccuuccuuuuagcccccaaauuuuguguucuuucacaacaaacaccccaguguucucugcuuaggccugcccccacccagcgugcagcaugcaacuccugggccuggcuuuaccccaccccgccugacagcuguugccauuugcuuccccaccuccuggauaucuuugauuuucugaccucuccuuccucuagcuugucuguucucuuuuccuugugugcuccaggugccaggauggugggagaacuccgcuacagggaauucagggugccccuggggcccggcuuacaugccuauccugaugagcugauccgccagcgcgugggccaugaugggcauccugaguaccagauccguuggcucauccugcggcguggcgaugagggggacgggggcucuggccaaguggacugcaaggcugagcacauccugcuguggauguccaaggaugagaucuaugccaacugccacaagaugcugggcgaggauggccaggucaucgggcccucccaggagucugcaggggagguuggggcccuggacaaaucugugcuggaggagauggaaaccgacgugaagucccucauucagagagcccuucggcagcuggaggagugugugggcacuaucccuccugcuccucuacuucacacuguccacgugcucagcgccuaugccagcauugagccccucacuggaguauucaaggacccaaggguccuggacuugcucaugcacauguugaguaguccugauuaucagauucgcuggagugcaggccggaugauacaagcccuguccucccaugacgcuggugaggggcaguguggggaggaagggaaagcaggagaagggcugggucggcucagggacucacaggacacuguggcaggagccucugaucucaucaguacguaaaugauucuguugcccuucucuuagaguuggaagaaaaggaggugggcaugggagugaggguggggguuaucugccaaaagaggaaagacuaucuucaagaaccucauauuaauuaguugcuuuuuaugcaaaggaagaauuuagaguuuagacuauuguagaucguguuuaugugcguguguguguguauguguauaaguuagcaaauuuuagcuuuugaagcaaaucaguucuuucucauugugugguggcaaaaggauuggauugaaagaguagagggucuaagauuucuaggaagggugagauuagggagaaguuaccaacugggguguggguuacagggacccggacucagauccuucugucacugagccaacaagaagccauugagaaacaccuggauuuugacagccgcugugcucugcuagcacuguuugcacaggccacgcucucugaacaccccaugucuuucgagggcauucagcuaccacagguaaccuuuggggguguaagguggggggaacuugugaacaagaucuaggguccaggccuuugcaccuaucugcagaggaugguauggagagaggggcuuaaacugggacaagguggauauaggccaaagguuguaucccacaggucccaggaagggugcucuucucccuggugaagcgguauuugcaugucaccucgcuccuggaucagcugaacgacagugcugcggagccaggagcccagaacaccucugcuccugaggaguugaguggggagaggggucaacuggagcuggaguucaguauggccaugggcacccugaucucggagcuggugcaagccaugcgcugggaccaggccucagacagaccaaggagcucagcacggucccccgguuccaucuuccagccucagcuggcagaugugagcccagggcuccccgcugcccaggcucagcccuccuucaggaggucaagacguuuucgcccucguucugaguucgcaaguggcaauaccuaugcuuuguaugugcgggacacacugcagccggggaugcgagugcggaugcuggaugauuaugaggagaucagugccggggaugagggcgaguuucggcagagcaacaacggugugccuccugugcaggugaguggcacaugguggugggauacuguugggggucuauuugggguagggcagagcugggacuucuauaugggggggcuccagcaggccacccaaagagaaagcuuuagguaagauuggaauggugaaaagagucaguaguugagaggggggccauucugagagcugggaaaaucuggguuuaggaggcugugaagucaagaagacucacaccugggaagaaacugauauagccagacuccuccaaaggucagggucagggagauggagugguggaggccagaaggaagugugggggcauaagccaugaaagacagggugagaggagagacaggcccaucccccaaaggagaaggcauccuguguguguguguguguguguguguguguguguguguguguguguguguguguguguauucuccauaugcugcuguuuuguuauguggagguuuuucuaaaaccuggccagguggucacccugagggcuauaguccucaguacugggccacagccagucauuugugaguccucccuuccccuucccucuuucuuucccuaugcuccagguauuuugggagucaacaggccgcaccuauugggugcacuggcacaugcuggagaucuugggcuuugaggaagacauugaggacaugguugaggcugaugaguaccaaggggcaguggccaguagaguccuggguagaggugagcucagggaggaagcaagggucagcucugagcagaggaauggugguccugcugaguugcuagugacauccuugugccccuuggcccauuuucacagcccugccugccuggcgcuggaggcccaugacagaacucuaugcugugccuuaugugcugccugaggaugaggacacugaggagugugaacaccugacccuggcugaguggugggaacuccucuucuucaucaagaagcuggauggaccugaccaucaggagguucuccagauccuccaggagaaccuagauggggagguagagccagccuggagacacucagagguuggagggcucuauugcaagggcuggacuguauagagcauuuggaaggcucaggaugaaaaguggaggucagagaguggaaggggcugcagaggaggggucuggaauuuucagaggugggagggugagcuguuugggaggagccagcugccagcugugagaggaucaggauggaggguaugugugcagagagacccccaccccuaccaagugcucccuggggccucugggucggcagggcugucugcagugagagcuucuccuugauggcagauucuggaugaugagauccuagcugaacuggccgugcccauagaauuggcccaggacuugcugcugacucugccacagcgacucaaugacagugcccucagggaccugaucaacugccaugucuacaagaaguaugggccugaagcccuagcagggaaccaagccuacccaucccuucuagaagcccaagaagauguccuccugcuagacgcgcaggcccaggcuaaggacucagaagaugcagccaaaguggaaggugggugccagacacagcagcugagcugacacaccuucagggcaguagcacaggagagaugucugugcugauuuuuaugcaauccuuucuggaagugaugccaccuuagaagcugcaacuuagagagaagcaacaaacggagaagcaggcauuguguucccucaaagaaugaaggaggauguaaaguuagaaaauugcaagagaauuuugaagacuuaaaaaagcccccacauuuagcuuuuucucuuguacagaaacauauuccaugcuuugaaauaaagggaagugcucuccuguuuucagaugaagcuacuuugcuauuuuaagaauauaaaggccgggcaugguggcucacgccuguaaucccagcacuuuggaaggccaaggcagguggaucaugaggucaggagaucgagaucauccugccuaacauggugaaaccccgucucuacuaaaacuacaaaaaaaaaaaaauuagccgggcgugguggugggcaccuguagucccagcuacuggaggcugaggcaggagaauggcgugaacccaggaggcggagguugcagugagccgagaucaugccacugcacuccagccugggugacagagcgagacuccgucucaaagaaaaaaaaaaaaaaagaauauaaaauuugucaugaagcugucuuacaaugacauucagagauuagauccccaaaccuaacuuuuagggggauuaaaaaauuuaaaacauuuuuuaggagaaauuagagaaaaagauugagaguuaugaaucuauuucugagccuucacauuacuaacaauggccaacuccugugacuguccccuuccuguagcaaaagaacccccaucucagagucccaacacuccccugcagcgucugguggaggguuaugguccagcugggaaaauccuccuggaucuagagcaagcccucagcucagaggggacccaggagaacaaggucaagccacuccugcugcagcugcagcggcagccgcagcccuuccuggcacugaugcagagccuggacacuccggagacuaacaggacccugcaccugacugugcugaggugagagcauggugacaggugggaucucugagggcaaaggggguccaugaggcuggcuacacauuucucugcccccagaauccugaagcagcugguggacuuccccgaggcacugcugcuccccuggcacgaggccguggaugccugcauggccugccugcgguccccaaacacugaucgagagguaccccugcccugcucuggggagaggcugggggagaggauaaaggcagccacuggcaaggcacaccugcugggcaaggcucuggagggcgugauagagccuuugagcucuugguuugaguuuugcuuuuaaaauugaauuuuauuuuuuuuaaauagguaauacauucacaugguucacaaaucaaaacgcucuaacaagguauacacugagaauucuugcucucacccaaaucucuguucccccagggucccccacacaccccuuacugguaacuacuuguauuaauuuauguaucuuucccguguucccuuaugcaaauauaagcaaacccaaaugugugaucuugccacucucuuuuuuacacaaaaggauauggagauauuauuacauaaaacauuaagagcuucaauagcuccauuuuuggcugggccugugggagaaagggggaugaaggaggcagagcgcccaucacauaccagaguccccugcaagagcuacagagaaguccugggcacagaaggcuucagaagggcucagagaacuagggucauggugacaguagguauuugcaguguggcuauauuuuuggcuguuaccuagaauuuacuuucuaaggcaggcucauuggguauaauacacacacaaacccagucccugucagccccuucccagccauccaggugucugugccugaacaucucaaaacacagcccuacaacugguuuuugggacaguagggccuggaugaaagaacccagggaugcucucugccguuuuugccaacauaaucagcagccuagaacccuagaguagcagggcaucuugugcccuuuuccauuuugguuugucuuugguucucuaaccaccuggcucuugugucuccccaucccugucuuuucacuucgucacucugccuugcucacuguagcaccccuagcacccaguacacagaguacacaguggguaccugcuacugcaggugcccuuguggcccucgcccugucuucauucaucuccucccuuauguccccacccaggugcuccaggaacugauuuucuuccugcaccgccugaccucagugagcagggacuaugccguggugcugaaucagcugggagcaagagacgcuaucuccaaggcccuggaaaagcaccugggaaagcuggagcuggcucaggagcugcgggacaugguguucaagugugagaagcaugcccaccucuaccgcaaacucaucaccaacauccugggaggcugcauccaggucaggaggaaggggagcuugugggcuuagaguggcaucagaauaugaaacccaagcaguggcggguaagggcuguguucccauggcugggaacagcaggugacucuagugacccuggggcauuuguuccccuuccccucugccccaucugggccugcucugcuggugcuguagaggaagucccacugcugcauggucucuccuucauccguguuuccgugugugucuccguguuccuucugccccugugccccuucucucugauguucuggcugcagauggugcugggccagaucgaagaccacagacgaacccaccaacccaucaacaucccuuucuuugauguguuccucagauaccugugccaggguucgugccuguugccguguugcuccaccuccccacaccuaugucuguuuccccucuacacccuaccugaccgugaccaccaccccuucccacuugcccccaggcuccaguguggaagugaaggaggacaagugcugggagaagguggagguguccuccaacccgcaccgggccagcaagcugacggaccacaaccccaagaccuauugggaguccaacggcagcgccggcucccacuacaucacccugcacaugcgccggggcauccucaucagguaacucucccacacaugugcuuugccacacacgugugcuuuccugugacgccccuguguuuguuuugggggaagcaccacccccuggacuuggccaugggcccugucuacaaguuccaaaugguuuuuccuccccacucccaggcaacugacucugcuuguggcuagugaggacucgaguuacaugccggcccgagugguggugugcgggggugauagcacuagcucucuucacacggaacucaacucgguaggaccccagggccauuagccauuacuccaccccucacaggaucugcccuccugcuucuaucuggcccuauccuacuuuuuucuaacucccaccugucuugagccccacagaaaguaguguccuuuaucccugugcuugugccaccaggcccugaacaaugaggguggcaugaggacagcuuugucaggacccuacacaucccagggcuggggaagggagggaaacagugaggggacuggagccuagagccaacuuggcucugcauguguggaggugacagcuuucucugcccccugccaggugaaugugaugcccucugccagccgggugauccuccuggagaaccugacccgcuucuggcccaucauccagauccgcauaaagcgcugccagcagguggggccagggaugugggguguggcccuggguagggggcucugagccccauaaacaggcagaucuuaagccagaggaccagccugggucucgagcagcuccaggggugagguucgagggcguagcugaccccagcccaucccaagguguggagcgagugaagauaguccuguguguguuucaggguggcauugauacgcgcauucggggguuagagauccuaggccccaagcccacguucuggccaguguuccgggagcagcucugucgucacacacgccucuucuacaugguucgggcacaggccuggagccaggacauggcagaggaccgcaggagccuccugcaccugaguucuaggugugugagagugugcguguaugcuugugucugugggaaagguaaggcuauugcaaauagcuggcaggcagggguccauagaagcugugagauggagguuuaauaugcguggggagggggcuggaguuuucugagcugugggaggggaagaaaggauaaagagaaaagauuucuccagugggcugggaaugggauauaccaguuagcacagagcaguucugaaguaccagggggccuucgguuugggugcugggguuagcuggcagucuuaggaaggguggacacugagauaacauaugcuucaagccccugacaccuuccuccuccauucucacccccagacucaacggugcucugcgccaggagcagaauuuugcugaccgcuuccucccugaugacgaggcugcccaagcucugggcaagaccugcugggaggcccuggucagccccguggugcagaacaucaccuccccugguaaccauccugacaucuggacccauuacuaucucagggcuugguuccacuaauuaguuccuucuugcucuacccuagaaccaccuggauuauguccuggcccuuuuggcaccugcauuuguaaucccagugcugucuucucacagcccaggggcugcccccuuucccaugucucucaagugucaggggacaccauaagugcuggaggugccuuguuacccacucccuuuaucauucuucuuuuuuuuuuuuuugagacagauuuucgcucguuacccacgcuggagugcaauggcaugaucuuggcucacugcaaccucugccucccagguucaggcaauucuccugccucagccucccaaguagcugggauuacaggcaugcaccaccaugccuggcuaauuuuauuuuauuuuauuuuauuuuuuugagacagaguuucgcucuuguugccuagacuggagugcaauggcgcagucucggcucacugcaaccucugccuccaggguucaagugauucuucugccucacccucccaaauagcugggauuacaggcaugggccaccaugcccagcuaauuuuguauuuuuaguagagaugggguuucuccauguuggucaggcuggucucgaacucccaaucucaggugauccacccgccucagucucccaaagugcugggauuacaggcaugagccaccgcgccugacccacaccuggcuaauuuuauauuuuuaguagaggugggguuucuccguguuggucaggcugaucucgaacucccgaccucaggugauccacccaccucagccucccaaagugcugggauuacaggcaugagccaccgcaccuggccuuuucuauuuuuuuaugcuuauuucuuauuuuuaaagaugggguccugcuauguugaccaggccagucuugaacuccugccucaagcgauccucucaucucagccucccaaagugcugggauuacaggcguaaaccacccuaccuggccccccuuccuuguaucauuccguccaguugcucuaucuccacacuccuguucagcccaaccacucccacuucccugcagacauggcugugccuugguuuguuuaucucacccucuagaugaggauggcauuagcccccuggguuggcugcuggaccaguaccuggagugucaggaagcugucuucaacccccagagccgcggcccagcuuucuucucgcgggugcgccgucucacucaccugcuggugcaugucgagcccugugaggcacccccuccugugguggccacuccucggcccagugaguaguggagauucagguggggagcucuagucaggagcguuuuccugggccccauguguacaccacaggcuucuguccauccccauccuuccccucccuaugggcucagccuguucaucuuccagguuugugucaccuccauccaugaacaucauuuuggguggcagcaugucaggaaaggccucagggaacccccuuggauggggacuugggaguggaggggcugcacccuccuugccucugccacuuucuuggucucuacagaaggcagaaacagaagccacgacuggagcuccuuggcuacccggggccuuccaagcagcaucaugagaaaccugacgcgcuguuggcgggccgugguggagaagcaggugggcaggagcaggccugcgggagagaggggacaccauaaugguggcauguuggguugugucuucaugcuccugccccuuccuuccaggugaacaauuuucugaccucauccuggcgggaugaugacuuugugccacgcuacugugagcacuuuaauauucugcagaacucaagcucugaacuguuugggccucgggcagccuucuugcuggcgcugcaaaauggcugugcgggagccuugcugaagcucccuuuucucaaagcugcccacguaagccucuacccuugccucauccuugggucucuuccgacaaacucucccuuccucaccuccuccaaaugacccacccuuccauucccauucuaugaugaacauauguuaguauauagccauguuauaagaaguuuaaaaaauugaaaaaaauaaauaguggccaggugugguggcucaugccuguaaucccagcacuuugggaggccgaggcaggcagaucaucugagggcaggaguuugaggccagccuggccaacauggccaaaccccaucucuacuaaaaauacaaaaauuagccaggcaugguggcacaugccuguauucccagcuacuugggaggcugaggcaggagaaucguuugaacccaggaaguggagguugcaguugcagucagccgagauugcaccacugcacuccagccugcgugacagagcuagacucaucucaaaaaaaagaaaaaaacaaaaaaaccccccacaauugaugagcuaaaaugcaagaagcacccuggaaagcaggguacagagcagcaggaacaugaggcuccuuguguagccuccaguccuaguuuaucagugacacugcaucaggaccaucuuuguguauguaacuuaccuccuuguguccgucuuucuuucucucucucuuucucccuuccugccuuccuuccuuccuuccuucccuccuucccuccuucccucccuccuucucucccucccucccuccuucucuuucucucuuucucuuucuuuccuucucucuuucuuucuucuuccuuuuuuuuuuuuuuuuuuuugagacggagucucgcucuguugcccaggcuggagugcaguggcucgaucucagcucaccacaaccuccgccucccagguucaagcgauucuccugccucaaccucccaaguagcugggauuacaggugcaugcuaccacgcccagccaauuuuuguauuuuuaguagagacggaguuucaccacauuggucaggcuggucucgaacuccugaccucgugauccgcccgccucacccucccaaaguguugggauuacaggcaugagccaccucucccuucccuucccuuucccuucccuuccccuucccuucccuuccccuuccuuucccuucccuucccuccccucuuuuccucuccuuucuuuuucuuucucucccuuucuuucucuuucuuuacuucuuucuuaacagggucuuacucccucccacacugggaugcaguggugcagucacagcucacugcggccucaaccucuugggcucaggugguccucucagccuucuggguagcugggaccauaggcgugugccaccaugcccagcuaauuuuuucguauuuuuaguagagaugggguuuugccauguugcccaggcuggucuccaacuccuggguucaagccaucugccugucucagccucccaaagugcuggaauuacaggcgugaacugcgccuggucuuauuuucucauuuugaaugauuauuauuaguuugauuuuuuagacacaaugugaaaagacacuuuccauaauuguuaauauugcuaauuuguacaaugguuaaugaucuuauaaaauaguuguaugaaagcaccaaccaccuuagaaagcugccagcauucauaucuacuuuccagacccucaucccuccuccccacucaccugcucugcucgcucauucauggcuuuccugugcucugccauugcucaggugagugagcaguucgcccggcacauugaccagcagauccagggcagccggaucgguggagcccaggaaauggagaggcuggcacagcugcagcaaugccugcaagcuguccugauuuucuccggcuuggagauagccaccacuuuugagcauuauuaccagugaguguggaccuaaggagcgggagcuggcgggaggcaggaugaugguggcagagccagcucaugggccuggaagucugggauagaggcaggcuggagccuuggagugggaggcugggccacacuggugcccacacugaggcuuggcccgggcugcaugcacugcaggcacuacauggcggaccgucuccugggcguggucucgagcuggcuggagggggccgugcuggagcagaucggucccugcuuccccaaccgccucccccagcagauguugcagagccugagcaccucuaaggagcugcagcgccaguuccacgucuaccagcuccagcagcuggaucaggaacuccugaagcuggaggauacagagaagaaaauacaggugagugccuuggaagggauaagcaaauaagaggguagggggaagaggggcguggagcagacuggaggaggccauggcaucugggaacccugugcuccuucaggugggccuuggggccaguggcaaggagcacaagagcgagaaggaagaggaagcuggggcagcagcagugguggauguggcggagggagaggaggaagaggaggagaaugaggaccucuacuaugaaggggcaaugccagaagugucugugcuuguccugucccgacacuccuggccuguugccucaaucugccacacacugaaccccagaaccugccugcccuccuaccugaggggcacuuugaacagauacuccaacuucuacaacaagagugagcagccaggcagagggacuggggacuggggagagggugggcugcuaggaaaggaccugggguugggggcagacccugauguugggaggcuugauguaaaaagagauagucuuuggcugggcacagugcucacgccuguaaucccagcacuuugggaggccgaggcaggcagaucacuugaggucaggaguucaagaccagccuuggccaacauggugaaaccucgucucugcuaaaaauacagaaauuagccgggugugguggugugugccuguagucccagcuacucgggaggcugaggcaggagaaucacuucaacccacaggcagauguugcagugagccgagaucgugccacugcacucuagccugggcgacagcgagacuccaucucaaaaaaaaaaaaaaaaaaaaaaaagaguuggucuuuuaauuuacauuuuuaauuuuuguuuuuauagauucagggagagauagucuuuagggauaagaauucccuaggccaugggaaaaacagugguuuugagaacaaagggcaggagcuugguggcuggggguggcaggugcugucagauaccugauccccagaccauugcuuuuucuguucuaaaauaagaccugggaaucucuuugugggugacggggaggauggaggcaggaggcaccugaggccaccagauaugaguaggugucuggcucuuuucuggucagucaccugucauccuaaacuccccaucgggggcugaucccugagcuggcagcaacacaggagggggaagaggcucagaccuguggucagggcgccuccuaauaggggagacauuguuuccugucauaauauuccagcuugauaagagccccaguccuuccucccuucaugguuuugucucccuaaaaacacauggggcaauccucgaaggcacugaugagaaccugcuuggcaccaggcuaggcauaggauagcucccagauccugaggcuugccauagaggcaggcccagagaaggcugagaucuggaagcucagaccagaagccccaguguccauaaaugcuggggucacacgccuugcagagauaaacagagcgugaccagcgugcacccucccuccaacaccaacucccuccuuucaccugcucuuugucucccucccccuuccugguccaggucagagccacccugcccuugagcgaggcucacagaggcgacugcaguggacguggcugggcugggcugagcugcaguuugggaaccagacccugcauguguccaccgugcagauguggcuacugcuguaucucaacgaccugaagguggcccagccccgcugcaccucucuccugucucccacuuugucccuugccucucuucccaaaaccuugacucccucugcuucuucccuccauccucuucucuccacuccuuggggaggcccugaaugucucccaucuguucucugaaggcggucucuguggagagucugcuggcguucucagggcucuccgcagacaugcucaaucaggcgauugggccccucaccucuucaagaggcccccuggaccuucacgagcaaaaggauauaccaggagguaugcacuuagggccagaggggccucugcucugaggcagggccaggcuccucgugggcucuccacugagugagugaucagcauuuauuucagggguccucaagauucgagauggcagcaaggaacccaggucgagaugggacauugugcggcucaucccaccucagacguaccugcaagcugagggugaagacggccagaacuuggagaagagacggaaucuucugaacugccucaucguccgaauccucaaggcccauggagaugaggggcugcacauugaccagcuugucugucugguaggcaggggugggcacaaugggugacagaucuuugcugggguugggggagcagucuacaggacaaggugggugcacguguggugaggcaccugguucacuguguagccuguaggagugugaggagugaggucgggauguaccucguguccuuggggcauccuguccuagcagcuggugguuggaguggaagcucaagcaaggaggggucagcugccucuaaacuaccgcuucucccuuccucccccacaccaggugcuggaggcuuggcagaagggcccguguccucccagggguuuggucagcagccuugguaaggggucugcaugcagcagcacugacguccucuccugcauccuacaccuccugggcaagggcacgcugagacgccaugacgaccggccccaggugcuguccuaugcagucccugugacugucauggagccucacacugagucccugaacccaggcuccucaggccccaacccaccccucaccuuccauacccuacagauucgcucccggggugugcccuaugccuccugcacugccacccagagcuucucuaccuuccgguagcccuagacuuggggucaggggaagguagagcuggagcuuuuacagaaauaaaacccaagaguuugauuauaugacgugugu

SEQ ID NO: 18374 - RNA, 4744 nt, Homo sapiens
cuccugccaacaccuauuuauuuccuuguuugugcuaugcugggcaggccuucucuugucccuuauagguaccuuggaggggccaggggcugaggaaggccggacccagguuccaggggcgcaggcagugcggcuuuuggcuguguacauagggugcuuuauucuccacagagugauacaugcuaagguggguugggcuuggaccgauguccccauauguacagaacugaauaaagugggucucugagaagucugaugugccuugauguggaaagggagacggggaagauggaaauggacauuacaaccagggauguguucaguccugugcugguucuggccuggaauguaggaauauaaggcagcucucacuguggucacuuccaggcaggggaugccugccgggcuuggagggcuuucuguaccacaucuucccacugggcauccgauaucucccgagcccaggcaggaaccccuggcgcaggcaggcuuacuccagccauuguccuuuucaccagcucuacauguucugaaaucagagccagaggccauucaggcauagaaauaaugggaccagcuccccuccccaauccccgaaucaacccagagcccuugggcugcuagggucaccaaauccaccuuguuacuuuaaggcaagccugcccauccccaaagcuagcaaaagagcauuucacuuggacucugaagucuacaaaaucuuaguuuacaaacuaucuuuuuaggauagggucuuccucugaaacuuccuucuacugacucaugccaguucauuuccuuaguaauuauuccagaaugaaagaaugaucuuuuaccuggguccaugggaauagagcugugguuguucaacgcuguagcucccuccucaucuucaucuucacucucuaauggugggucuggcaaaugaagccccagggccugcagagccacagaagaccguuugggucuaggcuuucagggagcccagcuucaccuguucaggaaccaucccuccuccacccuaccuggauucgauccuggaugucagcaacuacaucuccaucccccacuggugccaguuccaccuccucuuguucaggaucuugguucaggggcugguaggaguagccagcugggcccgaccccguuuccuccugcucuuccucaggcuccucacugcuccaauccccagugccuucugaagggcccugaugucccaguuccucagucugauuggggaagauacgcucagggcccauggugucuccuccuagaacuacuguugccauccgggcaggggcugcaagaacagggaggcgguaggacagggaucggaugaaaccaggcccaucuucauccucucaucaucuccuuguagucuccugcgugcaaaaaaccagcuccuccccgaggcuccugcauccuccaccccuccgccccaauuccagccucucguuccucccccuccuaagucgggguucuuaucuugaaccaggccccaccaacuugcuccgccacuuccuaguuaaacgcccaaccggaggcccugccaccuccuaaaagacaccccuuccagaaccccggcuccccgcgccacgccucccccgcgacuugggaacucugggucaucagacuccccuaaacaggucggcguacccgcccccuucuccccucuccuagaggacccccucuguaccgccugacagaugccuuucaggccccaugggcuccccucaaauggccccagcugcagcgucccccacccgcccccauccgaaucccggcgccgguguucccgcgcgccucacccgcucagagcccgcggccuccacuuccggcggggcaggacgugcagaggugccuaguccuccagccccgccccauauccaugauugacgcuggcgaggacgaggaguccgccccuugccccgccuccgucauucccagcccaaaaaacaaaggacugcauuacccaguggccuccucggucucgacacauauuugcacaugcgcagaaucucuccuacgccccugcccacuccucagcccucucgucccucaggaaacguauggacuacaagucccgaaaugccuccggcacuuagcuacgacugcacgugcgcgcacagcugcccgccggaagaaccgagcuuggcuguguuuaucucguuggggacuaaggcgucgguuggcgcgcaacggguucuaggcugcaggcagcucgaggacccgcggccccgccccggcucggccuggcagguagccugggauggguagaagggcaagggagaauuagggggcuuaggacgugcugucuggagcuggaguggcgggggaggggccugagagugaugagguggggguggggagggagcuagggggaugaugggaaaggagaguguuaauggggaaagcagggcuaggggaggauggcgaggagauggguaggagagaccuggugucuggaggaagcaaugaaggaaaugggaaggaagacugggccaugaaaacagggaagcugagcauaauggaaggggaggggugucuggcguggugggcuaggggaggccggaaugucuggaagaagacagggauagagucauaugcagagagggguaucguggucagugcaugcuaauuuuucuuuccuuaguggaggugggaaaauggagggcuguuggguggagcuuggaaugguaggagaaggaaaaaugagaaaacugcaaagcucucacgagaucaagaagggcgagaaauggggaauaaaaaaugcaagagaccaggcggguagauacauuaagggaauagaagaaguuugaaaaugcuugguggugauggaggacuggggagacccagggauaagaggagccccugagcgccugggggcuuguucuccuugaauuugaguuguuuauauggcagagaaacuaaaauuuuuuuucuccaccuuuggcuggaauugcuuaucuccucuccugugcauauuuuacuuuaccuugacauaucugaagggaagaauagagaauauaagggaggauggaagacuuccauucuuaagcccaucgaccuccuaacagucuccacaagcccagacccaagauauuuuggagagcgggaguaaugaagugagaguagcuuccugcuggggcuauuucaggaugggucccauggcuauuuaaagcuuaggguguggaguugggggagguugggugggugggacuagcaagccagcugaaagccaugucucuuuccugcaaggggccucccuuauuugagcuguuuuagugccugagguuuugccuggcccuuuccucugccagggcuucuuaaacagggagcagaugaugauacacccaaacucaggagaugcuugccagcaaaagcauugucaguugcaaggauuugccugaaaaaaccucagauguacccagguguacgugccacuagguugacagguuguguuuaagagaccaugaccagcugggcaugguggcucacgccuguaaucccagcacuucaggagaccgaggacgguggaucaccugaggucaggaguuugagaccagccuggccaacauagugagaccccaucucuacuaaaaauacaaaaauuagcugggcaugguggcaggcgccuguaaucccagcuacuugggaggcugaggcaggagaaucgcuugaacccgggagggaggcagaguuugcagugagcugagauugcaccauugcgcuccagccugggggcaagagcgagacuucaucuaaaaaaaaaaaaaaaaaaaaagaccaugacuucucaugcuggaucuuucucuuguccugcccaagggcauuuuuugccucccuuccccuuuuuuuuuguuuugagacagagucucgcucugucgccagacuggagugcaguggugugaucucggcucacuccaaccuccgccacccgagugcaagcaauucuccugccucagccuccugaguagcugggacuacaggugcgcgccaccgugcccagcuaauuuuuguauuuuuaguagagacggguuucaccauguuggccaggauggucuccgucucuugaucucgugauccaccugccucggccucucagggugcugggauuacaggugugagccacugugcccagccccuuccccuuugcauugcacacucccaccucuauccgccuuucaggaacccaaguuguggaagagcuuguucucucuuuucuacuggaaauggcuuguucucuaccacaguagcagggauggggaaguggcaggaggagaaaaccccucccucuaucaccaucccccaagccuaagcauacacauaccuuucuggcuuaaguccuggcagcauaccaggcacagcugucaaaggaacuccuugugccuguggggggcccugggugaccccaaugacaacaacucagcuugacaggagcucccugugaggggcuaaccaaccgcgguaacauggaggucccuguccuggaucagucccgcccuaucuuggguagggggauuguuccacucuaaaagccugaaagcuuuucugcuuugaggcacucaugccagcuuucaauggacuguuugaggcuggcugggcuauuaauagcugugaguauuuugagaucccuuuccccaccucaaagaacacagauucuuagagagguggcaguaagcagagcagagacaagagaauauaccguuugggaagggggcuucaaguuugugccaagccagggaca

SEQ ID NO: 18375 - RNA, 1391 nt, Homo sapiens
uauauccgggauuguggggugaguugcagcagcggcagcugcacauguggguuuguuuauaagaacaagguuagaaacucgcaggccucccccuccccccagcuccucccuacuacccccuuacaggccggagauccgcuacuaggggugugggugggagggaugagugcgugugguggguuggggggacagguaguggugagaaagauggagcgggggggaauauugcaccgccuggcccgcgccggaggaagcagcagcuggaacagcuggcuggggagccgcuugcaugccuccgguuuuuucuuuucccuuccaccaccccuucccccaacccauuucugccuccccguagcccucauccuuaccgccccccuccccccuauccacugcaguucggcgcggccugggggcuccuggauccccgcaggcaguuacuagggcaggagaaggcaaggggcacugcgaugggagagacuggguuccucacugcaaccugguucgaggggcccugggggaguccauaaaaggauuacuauuuuuuuggccaauugcugcagucggaggggugggggcgggggaaggugagauccacacccccuuccucuuucuucccugcccuccccgagcucggucccggccacucccuccgcagcugggcgucgccggccgcgcuggggugagacccuagccccgggcuccguggcucucuggggcggucggucuuaggaaagcggugggagaagcgguacauuauuucuagggguggugggagggauuugucaccggaagugaauggccuagccuaaagucgggaccaacccgaggugugggugggcagccaagacggcgcagucacuggcaaaaacccgaggcagcgggcagggcgagaacccgagacgcagccgcugcccgggcgcggcagccucgcaugcuucgcucagaucugcggagcucccgaaccucuuuaacccugcccgcccuuccaacccuagguuuccuccuuauauccccaguucccagccuccaucguuuaaauugggguauuuaacgacccaagaaacuugaaauuucaccgaucuaccugcauuuugaugcagagaaagaugggaggaaacgcgaaccauugaauuaaaucugaguuaaaacugaucucccauuuucacgccccacucucuuccuuuccuucccacuuaaaacaaacaaaacacacauaaauugcugggccagaguauuucuccgcugagagcacaguucauaccguguggcagauuccccgcgcaggcggggcgcgggggcaggggagaggcuuguguguccgcgugccugcgugcacccgauggaaaagggggugccgaaaaacaauggugcuuacucuugugcauagucau

SEQ ID NO: 18376 - RNA, 1840 nt, Homo sapiens
acaaauccugccucagguuuauuuguacaaauagcacaggaggaccccagccccaugcagaugguagcccaggggcggggguggggggucgcaccaguccuucuguccucauguuggcagagauaucuacucugaagccuuuguaggggccuggguacguuugggagccugagcuggaacugaagcuggggcugcagccugggccuugguuugauccuuggccuuggccuuggccuuggccuuuggccggcacagccugagccccuuggcaauacgggcacgagcacgcuucccaagcuuggggugggcaauguaggcaagucgaucgagcuugcggcugacacccuuugggaucuugggcuuaaccuccuugggcuuuacgagggccuugauagccucggcacgugcacucauggccuuggcauuguuggccugcaucuucuuuaggcccuuuuuguugugcuucuuggcaaagcgcauguuccucaggaacuugggguccaccugaaaagcaggaaagguacagguggcagcauguggguccccaagucucucccugcugccccucuccauagggguacccagcauucuaaagacagcaucaagucaaccucaaauguggaaauacccaaccucuugaaacuauuuccagagaaaguguaccaccaccccagggagccaauacgccaccuggguaaugcugugcagaccuccuucaagaacaaaauuacaagcugcuuugcugcccugucugccaagguuguggggcuucaacuuccuacagcagggguucgaccaaguuuuuuccugacauccccucagggacacccccuccccucuuuagaagaaggugucaauuaaauaccaagucugguccaaaagacuuauagccaaggugggauauggggaaacugaggcucagaguuugugauucacuccacggaacagagagcaaaaguaaagggaaggaacagacuggggacaugcucagcucuccccuagacccuccagccuucucagcuaauccuuagaacccccugacacaggaagagaagcugaccccaacuccagcacugggucagauggaggucauaaggcuggucagugugggaaugugcccugcacgcacucagacaaggccacuccuuacccuaagugccacugccaagcaagggagauagccaaacugcccucaggaggcagguuacacccugaccagaggguuacacuucaggcuguggagaccaaggaaagcuuuauuaugggucugguaggguagaaaaaggaauugcaggcuuugggugggccaguuaggcugugcucaggcagaagccaaagcuagagaaaaacuacaugagaggccuugacugugcaccuggaaccaagaaaagacacuuccaugugauucagugcacucacccccuuaagagauucguaucuuugugaucgggguuucuugauaccauuucugugccauuuucgggcugugggagaaaaaaagggaauuaagccaacaaagaacuuuccucuaauaagaccacccaacaucacagcuggcaagucugggagaaccaacacuuccuacagcagcuacacuugagauaugggaaacccuuacuacuaaaugcaaaacacucuguaucucaaguagaucucuaaaccuauaaacccuaaaguuauuacugggugaaaucaaucagccucaggcccacaauggaaacgugccccuucaucucugucccaguuugccugaaccaguccuugccagggucugggauguaggcagggcccaaaaaacuuacacugguuguguguggugugguucuuggacuuggccaug

SEQ ID NO: 18377 - RNA, 3476 nt, Homo sapiens
guuugcauucaaacaaugaauguauucaucacaagucacuuaccaaagcacuucuagacuucuccaaccuccaugacuuugcucugcuuccuccugucccugucagcaggguugcuguuuguacuugaagguaauaaaccuguaauccuucaaaaaugccauuuagccccaggcuucugagcugagucagacugacccaucccaccguuagggcaaaagucaggcugggacacagcgccaguacagagaggauccugcuucaugcaacuccccuuuuggaguuaaugcagcgugauuuccugggccgguguuuucaggcaucgcccaccccagguaugcugguucccagcuccacguaggugugccuaucacgcugggccacuuugcugacaacauucauagcuugacaugagagagaauaucagcagaagcaugagaguaggaccugacgucuuugacucugcaaaagcauuuagcacacacucaugggggggaacuggcugugagccacagcagccccacacagacaguggucucugaacuucaggaaagccauggacagaaaaaaaaauaaaauucuuuuccaucauucuauuuucaaagaggucuuggcguuuuccuacaucuuuuguuuagagggggaaaaaaguuucauuugcugccauuucagaaagguuaugcuauccuguuuuauccaagcaguugugagucaggaacugccugggcagugugcaucaacuuuguggccgaaccauuacagcugucauauccuuggcugaucgucucucccagggacuacugcccuccacuuagugucugaggguaagccuagaagggugcugcuauugggucuauggaagcuuaucuaucaaaggagcaaacauccagaaaaguguuuauaaagcaaauguauugccucuguuuagagauuugcccagcuguuccaguuuuaaacauuaaaaaauaaacucaguugccauggcaaaaauagaaugcacagcuuacuuauaauuuuccaugcaguauagcauaaggauuuuugacuugaaacaaccaaagaacuccuccuuaacgagacaguucaaauuccugaauuaguauuucuugacuaucaacuuaaagaauggacuuccuaguacaauguugcacuuauuuuuuuuucugaaauaauucugccugcauguauguguuguguuuuagcuucuccccuuaccccaccccaaagaucuuuucuuccuaaugguuaaugucucaacucgguuacuguuuacuaucagaugguuuuucauuagugaauuuagaccucuuugagaaagcuuguauauaaaaaguuaacagauauauuuuauggaaaaacccaucuuauuuucaaauauauuuaacugcuguuauauuuuauuagaggaagguuguaaauauuuucuaggaguucuauuguaaagaaaaguauuuuugaaaaaaauuaauguaauaaaaaggaaaacauuuuuaaauagugguugugauugcuuccuguucuggcuucguuauguucuauucucagcagaugaauugcaugccuuccauaucaggauguaauuuauucagguuugcacuauuauaaguugacaucauaauaucuagugugcuuaacuguauuuucccggaaugcaagucccuugguccauauuaaagcacuauguauagcauauucauaauuuuucuuuuguaacguguguauuuuuaauaaggauuuuauguaacauuuuggcaacaagaggaccguauuuucuagugaauuuuauaauaacauuuugcuaaaaauguuucuuccuaggucaguuuuuguuaaggugaaccaaaagucuuauuuuaccagggguuuaaaaaaaguuugaagcuugaaagcaaaguuauauuuaaacaucauauguaacaaauaaauaaagauguuuuauagacuuguccuaaaaaggugcauuccuuaaaaaaaaaaaaaagaaaaaaaaaggaaacuggggcauucuagguuguuuccccuccaagugauaagcuuuuuuuuuuucuuaauuaucacaaugcuucuucaaaaagggaaccagggaaauuuuauuuaacacauucuaaucauuagccucucagaaaguuauuacaguuccuauagaugggcauucaucaaauggagauguaaccaaacagacacugucauauuuauuugugaaaaccugauucaauauugcaucagcugcucugaaaauaaaauauuaaucuuuugcguuucguuuggcuuaaauauuucuucuuucuagccauugcuaugacuucucaaugcuggauaaaugcuaguuuaccuguuaauugguuuccguagacaacaaguuuaagucggcugaucaaauuuaaugaucauuauuaaagugucccccgacuccgaagaccaggacauacauuucugcuauucaagcaguggaugaaccacuuggguucguaaaccuuaugacucaaacugugucauaaacucaaacugagucauaaaccuuaugacucaaacugugauucaagggagcacacugugacauacaggugucuuacacuaaauccuccacaaagucuuaaguccaccccgauuuauuugcauuuuaaaucugaauuuccaaauuugaguaaguaaguuuacuuuuuuuuuuuugacagucuugcuuuguuccccagccuggagugcaguggcacgaucuuggcucacugaagccuccacuccuggguucaagcaauucucacgggucagcuccucuaaguccaccccgauuuauuugcauuuuaaaccugcauuuucaaauuugaguaaguauguuuacuuuuuuuuuuuugagacagagccuugcuuuguuccccagccuggagugcaguggcaugaucucagcucacugaagccuccacuccuggguucaagcaauucucacgggucagccucccaaguagcugggacuauacaggucaugcaccaccacaccuggcuaauuuuuguauuuuauuagaggcgagguuucgccauguuagccaggcuggucucgaaccccuggccucaagagauccgucugaggcccgccucggccuuccaaagugcugggauuacaggugugagccacugcaccuggcuguauguuuacuuuuuuuuuuuuuuuuuuuugagacagagucucccucugucacccaggcuggagugcaguggugugaucucagcucacugcaagcucugccucccggguugaugccauucuccugccucagccucccgaguagcugggacuacaggcgcccgccaccacacccuggcuaauuuuuuguauuuuuaguagggacgggauuucaccuuguuagccaggauggucucgaucuccugaccucaugauccacccgccucggccucccaaagugcugggauuacaggcgugauguauguuuacuuuucauggucaacagaaaacuauagaagaacu

SEQ ID NO: 18378 - RNA, 3924 nt, Homo sapiens
cuugaagccaaaacaguaaauuuugaaugaaauuugaauuaugcuuuuggaagcugccaugucuuaauucuugcuggauuuugauuuucaauuuuggaaguuuuuaucaaaacuguccagucaugaguauaucagguagcagccuuuaaggaucuaaguuucauuccuauaaagaacaggaggugcugguauuucuugucuuagcaagugaucugaugcaggucuaaauggggguuagcaucuauacuauggcuuaaaaguuuccuccuuggucaccauuugggaggugauggcuucaaagcuaagcuuugcucucaugugacccuucuuuaucuuaauacccaauaagauauaaaccucucagagucaacccaguguagacucaaagggucuuagcuucaucuaucagauaagaucuaucugauuuauacaaagaauggugcuguuuuuauauacauacuaaaaaaaucuaauucucaaacaauuuucuuaauauuuaugccagcaaggucaggaaagacuauuuuguccuguuuaacuuuaguagugaacaaacugcuagagacaucugucauccuuaacaggccacugugguccuuauauacugacccuccuuuccaauuaacguccuuuaaucccauacuaguuccauaagagacuuggcacauaaaagcaguauuuuuuuuaaugccuaguaaacuggccagaaaaaaauauugccaugguggaccuguuucuauccaccucuuucuauggcuauauaagucuauacaugccaguuccguacauacuccauuuccaaagagcccccaaacccuggacaguagcacuaccaugaauuuuagggucacaaaacauuuccuucugaaggaagcagcugccucagcagugucacuuuagugaccacugcccaggcuuacuucacuuugccucccccuacacaucacugcccucuuucugccaccaaaccucacuauuccagcaaugaugccucccuggugucuggaaaacccaucuggugcacuaaaaugcuaugcaacaccaaauggcuucuuccccuaauauugcucaacaauguaaauucuucaagaauaaacuucaugcuagguuaacaucaauguaugguuacagcuuccuuuuuuuuuuuucccuuuuaaaaugaagcaaaccaccuccauuaaaauccauguuuuggggcuuguuuuugucucucaagugugaaauauaaaucauguuuuuaugauuuuuguaaaucuuuuuacaccuuguuuuuguaagcaaaaguuucuuauuaaaagaauaaaaugacugccuuugugugcgguauuuauuucaaauguuuuuuaaaacagcacuguuauuucucaggacaagagcaaaaaucacccccugcagaagcuugggaacuauguacagaacuuuacagaauagaggcaauacuuuagcuuaagccugucugcugaccagagaauggaauucugcguggacucaaggaacaaaaggaaacuaggcagggaaggggaagaaaagugcccaucugaaucaaacuucagcugccaucagggcacaucuugugguggucacagauuguaggcuguuuuuuggaagauucggguucagcacaggauuccauuugucugcaaucagaugauaagacgacagguggcauuagaacuguaaaaguaugggagggaaacugguaagagauacuuaaaucccuuucaacaucugaaaacacauuuaacuaggaauaguuaaggguuuuacaucacauucuuuuguacauuucaugaauacuugacagaaaacauugcuucacccagucucuaggucuccuaagacacgcauggguguaguucagugcuuaccuacuuggcuacaccccuggcugaggugccaugaggucaaugucacucaaguuccuggccagccaaacucccgcagcaaagagucccaaauuuaguaucaaguuccuggaaaaacaauguguuuuauuaacccuguggucacugagucaguuguacaguuaacgaaauguacuggggggaaaggcuuccaucaccaccuucccgaggcguugauacgugguugugacggcagguugcucaagacccacgugggaauuuggaguucauuuuugugccuaguaaguguaaggucaggcugggcgcggugguucacgccuguaaucccagcacuuuggaaggccaaggcaggcggaucacgaagucaggagcucgagaccagccuggccaacauggugaaaccccgucucuacuaaaaauacaaaaauuagcugggcgugguggugcgcgccuguaaucccagcuacuggggaggcugaggcaggaaaaucgcuugaacccgggaggcggaggcugcagugagcugagguccgccacuacacuccagccugggcgacagagcgaggcugucucaaaaagaaauaaauguggccgggcgcgguggcucacgccuguaaucccagcacuuugggaggcagagucggguggaucgagaagucaggaguuugagaccagccugcccaagauggugaaaccccgucucuacuaaaaauacaaaaauuagcugggcgugguggcgcgcgcuuguaaucccagcuacuggggaggcugaggcaggagaaucgcuugaacccgggaggcagaaggggcagugagccgagauugcgccucugcacuccagccugggcgacagagugagacuccgucucaaaaaaaaaaaaaaaaaaaaaaaaaaaggccgggcgugguggcucacgccuguaaucccagcacuuugggaggccgaggcgggcggaucacgaggucaggagaucgagaccauccuggauaacacggugaaaccccgucucuacuaaaaauacaaaaaauuagcagggcgugguggcgggcggccguagucccagcuacucgggaggcugaggcaggagaauggcgugaacccgggaggcggagcuugcagugagccgagaucgcgccacugcacuccagccugggcaacagagugagacuccgucucaaaaaaaaaaaaaaaacaaaaaagaaauguaagaucaaacgcaaagcccagcuaaagcacuaguccagggccgaaaaagccuguuuacgugcuagcacuucuucccuugaucagggugacauuacagauacagccacaugacagaaagaucgcuuuugccacacgggaacucuccuggccagggaucucagugaggcacagccagagcuacgaagacgccacaaugcugguaauguuaaaaaacaaaaacaaaaaacccugaggcgccagccucgcaagaaaggggaaauacggauuuaagggccagaaaaggaccaaguuccucgggcucgguuaccuccggaagucauuccuaucaguggcaaagcgguagacgccccgaagccaaucucccacguuguccgguauuucgggaguuucauuagccgagccagcagcgcucaccgggacagugcuggaagccauaguggaaagcuucgcaugggccucgguggaggaaccguaucggcgucgccggugaaugacgcaccuccggucuggcacuuccggcugcuaccggccggcagugggggcgcuguucgcuuaguccgacauccggaagagggacggcccucugcugcgccuccacgaacucuaggaggggaggagcgcggcccgguucuacgguccccugcucccggucccaccuccggcucuccagccgguaacugucacgcgugcugugaucauuuaauuggcuugggaggaggaugguggggacggggcugucccagccuguggagguggggguaggggcuaucucagcaggggaagcguagcuuuggggaauggguuuugccaagaaagucuccgccaaaagucuuagaacgcgcaguacugaag

SEQ ID NO: 18379 - RNA, 2833 nt, Homo sapiens
ugucugcuccccaaccaucagucaauacaaggcccagaacucaacaaccucaguuugagucaccuagcccagcccaggacuuaccgauccucaagaaugguucugaucauggacaacuguccuggaagguuggcucacccagccuucucccaaccagccagcuuaacuagucccucagauuugugcuuccugggcguguguguguguguguguguguguguguguguguacacuggggucuccucaccauuggguggcuggggggcucgagggaggucaagcucagcgggguggcuauugcgggugaugaugacaggcucuuccaucacauugaugcuguugcacugcaucagauccugaaggagguugaagauuuccucagcccgggaacacuuaaaugcaaauauuccuggagaaggagaggaagaaaugacccuaggcaauagggaaggaccagaggagcucaacagaugcacaaugugcaggaaaugucccucaacuccagucccaggccuguaggggcaggagagccucuccucaucuugagcauucuuuuucuuuucuuuuuugagauggaguuuugcucuuguugcccaggcuggagugcaauggugcgaucucagcucacugcaaccucugccucccagguucaagcaauucuccugccucagccucccaaguagcugggauuacaggcgcccgccauuacaccuggcuaauuuuuuguauuuuuaguugagacgggguuucaccauguuggucaggcuggucucaaacuccugaccucagguaaucggccugcugcggccucccaaagugcugggauuacaggcgugagccaccacgccuggcccugagcauucuuucuaggucugcucuagaauccaagagcuacuagaaaggcuggguccaagguacccugccccagcacgcccacaccacauugaacacuccagcuauauugcucugaagcgaaaucauuuucauaaggauguguguguucaggggucacaagaagagaaucaaaaccaaaguggaggccgggcaugauggcucacgccuguaaucccagcacuuugggaggccgaggaggguggaucaccugaagucaggaguucaagaccagccuggccaacauggugaaacccugucucuacuaaaaauacaaaaaauuagccaggcgugguggugagcaccuguaaucccaacuacucaggaggcugaggcaggagaauugcuugaaccucggagguggagggugcagugagccgagauugugccacugcacuucagccugggugacagagcgagacucugucucaaaaaaaaagaaaaaagaaaagaaaaaaaacaaaaccaaaagccaagguggaaaggauaguauuagaugagugaacauucuucuuuuauuuuuucggagacggagucucacccuguugcccaggcuggagugcaguggugcgaucucagcucacugcaagcuccgccucccggguucacgccauucuccugccucagccucccaaguagcugggacuacaggugcccgcuaccaugcccagcuaguuuuuuguauuuuuaguagagacaggguuucaccguguuagccaggauggucucgaucuccugaccucgugauccgcccaccucagccucccaaaguucugggauuacaggugugagccacugagcccagccaggugagcgaacacucuaccucacaugcuucccccaucuuccucugccuaacacccccugcuuccuaggaaaaaaaacuccauccagagcaccagcccucagaucgcugaugacaagagggucuacucuguucccugcuucuucacuuauuagcccaguguguggccagaaagcaaaugccuacuguauauaggucccuaaccucauagauuaaacucuggcacgggaaggaagaaaucaugggcagacuagcuaaaggcaaacauggcaaggcaaucacaaggcuccucaaugcagccagccucacagcccuucaaauugcaacacugcaacucaaggucccaggaacagcaggacugggcugagugucugucaaucaggggacucaaagaugcccuugggguacugggccagcauggacuccucuguaacagggggaccugggaccuaggggaggcuacguggggugugccugugcauauacccacaacuaagacacaauuagccuggggaaugggacaacuaugguuugcacaaauaggauggggaggaaacagggaagaaaaauaacuacucuggcaaaauaugacgagaaguagaaaagacugggaaagacuggaguuguagagaaccccguguuggggccagggguagccccucugggaacccaaguguagaucaaacaucacuaggagcaaggaugccucugccugcucugccugcucacccagcgccccugccucugccucaugaauuccaaagguaagaugcauggagggaagucuccuccagcaaacaugaccucggaggcucacuauuuuguuggcagccucaucagagaagcuuguucauuccaccucugcacagccauaaucccaaacugcacugaacacaaucccaugcaggauuccuuuugcacagcuuaagucuggauccuaagagauaaacucagaccaugccacuucuucagagagcuguggcuggcucuagccuugaccuuauggaauaaccuaccaccccugaccucugacugcagggagaauacaucacacucuacugcccacaggugauggggauaacacuaaccucuugagggcuaaccuauacauuaggaacccuggaguacugcauaagc

SEQ ID NO: 18380 - RNA, 1735 nt, Homo sapiens
gcuaucaccccagagaggguaggaugaaauggggugggucccaugaccuuuuguccauuuggaaagugaauuuagagauccuucucaaggacaggcacaaucagagaugaccgcaagucccaaccuguaaggaaauaccaguuagagagaaagauauacaguaaaaaacccacugugguacauuaaagauuucagggccgggcaugguggcucacgccuguaaucccagcacuuugggaggccaagucgggcggaucaccugaggucaggaguucgagaccagccucaacauggagaaaccccgucucuacuaaaaauacaaaaauuagccaggcaugguggugcaugccuauaaucccagcuacucaggagguugaggcaggagaauugcuugaaccugggaggcagagguugcagugagcugagaucgugccauugcacuccagccugggcaacaagagcgaaacuccaucucaaaaauaaauaaauaaauaaauaagauuucaaucagcauacuuuacaugccagguacaaauaugagcucacgaccaucagaaaggagcgaggggcuaggaggaccuaagcaaggaauguuucaaggugaagaacgguuaaggcuuugagagggcuuugcauaacuggcagaauuuuuaucaggcagagagggggcuggcaaaguauucuggauggugggaacagcauucaaacagccuggaauacacagaccuaaaacaggaaccugggacgagaggacuaacugggagaggugagaggagaugggggguuucugacaucuuccccaaacccaggagcuucucucaauccugguuccccuuccuggucugaggguccccucucuucucuccauuuuuuuuucuuuaagaggaacguugggugagcuccaccuccaaaccugugugugagaccccaucagcagaggacaucuguggcaaagaggagguggaggaggaagcaggguguauguucuugccuucggccuccuuugcugucucuccaucucugauccccacccuggugucccugucuccucucugccucucucucucucucucucucucucucucucucuccagauuccucugucauugccucuucucucucccaguccacucugauccaaauaucccuucaccuuugcucaggaacaaggcacuccuccaagugcccaggcaggagucgguauggggggcugguggccuggcccaaguccuccagggagcaggccccgaggugggaagaauauuucucccuuccccccaucucugggcccucccucugugaguacagccugaggacaaaggugaugcuccaccccccuggcccaccccagccuccugccccaccccagccuccugcuccaccccucaagacuuccccuccuugucauccaaagaaaagcccaccacuuugggggaccagccucggaggaagccucagucagcuuccugugugaagauccccaagguagagcagaagcuuccucccaaggccaggacccaggccuccccuaaaggauccagcaccuuccaggcccagcaacagcuggccccaaugacaauuuggccuccgauuauuaucaaaacccccuccgagagcucaccucucaaagagcgacaugcacccucugccaaggaggccuccugcuccccaggugcaugugaccaccccuuaccccacuuuucuucaaaauaaauauuuuuguuagaucagcaau

SEQ ID NO: 18381 - RNA, 27223 nt, Homo sapiens
guggugucaaagcgggaaggugggcguggcuucagggaacgccugcgcguugcuccuccgaagggguggggcgaucccugaacuggaguuagugggcguggccucagaggcgccugcgcggaggcgguuggagggaggcccgauuccccuuuguucggguucgccauuuugcuaggcagcggcaguggcggcggcagcggcggcuggagccucugauuggguuucggaguccgguacuggagccaaucagcgcgggcagcgaaccgggggagcgaggcacggugagugugaggagccaauauccagcggcccagagccggccccagcgccccgauuggcgggucucgcugaccacucaggagaggcccaggcgcccgucgagcccggggagucgagcugagccuagccgagccgggcggccagcggccccggcccggggccugcgagcgccucggggcacucccggccgaggccugcaggggccgccccgcgcggggauggcgccucggggagcaggcaccucggggcuccgacccucgcagggugccagggccaguugggaaugcgucccuguuccccgacucaggcccagguucucaggccccaggccuggggccacgaauggcccuacacuaggggacacaugcgcgcccugggccucggcgauuuccuccuggucguucuggccgcaaacuuaaaccugcccuugcacucuccacucuccggcccuugggacaggaagccuccccggggcccgcgccccccgcuccccgcucccagcgagccgggucugucuuaucugcagccccucuaggucgggagggaggccuggggagggugcgcgccgcggccgcggggucccgugugcggcuggcaacggggcuggcccgcccacgccucggagcccuaugggcccgcccccgcugucucccugguggggagagggggccguuaguucgcccacucccccugcuccgccgcgccccuccucccagcccgcuccgcccgggucuccggcccggcgccguuaccaccccuuuuggcucgucauuuccucucuuccccgccccguucgcaguggcaggaccgcacaccuccgucuuggagcccaaccaagcggucuccguuucuuguccgggcuguaagaccaguccauucggugccuggaaccucacucuuagaagauugauacccuugcgcauucuuuccggaggcugcacaacuugcuguucauauuacuaaucuuauccacugcucauuuugugaaaucucccucccuugggaauauaguacaguuuuggggguuuuuuuucccuuuguuuuugccuucgccuuucuauguuacuuugugucaggcuugacccaguccacucaucucuugguuuauguuuuucugauacacuuucaaguccuguguuaacguuuucucagcagauguuuagaaacuaacaguguugugggguuuuccuuagggugagagguugcuguuggcaaccaauuauccagcaguuaguauaugccagguauaauccguguguuagggagggaguacguagaggucaauaagaacugugccuaccugauggaaauugacaggugaacagguaguuaauaccuaacgguuagugcuauaaaggggccaaguucaguugcugugaaguauccaugcgugagcuagccuccgugaaaggcuuaucaccaccgcacuuuugacuggccuugaagaaugaugguaauucuuccacaggaaagauggaagagcuugcucgaagagaagaaaagcaugugcagaggaaucaaauuacacuguuggaggcaggaagaugggauagggaagugggcaguaguugugauaguuuaggggggaaagcccaguugguaaaauacuuguauaucuugcuaaggaauauuuuggaaacaguuauuauuuuguauggagguucaaguagaagggaucuagagcuauauuuuuuccuaagauugaaaaaacgaguuucugacuuguuuauggguucugccccgugauaguggcugaguucuuuggggaugaagaggagacuuguccuaggacucugaaaauuauuuuuacucaugugaaucaucuagugcauucccuggcacauaaaggucuuaaguaucuggugcccauuucuaaauucacauuuaauguuauacaacuaauagguuucagaaaacucguauuccagugcucuuucauuacuaaaacuucggggacagguuuuauuuucacuuuuuagggugaguuuuucauuguugcuuaagugauuuucuuaauucauuugauugucacguuauccgcauuagcagaugagaugauagagcuuaaguagucuaaaaaacauguauauuugccuuuggaacguuuuuuuguuuguuuuuggauacagggcuuuccucugucauccaggcuggaguacaguggcgcaaucguagcucacuaaccuggaacuccugggcucaagccauccucccuucuuguucucccaaaacguugggauuacaggcaugagccacugcguccugaccugaaauagauguuuuaaccuuaguauuuaaaaauagguauguucuggucacuucaaaaucacuaaauacuuuugcuuggcaucuuucuaaaaggcauuauaaucugguaacuuuuuugcuaaauaccuuacaagcuuccaccagucugcagaagaauuucuuugucugacauuuugagagaaaguaguguggccccaagcuuuuuuuccuguuuaguccacuguucacaugcugaaauauuucuguucuuguuuuuaugcucucuugauuuguaguacuucaccuuccuccacaucaucacauagcuaaaucuuucucacacuuaagaccaguucauccugcaggccucugauagcaaagaaaaaaaaaguucaaguaguaccuuuuuuuuuuuaagccuuguugauuuauccccagcuggaacaaaucucuguccuccaaauucccauaucacuuuaucucuuaggauuccaguauagguuuuuaguccauuacuaaacuuaaagacucuuugaaguuugaaucuucgucagagauuucuuuuuauuuuuaaaaccuucagaacagugucuggcacaugguacauaauuaguggagagaagugcauuagaaagcuccaauccagaaaucuguaggaugauggggaagcuggacagcccuuuguuguagucuagucuuucaucaagcgucuaucaggacccacuuguugaguugugaaagaaauugagugagccaaugcugggaauuuuuaaauaauagaauagaaaauaucugccaggcaugaugauggcucacgacuguaaucccagcacuuugggaagccgaagugggagaauccuuugagcucaggaguuugagaccagccuggguagcauagggagacccccucucuuaaaagaaaaaaaagaauagaaaauaccaaagugcaucuuguguuguauaaagguaaaugcuguuucaugaaacuuucauuucaguuacaugcuuuauacaugugugcacugaguugugauaaugaaauguguuucuuacuaaggguuguggucaaaaaaguuaaaaagcuacuguucuaggcuuugccugguagugauuaucaacugugauaauccuauggcuuuucauaugcuuacacuaguugaguuucugaagagguuuuagcuuuggaguuuguguagguccacauagaauggguuccuaguaagugguuggcuaagucucagcuuuugcaccuuggaauaguggggcaaagagaauugcacugagaagagaaugcacuaggaagagaauuuucaugcuagccagaauaaacacuuauuauuuguuucucucucuuugaggaaaaaccauucaaaacuuuguguuaagagcaagagcuagacagacuaaaucuggcuuaguuugucauaaucuugggcaaagaggcacuuugggaaagacuaucgaauuguauugcagucuugcuaacugaagcucacaguaguaggaacauaugacuuuacugaagccaguugcuuauagcauuaaccauuaacaguaucaauaucaugauacaggcuaaaucacucugucauuaaugugagagagaauugcugcuagauuugaagcugcucuucaaaucuugauacucuucaaaguauaaauuuaaauauugcuaaauugguucauuuguauuaccagaauaaacuaguuaagaagaaaaucuguacguuacauauauuagucauuaugugcuucaaguuauauuuagucuuguaaagauguaaacuucuggauauuagucaaggaaaaaaucucauauaagaaggaaauuuggaguuggggaggcguugaaaccuaaaagacauuccuuucaugauccuuauuuuuuaaaaucaauuuauugagagauacuuuagaaacaaaguauaauaauuuuaaauguguauuuugaugaguuuugacaaauuuguacaccugugcaacugcuaccacaaugaagauauaaaacauuuucaucacccuacaauguuccuaaggcuccaugccagucaaccucccucuuuccugucucccuguauucuccacucccaaggaaccacugauccauuuucugucucuagauuacugaugucuuuuggagauuuuauauaaauggaaucauauauauucguuuacaucauaaccuuaauuuuauuaguuuauagccauaaauguauuguguauuagagacaagauagaauuuagggaagccuguuagugccccuaacagacucacagucuggcugaaaaccugauuuucuauucuauacccagaaucucugaggagcagacuuagucaaccaauuccaaagagacugguguaaaaaucagaaaaccgguuugucauguugcugauuauauuugcucccuguuggccaaucuauauguaaauccaaauuauagcuagaaauuuaccuagcgagcauuccauuagaucaagggcagugcuuuggagaaccauauggccacaaguccucuugcugugaugacauagccuguuauuuauggcucauagauucuuauguuguauccauuuugguuaugaguaaugggguugauuaauuuuuauuuugauuaaauuuuguuauauuuuuccuaacauuccaacauucauuugggaaauaagaauuucucaaaauucuuauucuagaaauaagaauuuucaagugugcagugaaaucaaaggaauuugaaaauaaacaccuguauaccugccaguuagggucuauuaacaucuuacuauaauugccuuaccagauauuucuccacccauucauccauuuuuugaugcauuucaaaguaaauuuuagauaucaauacacuucuuucuaaguacuuggacauauaguugcacauauuuugguuucuucuuucacacuguauugagacaccuugcaaaugauuaauuccaccagcauguguggauuuauggagagugguacuguacuuugccacgauaaugagcagcucaguuaggucacgucauuuuauuauucagauguuggaauuuaugagggccuagugaaaaaucagagagaaagaccuaucuacauuuuuguuuauauaucuguccucccucccauauuuccaagaugaauugccgauugcuaacuuauaucauuuuaauuuuuuaaugaagucuuuauuaaagguucucagauaucauucaguuuaucuaauuguauccuuauuuuuaaaaguggaucuucaacucuuaaagucuaugagaaggguaaauuuugccuaccauauguaguggaccugaguaacauguuuggugggaagcaauuacguguuacaacuuaaagaagcuuuauucucuaaaguauaugugcaaaccugaaaaucaguguuagguaugccuuguaucaaagugauguagcuuaacgaguaucucuuaggugcaaguauugcucugacaguauugaaagguaagguugccaguauacugaaagcauuuuagaaacgugaaaauagcauuauguuguuaugauugugccauguaaucccaguuaaaaaugauacugaauauaagcauuuccuauucuccuauccuguuuucuugcaaauaaaguacagugauaaauuauccagguuaauugucugguaaggccuuuauugacaaucucacuuuaguuucuuuccccaccuuucuaacaggaguguaccucacagccuucuaggaucuccagaguggacaggaaucucacuuggagggaccauggagcaguauacagcaaacagcaauaguucgacagagcagauuguuguccaggcaggacagauucagcagcagguauggaagcaaaacugcuuuaaacauuacagcaaugaaacugauaacagcaccacucaauugguuggucuauugcccuggggaauuauuugaaagauaccagaucuugugagauauugggucugauggcuugugcugaaaugccaugucuagcccaugaccacuuagaaucuacucuucaugggugccugguuauaguaaauugccucuuuuaucucauuuuaaguaaaaacaucuagucugguuuucagauggaaauuuggacuuuaaaauuuuucuggauucuauuuggucuuuuucucuucuuguuugagcuaacuugugauuuaguaagucuuuggccacaacagacaaaccaacauagcuuccaauaaaucuucuguuuuuugauuuggucugccacauuuuuuauucagaaaagcucugguuuaacauuaggauaauauuuagacagccauucuuauggauaagacauacuagaaaggaauucccugcugcugguuuauuccuaauuaauagauugcuuucuugaauuuauacacagguuacauuuucugaugcuuuaugcuuggguuuauuauaguaaaauuucacuuuuuuccccaccccagaagaaaaaaauguauuauguuucuauuugaccuuaggccaagauugauauuuuggaaauacuuuguuuucaaaauggaauuuagcuaauauagaaaaguaguagggaagggaaagguaguauugaugaugaguuuuucccgucuaaugaucaaagacgaacuccccugauagcuuucccuuccauacagcugcuguggcucuggcaguuuccuucaacugccuuuuuagaggaagggauuccacaaagggcccuccauucacaccagugcccuggaggguggguuuuuauucuuucagaauuugccauuaguggauguaaaaauaagguugaaucauugaaaacauggcucuuaaagcaguccaguuggguagaaauaaucuuaguuuugaagcugggcauggugcugcaugccuguaaucccagcuacucuggaggcugagacaggaagguuggcuuaagcccaggaauucaagaccagccugggcaaaacagcaagaccccaucucaaaauaaguacauaaauaaaguuuaaaaaaaaaagaaucuuaguuuugggacaugagagcauugacgucaugaagaugauuucgguucauagugauuaauuacuccuccuuucuuggugauugcauuuaagcccagaauuuuuuaugguaguuucagggcuauuaaaaccuaaucauuuuuuucuugugaacucaucugaggagauaaaaagggcauuaaacaauuguguaaguagaagugucagauuccuguuucuggagggaaagauugcauuacaaaucuuuguguuaaugaugacaacuguuuugaguuuuugagucaaauuuuugagguccacucuggagacaaagggcuaauaucuuuaauccuacuaccuucaacaaaacagcuucaauauagggagucuguacauuuugaaaguccuucaggcuuccgucucucuccuccaagagguaaggugaucugugucuugaacuacacauuuccuuccugacauauuucaagcucuuccuguuccuguucucagcagcaggguggugucacugcugugcaguugcagacugaggcccagguggcauccgccucaggccagcaaguccagacccuccagguagugguacccucucugauucucugugagcacugcaugaacuucuccucuccucaugucuggugcuguuuguguuaggaucuccaguaggaauggcaaagucaguugcaugucuuugaugcugcuaacuugucuuugaggcuuauaagaugccaguuuccuaauauuucaugccaagucauauagagaccccguaucaacuuucugagaauuggauuugacuagcauguuucuuugagaaugccuggaaaagaaaugguauaagugacaggaagaaauucuuauaagugacauuagaauuuauucagggcucggccgggcgcgguggcucacgccuguaaucccagcacuuugggaggccgaggcaggcggaucacgaggucaggagaucgagaccauccuggcaaacauggugaaacccugucucuacuaaaaauacaaaaaaauuagccgggcaugguggcgggcaccuguagucccagcuacuugggaggcuggagcaggagaauggcgugaacccaggaggcagagcuugcagugagcagagauugcgccacugcacuccagccugggugacagagcgagacuccgucucaaaaaaaaaaaaaagaauuuauucagggcucacacucugauccaauuaauugcaugguaaaaauuuuguguauuuguguuacaauggagaaggaaauauauacauauacagacacacauaaacuaggcuaggcugugcuuuauuuuuauucaaggggcaacucaacugaaaaauaaucauugcacuuggcaagguuuaucuaagcacugaaucuuguuaaucucuuguuaacugcuauuguuuccacuaccuuuccugggggaauagugaccugucuuauuacuagaucugcaaagauuaccccagauaccucuugguuaggcagaagcaggaugugcuuucuguaagucuuagguguuaaagccacugugauaauucuugguuaaucaauacaguucuuuagcaucguguauggcuaaguauccuaaauuggguucuaauuuggccaguuccuauaaaacacaggaguagcagcacuagucuacucuguguauguagguuacuuuuauuaaaauaacucuauuuuugagaaauuggcaagauuuggguacccuacuuuuucccuccauugaauuagaaaugauucaaaguagaaucuagaauguagaacuggcaucucacuuuauugcuagugcugcuaagcauccagcagauaacuaccucuuauugucaucacuuuauccuuucaaucccaccccuaccccugccaccaauaguguuugguaaugauguacagccaacuuugaacauaaauuaagccgaaagaaacugagcuuguaggcauuccaaaauuguguucaaaucucacaguccaacagcuuguuaauguuuuucaugcuugcuucaucuuacucauauauaaaacaguauuuuggauugucauuaaccccuuguggaauaggaauguaacaugcucuuaacuguauggcuucuuguuugaugcaugugucuuuguaacauuuuucuguuguaaauacagugagcucuuuggagucucaaaucauuuaucaugugcacgaauagcacaucaauuggggaggaaauuaagaugaugaauagauagaaaauuauuaauagcuguaucuuaaaacuuguguuuccuacuuacauagauuuuauuuaaaagaaguggaaacacuuuauggaaauaauagaaaccuuuccucuagggaucugauuauuuugggagaauuuuaaauaguuauuuugguuauucuugcuauauguauucugagaaaucuuucuugauacagaauaugcaagcauuugguguagcaaaggggauuugauuuggaauggggaaauaagggaaagagauagcaugagagagucaggcuguaaaguccuuaaaaaaguaaaguaaagguucucaauggacaguuuaacaaaacuuaggauuucaauguuccuggugauucuaauacauuaguggugguggcaguggcggcgguggugguggugauuguaggaggaccuuacuaucuaaccuacucaucuaggacagaaugaucuguuaacuaauugcuguuacuugcacauacuuucauuaagugugaauauuucagucaugaauauucuguucuaaguaauuucugucaaagauagagucugaaaaugaaaauuuuggacuauuccauggaucauuacaguuuacuucuaaagcacuuuuaaagugcuuccagaaagcauucuauuagguauuuuuguauugggacuuaagaugugacagagcacuuguagugaccuggcuccuacaguagucuguuuacucauaggagcuugaaauuuguacacuugacugcucuguguaauuucaauauuuguuguugcuucugauaaagcuaaaauaaccauguggauauuauagaggccagugaggaauuccaccauggagacugcaaacugaccagaaagugcuuuuaagaaaucuuuaguagugaguuuaaacaacaaacauaucuagaauucacagaguaaaaugagcaggauaaagguauacauuugacauuucauuuuagcuugagagacuguagggaaaaaagggucauccucuacauaagcuuccagagcugcuugcuacccagccuccuagagucauugcuggguacaguuugauuuaccuucuucacuuuauuuagaauuuguacucaaccaccaucaccaccaucaccuuucccucucauugccuucucuccagccuucacuacagaccauuccuggauugguuuaaacaggcaacuaaccuugccauuaugauuaaauguuugucauggauuuagcccguguuuggugacaaaugccuuauaucuauugagacuucucaaagacucuggauauucuccauuaugucugaccuuaaaguauugagcuuggcauuuaguaacaggauucauagauauuuaaagauaacuugaggacuugagacauauauuuucuuagucuuuucuaccuuuuccuuuucuagcaaggcagcagaauaguuccagugauugucuuuugguaaaaaccauuuugugucuuauguuauuucauuguucuuauuuuauuucauucuagguccaagggcagccauuaauggugcaggucaguggaggccagcuaaucacaucaacuggccaacccaucaugguccaggcugucccugguggacaaggucaaaccaucaugcaaguaccuguuucuggaacacaggguuugcagcaagugaguaauauuuaaaaauauugagcaguauaucagaggagagguuucaaagaauagauuauuacaaccuauuugauaauugauauugcauuuaacugcuuccuaacccacauuuugcauucaguugauuuucugccuuuauaguaccagugauauaaacuagaacuaugcagaaauuggacagcuccaguaaugacuaagauauuaggcaugaucuugaauugcuguaaaguauaugaagagguuagaaucuaguuuauaguauauuuuauuuuaaaagaaacaaaaaugaguauuuagaaaguuagaaaaauaacaaaacgagcaaaaaguggguccaaauuaauuaaguagaaaacugacguauagaaaggauaaauaaaaucuagauuguuuaagcagaccaauaaaacagguaaauccaguugaaacacugauugagaaacagaaaacaaaaguaagcaaagauguagaagagauuaaaggaaggccaggcgcaguggcucaugccugugaucccagcacuuggggaggccaaggcagguggaucacuugaggccaggaguucaagaccagccuggccaacaugacaaaaccccaucucuacuaaaaauaaaaaauuagccgggcgugguggcacgcaccuguaaucccagcuacuugggggguugaggcauaagauaucuugaacccaggaggcggagguugcaguaagccaagauugugccacugcacuccaggcugggcaccagagcaagauucugucucaaaaaaaaagaagagauuaacagaaauauguagaaauguuacauacaacucuguggcaucauauuuuaaaauuagauauuucucaucgagauggcaaaaaaaaacaaaaagucauuauauccacuguuaggauggauguggagaaaaagaauuaaucauuauuuuugguaauuuaaaacuguagaguuauuuuggaaaggcaccucacuaucuguuaaauacaaugaauauuugagcuagcagucccacuucugagaaucuguccuauaggaagaaaagcaucaauaguagggggaaauuacaaagacacuuuucauagcauuguacuagcaaaaaauaaaauugcaaucugaguguccauuaauaagaauaaggaaaugguuggaauaaaucauaauauauucauagggaauauugcaucaucauuaaaagaaaugaacuguugacuugggguggguuaauauugaaauauuuuuaguggaaauaauuugcagagaaauagugugugaucucaucuuuguaauucauaaccaaccccccaugaguauauguuuauagucauggaaaagagaguaugagauaacuauuaguuacucuaucuaaauguuuauauuguuucaacaguuacagcagucauauuaaugucuuaguuuucuggaggaauuuaaguugaaaaaagcagccaugaucccacugcucauaaaucaaacuuguacuuuuuguguauucuuuuguguuuuuaugcauaauuuuugggcauaauuguaccaugcaugugggguuguguuuucauuuuuuuuuuuuaauucuuucauaauguucagucaacuugaugaaucagaauuucuaauuuauaaaauauaguuaaggauuuugguuuucauuugccuuuguagguaaacauuugggcacgauaguuuuauuuuucaacugaauucucaggauaauuucuuuggauuggggauugcuuggguaaaggguaagaguauauuugagcccacuggcauauuuuugccaagauagaauuguacuugggauuaaaaauaguuuucacauuucucuuugcauaaauauaugaggcuuuaaauaucuuuucagcaugugcuuuccuugauucccuauugcuauauccuuucuguucuucucucuuugcuuccucuccagucccccuugcugcgccuucuccacuguugaguagagacaaugugguauaguuaggaacaguauacugugaguguagugguccaagcuuucauuaccaggucugccauuaaauaagcauucugaucuuggccaaguuauuuaauugucgguuugcucauccaaaaauaaaauuuauaugagaugauaucuaggguucauucuagcucuaaauucugugauuuuuaugggguuuuauuuugcuauaaggaaccuucaaauaguuauuucccugcuuccaaguagggcuauaacuaaccaagcugaaaaaaauauauucuguuacguaaauaaagcucucuaggugagauuccauagccucccuuacaauacuuaaggcuuuaauccccuuuguauaggaguuuuuuuucucauuaguguugaguagccauuuuuuaaagaagacuacuucuuaaccuuuuuugaauuguauucucuauuuuagaauccuaguaaagcuugcacccucuaagaaaaaguagagauguccagucucaugaaaaauucugcauauaauuuuagauuaaaauccuuggccugagaaagauacuggaaccagagagacagccaagaaauagauagaagaauauuggaaguuggcauauaauaaaagugguauaaacauaucaaugaagaaauggcugaagaaugauacagaaaagaaacugauuucuaauucauacuguauuuuaaaaaauauuugcuagguggauuaaagaucuaaauguagaaaaguaaacuuggaaaauucaaaagaaaauauaagaauuuuuaugcuauagagaaggauauuuuuaaaaacaaauugacuaaaacauaauaugcauugaaauacaucaaauaaaaguaaacaaggugaaaacuuggaaaagauauuuuuaauacauacaaccgaguuuguauucagaauauguauaaauaacguuuauguauuuauacaaaaauaggaaaaugggcgaagaauaugaauagauggaagaggaaauccuaacagccaauauaaacuuagaaaugaaguugguucacauaaccagauaaauuuguuuacuuauuuauuugccaauacuuucugaaugccaauuaugagcugaguauuuggaaaaaauaauucagaagaccuaggcaaucuauccccuaacaaaguaggauccaugaaugucucuaagacauggaacccauugaccuguuuuuuucaccuuccuuccaucaguaguccuuuuuccuaucagcugguagacuuugugauaacuuaagguucuaggcauguucuucuuuccagaccaagguggucccaaguugaaauuauggauggaaagugaccuggcuauaaaaaucuaucuuucugaaaguauccuccuuccagacugccaucuauguugaagcaaugcucaaauaaaaaaaguuuguugauggaauuaauggucaaagaagcaaagagaagguuacuuaguacuagccauguauucuggcuuuuaaguuugggagguauucuugaauauaaaauacaagacauuuugagcuauggggcucuccucacugcuuucucuuuugcacuuaaaaaaaaaaguguucacuaguuauaugaaaauaggauuuuguacacccaacauuuaaaggguuguauugcaguuuuuuaguuccaaaauuuagagaaauauuuuucaagcuucuugucagguuucugauaacacuccuaauaaaguggcuauagccauuaaaaaaaagaaagaagauagauuuggauagcacacgaucccuugcuuuccauaauugcuuuauaagguuuagcuauccaauccuaggaccaaauaggagauacaaauuaaaucaacaaaaauuugacaaacauuaaugacaguagugaguauugguaauuggaaacuaauaggaggaauauaaucugucacauugccuuaauuaucuauuaccauauaacaaauuauccuagaaguuagcagcuuaaaacaacaaacauuuggccggugcgguggcccacaccuguaaucccagcacuuuggguggccgaggcggguggaucacaaggucaggagaucgagaccauccugguuaacacagugaaaccccgucucuacuaaaaagacaaaaaaaaaauuaagccaggcgugauggcggacgccuguagucccagcuacucgggaggcugaggcaggagaauggcaugaacccaggaggcggagcuugcagugagccaagaucacaccacugcacuccagccugagccacagagcgacacuccgucuccaaaaaaaaaaaaaaaaaaaaaauuuauuuuauaguuucugugaguuaggaauccugacacagcuguguuggauucuuucaagguccucucaaggcccuuaucaagguguuguccugggcugcagucacauuugacuagaguagaauacauuuuggguuuuuucuuuguuuguuuuuuugagacaguuacucgcucuguugccuaggcuggaaugcaguggugcggaucuuggcucacugcaaccucugccucccaggcucaaaugauccucccaccucaguuccccaaguagcugggaccacaggcauguccuaccaugccuggauaauuuuuguauuuuucaguagauacaggguuuugccauguugcccaggcuggucucgaacuccugaccuaaucugcucgccucagccuccugaagugcugggauuaugggcauaagccauuguacccggcuuucagcauuuuuaauauauauaguauuuccucuguaaaaaaguacuucaucauucaccaaaauggcaagauuaaaaaauaauaauaaagcacuuuagaguguauuuuauuuuuuuauuuuuuugagacggaaucucgcucugucgcccaggcuggagugcaguggcgugaucucggcucacugcaaccuccgccuccgguucaagugauuuuccggccucagucucccaaguagcugggauuacaggcaugcaccaccaugcccggcuaaucuuuguauuuuuaguagagacaggguuucaucauguuggccaggcuggucucgaacuccugaccucaagugauccacccaccucggccuuccaaagugcaaggauuacaggcgugagccaccacacccagcccagaguguauuuuaaauaugcaugcuuuucaauauauauaaucauaccacugcuaucuuucauaaaaaccgacauugauuuguuaauaucagguauccagacagugucgaaauucccuauuuguuucauaaauggaaaauaaguugugucuacuucauaauggagggcagagcaggacuucuuuuuuccucuucagaacauuuucugcuuucuagagaaauguggauaacucucggggaccaaaggagaccagugucaguagaguacaauccuuuuuuuauguucuuuucugcagauacaguuggucccaccuggacagauccagauccaggguggacaggcugugcaggugcagggccagcagggccagacccagcagaucaucauccagcagccccagacggcugucacugcuggccagacucagguaauuccacuagcucugucacacaggagcaaaacugauuuggaagagucagauaacugagucagauauuucauguauagcauguauaguagaaaaggggaugaaaaccauaaaaaaauauauuuuuggccgggcgcgguggcucaugccuguaaucccagcacuuugagaggccgaggcaagcugaucacaaggucaagagaucaagaacauccuggccaacauggugaagccccgucaaaauacaaaaauuaggugggcaugguggcgcaugccuguaaucccagcuacucgggaggcugaggcagagaaucgcuugaacccaggaggcggagguugcagugagcugagauugcgccacugcacugcacuccagccuggcgacagagugagacucugucucaaaaaaauaauuuuuuuuuuuaaggacuacaucguucuuuguuaguaucuuugggaucuguugaauugugucauuacuuauuuccuccagacacagcagcagauugcuguccagggacagcaaguggcacagacugcugaagggcagaccaucgucuaucaaccaguuaaugcagauggcaccauucuccagcaagguaaguguacccauaagcuucccuaggacuuuuuggggcaacuuuuuugucccuuagacaacugacaucuuuagaauuugaguggugaacuugacacuacauauuuuuuggacaaaaaaaaaaaagauuuccucuagcucuccauugauuguugguuucuugucaccaucugugaccaacagugauuccauguguagcaguuucuauagugguugcuaaucuagggauuguguaagcuuuuagggaagaaguguuucuaaacagaagaauagaaauagggaguucauugguaaagagagaaauagaucaaaaaucaaguuggcuuuagagugcuauugcugcuuauguuuuuuucugggucauuccauuacuuuaaaugacuauuauguauacagcacuuuuacuaagaaggguccucaaagagccucuagucuaguaagaaagacgugaacaaauaaauacaaugcagggcccucauggaaguauguucuaggaauagauaacauaaauaauagauguuuggucugggaggaggagugcagaaacugaacuugaaggcuuuuggaagcaccuguuagucaaauaguuaaaucaaaaaaggacaucuuuguuagauuccaugacuuugugauugcaaauuugcaauauacaggauccagagagugcacuaacugugugcucuuguauuacuccagggaggcccugaacuggauugagcccaggcaagagcucaaacagaauggugaacaaauccucaagugcugcuauugauagucuggggacuuggaaugcuugguuuaauuuuaaguuuuaauacuacaacugacucauugucaguuugagauaaacaaaguauaaguuuuaaaaucucuguccugaagcagauugcucauuauguacaagagcaguagguauagcuguagucagacugaccuguagaagaggaggccuccaaaccuuuucaccuuuugaaaacugcuaaggauagaguuacucaaaacugggaccuagacaguuaauagaauuucaaagauugugauuacuuagauuauauauagcacaccacagugggagaguacuuuuucuccccuuguguuuuucaguguguuuugccaggaucggugaguguauaccagauagaagagggacuaacuauguucccuucuuucuguucugugugccuguuuuuuguuuguuuuauguuuuguuuucuuaaaguuacagucccuguuucaggcaugaucacuaucccagcagccaguuuggcaggagcacagauuguucaaacaggagccaauaccaacacaaccagcagugggcaagggacugucacugugacacuaccaguggcaggcaauguggucaauucaggagggauggucaugguaagaaaauguauuuuucagcuuugucuuugaaauuuucuugaacaugcaacuugaugccuccuaaaauuuauuauguugaccucuugggauugagaucgauccuuaaggcacugucgguaaucuacuuugacaauaacauuaugacaaaccauaauucauucugagcaccuacuaugugccagggacuauucaccagggacuauucuagaugcuggagauaaagcaauggauaaauagugauuuuauggaauucuuuucagaauucaaauaacgaagggaauuauauacuaaucuuugagaaguggaaaguaguauugcccaugauggacaaaauaagaaauaagcuaaaaauuagaaagauuguaauugauagagaaaccaaaaaaaaagugucauguaaauguauugggaagauaggaagauuugggugguguaacugaaagcuaaauccucauaugucaaaauaggauguuaaaaugcauaaauuaagaaugaguaacagaagucugcacagagguggaggaagcuaugaaaagaaacagaaccaacccuggcucaguggcaugcaccuguaguccuagcuacuugggaggcuaauccaggaggauggcuuaaguccaggaguuugagcucagccugggcaauguagagagaccucguuucuacgaauugaaugaaaaauaaauaauuuuuauaaaagauucaauacaguuauucaaagcgguuguauuugggaaagagcugugggguacaggacucuguuacuuguuuuuaccuacauuuaguacaguguuuugguguuuuuuaagaaaaauuaggauugaauuauaaguuaacuauuauuuuuauaaauauaggcauuuaguagcacuuggucuaucuauuuuugugcuguuuuuuugucuuaugacuacuguuccugaccauuagauggcagcagaaauaucuagagccauggguggacaugaauuagggcaugguuauauaguuucucagaguggcaccugaaucuccuaugacacagucaucugggguguuuguuuaaagugcagaucuuuaguauaaauuucuccagggauccgcauuuacccaaguacccuauaaaaauuacuuuuuguggcauuuacaaaaaaaauggaugaagaggaaccaagaaacuguuucuauguccauacuucaugccaccaauaagcucugguuuccuguucacacagaugguuccuggggcuggcucugugccugcuauccaaagaaucccucuaccuggagcagagaugcuugaagaagagccucucuacgugaaugccaaacaauaccaccguauucuuaagaggaggcaagcccgagcuaaacuagaggcagaagggaaaauuccaaaggagagaaggguauguauaacauugggaaggauauaggaaaggagaauagcaggguucuacuuuugaaauuaucuuuuauauggcuuguuuucucacguaccuuccaaacaauugacguuagauacuuguugucucuuuuguaagaguuagcauuuguuauuacuaauaugcagcugcaguuauaauaacgaaaacaaacaguggcuuaaauaagauguuauuccuuuucauacauaaaaguaguccagagauaaauuauccuggacugguagcacauuuucacaguucucaagaccuguuucacugcuuuaauauugcuagugugcuguucaugguccaagauuccugcuuaggcuccagccuaggaagaaagggaacaagaaagguacccuuucuuuuuuuuuuuuuuccugagacucagucuugcucugucauccaggccggagugcaguggcacaaucucagcucacugcaaccugcaccuuccauguucaagugauucuccugccucagccuccugaguagcugggauuacaggugugcgccaccacgcccagcuuauuuuuguguuuuuaguagagacgggguuucaccauguuggccaggcuggucucgaacuccugaccucaggugauccaccugccugggccucccaaagugccgggauuauaggcgugagccaccauacccggccagguacccuuucuuucaaggaaacuuugaagaaguuguguaccuuccacuagccggaauuuaguuaccugaucacaccuaacaugcagauaaggcuaggaaaguccagccuggugugguggcaaaugccuguaguccuacuuggaaggcagaggcaggaggaucacaugagccgaggaauucaaggcugcagugauucaugaucaugccacugcaguccaacagcaagggugucagagugaaacccuguuucuagaaaauaauaauaauaaacuuuaaugcuaggaaagucuuuuuacugaacacucauuugcucaaacgaaauuuggccuguuauuaaagcagaggaaaguguauauauugugaaguguaggugguagucuguuauuuuuuuuaaaaaaaauucauacuauaagcauucacagucuuacaguaguuauauaugguuagcuauauuacuuacuagguguuuucuccaaagcuuccaucgucauucuaagucauaauugucccuugugacuuugaucccagcugucuuaaacuuuggagaauggaauuugugcacuagauaacugugcugguucuggauaguauuaauaguuaaaugguuuuauuucucguuuuagaaauaccugcaugagucucggcaccgucaugccauggcacggaagcguggugaagguggacgauuuuucucuccaaaggaaaaggauaguccccauaugcagguaggaagacauauacauuuuauucuucucuuuauuaccuuguauugacuugaguugaagccuucagcaguguccucuugcuauuuuccuacucugggacuacucacauucucuaaacuggaugcaaucuuaugucucuuuagauuaucuuuuaucuuaaaaccacuaggccagacuugguggcucaugccuguaaucccaacacuuugggaggcugaggugggaagcccaggauuucaagaccagccugggcaacauggcaaaacuccaucucuacaaaaaaauacaaaaacuagccaggccuggugaugcaugccuguagucccagcuacuuggaggguugagaugcucuucgucuuugucacuuauuacuauucauucuuucuugaaaaucacacuuuucuuaauuuucaaggaacaaguuuuauuuuuauugaacagguuuuauuaccccaucacaaauauaauuugaauguuuacuuuuuucccuucuaacugaugugagccuggucuaauccucucuucuuuggcuuagauuuauaaaauagcugcuuaauuugguuucccuucuuccacuuuuguuccccucuagccuacucuccacauccuagugugaucuuuuuaaaauguuuauccuaucaagucccuguucugcucaagcuccuucaaccccuacccuuucccauuugcacuuagacugacauccaaagugcuuacuacuaugcccagcaaagccuuacaugcuccagcuccugucuaccucuaacugcauuucuacuucuuggucucuaugcugcuguuuacuguucauuggucuacuuccugccacgggucuuuguccuuagaauuuucagucuguaugcccuuuaucuuuuucaugcaugucuaucucccuaucuguuaggucuggguuuaauuaaauacccuaucuagaauagaucucuucucucucaguauguucuuacaacaucuuuucuuuuuuuggaggcaguggugugauuauggcucacuuuagucuugaccucccagcucaagugauccucccacuuuaggcucccgaguagcugggacuauagccacgcaccaccaugcccagcuaauuuuuaaauuuuuuguagaaauggagucucacuuuguugcccaggcaggucucaaacuccuaggcucaagcgauccucucgccuuggccucccaaagugcuaggauuacaggcgcacaccauugcacuuggcccuuuucuuuacaguguaauaauauuuaaguuguugaauuuuucaagauuguuuccuucacuagacuguaaguuguauagaggguagaggauuguuucguucucuguuauauuuauuggacuuaauucuauuuaaguaaguuguauuuaaguacugacuuagauguauuuguuggguuuaguauccaguucugaaccaagcaaucaguguuucuugaauuaauagauuccucccauuugcugauacuccauucuauauuaacaucacauuccacuugcacuauugcaauauccaucaaauuaaucuccagucuccucuaauuggccuuauauaguacuuauacaguacaugguuaaaguguuuuuuuuaaccugccaguccccaggucaaggaugcaugcuauuaauaguucucauuucuuaacugcaucaaaucucaaacuauuucuguauaacaucuaagcaacuuugccuuaucacccccucaacaaucaaacuagguuuccucaguguccccacacaugaacacuaacaacucuuucagugcuauuaauccucaccuguagugugagagccccuccuuucucauugcuauucauucauaacgguguaugaaugugggccugacagcuauuguggcaggagggcauugugccaggaacucuccucauucugugugcuaacaauaugaucuuggucaauucagccucuuuuauuuuuaucuguaaaguggaauacuguugauacuucacagcaauguuguagggauuucauucaguaauccacauuaggcaucuguguagcaccauaccuagugcauggugaguucaguaaaugcuaguuguuuuugcucauuguucaagacccaguuccagucuuccaucuccagaaggcuuucagcuuuuucucagauccugccuaccaaggcuucagagccuugguaugggggaacuaaaggugguucuugcggaguguugcaaaaagcuuccaaggauuuauccuuguguuaacacgguaggucuuaagugagaaacagcauauagaguuuaguggaaagaagaugaaaugggagucaggagauuugggaguuagcccuugcuggacuccuaacuuucugacccugacccuaguccacgcaaaucacuuuacccaucuggccuucagauuuaucuguaaaacgaguacauuaaaguguauagauucuaaugauucuuucuagcccugcuaaguacucaguauuuaaaugaugaucaaaaaacagugacaaaaauacagcaugacaugguuucucugggucuuuuccuuagacaccugaaucugaauacucuuaacccuuaaguauagagaacaacacaagguucuuaggaaagagauacacuaacagcccugcaguguuucaccauggagugcaggccagacuuuaaauuauuuuaagaauaagguuuauugucucuucuuuccuaauggggcuacacuuuaagccauguaugcagacuuaagauguauuacaagccuuugauuuacuugguaaaguuauguguauucucuuggggggauaaguagugagagccaugaguuccuguugcuuuugcaaaggacuuuaaucaucaugucaucuuugucucuaggauccaaaccaagccgaugaagaagcaaugacacagaucauccgaguguccuaaccccacgccaugugauggagcugaucaaggucauguuucucacuguuccaggaaauugaucaacucuuccaaugggacauugaugaucacauucugcccuuuacuacaggacagaaaccacuuaguuuuuaauaaguggcucaguauuacaauugcagcgaugccuggcaaauugaaguugcaagccuuugucuuacucuuucagucaggaccuauuucagacuguugaugacauugacauuucauggauucggaugaugcaaggagacacaugccaccccagcaguacacaaagcacuuaccuugacuggugaagucagccagccaucucagcagggaagaacaaccuucucaaccaaaacugcaaucaggaaagcagcagcccacuccuucccauggaaucuagacagcauuuaucccucuggugggggaaucucacacugacuaacugaauggacgcuuuguauucagagauggcuuccaggcaaggaaguucuaucuugugauacggaaacaauaaauuccugagauacauucuuccaaucugugguaauaauaagaauuccucucugcccagaugguagguugauauuucuggacucuagccaagaaaaagcuaauucuggggauagaaugauaaaagacucaagcacuaaaaauauacauugccgaaucucuuuuucuagcuuugaaaaguuguggccugcuugucccucuguugacuggucaucuggaccaucguacuugcuguggcuacuucuaagacaauguagaggguuauuaaaccuugaaacugccuuuccuaaguagagaacaagacuauucaacaacuucuuugcugaagcacugaggagauuuguaauacuccuaaaggaagggccaaacuagagauuuucaaucauagacuuugugacagcauuuggggaacuaaaagauucauguguuucagccuagugggagagagugggggagaggaagagagagagagagcauguauacccguauguuaucauagagcacgauucuccaguggauggauaccuggaauggaucauuaagaugaagagaguaauucacauuuacucuagaaccuuuaacaagcacugaaaggaagaagccugagauuugauccuugacaauuucuggaaagcacuggucagucacacuguccuggacagaguccaaguuacccacuaaagcuugagguggauguuggcuucacuccugcagcacaaugcuggcccuagaaagcgagcauuuucauucuucccauggcagcugauucuuuggugccaguuuucauguuuucuccauaggccuugugcagaaagguuuucucauugcauccauacugugagaauaaacugcagacugaaagaaacaugccugcagggucaggaacugggccacuguucccagaacggguugugccucagaaaucuauuucucuuuuagauguugaacccugagagaacuaagaugauauuucagaagaguuggcugccuucucuggaaacaaggaaaacccaauaauuccgaggaacauuggggguuaaauaccaagaauaaaaauugguucuucuuugacuucagcuuaacuguauuaagacagaaauuaagcccucuaaaaacaccacaaagagagaugauuguaaugauagaaauagagguacagagcuaugcaaaggaaacaggaagugaaauauuccuagucccagggaucugguaaucgcuccuggcuuccagaugucaaaggacugauccuuugguaagcucacuagaaacuucuagcucuacaagaguuugggauauuaauguuauucaguaagucccaaguuuuucagagaauagauuacuaacaaugaggaauuuauauuccuugguuaauuuaggagucuaagaugcagaguucagaaagaaauuacucagaccuaacuuugagugcuuaagcugccaacaguuagaagaugcuauuuauuugugucuguaaguuuguacauaguaaugccagccuuguugcugaauuuuuuauuuggggggagaugacuuugaauuuuguuugaaaugcuucaguugucauuuugucauugcauuucaaauagcucaugacccuuuucuuguggucacuuuggcacaccauaguagcccacaaagugggggcaggguauugacauuuggauuuuuucuuugauacuaguucuuuuauucauuuuuauuugugacuguagugauaacuuuacagauggagaaagagugaauggaugaaugaauaauugguuuaaugccuaguuaugcaacuugagugcuuuuuuuuuuuuuugcaggauaauuuuaaguguauauauuuuaacugcacugguacauugaacaugucagugucgaugccacuggaccaacagagcauuuuguggcuauagggugccugauaauaaugucuugauuuuucuuugggauucaacuauaucgaagguuuuucccccagcaguaugggggcguacaggugaucgaucauuaaugucauugcaauuguuauuuuuuaaaauaaauuuauaaaaauaaccgaaaaguaaugugacuuuugaggaaucugcaacuccuggguucuaguuuguguuu

SEQ ID NO: 18382 - RNA, 3216 nt, Homo sapiens
uuuucagguaauuaaacaucugagugcuaaaucuuuaugccagguggggaggcaugugaauggaggcgagcuggugugcccaccccucccccaugggccuucacacauucauucacgcgcacacacucacacagagguccagaagcuucuaucccacucugccgcccuagucaucauauuaugcauucaaauacacacuucacaucauaccuucagaguuacuaauaggauuuuauuauuuaaguguaaaaucaguuucccccccuuucccauuucucugauuucuaaggaaaaacggcaccaggggacccaggaggguggucccauuggggugaacccuaacuccacagcccugcuugcagacucuuccuccccacccugggcgucccuccucucccaugcccuagggccucagucacucuucuccgugggcugaggcuggugcacuggacaaaggcugucccuccacaggugguaggugagggcugaagucacggugagccaggcuagguagggcagcaguaacagggcagccaguuuguugaugggaugccagaucagugcugugcucaccaccagcccauacagcagcagcaggugcagcagggccugggcauagaggccgggggucagcuggcugcccgagaaccagcaccuccaccuuucugcaguacccagcccagcaacgagcucagucccuggggcucugugcacaccaugggagugcagagaagucugcccacccauuaccugccugcacucaauugcucugcugaauuaugugcuucuggagccaggugguuucacccucucccacauuacuucugcuacugagcacugugugccuuaccagaccaggguuguggacugugaaaaagagaaccaggacaguccagcugauggugagcugaacagcauagaggccaagaggcagggccaggggccaccccaagcccccucccagguccuuccacaccagguaggaggcauagcuguggagacaugguggcaaaaacauucagugggaggagguuccguggcaaauggaggaggcucucuggcauaaggacucuuggauacccuugugggcugaaaugggggcagauggguuuaggcaucauguaagggccagggagggaguuggugggaggagcugggcauggugagguggaggaggggcuggggagacuuagagaggguggaagaagggcuaacuggaaccccaggcaggcauagaggguuucuuacuuucuggaggacccacuaugguggugagaggcaagacaaagcgccuaccuuuggaggccaauauaugggaguaauucagauauagaggacuuguucccaccccauuggguaccagggccaugugugagaaacaaguacucaccccacgacagaguagauggcugucuguacaagcaauaagacuuuguagaaugggcaccaggacagcauccucgggcccucacaccaaccagacaugugaucacgagugaacagccagaccaggaugggccccagguggggcaggagcacaaagauagccccuugaagccgcauucaccuugaagaggcaaaaucuggggaggcagagaacaugcuagugaugagccuuccccugcggcuccucgucugucucugccuccuaaccugacucauuuccuggccugagccccucagagaaggucuacucacggagguccuuccucucucccuggcccagcuccaguccuguaccucugagcucucuccaaccccaggccacaccuugcccaucuccuggcuuccauggacuucuuuucuccacagcacuccucuggcacuuggaggacacugcccagcacugguaacugcuucuaagugaauaggccuuccuccaagugcuucugaguccuggagaucaggucccgggugaugagcuuuucugcagugggcagcgcuuagccagguauguagcuggcccucaccgagaacuguucuaccuaagcugaucuaccaaccuggaaaguucacaaucugaaggcaggagccagaaauuccuggggacucuuuucuagucacgaaugcggcagcacaucugucccaggcuuaucucaccauaucagacuggcacacucauggggcccacccaggcugaucuccugcccaaauucaaacuuggccuguugacaccguggauuccuuuuucugaacuuuuagcucucuucuaccccuggagccaugggguaugagcuuccugcuccaucuuuccauucccagagugucaggauguaagcacaagcauccagguuucuuguggccugacuuuucaaggaaacaacugccuggucuuugauuaaaaagcugccaagguggcauguugcuuugcaugucauuugcaugugggacaauguacagacccuccuccagccaaggccccaccaaggccccacaaauaucauucuucucauuuguucaugauauuucagccuccccccaugauuaaccagauuugaaggagagaaaacaaucugauuauuuucaguauucuggacugacuaucuaauccauccuuuuuuuuuuuuucuuuucauacagaguuucacucuuguuguccaggcuggagugcaguggugcaaucucggcucacugcaaccucugccucccuaguucaagugauucuccugucucagccucccuaguagcugggauuacaggcgugcgccaccaugcccggcuaauuuuguauuuuuaguagagaugggguuuugccauguuggucaggcuggucucgaacuccugaccucaggugauccacccgccuuggccucccaaagugcugggauuacaggcaugagccacugugccuggcccuaauccauccuuuucugucaagggucagggacacugguccuggagguucugggacagagcugagcagcaugcccaccugugcauauuucuacuugucuuucugugcuccugacuguccguuugcucaucuucugccuuccuguuuuucuacauuucuguccagugguggaggcccccucccugccccucccugcccccauccucuuuucuccugacaccugccucucccagugccuccugguuccuaggccugugcuccccuuaccucuggcagcacaccucccaggcggggggccugaugacauaugauguguggaaggcagaggaggguggggcugggaggaggguggggcugggagg

SEQ ID NO: 18383 - RNA, 22984 nt, Homo sapiens
cuucaggacugugaaggccuuauuguucgcucugccaccaaggugaccgcugaugucaucaacgcagcugagaaacuccagguggugggcagggcuggcacagguguggacaauguggaucuggaggccgcaacaaggaagggcaucuugguuaugaaguaagucauggaggcugcgggcgguuuggggguaggggggugagugcggagacugaccacaccuagggagaaaaaacucacuugagagaaagcugaguccauuggaagggcuuccaggaggaugccuggucuagggccugcauggucaacacacacagcauagugguuucaagguuuuuggaaggcagcuaugcucaccacuauaucaccaaugccaucaggguguuacacaguuuuugaaauugagagucccugcauaaucucaaaauguuucacgagcccaccccaugcgcaguugcuugcaccucugugaccugguucaggaaucggaaggucagugaguucaucugcauuuccugcucccacccagcccccucugccucuauuaaugcuguuuguggcagguuuuugucagcucuacuuuacugugcuuguacagaggcacaaccuuugcuagcagacuaaugacuagaauccuugcccuccccacuucccugccaccuucuggaacuaagacacuaguuucucuuucagugcucuagggcaagaggagaagggucccauuuaaagcuguuucugcagaaacacaggggcagaggucaucagcacgccagugcuguacuguacccguucugucacuuagaugguauggcaaggccauccccaggccucuuuguucuuaagacuuuucucuucccuuggggacuucauuguccuuaagaccuuuccccuccccugcacugcacuucccccuguaggguagagguuaauuggucaccugacugaagucaauauucaacagcagaaauguuaaacgauaacccaucccacauucuugccuuggacccagaggcagccaggccccaaucucugcaccucuacuugcgcccccauacagccuguuugcugugggaggaugagaagccaggugguuuugcaggcagacagacucugagaguccguuuaucuuauacaggaucucuugacuuuuucuucuuguaaccuuauuaaccuucauuccagagaugaaaaagacagacccaguaggggaauaaucagggugaacacguauaugaaauucuuucaaaaaccuaaaaagcauuuaagaaaagaaaaauaguuuuguggguugccaccucuauuuuuuuguuuauaaaaugggaagggucuggauugcccugugacuuagggugugaggaggcuuucucaguucagaacuuguugagagauaggaagaguagucagacagguggagauuacuaauaaaagcuagguuggggcugcgugugggggcucacaccuguaaucccagcacuuuggaaggccaaggugggaggaucacuugggcccaggaguuugagaccagccugggcaacaaagugagacccccaucucuacaaaaauacaaaaaaaaaaaaagaaggaaagaaaagccagguauguuggcaccagccuguagucucagcuacugagaagguugagcuggaaggauugcuugaacccugggaagucaaggcugcagugagcugugaucaugccaguacacuccagccugggugacagagcgaggccuugucaaaaaaaaaaaaaaaaagccagguuggguaacuugaugaagauauguaggcauuggacugagcccugaauucgagagacucugaccuugguaagaucaaugguaggagcagcagggaauuugugcuuucuggaggcagguagauccugaaauaggagaaagaaaagggcugaaccacacacaaaucugaucaugugagacacuucucugccuugggaggaguguuuggauagagagaagccagauauguuucucuaauggaggucccucugcagggaaacauaaagccaggggaaggggguuucuuuccagcccuuggcuuagggcgagaguacaucagagaacucuggacaguggcguggucaguucauggagcaggagugagagaacacagccugcacucaaggcuuucucuuggggaaggagugggaauacugggucugugcccauugaugucccccuuuucuuugaucuuuagcacccccaaugggaacagccucagugccgcagaacucacuuguggaaugaucaugugccuggccagguaagucccugacuucucagcaaagcuagucucuccgauaugccaauuauuaccacuugccaagcaaauggacccagaaaaacuuagaaacauuucgucucagcgacuugcagacugcuaagaaggcgacaugcagacugcaaagaaccuuuaaggccaucagguccucuauucaacauucauuacacagguucccuagugcacaaaggugcacuucucuuuacucauguucuauucuccaugcugcagacaaucugccuucucuagccuccaacucuugcaaauguucuccauacccugcugccuggagauaacaaggaaggauguuccaggcagcaggguauggacagugucuagguacccucugcuuacuuuucaagauuaagcuucaguauuaauuuauccaagaagcucucuggcuuuuccagcuaggcuaugucccucacugauuccccuggcccucagggcuuaucucugucacugcccuuacaaaucuguauuguaauagaauggaguaagaaccugcuucaggguccuuguguguucuguggguucauaacacaauggaacucaaaugggcaagacucuugcucuucuagcaggaguuccaggccucuugaguggauggggcagccuagaaaucaaaugguuguggcacagaaugugcuugagucucaguguguugguuaguaauuuggcaaaacugauugcauggagcacuucuguugaacaggcaauucaagcauuuauguggucaaggggaagaacaaggcucccaauaaacaggguaggaaguuguucuaggucccuuugaagcuccauggauucccuaaaccagcggaccuaggcaucaaggacuccuuguuucucuacucaggccugaaaccuuccgggaccaagaaauuacuuuucccauggcgagaccugcuuucccuccugcuggaggaggaucugggggaauuuaccucugcucuaacuccucccugcaguuuccaucugagcucucugguauucacugauauucacugguaggugaaaggaggcaguggggggaaaggagaaacagggauagcuuacacagcaguagggucucagccuagaaggggcccccaggcuggcagccggguucucccagaacaucuaggcugagugucucucccccuggagaaguacagaagccuggcacccugguuucacuucagcuauuaccuucagggauuuuuuuuuuuuuuuuugaguaagggaaaagaucucaauguggcuuucugauuaauuaccucacuuuuuuucuggagguggaaggaaaggauugggagccagcaauacuuucccuccuuuuccaggaccagcuuuguuuaaaggaaucggugaaaugcugugguuuaaaagaagcuccccauugucaacugcucaccaugaccucacucaucaaaggugcaucaaaacuaggaaacacgcacacccuauugggaaggaaugcguucguuucaucagacuguuccuagcagggaggacgguaggagagugugggugccuauauguagacucuacaggauugggcaauguggguggagagcaggcguggcugggccucacaguagggacuuugagcagauggcgggggcuccugaggugcagaagaacagcacacagaaaggaaggaaggagagaaucaacaaauguagguuucaccauuuuugccugcuuuaccaucuccuccucuaguaagucaggccagcaaccauuuaauuauugugaggacccucgcccacauuagaguccucuccagucuggccugaugaggauuccaaagcauugaaaccuggagaggcuccaugaucagcugggagcagcagccagagaaaaggguuagggauuucuuguguucuguggugccgcacgcauacaucuuagauagcacuguggagucuggugggaagaaaauaggaugugagggagaggagagaggggccagguggggcucugucucacuaggucaaaggcauuuuaucaggcaagcuuucccaagaagugaacaguuccucaaggcaagucccuguccuuauuaccugccugaugggucagagcagugaggugaaugcagcuugucccccauguggcuugguacugaaguucuucugaguuuacccauaagaucgugcgccucugugauggaggacagauuccaccuucagccuuacccucagauggagaucaauguccuagugauguguagagaugagagaauguuuuuguguuagaaguuagugaagugaaagcacggaaguagcagcuugagauuucucuuuuugcacgcucgcucacucugagguuuuuggcaucagguuaaaggccuacauuuaaguacucaggaggcuggccgugcugggguugacuuugcuggcuuugaaucuguucaagugccuccaguugggugaucuggggagaacuguuuaaccuccagugccucccuccgugcagcugugaauguuagaggaguuaaugugugucuaaacauuucuuuuaggaugucuaaaauaaagugcuccuuaaacauuguuucucaaaucuuccuuuuuugccuccagagauguguugaugacccaugcccacaggacauauaucgcccuuugaccucuaauguugcccuaauugccacuuccucugucuccuccagaaaacacagauguagacucagacuuccaucuggacuaauaggaggagacaggcugugaagaguguguguguguguguguguguguguguguguguguguguguguguuggugguggugggacaggaagguggugcggauguuuaaaaauguugggaccacgcauucaggacagaauggaagugucugggcuuuggcauccacccacccacucuaggguccagacuagucuaagacccucgggguuaagaaacucucaaggaagcauagguaauuagguguccucuucauaauaguagaagacgucauagguuauggugcuggaugagauagguagaucaaaauaauuccuugagcuucuggaguacucgaugucaucagaguugcccaguaccccacucaguuaucccuacagacccuggaggauuggcgaucgcuuaaaguaaaaaacucacucugguugaugccucaguggcugagguggaauccauaccuccucccagaugccuggcuggucacagaaaucccaggcuuucuaagucagaucuugccaaggguuucucucuucuguuuucccuuuaucccccaucaguguuccuaaaccugaacccccagacccaguucuuggggaaguggcugucaugggcagugacugugcaaaccugauguugcaucuccuuccugggcuggcgggaguccgaauggacccucugaaccugugucuauccuugcaggcagauuccccaggcgacggcuucgaugaaggacggcaaaugggagcggaagaaggugagcagcggccuugacucgccccaccugggcucagggcccgggguccacucauguugcugacuucagcuucuuuccuuuugccuguuugguugcaguucaugggaacagagcugaauggaaagacccugggaauucuuggccugggcaggauugggagagagguagcuacccggaugcaguccuuugggaugaagguaagauguugcuggaacccugugaugugggacuuucugcagcaauuuugggaaaggcagcaugucugggcagaagccagaagcuuuguucuaggagggucugacccucucuuggagcccccaucuaaauaaguguuaaagucaaggagggagagaacacuggccugcugaucuggacucaaaagcuggaaauacuugguggggguccuuuagcucucuggugagugaauagcccugagucccagugaaccagguguugauggcucuuuugagacuuugguuccugucuucuuaguuuaaaagaauuuaaacaagagacacggugcagcauugaggaguuuauugcaaaggaaaaagaauauuuugaaaguuaagugcagaguagacaguacaccucgggagagagagaauucagggugggcugcucauaagagugaggcaguguuggccgggcgcgguggcucacgccuguaauccagcacuuugggaggccgaggcaggcagaucaugaggucaggagaucaagaccauccuggauaacauggugaaaccgcaucgcuacuaaaaaaaaaaaaaaaaaaauuagccgggcgugguggcgggcgccuguagucccagcuacuugggaggcugaggcaggagaauggcgugaacccgggaggcggagcuugcagugagccgagaucaugccacugcacuccagccugggcgacagagcgagacuccgucuuaaaaaacagaaacaaaaacaaaaacgaaugaggcaguguugauuauugcuggagaaacucccuuuauaggaguuuuacaugauuauucauaaggaggugggaagagcuguuacuaguaagcauguuuugggugguccucugggugcacaugaguaguagcuguacauucuuguucauuuggcacaugucuuauuagcaucuuaaaucuccacccaggaguguguuuuuuacuauuauaaugagccagggggucaguuugaggacaggaaaaaucaaagugcacaggcugucuagaugggaaguucccuacugaagauagcuuugcuugaaugagcucaguuagaauaugaauaccgaggcuuauuguguugacuauaggaucaccaagguugcugcacuuccuugauuaccuauccugccucacagggagggugcuuguguccugcccauucuuucuuuccuuccugcuuuuguuuugucugcuuuccugugauaauuuagaaaacaggaacaaguuuauggccucacaguagagccuuacauccauuguccaucuguccuuccaguuucccuccauauuucagaaaagauuuaaaagugcuuguauguacacuaugauaugauuguagagccuaugguggcuggaagaccucacaccggucucagaaaucacaccuaacuccugucuucccccaggucucugccuuuuccuacucugggagcucaguaggcuucuggcuacucccuuagccugauugcaacccucugguugccaucaguagcagugccacccacuugggcuaauccaggagaccuugcaaaugagagaggcaauucagcuaagagaggggaucugcagggcuucccagauaggccaaagagaugaacccacuaaggcuacuaugggacaucucucuguucacuuucuguuuuagggaauuacagggauuauggggucaaacugcagccaggaagucuuuaaacauuaggagaucaguuuugacaaccagaucaugucaaaucuagaaaaguuuacauagagcugcuauggaacucucccuuuuucuacaucccuccuaccuucuuagaguuagaagggaucuuaauagauuaacccuuaauuuuacauugacaucuagaauuuguaagcuuaugccuaaggacucauagcaaauggacaguagccuagagccuggugagcaucccauuguacacauugaauauuauccucucccuccugccuccacuccccaucuuauuuauuuaagucagccagauaucuuuccuaagccucugcacugagaagggccagguguauucuugaucccuggacuccugagagaggcagauguagcccagcaggaucauugaucauguaaacaaaccacagccuugcccucugugcagggauggugggaugccauaagccacaaagagcacucccuccuccauccucuuuuguaagggaucaagggucaagguuuaguccauggagaauuuugauauaaaaggcagaggucaggaguuaaguaaaacuaagagcacucauagccaaauaggugagcauuucauugaugaagcaguaacugggagacaggcuccagaccaguggccguuccaaggcuccugcccccuuccccaggggguccucuuccccaugacuccccuuccccaggcuuccuucuccguggcaccacuacacaucaauauuccuggcaauauucuucaucauggagacuucggcagcgacuucaaccagaugaaaagccccaccucauuccugaaugauugaggugcuagguaagcuugucuguccaucuggcacugcccaacucucuacccugggaugcuuccaagaggugcauggguaccugggaccuugagcaucagugucaggaaauggcugacaccucucgugcauguguuugauugaaagagaugucuacggccugcucauuucaguguuaaucugugccucagagcaggucacccacugaauguuuuauucccauucccagcaugguguggagggugccagugccuucacuuugcauuucuucuguccagaugucucuggagggucauucuuaacugucuugcuuccagaacaugcucuuuguaaaccccugaaacauggcuuggaucauuccgucucccaccucagccccuccggagcugccuggaccucaucauuccggagagucuaaguggccucuucucgugcucagcugcuuaccucaaccacgucauuaucauacuuuugagucuggaugaauuuugucuuagggcggagagcucaucaguucuaccggucuuggagaacaagauuuucuaaagggaaaggaagauucuugaacauauugugaaagagauguauaagcacccagacaggaaaugaggauaaguguuuauuaaacacaaguuauuucauacuagccucauccucuuuuuggaaaccauuauuaaacugguagaguauggaaaucccuagaugucagauacccggacuauuuaaaguuauguuuuaaucauguaauaaaggaaugcauucucauauaaauuaaaacuuggacaaggcuauacuugauuaccaucugaacccuagucuccucacgguaaacaucaguuuagcaugucauccgagacuuuucuaugcauuugcacagaaugcauacaguuccaugccuguggauggauucuuuggcugcaaacaauagaauauuguuugugauguuaagaaaaaaacauguuuaucucagaacaacuaaaucuagcauauuuuuaaacaguuguguggaauuuuauugugcagauaaauugcuuuuuauuuggccauucucucaaugauggguauuuagauuguguauagauauggacuuugguaagacaucuuucaugauucccucgggguucggauggagccccuugagcuuggugcuauugaagggauuagugcuuggugcuguuguggaaugggccaccucaguuuggagggagauaguaugcaauagugcuccaccuugcccaccauucucaucaacagccugaaccaugugucauuuguggauggcaggaagcaaggagagguaguuaauacuuaagggugcagaaucagguccaaaaagacauaugaaggcuagaaugguugggcacccucacaggaaauuuagcuagaauacauuucugcacccuacuuguggguccaaaaagcagcuagacaaguuuuagauguagaagcauuugucaaaagcuuuucugggggagcagggcuuugguuuacaaaagagcagugugguugucaguggcauagcugauagaaaagguaaccugacauuuggcagcauuaaaagaaguauggcuuccggagcaagggaggugacauuccucacacuguggccugaccugcagccuaccuguggucugagucauacaggucuuaacgcucuauacuguugugucugcgagagacuuuuucucaauaguguugcugaaugacaggucgugaccucagagacucagcucauucaugcugguguguuccuuagaauguguuaagaggcacaaaccaaucaagaagcgagccuugugcuuuaugaucaagguuuuccuugagggaacagacaagcaucucuuaacaguuucuuuguagccagcguugugaugaauccaacuuuagcccagaggguuggauguugaaccugaggcaccaguuaucaccgauuuuuucagguccagcuaauguuugcugaggucuacugugucgguuccugugcuugaaaugacucugcagggucagaauuauuaucccagguuuacagauaaggaaacugaggcccaggaagguucuaugauaugcugaagauaaugcaacuaugaacuggugaauuucggcucagccuuccaggcuggcauucuuugcccaguaccacuuaacuuuauucaugauccauuuuagguaaacagucccugugccaugccgguaugcuuagcuauuccaaagacagauacucuccaggaugggcagcuccuaucucaguguguuaccuggaaugcuuacugcccagagcagugauucucaaacucaagagccucggguucuggcaaggugccuuagggacacaggugggagcaaggaggggcccagggagacagcaggugguggcacauugagccuuuaccucugcagcuuugaauugaccuauuuuuauauuugggucucuguuuaagauuucauugccgugguagggagaguuccaaugcuaaacuaaaaauucagcuguggggcagagagagcacgugacggugaggguucuucuucagagccucuuuaacugggaggccuccuugcucuccucuuugcucugcugagccagcaaggcccugcagccagcauaccagccucucagggcugucuucugugaccucaggcagguaggagccaccagcugcccuggaguccugcuuagaaagugaggcuuccucuguugccucaacaucaggagucugcccuggggcugggauugaggugagggaaccccuucauguuucuccccaaggcuucucuccgggaguagucuuugaaugguggguacccagaggugcuccaaugucuguauauuaggacaucugacccuuuccaggacacaccaggacccugacaggcacguguguccugggccuguugucacccuuuccauccccucaguguugucuccuagugucggaaccccaacccccagcugaguucagcucuucucugcccugguuaucucaaauggaaaaugagaacagagguuugcucagccagauuccuucccugcagucaucugcagauaaaugagauacucucugugaaagaaggaagcugagucagugcuucgcucaccccugaggaagaugcucaccugcuccucuccccaacccccucccuccagccccagucaccugucuguggagggggccagguucagccugcaggguccuuccuccugccagcccccagguuguucuuggcuccugagcauggaguagacgucagucaggcuggaccuugugaucucuauugguguucccuuccucuccccacuccauaugagaaaaaaaaauacaucuggauuagagaugaacagggccauuguucuggccggccucagggccagcagacgaagaagacuugugacaacgauggcagggaucccaucuccucgccuggacacuuucuccuccccaccagaaaugaguagguuacagccgaggggagcagcagugucugaaaaagaccaccagcguucugagcuggagguucuuauagggcgugggagaggcagcaucuuuccccaaaaccugccugaugguugguguggggccacuuggcuuuccuuauuccacaaggcuaaugaugaaaaaagggauccagaggcuucaccuuaaucauaaccauuuuagcuucugcccuagaauuacugaauuugaaguccucuuuccuauuacguucuuuuuuauuuuguuuuauuuuuuuuuuuuuuucugagacaucuuguucugucacccaggcuggagugcaguggcacaaucuuggcucacugcagccucaaccuccuaggcccaagugauccuccugccucagccuucuggguggcacaggugcaugccaccaaacuuggcuaguuuuuuaaauuuuuuguaggggggggggucugacuauguuucuccagcuagucucugacuccuggggucaaaugauccuccugccucagccucccaaagugcugggauuauaggugugagcaauggcacccaucuuucccauuauauucuaaaguaucuauacuguaucccuaauuucaaaaguaauuuaugaauaauguaguagaaaacuugaaagcacaggaaagcaaaaaggagaaaaauaauuccacuacccagagacaaccgcuguuaaaguacuaugcuguguauucuuuguuuuugucuaauccugggcucacucuuuacauucugucucgggguuaagggggauuucucuucaaauaauucccagugauugaaugugagagugagagauggcugcaaucaucugcccagcuccuuuauuuaggguugaggacccagguccaggggaacugaccuguaccuuuccacacagugggcagugacugggggaggacacaggucaggcuuccugauuuagagggcaugcagucuugcucccacucuggguccugccuuguaccccuguuguccuccuccuucgcuucugcucacucuguuuuaguaccugaugcaccuguuuccuggacuggacccuccagcugcagcugccauuucuccuucucccuuuccuggcuguccgcucccuacaugacugcccucccucccucaggacucccugcuuucuaaggacuuccaagcuccaccuuguccagaccuauaugagcuauuguugcaucugugugugaucacagcauggaggcagacgcaccuucuuuugagcucuggcugugccccuccucauuguggaagcccugcuucccucagcucucaagcagacaagaacagucccagcaucauuguguggucaugagaauuaauuaagcugaucaugguacuuaguauaugguaaauaguacuuaguauguggaacaugguacuuaguguaugguaaauuaacuggagaauuaauuaagcugagcaugguaguuaguauaugguaaaugcucaaaaaauguuugccauucuuaauaauaacaauacuaauaauuaagaaugacacuuccucccucucucuugcuuccaaccagacuauaggguaugaccccaucauuuccccagaggucucggccuccuuugguguucagcagcugccccuggaggagaucuggccucucugugauuucaucacugugcacacuccucuccugcccuccacgacagguagguguguccuuacauuguggauuggucacagaagccacagaccaguuaacaaaugggcccuccaucugggccuuccccagacagugguaaccagcuguggggagagguccaccuggguccugcagaggcugguguuuuguuagacaccccuacguuggauaggggagggugagccagcuagaagugcuuggggucuagguaagcugggcacagggacaaccagugacccccauggaugcuuucugcagccccugcagggcuuucugauucccagacccacuugaaacaguaauaucucaagaauuucuaagauguuucuaaacugagucuggcccagauccauaacagggacuccugccccagagcaucugaggaggaagagaugagagcaaagaggcugccguccagcaggagagaggcucugggaaagagcuggcucaaggaaagggaagaccucuggaagccagggaugagcguggggauccuggugcugccccagcaggaagaugcuucgcuuucuuccaggcuugcugaaugacaacaccuuugcccagugcaagaagggggugcguguggugaacugugcccguggagggaucguggacgaaggcgcccugcuccgggcccugcagucuggccagugugccggggcugcacuggacguguuuacggaaguaagugccuggcagccucagcgucaggaggacgggagagauagggagcagagaggcccauggcagggaaagccuggcguuuuacagaaagccucuagcuuauugucucuuucauccaugguaaaaggagaaaacuguguugccaaaaacacaccuuugugguuugaggaguccuugcggagccugguauggaggcagcuaugugguuuucugcaaaacucgggcuuuaaaggggacccaguuccugguuccgggcuucucagacugcuaacauauugacaaagauaaagccacaaaucaguucugaaguugagggucuggagcaggaagagagggggcuuuaguguauaguugagggacccugauggaaaugcagucccauugccaagaaaauguccuuuucaguguccaugggcauucuuuuucccuucuucucuugcuggguggacagaagcccgaggauacuggcaguauucccucaggguccucggggugggcugcuuucccagcuggagcagaggcucagccucacaccagauccaguagggaagagugcauuugcacucgaauccuuuuggcuccucuccugaaagauccuguccccaacauuggagcuuccccuggugaggaaggggaaaggacauggacuuuggauuagguaguugugguucgcagguuacuagcuguguguccuuggaaggucacuggcccucucugagccccuguagcacucacuguguacucccagcccagggcacacagugccuuuugguuuguaaccuuggucaucuuucucagcucuuagaucauaagcucccugaaggcagggcaagccuuguccaucuuuguaucaccauccucccuaacacagcaccuucuccugcucucuucagcauccuugaaccacuugcuggugguacuuacaugguuacauguggccgggacucacaggauuacaugguuacauguggccaggacucacaggguuaaauggucaaaauucaaugggaccaacagagcccugaggagaauggccggaagaugccuaaauaacauacccaagggcaaucuucucagugagcagaaggguggaaaagacacuggagggugggguggaggugccacagaugggcaaccuguccugaugagagccaagaugcaguuaccugcguggagugucuuggaagagcaggacacugugcuaaaaguccagcaaggcacaucgacagcaagugcugcauggaugcaggggggugaguuucggggaaaagcccaguaacaacaacaacaguagcuccuauuggucaagggccucccauguuaaaggugcauaauccccacaguaauguuaugagggagauaggaucaacccauuucacagauaaagaaacugaggcuuagaucaagguucacccccaaggcaccuaggugguuaaguggugaaggugagauuugaaucugguucacacuuugugcuguguccacucugcugagauggaacauucauguggaagcccauuauugaguccagugaccacccugacaaaauagaaguggaaggcaccagaacuccugacugccuucccuccaacuuuccuguugccugggguggcccaagaggguguggccaguccauggcagccaacuuagagguaucucuuucugggcaggagccgccacgggaccgggccuugguggaccaugagaaugucaucagcuguccccaccugggugccagcaccaaggaggcucagagccgcuguggggaggaaauugcuguucaguucguggacauggugaaggggaaaucucucacggggguuguaaguaucaccaccuggggcugggggccaggagucagagggaggagaggaaggaaggcaucuuguaggggcugguggcagcgugggugaauagauucagcccugggagcugaagauaagggaaaucugcuugagucagcacucuccggagcaggugggcgggagccucccgucuccagccuugauagcagaggccuuggcagcagagagcccggcucaggccuguuauaucguagucuugcugcagagauuguggcccuucccaggcccagccucuagagaaaggcuccuuuguucuccacaugccgugggagugaaggagugcugcuugggugccagcuggacgcagccgcagcagguggggaugugguuggggacggccauguagaaauuugcacccuguaagcuccccagacccugccuugacagccugcccuaccuacucccaaaugagcccucugugcuggcugacccccuugcuuuccccaaaucaaggcauaagacccccacuucuugucuuugcuuccaucaagcccuuccuggcaugugcgucuccuacgagcuuaaccugacuuacacuucaaguccugucucauucauucagucuguggauauuccuuaaguuucacuggguaccagacauugucauagcucuugggagacacgggugcaugagggaggcauagcucuccuuccaggggcuugcugccuccuucugaagucuugcuuggccuuuccagccccuucucaauucugagaaccauguucuuucuuguuauuaagguucaguuccaugggguguuuuuuuuuuucccuaaucuuucuacuuaaccuaaguucuaaguucccugaggacaaaaaaacaugacuuaagccucucugcagcuugugugggugggcccaggccauggagucaaagggucaggaaaaugggcuggguguucuugguuguccuggcugacccucagcugggugauuuucgcuggugaggacagcacuguggcaggagagacggggauuuugguucugcccucccaccucuggauugagagcccagcccuccaggccucucugcccccuccauccugaggaaagaagggugccuccugcugcccagcagccccacacaguccauggaagucagcagggcuaugaccagcagcaugcgaggaggucagcagagacucugaccugucugcauccucuguccucuaugcugugugggcuccucagggcagagcacacuucacucaucuugcaccuggucggccucugagcagguucguuccucccaggagaugcugcucguuucccaggcugagguuugagcucaucaccauugccagccaaucugggcuucaggguuuuacccuuucagccuucucagaaagcagcugucugccuuccccaucgcagccuugcaauuuauugccauuaccauuagguagcagugacauuccagagcuuuuccugaaagggacuccugaauauaagcucuggcagagcgagggggugggggagggagggggaccuugcagagagauggggaggagggggugagagguguaugggcucugcccugcuggguguaucugcugcaggacacagaguuccaucaaauggaccacacaguguccccaucuuaggaggugaaaccucuuggucaaaauaacuacccuuagcaaauugaacuguucacccacaucagcaaauagucuuagaguagccauuuggaaaaagagacauuuuugucacauaagaaauauauuuuccuaauucuucccugcauuuuccccaguucaauucuguucuaaccucagacacagaauaacauuagggucagguuggugucccaaagugccugacuccucccuggaauucucccaccuguccaccagggaagacugagaauccuccuuuuacuugggagcccugugauggacaccuccccgggcuugggcucugcaggcccacacagaggacagagagaugugccgaggugccugcguuaugggcccucuuaguuggacuuuccucugcugcugcaggcccucagccccggcaguggcagcauggugcuccagaucuccucccagcagcuagcugcuccaccccaccacccuucuugucugugacuccuuggagaggauccaggagccaugcagcaagaagccugcagaccugucaccucccacacuggagaggcucccgugaagcccggccucagcagucauuucccauaccaugauucuuucucuguuuaaaaaaaaaaaaauucuuccaaugauaucuuuaugaaaacagaaagagaagcaucuguguuuccuucuaauuacaucuuguagcugccuguuugauuugcaucuuucuaagaugguugacuuuacaaguuaucucaauaaaaguggccagaugccuaacucagaaccagagcauuuugaaccacaaaauggaauugaaauuuuggcccagaacaagcugguucuguuaucaggccccuggguggggcagggggcagccagccagguccuagacauaacuuuugggggauauggggcuuguguccccucagugucacaacaugccucacaguggacuucgcaugcguugauauuugaagcacgaucaucaaaacuuugugauaauugaucguaguguuuaguaacaauguaaacacuuaaaaaaauucaagauagaaaauaaaaaugaaggcaaguugggacugccagagaagacccgucacuccucauccaaguuaucugcgacucccauauguuuugugucaaagacucaccuuuauugugcuguccaaucccuuccccagugcagaaacaagucucccauggagggggcuggggcagacacaguuugcugaaaggagcaauuuugagugguuguggcauucuguguccauuucuggcuccacagcuuucuucauuuguaggaacaaguccuuguccuguuguuaguggcugauggaaguugucacccaccaggcaccaaggcaggagugacccuauacugucuuucuuguggagcugggucuuggcagccagaucuugauucaggaucugccaugccucuuccugaccacagccccgcuccuccauccucugcaggugaaugcccaggcccuuaccagugccuucucuccacacaccaagccuuggauuggucuggcagaagcucuggggacacugaugcgagccugggcugggucccccaaagggaccauccaggugauaacacagggugagcuggggaccuugcagagggagggggaggaggggaugagggagugugggaucugcccugcuggguguauuugcugcaggacacaggguuagugagaggcagugagggugccuuggacccugcccugaguauagcucccuuacuacuggugggagggugguaaagggagggguuaaaaaaagucguuggaaagauguacugaauauucauaaaucauguuuauguagcauuuuuaagaccuagauauuuugggugcaagagaaaccucuacgagagagagaguuucaugcgagaggucguaggauggcuggagggaggcccuaauuaagcaacaggaugcuggauucugguuuuuggcccugucucuucccugcugugugacucucccuucugaggcuuggauucuucacuuguaaagugagaguuaggggcagaugagccaggagcggugaggacacuuugugcucuguaacuuacuaaggugguaccuugggccgucugacagcccucgagagagaguuugcucagccguggagugggaaugagaacagugcccucugaccaccccucgggcugcugagugggcuguggccaccuuugcaguggauccaguacugugcggaugugguugagugaccaaggagggcuccaguuuccuuaacccuguagacguguaucuuuccccauggacucuugggugucucacaguugggcagagauugcagggagagggcagcuaaacccuaggcauugacaauaccagggaagggcagagccagggggucccacuggccuggguguccaagcgccgaaggaaacaaggcagggagcugggcagcaguugcuucgguuacuucuuucugcuuugauuuccugaggcuggcaaggcucugagugccaggaagggguaagaguagggaauuuuccuguguccccugggagaauaauagguaggccaggauggccaagccaggugcaggguuggggagcggaguggaguugagcugaguuuuggagaggaguuucucagggugguuaaaacauccuggguuuccuggcuugggcccagauuaugccucuucugagcccacugaagggcgaguggaccugccuggagcaagcugccuuugggguccccagggcagcgaggagcccauaguccagagcuaggugccaguggcuuccugcccccuccuguagugcucaacaaacagugaccucaugguagcuucucucuguccccaggaacaucccugaagaaugcugggaacugccuaagccccgcagucauugucggccuccugaaagaggcuuccaagcaggcggaugugaacuuggugaacgcuaagcugcuggugaaagaggcuggccucaaugugcgccccucucccccacgcugccuccccaucccugucagcacuagucuucucccccacauuuccagagcccguucucugagcggaggccuaggucccagccuugcaucggccugucuaccugugagggguagcugcaguuucuucaacugcaaaaugaagauacugccuggccccgaguguugcuaauggcacugcuuuguguaugagugcugugggaauggaggcaguagaaguguccccauuucacagccaaagaaaaugacgagcuaguguguuugacucugcccgacauggcugccaggccauguuugacucugccuaacuccccucagggcuccucaugccguagcacccggguucuugauucacuugcaagcucuaggagcccugcugccuugcacggcuucccguuggcgccuuccccucugguucccuguuuagaucaaagucuguuucaaagccuguugcucagccagugggagcuggcagaagggauaggcaguagagcugccauguccucaccccucugcuccccuccacuccugcaugccagucaugccacugaugccgugcaggaggcugugucagagcaggaggggccagaguggagucuccucacagcccugccucccugcuuuucuuuccucccuguuuuccuccaagccuucgccugugccuggcagaucucuuugcccucccuuuaaggagaucauuggcuguuccaggaagcugaugccgaagggcacacagcuuggcccauuugcccucucccuucugguccugaauuacugagcacauuauccaggcuggagcccuacauccuaccaaugggugauuuggccaagagaggaggguggacguggugcagccaggagguguaacagucaccuugccuucuccacacaggucaccaccucccacagcccugcugcaccaggggagcaaggcuucggggaaugccuccuggccguggcccuggcaggcgccccuuaccaggcugugggcuugguccaaggcacuacgccuguacugcaggggcucaauggagcugucuucaggccagaagugccucuccgcagggaccugccccugcuccuauuccggacucagaccucugacccugcaaugcugccuaccaugauuggugaggagggcccuguagggcuggcugguguccuugaggcugggguggggucugcccuggaauugaacucuacccaccuuccuuuagccccucuucaugucccagggugucucuggaucugcaccauacagagggucugaugccaguuuucagaaccuucagggaguggauacucaguucaaagagggaaagugccuuauccagggucacagagcagcauggcagggguggggccauagccucuauuccugcccagcuguggauccucagcuugccauguuagguacacuggaccagcuuguggagccauagcccaggagcucagggacauugagugcagguuucuuacuccuaccugcuggcccuguggcugucccugguggccagcccagcugcagcaaaaccuacaaagccuccagccaugguaggcgucuuggaccugccccagucagcuggggcuugggcugcuagggguuuuggcacacguccauguuuggcggagggugugccuucaaacccugaagggccuaauuucaccauucuuucuggcugcccaagggaacuucccugcuuuucucccuugcuguuggcuggauaaaacuggcaaucagaaagucaagagcuacagcugauggucaugguguucccagagagucaggaauauccauggaagcugagcagaugcccuguugcucucccaucucagcucuuugauucugagaccaucauccgcucauugcaccuuugaucacaaaagcuuugaacuucugauucugcucccaaucccucgcuccuuuuuccccuauccccugugccaaccaggaguuucuucuauuuccaggccuccuggcagaggcaggcgugcggcugcuguccuaccagacuucacuggugucagauggggagaccuggcacgucaugggcaucuccuccuugcugcccagccuggaagcguggaagcagcaugugacugaagccuuccaguuccacuucuaaccuuggagcucacuggucccugccucuggggcuuuucugaagaaacccacccacugugaucaauagggagagaaaauccacauucuugggcugaacgcgggccucug

SEQ ID NO: 18384 - RNA, 18335 nt, Homo sapiens
uugugucucaaaagaagaaaugaauaagucugauuuauauaauaaacuguacaaugaugaaaauaaucuacaucugccaacacggauaaaucucaaaaacaauauugaguuaaaagucaguuguaaaaugauguguacaauauuccuauaaaauguuaagauauaaaacaauacuuaaaagccuaugaacaaauaugacagcaagacuauaggaacacuaaaaauacaaacaauucaacacugauuuuaggauaaugauugacuuuggggaugaagggaagguaaggaucaaagcuagaucagagugucagaccagaaugaucuuuaaggcaaaaguaaaguacucaauggucuagagcaggaguuggcaaacuuuuuugguaaagaccagaaaguaaauauuuuaggauuguaggccaagaggcaaacucaagaauauaauguagguacuuuacuggaguucaaaguuagugcuucuaucauuaaaauugauuucaaauguuugcuuuuuuuuuuuuuuuucaacuauuuaaaaacguaaaaacuauucuuagguugaagaccauccagaagcagguggugugcuagauuuggcccauaguccaacuguacuuucugugaugauggaaauguucaauauuuccucaauugucuaauaugguaaccacuagccacauauggcuacugaucauuugaaaggugguuacauggacugagaaacuguuuuuuuuuuuuuuuugagauggagucucgcucugucacccaggcuggagugcaguggcaccaucucggcucacugcaagcuccgccucccggguucacgccguucuccugccucagccucccaaguagcugggacuacaggcgccuggcuaauuuuuucuauuuuuaguagagacgggguuucaccguauuagccaggauggucucgaucuccuugaccucucgugaucugcccgccuuggccucccaaagugcugggauuacagguguuaguaguuucucgugccuggcugagaaacugacuuuuuaauggucuguagucuuaguuuaagauagcuacucuaguguuuccaugaaauuaaagaauaaguaugaagggaguaguaagaaaaaaaaaacuuaaaaauuaagagacugugauggaagacuaggguguaugaaucagugauguggcggauagaaaaauuugggaugaugaaaaggauuuuggcucugacugacauagaauacagaaagauagggagauaacagccaagaaaaucugagauaucaggauuagaacagucccucaauaaaauuauaauuuguuaaucaugaacugggagauuacacagagauaaguugggagagagaaguguuagguugaaaguauggaggggaagcugagaguuuuauagcaaugacuacugaaaauacuaaggauuaacucaccuagaacaccccccccucaaaaaagagaauaccaaggggaggggagaggaaauguccaaggaugagaauagugaagacagagagauacucuauuuuugauauuuaaagaauagaaggaaagcaaucacuaucuuauacaaacuuuauugcucuuuaaaaaugaauaaccuacaaaguucuaaaauuuaaagagguauauacaaguauagacaucaaacuuucuaaacugaacuaauucgcuuucauugguuggucaaaaauaugcaaaaacccuaaauauucacacauuuaaucucugagauuucugacuaaauaaggagcuacccugaaaguacaugacauuuguaauuuuauggagacaucacucugaacauacaauuagagcuugggguucacaauuagucacuuaucuugucccugagccuaaaaaagaaucaauuucucuagucauuuucccauacauauuuuaucugaaaaauuaaauauaacagugguauaaggaauucauaaacaacuuaggguguacccuacuguaaaugucaaauauuuauuuuacucgaauacuacacagaguuucaaaagauccacaauaauuuauuuuacucaaauauuguacuaaagaguuucaaaagauccucuuagaaaaucauucacuuuaguauccccuacuuaagggaaaaauagagaugccagaagcuuauaauuaaaagaucuuauuugaguaaucauuauucauuucuacaauguuuguauaagauacauuuugggcugggcacaguggcucaguaaucccagcacuuugggaggccgaggugggcagaucaccugagguugggaguuugagagcaaccugaccaacauggagaaacccugucucuacuaaaaauacaaaauuagccgggcguaguggcacaugccuguagucccagcuacucgggagucugaggcaggagaaucgcuugaaccugggaggcggagguugcgguaagcugagaucgugccauugcacuccagccugggcaacaagaaugaaauuccgccuccaaaaaaaaaaaaagauauauuucgacuaaaauuaagagguuuaggcagcauaagaaaucgauaugaugauaaugcuuaagcucaguuauuuauauucaaaagaaaaaauaaauuaaauuuauuaaaguuuuaauacaaagcaucccauuugaaguauaguucugaagaaauguuuaugagcuaggguccugucaagagaauauucuauggcaauggcucacucuguuuguguacucuuacagauccucuccugaagcaacagaaagagguguagauugaauuuaaacaauauccaacaaaaccuucauuguauuuguuucauacuuuuuuuagaacgucucaaauccuuuuucugcuugaaaauaggagaauucaaaaaacacaaaucuguaaaaggguccccucuucucaguuuccuguaagaguaaaaagagaucucaggcauaauguaagcaucccaauauuaacuuacucuucccuaccaaguuaugguaaaacacaccaauuuuaaauguucucacuucaguuuuuuuaaaucaaauguuuauauuucagaaaaaacucauucuugaacaaagcuccauaaccuuauuccccccgacauguaucauuaaaaauaaguucccacaaaccaaauacuuacgaagcgagggugggcuccuuauaguucacgcuggcugugcaccuacguuuaggcagagccacugcugggcuugcuuuauucuuuuuuggagaaagagaaagucuucugauuuucacaacaggauacaaggagacauuggugauauccuucaggcuaagaugaggugacugcugaguuucaggugguguagcuacaaaacaauuuuuacugaauaugauuuaaaaaaaaaaacccacacaaaaacuuaaauuguacucaauuguauauaucuuaacuguacacaaaauccagcauuuaauaauagaauuuuuuuuuagaugggcucucacuguguugcccaggcugaagugcaguggugugaucucagcucacugcaaccucugccuccuggucucaagcaauccucccacuucagucuuccaaguagcugggacuacagguaugcaccaccaugcccagccaauaauaaauucuuuuuuuagcuuuuucaucauuuuuuccucuuccuuucaaaccagacaguguugaaauauuaauuauaacagaacacuuuacuaaaacuuaaaauucuucuaggauagcuugggcauaauaacuuuguuuaaccauggaauuucauuuuagucauaccuugcuauuuggaaucaaguccucucucuuucaauaccaagguuuauuaucaagucucuuccuauagucuuauaaagccgcuaaaacuccuucuauuaaauaaaugagaauucuaaauaacagccucuguguacaccaggagaaaagcuagcauguaaaaaaguuacucaguguuuuucccaucauaaacauccaaguuauuauacuuugaaguuacaccuauauugggaggcaaauguccaacacauaguaaagacacugcaaaacaaucuccucaaauagcuuuaaaaagcaaacuguauccccaaaaaaguaaaaacuauaacugugaaaugauuguauacuaagagccauaugcuccaguguuaucuggguuuuauagucuguccuuuuuguucccacauaaauauacuguacuguauuaauuauuccaacuuucaguuugagaaauauguuguuuggaacaauaucagaucaguugcuauauucuggaaaaaugcuucucaaacuuuaauguguauaugaauccacaggaggacuucuuaauggccaggcacgguggcucacgccaguaaucccagcacuuagggaggccgaggugggcggaucaccugagguuggcaguuugaggccagccuaacuaacauggagaaagccugucucuacuaaaaauacaaaauuagcugggcgugguggcacaugccuguaaucccagcuacucgggagucugaggcaggagaaucgcuugaacccaggaggcggagguugggaugagcugagaucgugccacugcacuguagccugggcaacaagagugaaacucuguuucaaaaaaaaaaaaaaaaaaaagaugcagauucugacuccacgguaugggguauggccugagauucugcauuucuuaaaagacgucuagggauuaaacucugaguaauaccauuuuagaguauauuuuuuucguuuaaaaacguauuuuuuauguauuuuauguauuuuuauggauacaggcucacacaucuguaaucccagcacuuuguaaggccaaggcaggaggacugcuuuagcccaggaauuugagaccacccuggcaacacagugagaccucaucuucacaaaaaguaaaaaaaaaaaaaaaaaaaaaaaauuagccaggugugauggcgcaugccuguagucccaaguacuggggaggcugagguggaagaaucacuugagccugggagguugagacugcagugagccaugacagugccacugcccuccagccgaggugauagagcaagacccugucucaauuaaaaagugaacaacaacaaaaaaaucccaacuuuuucuggacauuuuuaaauguacacaaagauggcaauaacaguauaauaaacucugaguuacccagguccaauaauuaucaacacuuugacaaucauguuugauuuauucuaacaucauuauagcauuuuugcuuuuuuuuuuuuugagacugaguuucgcucuuguugccuaggcuggagcgcaauggcauggucucggcucacugcaaccucuguuuccuggguacaagcaauucuuuuucuccugccucagccucccgaguagcugggauuaccggcacauaccaccaggccuggcucauuuuuuuguauuuuuaguagagaugggguuucaccauguuggccaggcuggucuuggacuccugaccucaggugauccgcccaccucagccucccaaagugcugggauuacaggcgugagccaacccgcccggcuuacagcauauuuuuaaaaaagauacuugccugcuaccacugacuaacuggccgauuuagaaaguugguuugguuuuuaagguuuuaaucuccuuacaaacaaaauaagcaucauaacaccuauacuucacagaauuguucugaggaucaaauaaaaugaugugacaauauuuugaaaaugauacaacuugacuauaaauguuaguuuuacuuguauuaacuaaaauugccaaaugagaaucuuuguggacagguguagguuguauuacgaacauuugaacuaugccuacuuuugaucuaauaaaauauuuucugagccaguuuuuagagaugucguacaaaagaauacuaagccuaucaauugaggaaaucuucacuaacuagaagauuauuuuaaaucacgguuccugucaaauuuaauauaaaacaaggccauuaaaauaacaagucacuggauucaaauuugauuucacuuucaaggggauacuucaguuaaguguauaaaagcuacuucaauucaaccuaagucuacaaaaaagucccucuguccccuugggaguccuaauuuacugaaaauaaaaauucugucuccauaacaagcaaucucugaauuaggucagagcaauacaacugugauuuccacacccagccccccacuguuuaaucagaccauaacuuccaccaaagagagacagaugguaagucuccaaccuccaccagagaaacagaugguaaguauaguauauaagcaucaggagugaucauuuaucacgaacauuaaaaauacagguaaacaaguagaucacuuacugguaggaguuuuuguuggcuuagaacccuccgucucuuuuucaucuguguauuucagugcucuuuuagcuagaggccuggugacuggucuaucugaauugcucgugggauucugaauguacuugcaagugggcaaauagaggucaucggaaucaucuccugaaccacuugauucacagaggcucacuucagacucguuguuuucuucucuauuagagucauugcucacuuuuugucggaaaggaguaagaugaacacccucuuccaaauuaaaauuguaagcaucauuggaacugacagauuugugcauuuuuuuuuggggaacaguuuuuuuauuuucgcuuuuauucucuuuauauuuugacauacguuuugauuuucuccuguuagcuuuucuuuucucuucucuuuuucuuucuuguguaucucuuugcuuacuuuuaguuuguucagauuuagauucuaaaaugucuucuuuuguuuuaguaaacguuccuggcugaaucagcuuuggugauaaguuaacuugguccuugcuccauugacaagcauuguguuguacauuuucagguaugugcauguuuacuagugggucuaaaaauccaacucuuucgaauucaaaagacuucccugccaaaugacugguuucaaaaucauccaagcuaucaaacugacauauacuguuacaauguuucuuuaaacugcuacgaacagauacaguucuagguaagacauuaucaguagacuuagcuucaccugaaucaaaaucaacucccagugugucuugaggaauaguagguaucugaucugagaauuuaaaaaauaaaugagaaaaguaguuuuacuuuguggaaauuugaauuucaagaacuuuagaauucaaacuaaaaaagugaaugaccaaaaggucauucuguaguuuuccuacauuauaaaaucuguaaauaaaaaccugggaacuuaaauauuaccaucuauuuacuugucagugaucaacugauggcuuauaucugacaugugaaagaaucuuguacagguucaguaucccuaaucugaaaaucugaaauccaaaacuuuuuuagugcagucaugaugcuccaaggaaaugcuaacuggaggguuuuggauuucagauuuucaaauuagggaugaugaacugauauaauguaaauacuccaaaauuuaaaaaauaaauccaaaacacuucuggucccaagcauuuuggauaagggacauucaaucuuuauaaucuuuaaaaacauuauaggccaggcacgguggcuuacgcuuguaaucccagcacuuugggaggccgaggcgggcagaucacgaggucaggagaucgagaccauccuggcuaacacagugaaaccccgucucuacuaaaaaaaauacaaaaaauuagccaggcgugguggugggugccuguagucccaacuacucgggagacugaggcaggagaauggcgugaacccaggaggcagagcuuguagugagcugagaucgcaccacugcucuccaagccugggcgacagagcaagacugucaaaaaaaaaaaaaauuauaacaggcuuuuaugugcucuugguuuaaagaaaaugaauagucuauauguaucauugaguacagauucagagaaguagaaccgcauauuccaaagugggacaaaugagaaagugggagcuaaguuguucuuugaaaaauaaauaagauuugaauaacuagaaagcuucucagguaagaaauauaauuuguauuuuaaggaaaaguggggcuaugucugguuuugcuuauucaaauacuauccuuccuucgacgucugguuuugcuuauucaaauacuauccuuucuucaaugcuugguucaaguggaggagauugacacuugagaacauggacauaucaauuuaaaaguaguaagaaagggauggcuuuggaguucaacuuugauuuuaaaugcuagcuguuaacaucuagacuucuucaugugagauauuuuaccuucuugaguuccuauaaaacaggacuaacuguacuuauaguccuagguuguugugaggguuaggugagauuaugcacauaaaaugccuaacauagagcuugacacguaguagcaaucaguaaauugcugccauaguuauagccaaagauucagauuacagauuugacacaauaaauauauuuuaacacucuauuacucuguguaaaauaaacagauuugcuuugagcagaauaccagaugaacaaauuuaaaaaguuaaaaaaaaagaauuagauaaauuuaauuguauuauuuguucucaaagaccuuauuuugcccuuaauaauauuuuuagauuuucacuugaauuaccuucuauuugaaaugauucuccuuguccuggaaguucaguuucuucaagaggaauuugccuuagaaaauaccaaugaaaaacagaaauuuaacaauuauguaauaaaaacaaauucaguauuuuccuaaauuauaauuuuucuuuccuuuaguaucauuucauaauucgauuucaaaucaauacaucuauucuguaucaaaggaaaccaaaggacacuuaugcugauuacagggagacugauuuguuaugacugacauucaauucccacuugaagaaccaaccuaucaaguuggagaguuccaccugaaaacacauuauauaacucaauuuaacuacggaaacagcccaugagaauuaauuuguuaaauguuuuuuaaaaaauguaguuugaucacucaacucuuuaggagccugcuuuaucauuagcagagcugugauuuguugguaauauaugcuuuuauggugcuuaacuauugaacucuucugaaguuaacauuguucauuuucuuuacaaauguuguucuuugguucaugaaacaugaaguguucuuuauacucuaacacuauuacuggcaguuucauucuaauuguaauuuuauucuuuauucucuguagagaauuuucuacucuagacauuaaacagauuuagguaaguaauggcugugguaaauaauaacuacuuuagaaaucuucuacaaauucaauuaccuuaucuuaccuuuugcccacaacagaucuuaaaguacaacaguuuaaaaacuacuaaugauuaaaaguaaucuauggugauagaaaucaucuuagugguuacuucuguggagaaggggauggacuugauaggcauacgaaagaacugucuauggcaguaguucucauccaagggcaauuaugcucuccagggaacaugccacaauaucugaagucauuuuuuguucuccugaugauguuacugggauucacuggguggaggcuauggaugcugcuaaacaucccaucaugcacagacagcucucuacaacaaagaauuaucuggcccacaauguuaacagugaaaacacuaugucuucauugaaauuuuaguuccacgauauauacauuagucaaacucaucaaauuguaacugugaucugugcauuuuacuguuuauaauuaaaucuuaauaauucauaaacaaacaaaguacauuugauccaagagaaggggaggaggguauaugggaucuagaaaaaugaacuggaucagcgagacaaugggacaacuguguuaaauaugauauuuuauuuauuuauuuauuuauuuauuuucugaaccagacuauucagagggcuggcaaaacaucucauuucaauagcuaauccuucuuagaauaaaaacaugguacacagaaaaguaugacugaaggaaaguaugaaguagaauuaaaaacugugguaaggcuucuuuuuccuaggcaucaaaaaaggagugaaauauaagaaaaagaaggguuuagcuuggcuauauguaauagaauuucaacacaucaaauucucuuaaauauauucucaguagagaaagcaacagacuacaaauauaagaguugacaugaugcacauuuccuuucauaaaugaaucacagaauuaaaccuuucuuaguauuaauaaucaugauaaagaauuugauacuaacgguaaauccuucacaaauaaauuucuggagcugucaucacuauugggguccauuccagaggaacauauuuccugguucuguuaauguauuaaaacaaaacacuguuauaacugaaguauucacaagaaagcauuaauuuauucaacaauaugcacuuguugacagucuaucauggugccaugccaugguucuaggaacugagacuauaacagcucaaaagcagaguaagucuuauccuuuuaaagcuuacauucuagugcagggaaguaaaauuuuaaaaagagaagauauauguacaaaauuucagauugcgauaaaugucaugaaggaaauacccagugugaggugauagagaguaacucagguuggauugcucuuuuaaauacagugaaugugauauaaaucagaagacugcaaaggagcuagccacugaaagaacaggaggaaaagaaggcaguggaaacagcaaauacacauaagaaaaaucuugcuguguuuaggaaagaaagguuguuguggcuggaacauagucacugagaacaguaggagauguacaugcaggggccacauaauguagggccuugagagccaugaguuuagauuuuagucuaaguaugaugggaagguacuuaauauuaagaaaggaaguaaacugauuuaaguuuuugaaagaucagucugaauugaaagaggccggggguagaaagagcugagaggucaucauugcauaucuggcaagauaugauaucagcuaagauuagagucauggcuauggaggugaagcccaguggaaggccuugagaugacaggucaagcucaaggacugaaaagggauggagaugggaacaaugagggagaggaaagccucuugugguuuuggccuaagcaaacauguaggcuacuuuacugaguaagacuuauaaaggaagguaggaaguauacagcaucugugggggagacaaggggaaguugugcuuuauauaagguauguuugagaucccuuauaaaucuuuaaguggagauagcaaaugguggcuguggguauauguguguauguguuuguuuuuagauuuuguacuauuaacuggggaggcaucagcagacagacaguacauaaagcuaugagaggguauaagaugagucuacaacaacuggcauucauucauuuuuuugaaauaaagucuugcuuugucacccaagcugaaguguaguggugcuaucauagcucacugcagccuugaacuccugggcacaagcaauccuccuaccucagccucccaaguagcugggacuacaggugcaugccaccacaacuggcuaauuuuuauuuuuuauuuuguagagaugggagucuugcuguguugcccaggcuggucuugaacuccugggcucaagcgauccucucaccucagccucccaaagugcucugauuacagccacgagucaaugugccuggccaauaaaaugccugacauuuacagguagaaugaggaagaaaucagcaaaagagaccgacauggaacagucagaaagguagaaugaaaagcaggggagcaugauaucaugaaaacuaagagaucaaaguaugucaaguaaagaguggucccuguuuugcauauuauuacugcaaggucaagaagaaagagaagugaccacugaauuugguaacauggagguuuuggugaccuugacaugcagugacaacagaaugguaaggauaaaaucuagauucagaguggcugcaggccaggcgugguaccucaugccuguaauccuagcauuuagggaggccgaggcagggguaucacuugaacccaggaggucaagaccaaccugggcaacauagugagauggucuccacaaaaaaguuuuaaaaaauuagcugggcguggugguguuccagcuauucaggagacugaggugggaggaucacuugagccugggaggucaagccugcaguaagccaugauaugccacugcacuucagucuaggcaauggagcgagacucugucucaaaggaaaaaaaagagucguuucaaaugugaauggaagcugaggaagugaagaauauacuguuuucuuuuaaaaaguucugcugugaagggaagcaaagaaaugaggagauaaagaaauaugagaccaggagagguuucauuacuuuuucucuaagguugagagauacgaaagcacaucuuuaugaugacugaaaugauccaguggagagggggauauauagaagagagaacaauauuccaggaauaaaguuguagaggaggugagaagagaaaauuggaugcaugggcuggggaguggcugggguuggugcuugccuuuaguaggaacaggggccauucugccacuguaacaagagggaagaugaagaaccuaaguauagagguggauuugcagaucucuguuaugaagaugacaauucucacucaauuccuaagaagccaauucuaauuuaauuaucuuuugaaauuugaugaacauaugcugacauuauaauaaauaagcuaaaaauguucauuaaaaacaaaacaacuagaaauuuaauccuguuaaaagcuuuaggccagguguggcggcuucugccuguaaucccagcacauugggaggccaaggccagaggauugcuugauaccaggagcucaagaccagcuugggaaacauggcaagauccugucucuacccccaacaaaaaaauuagacagguguggcagugcaugccuauagucccaccuauucaggaggcugagaugggaagauugccugagccugggaggugaaggcugagugugcuugagccugggaggugaaggcugcagagagcugugaucacaccacugcaccccaggcuggguaagagcgagacucuguccacccccaaccuacccuggccaaagaugaaacuuuaaauuugacaugaauauagcuaauguucugaaacuaauauuaaugcagguaaauaaaaaagaacauuuaacuauauacuaauauaacuuaaaaacaagucauugaaaaaucuacuauaaaauuagggaacaaaaggcuguuaaaaauuaccuaaacguuaacuauugcuagggcuaggcaagaaaacauucuuguaaaauucuuacauuuuaagcuucuccaccacugcuaaauugauuugauaagcacugaagcacggguguacaaugagguugagaaugagugacacaagcaauuaguacauagcagaaaauagaaacaaugaccuucuaaaugcuaagaauauauuugcguagcaacuaacaauguuuuuaauaaauacucaaaaacuauugagcugcaguaauagaauuuuuucccaacugcuuuuguaauuaucucauugaguauuugcuuccuacuauuucuguuuuucagcaaaaacuuuguaaagggaggaggaagauucaaaugccuuuagaggaacuguuucccccuacuaguugacugaacaaggaaaauacaaaauuagaaaagauuacauucuggaaaagaaaaagaaaaaguaaucuaccacgccuggcacaguggcucaugccuguaaucccagcacuuggggaggcugaggugggugggucacuugaggccaggaguucgagacaccugaacaacauggcgaaacccugucucuacuaaaaauauaaaaauuagccaggugugguggcgcaugccuguaaucccagcuacucgggaggcugaggcacgagaaucacuugaacccaggaggcaggggcuccagugagcugagauugcaccacuguacuccacccugggugacagagcaagacucugucucaagaaaaaaaaaagaaaaaaaaacauaaaguucccgugaagaaaacauaucuaaucuuuauagaggcaguucucaaauauaccauauauguacuuauugucuauguguguauauauguauauauuacauguaucuuaaucacauggagaaaaaaaaauaaggaaucaaaagggaagcaagaacucuuucacugacuucuccugucaauggagaagugauguuaauuucauucucaaguaccugcccaccuccucccaccccccauaucccuccccuaaucacaauguucucgcuuucuuaucugaccuuccggccuaagugccaacucaacuguuuucacuggcauagcgaagcaauggccacugggaagaaauucaacuugcuguacaccugacaccacugcuuuuuuuuucucugccccauuuccuuggcaguggcuacuggaaaaagggaaaaauaaacuagcucaucauuacuuuuuucguaaguaaugauacacauuacuguguacagugauacacaaugguauagccagacacaaagaauauccuaaagcaaacuuucuccauaucuguuauauuuuggcuagcaggaccauauuugaacaccuucuuuacaaucuuagacacaaagagaaucagauuaaaaauuugaggccgggcgcgguggcucacaccuguaaucccagcacuuugggaggucgacaugggcggaucacgaggucaggagaucgagaccauccuggcuaacacggugaaaccccgucucuacuaaaaauacaaaaaauuagccaggcgugguggcgggugccuguagucccagcuacuccagaggcugaggcaggagaauggcgugaacccaggaggccgagcuugcagugagccgagaucgcgccacugcacucuagccugggcgacugagggagacgccgucucaaaaaaaaaaaaauauuugagcagcaaauguuuaugaucuuacuugucugggaguuaauagucuucucuacuuagccaacaaguagguaaaaaugguucuccaaaaagcacuuaaauacucccuauguccuaaauaaagguaguucuuauaaaaccccacuggauaaagcaaaaugacauagcaaaacaaaaggcuagguaaaagcuaagauagcauugauuaaaacuuuuggauaaguccacuucaacuaccacuuuuacaucuuuagcuuaguugcacuaucuuugacucacuuaguugaacauucaaauggaccagcaaugcaaaaggcuaaacuauuucuucuggauccuguuuugcuaccugcuuuaagaaugaaacaggcaggaacaggccucaaucaccuauaugcuugaagcuuucuuaaauggccaaaugcaauagcuaugcuggagcacuaaagaaggauguuuuaaacaauucaugcauaacugagcuaucaguaauucauuuaaauaacauaauugaucuaaacuacuuauucauggcuuaacuaaacuaagaaauucggccuuaguaaugaaaauaccugagcagguucuacuguuuguugugauguaaguuuuccuuucaaugcauauagcugacaugugagauaguaacauucuuuucucagcuguaggaugauaucuugggcuucuuucacuuuggauuuuucauuuuccaaagcuaaaacuaacauuuuguuguugucuugguaauuuuucagcaguguagaaguguuggcuaaaagaggauaaaaaaauuuaucaguuauuaaaucuaaacuuaaaagugauauaaaaggacaacauaaaaaucucuuacugauuauuuggcauggugcagcuauaaaagaccugcguuugccaaucucugccaaguuuuuauuccuuuucucuuucauucgcuucuuuaugucuucaagacuaucuugaaaggacuuuuucaggcaucuuuccuuggccaucuuuugccuaaacaauaaaaaauauuuuuucucagagagaauauuaucaaauauaaaacuuaaaaaacauaggcuguucauaaagaaugcauuaaauagacuaaacuguagaauuagcucaaaguagauaguuaaccaacuugauaauauaaauuuuccccuuuuaaaaucucauucauauuucugauauucucucuuccuccucaggcacuuuauagaaaagguuuauugaauauagauuuccaacccaaagauuccacaauaugccacuuauucauucuuuaacaaauacucacugugggguauaugccagacacuauugaaaaugcuuauuauuauauuuugaugcauuauuuacacuuuuuauagaaaauguuuaggaccaacuuuuacugcuuaagcuuacagcauuaguucugaggcaauuauauauuuggguuuuguuuuccagcucuucucuaaugauuaauucaucagauuaggucauucaacuauuuuuccauacucuuuaaacgcaauuaucacuuaugauaugcacacagucucaagaaagucaagguacuccuuagagguuuaaacuauguagcacuacauacaauuuuaauaggcuauuguaacaaguacagagcuagagcaggaacuugggcagaggaacacucuaguauucucaaacuguggcuaaaaguuagggcuguuaacucccaguaaauuaugaacauaacaaaucagacauuaaauauuguuguacauacaguuaaacguugaguauuaaauacauaacuauacuuaaucuuucaacguugcaaaucagguaggcuuuagcaugcuacuaaacaugucaaaccacuuuucacaaacaucuuuuacgcuagauugcacuuugcagaucuuaaaauugcaaaaaaaaaagacuuguuuccaauaacaaucuaugcacagaauuuucacuacaaaggauaucuucaucuccucuacgauagucaaauauuuuccuaaaccuuacacuuaaucuugaguauuuccuccaggccuuauuuuccucuaugcagugucuggaaucuuaaauauagguauuguagauaccacuuaagaacuuucuuucuaccaagguauauacaauauguacugggagguuccuagcagagauaggguagcuauuuuuaaaagcacgaacgguaaagggguuguuuuacacaauuaaguuagaauuggagauguuugagagucauacagauuaaguaacggaucuaguuuaguuaagguauuuuaaaggcaaagccuuaccuaaaaagcuuucguuauuacuuuuaaucaaguuaaaaaucacaaaagaaacuugccauaucaaaaguuuuauauccugucuaaauaaggcgaugguuauuagcagggggugugguagacagaagggaugaaagcaaagacagaccacagcgcgagaugacggucucaaucuguacaguacucguguaagcgcucuggauuuaaagaaccuagcauauuugaucuccguccauaauucuccaauuaguccugcugcgaagacagccagguaggauacuagucagugccggccucuccaggguaagugaggaagagaauggccuggacaaggaggacgucaacgguaucacgcugcacaaagaacugcugucaauuuucuuguguccuuacguugagccaggcuuuuagcuauuguaaaagcuuuauuugcacaucacuuaaucuacacaauuuugcaaaguaggaaauuagggucuccauggaagccggaacaucugaaagcgcagaucgaguggcugaacggcgaaaagcgcggcgagugggacuccacggcccgagcuuucggccaccgaauuuagaaugauacugaaaaccgaagggaagucaaacagggaucacuacgcccuuguuucgcaccuuaaaaccuacuucuuccucuuucagggacuccaggaaggccggggggagguggggcuggcggaaguggacgcggcgacccuccugccgcaggcgcguccagaacgauaccuuggccacuacuucugcaacagcuaucuuccuccuccucacauuucaaggcucuucgaagcucuccagccacggcuagccccgcgcacugggcccuccaggaccguaccaccguccgccgucgccuggaacuaccgccgccacauucgaaauuuuccgccucgcuccuccauugguuggcugggaggcggucacgug

SEQ ID NO: 18385 - RNA, 633 nt, Homo sapiens
acauugugugcuuuuaauaguucaacacugguaauguuugauaaucaagaguaaauuaauaggcuaacauuuagaaauguauacuuuaauaaguauaaaguauauaaacaauuagguaagcuuguggagaaguugaccaagauacauaaauuagaaaauacaaguguccaucuaaauuuucuauauuucauuuuuuucauaauauuuauuaaaggcguuuaauguauaguuucucaucugccauuuugggaguccuuuauuguaaagacaauucuauuguuugaugacaaacagcaaccaccaugguuauucaggaccuccacauuggauaaauucaauuucuucuugagacacaaguuugcuucuguauuucugagguaauguuuuuauuauuucugcagugucugguggacccugauacauuagcaaaucuggugauguaucccuuagaauguugugaaauuacagaagagugagaugguagcccugcugaucucaaagcuucugauacauuggguuuaggauugucucuucugucaggaaaccuuauuaauggagugugugguuugacuaccugaacgacccuacuggcagacgccaucuugcugccaaucgucaccccugagaaggggc

SEQ ID NO: 18386 - RNA, 793 nt, Homo sapiens
agugggagacaagccaauuugggagcagauaggauccagcuucauuccacauuacuaccaguuauuugauaacgauagaccccaacuaggcgcaauuuacauugacgcaucaugccuuacgugggaaggacaacaguuccaggggaaagcugccauuguggagaaguugucuagccuucgguuccagaaaauccagcacagcaucaccgcgcaggaccaucagcucacgccgcauagcugcaucaucagcaugguugugggccagcuuaaggcggaugaagaccgccaucaugggguuccaccagauguuccuauuaaagaacaucaacaauacuuggguuugcaccaaugacauguucaggcucgcccugcacaacuuuggcugaccucucagcaggcacucaugcuguuucuugcucccuccucuccccagugcuauucccacuccuccagaugcuccaaauaucaugcacaaaugagcagggccguggcgggagugggugcagugcgcugcugccgccgagguguugugcaugauguuuggacgcuagacuaguugcaucugacgggagaaguuuguauuguaccagcgcaugccuuggaaagacuuaaguaaugcaaaagauuguccuuuuuuuucuuuuaaucuacugacaaguugcucuagcaacccaaagaagugaagagaaagaagcugccucaccgcccagacauugauuuguucagauguuucaaugccucaugauacaauaaaaccacaacaucuuccuaaaauaaaaaauaauaaaaauaa

SEQ ID NO: 18387 - RNA, 1415 nt, Homo sapiens
aauggcuucaagacaaccagaagugccugcucuugaggcuagugggccucuaggcaagaugucccugcccuucaggauauaccgccgggcacucagcuaugaugauacccucaaggacccugcacccaugacuccuccuccaucagacaugggcagcaucccuuggaagccagugauuucagagcacaaguaucagcaccucaccaagguggaggaaggagaggccagucuacccuccccugccagucccugucaucggccauugacaguguggacaagcucccaguggugaaggcuaaagcuacccaugucgucaugaauuaugugaucacaaaacagacccaggaaagcuuucagcauuuugggcaacaggcagggcugagagauccuggcuacacacccacaagggugucaccacucagaagaccaaguaccuuagaguagcagaagcacuccacaaacuaaagcugcagaguggagagauaacaaaagaagagaggccaccugcaucagcccuguccaccccaagcaccacuucucacuuuucaccuaagcagagacccaggggcugguucacuucugguucuuccacagccuuaccuggcccaaauccuagcaccauggacucuggaaguggggauaaggacagaaacuugucagauaaguggggccucuuuggacugagaucccuucagaaguaugauucuggaaguuuugccacccaggccuaccgaggagcccagaagcccucuccaauggaacugauccgugcccaggccaaccgaauggcugaagauccagcagccuugaagccacccaagauggacuucccagugacggaagggaggaaacagccaccacgggcacauaaucucaaaccccgugacuugaaugugcucacacccacuggcuucuagagcccuuucuuuccagggauucugguaaagaagguuucuugcacuccacugcccuuuuaucuuggcuuugacauaggaaagguauauuuaaaaacuuaaucagcugggcacaguggcucacgccuguaaucccaacacuuugggaggccaaguuagguggaucaccugaggucaggaguuaaagaccagccuggccaacacaaugaaacccugucucuacuaaaaauacaaaaauuagccgggcaugguggugggugccuauagucccagcuacuugggaggcugaggcaggagaauugccugaacccaagaggcagagguugcagugagccgagaucacgccauuacacuccagccugggcgacagagugagacuccgucucuaaauaaauaaauaaauaaaguaaaaaaccuguuaaauugaggcuagagcuggagauacaauugguuuuugagaaauauugauacaaagcuugccccuguuguguggaagaagcc

SEQ ID NO: 18388 - RNA, 2538 nt, Homo sapiens
ggcggcggcgagagcaggaggaggagcugcggcgccugcgggagcaggagaaggaggagaaggagcggaggcgcgagcgggccgaccgcggggaggcugagcggggcagcggcggcagcagcggggacgagcucagggaggacgaugagcccgucaagaagcggggacgcaagggccggggccggggucccccguccuccucugacuccgagcccgaggccgagcuggagagagaggugagccgggagggcgccgggagucccugccuucacuccacacguuuauggagcaucuacuagguaggaggcaguaucccagguuccgggacccaucaagaaagcagugcgugggcccagaaacuccugcccuggaggaggggacauucaugggagggagggggccgggcuugguggcucacgccuguuaucccagcacuuugggcagcugaagugggacgauuacuugaguccagcucgagaccagccugggcaagauagagagacccugucucuauaaaaaccuuaaaaaauuagcugggcgugguggugugcgccuguauagucccggcugcucaggaggcugaggcaggaggauugcuugagcccaggaguuggaggcugcagugagcugucaucaauccacugcacuccagccugggccacacagcaagacccugucucaaaacaaaacaaaggagggaggagcuguacagaugacaugaggguagugcgugcuguccggaguuuucggugcuaaggagaagaguaaaguggggugggggguuucucuuuuaaauagaguagacccugaaggugugaguagacuccaaaggcuugcguuuggguuuaaguaaaaggcuccgaaugggcugggcgcaguggcucacgccuguaaucccagcacucugggaggccaaggcggguggaucacgaggugaggagaucaagaccagccuggcuaacacggugaaacccugucucuacuaaaaauacaaaaaaauuagccaggcguuguggcaggugccuguagucccagcuacucaggaggcugaggcaggagaauggugugaaccugggaggcagagguugcagcgagccaagauugugccacugcacuccagccugggccagagcgagacuccaucucaaaaaaaaaaaaaaaaaaaaaaaauaggcuccgaaugaagggaggggaucuacgaagacuccugggaggggauacauucuaggcaggagaagcagcucacacacaggcccagaggacugcgccuggcgugcuggaggaacagcgagguggccucuggggcuggaguggagggaggaggggagagagggaaaaggagggcgguggggaacggacagagcaggccggguagggccaugugggcugcagggaggauuugggcuuugacccugagggaggugggagccauggagggcacuggacaggguagggacaggcccucacucgggugcucucgggugcccucuggcugccaugggguacagcuugcaggugagcgugggagcagguaggaggccuccuaggguggugacugucaggacucuccuauaccacguguggugcugcgggcccugucacgcccucuacccuuguggagauucaggcaauguggccugaauccagagucucaccuagacugagugccuggggcccacgugcuggugccccucagccaggccugccuucuuuggggaaagcacgaacagcgccguguucucucucugucacucccuucaucacagaaagggcaccgaacuccuggugcaggaggcguuucagccacagcccaggacugcugggcaggaggagugaagggggcuguuccuccacugaauggggccugggcuccaagaaccccacgauccacucaggaccggacacuggguccucccuccucucccauccugccccagcaccuucaaacaguguggagggcgacagaaagggucgagcugcaucuccugguagugggaugggcuaggggucuggguaauccccucuucccacugcuccagcgcgcccuuccugacugcuauaggccaagaaaucagcgaagaagccgcaguccucaagcacagagcccgccaggaaaccuggccagaaggagaagagagugcggcccgaggagaagcaacaagccaagugagcccugcucugccccuccacacccugggggccccgcaccccgcaucaccccacaacccucaccccucacaggggcagccccaccucugaguucagccuuggagccggacccgguugaaguuccugguccuuggguugugugggcugcguaggaaucgcugcugcgggagugggaucuuugcccagcccaggggucuccuccagggcgaucccgccuccagagacacggccacguccggggacaucugugguugucaugacuggggggugcuccuggcauggagcggguggaggcuggggacgcugcugagggcccuguagugcccaggaugacccaucccagagaacaguccauccccaauguccaca

SEQ ID NO: 18389 - RNA, 2538 nt, Homo sapiens
uguggacauuggggauggacuguucucugggaugggucauccugggcacuacagggcccucagcagcguccccagccuccacccgcuccaugccaggagcaccccccagucaugacaaccacagauguccccggacguggccgugucucuggaggcgggaucgcccuggaggagaccccugggcugggcaaagaucccacucccgcagcagcgauuccuacgcagcccacacaacccaaggaccaggaacuucaaccggguccggcuccaaggcugaacucagagguggggcugccccugugaggggugaggguuguggggugaugcggggugcggggcccccaggguguggaggggcagagcagggcucacuuggcuuguugcuucuccucgggccgcacucucuucuccuucuggccagguuuccuggcgggcucugugcuugaggacugcggcuucuucgcugauuucuuggccuauagcagucaggaagggcgcgcuggagcagugggaagaggggauuacccagaccccuagcccaucccacuaccaggagaugcagcucgacccuuucugucgcccuccacacuguuugaaggugcuggggcaggaugggagaggagggaggacccaguguccgguccugaguggaucgugggguucuuggagcccaggccccauucaguggaggaacagcccccuucacuccuccugcccagcaguccugggcuguggcugaaacgccuccugcaccaggaguucggugcccuuucugugaugaagggagugacagagagagaacacggcgcuguucgugcuuuccccaaagaaggcaggccuggcugaggggcaccagcacgugggccccaggcacucagucuaggugagacucuggauucaggccacauugccugaaucuccacaaggguagagggcgugacagggcccgcagcaccacacgugguauaggagaguccugacagucaccacccuaggaggccuccuaccugcucccacgcucaccugcaagcuguaccccauggcagccagagggcacccgagagcacccgagugagggccugucccuacccuguccagugcccuccauggcucccaccucccucagggucaaagcccaaauccucccugcagcccacauggcccuacccggccugcucuguccguuccccaccgcccuccuuuucccucucuccccuccucccuccacuccagccccagaggccaccucgcuguuccuccagcacgccaggcgcaguccucugggccugugugugagcugcuucuccugccuagaauguauccccucccaggagucuucguagauccccucccuucauucggagccuauuuuuuuuuuuuuuuuuuuuuuuugagauggagucucgcucuggcccaggcuggagugcaguggcacaaucuuggcucgcugcaaccucugccucccagguucacaccauucuccugccucagccuccugaguagcugggacuacaggcaccugccacaacgccuggcuaauuuuuuuguauuuuuaguagagacaggguuucaccguguuagccaggcuggucuugaucuccucaccucgugauccacccgccuuggccucccagagugcugggauuacaggcgugagccacugcgcccagcccauucggagccuuuuacuuaaacccaaacgcaagccuuuggagucuacucacaccuucagggucuacucuauuuaaaagagaaaccccccaccccacuuuacucuucuccuuagcaccgaaaacuccggacagcacgcacuacccucaugucaucuguacagcuccucccuccuuuguuuuguuuugagacagggucuugcuguguggcccaggcuggagugcaguggauugaugacagcucacugcagccuccaacuccugggcucaagcaauccuccugccucagccuccugagcagccgggacuauacaggcgcacaccaccacgcccagcuaauuuuuuaagguuuuuauagagacagggucucucuaucuugcccaggcuggucucgagcuggacucaaguaaucgucccacuucagcugcccaaagugcugggauaacaggcgugagccaccaagcccggcccccucccucccaugaauguccccuccuccagggcaggaguuucugggcccacgcacugcuuucuugaugggucccggaaccugggauacugccuccuaccuaguagaugcuccauaaacguguggagugaaggcagggacucccggcgcccucccggcucaccucucucuccagcucggccucgggcucggagucagaggaggacgggggaccccggccccggcccuugcguccccgcuucuugacgggcucaucguccucccugagcucguccccgcugcugccgccgcugccccgcucagccuccccgcggucggcccgcucgcgccuccgcuccuucuccuccuucuccugcucccgcaggcgccgcagcuccuccuccugcucucgccgccgcc

SEQ ID NO: 18390 - RNA, 17332 nt, Homo sapiens
cccucugucccacccagaucucucagccccagugaauggcgaggccacaucacagaagggggagagcgcagaggacaaggagcacgaggagggucgggacucggaggaggggccaagguguggcuccucugaagaccugcacgagugagugucccgggccgugggguuuggacuccugagcggcagcggugugacgcgcacccuggguccgagccgcuccuccugugccagucccucugggaugggucccagggaugucguccuuacucgggccucccaccuucacagcugaccccagggccccgcuggcuggcacuuccggcggccccuacagagaggcagcuccagggcuuugagcugccugccccuggccuccugggaagguggcuucuugccgagccuccaggguggcccagguagguaggccccgagcacgggcacccggcuaucugacggugccugugcccaucacugugggcugcugucugguacaaggcucaguggagucacucacuuacccagcagcugccuugugcuaugccuggcuggcgccagcguggggacccuggagaugguuguggucucuaguggcagaagacaggcagauaggagggcggcacucgagccucaggugccacaacggggguacacuccucggugcccaucccacccaaccgcccuacaggcagggcaggggcgggagggcauccucacaccgccuuugcuguucccaccagcagcguacgggagggucccgaccuggacaggccugggagcgaccggcaggagcgcgagagggcacggggggacucggaggcccuggacgaggagagcugagccgcgggcagccaggcccagcccccgcccgagcucaggcugccccucuccuuccccggcucgcaggagagcagagcagagaacuguggggaacgcugugcuguuuguauuuguucccuuggguuuuuuuuuccugccuaauuucugugauuuccaaccaacaugaaaugacuauaaaugguuuuuuaaugaaaaaagaaaucacuuuuauuggcuugguuuucuagcauugcuggugcagugggggccugagcuggggcgcaggcggcagugucacugggcccguuugggacuggguugagccaucaggccaccgugagaagcgacuaaaaggcacucugggcccagcccaacccugaaaggccaguggcaggagagcugggcgggagcaagcucuucccaggagacaagagggacaaaccagggcaucuaagcugugcugccugcgcccugccccgcacccacgaggcugggggguuugaugcuuccugcaucuggcagcccaggguccaggcaggugagcagguccgauguggggaggacgaggguccgcgaggcuaggcugggaggguggagaccaggccuucccugagagccgcugcuagccgacaguggucuccagcguucagggagcaugggccucaggggccagccucgacucaccccagcugugucacccacacaccgugugacuuuggacagguuccccucccacucggggcuucucuuuccuccucugcauaaggggcugucacgugggcacggucccaagcaagucaccccgugcuccgaaguugcucauuccacaguggcgucucguguuugucguccugcccagcguagccgaguugccuccgucccaguaagaauuaggcugugguguggcgggaagggacuuccugagcugcggccccaugcuugguuggcuggacgugagcugcagucacugugccugauuucugcaaauggcugugucuggcauccuagccuccgauggccaugggugucgggcugaggagaaggcuugggaaggcuccugacccguccccucucacggcccgucaccugaggcaguccuugccgugccagcuuccccgguucagagcugagcugaaugccccggccccucacggccccuggugcacacggugaccccuggggccccuccacccuuccucccccugggucugggguuccugggcucguguccuaggagagcauggaaaggggacgacaagguucucuuaccgggugaguggggauauggcuuccuggggaggccgggcugaacggcuccuccccgcuggacugagcgcagccacggcacgucucacacccgaccugagccugccagccuccacgaccugggcuagccugagagcacggggcccggcggccggguccgccaccaccagugucucugaugccugcagccuccccagccccgcuuccucugcagcccggcgcuugggugggccugaggacccagggggagugugcggcggaggaagggcugugccauaggcacgcagccucuguggcuguucccagcccugucugaucccuccauagggcacaguucccugcggggaaguccuuugucuguguucuccaggggcagcugcugggcccagccuccccaggggccucagagccccaggugccuggggcaggccuguggugggcagcuggaggcagcagcagccuguuugcuuguuuuuugcaccccccacccccugcaaacugcucagucucaagccaggcuggugcaaagccccagcuguggcugcuguggcuccuggcagcuuuguccccaccgugaggccaccccgggggucagcaaaggcaguagcagccugccuugggaugaugauggcagugucgcuuuuucuaguacuuucuacuaugagggaaugugguucuuaagacccucaaggugugugugcuaaggccggagacccacuuucagcaugagaacggagcugcccggagccugggaugccacagcacugccugcaccgcugauagcugggggcccgugcugcaggacuggaagagcccugcuagauauaaaaggguugcuagcggggcaaacagaugcccuuccaggcugggcacgcugcuuuuucucuuuccuaauugcagugcuugcuuggggacuucaagggaaggcucuuggcugguggucugagugaccccaggcuccgagaggggcaggcagcgcuggggaggaggugggagaugcaggcaggcccggagcagggcgugggguggcucaguuaagaaggucacugccuccgcagccccucggcgcucagccagcugcagccccaaaggucuagggcuuuagggaaccgauccagguuugggggcggggagaaaguucugaggcagcuccucccuggacagagcagggcgaccccgcgccgggccugcaggcuccuacagcuacugcccgccagcgggcaaggcgaagggcccuaccagccagcugagcgggggauugugcuguaggcccuccagcagcugcucuaaccccugccaagccuggugcacacccucgcggcucugcaccagccgcucugcgggcagcuccucuacagagccagcugaggccacgaugccauagagcucacagaggcugugccgcgcccgccccacuggcugcuggagcucggcgggcaggcccuggaggcuggagaccaggccacuguaggccgugugcagcugccggagaaggccgcagacccuggacagaaccccggcaucccgcuccugugggaggaaggcgcaaggugaguggagacccaugggcgggguggggggacccuagcccugugccagacccaccuccuggacagcagcguccuccgcacuggcaccugagcccugguccagacguggcugcccuucuggagccugcugggccuuuucaaucuggagagagaguacaguggggaaaugauggcuucuuggcaaaugaccuuucacaacccccaccucccccucccccagggaccugggcacauucacaguccugggagaaaggccacgaguuccaagucaguuguaccacagugggcguguugucuugcagaaagaggcaauaguucaaacuuccccaugaggucaucagggagugcacguaacacagugucuguggggucgugucacuccucaccccuaaaccuguggcugcccaguacccuuaagauaaaacccagcuccucaccauggccuuggugggcuggccccugggacaccucuggccucaucucccauggcaccccacugcugucuccacugaggccacacuggcuccauucugcccuccggccacuccagcaggcuucugccccagggccuuugcacacacugcccacucagccgggagccugcuucccgggcccuucacaagguccgcguucggccucagcuccaggugacccuuggugagaccuuccuggcccaugguguggcagccccagucccucccgucacaucugccccucuccucgggagcacagcgugcggcuuugguguucauugacuugguguuuauccgccccuggcaggggaacacucaggacucuguccucguuguugcuguguccccagcacguggcacccacgccccacccuguccacagggccccaucuuccucaucaucucaauggcugguagggaugcggcacgccgucaaaauaucgacuccagacugcugucgcccucccagcccucgccgcgccagugcuggagaccugaagccagcugcauaugcagacgcguccccucggugcccaccaggcaucuccccucacccuguccaaggccaggcuccuaauauccacucugcaacccgcccggccuccccucagccccccugcucuccuugucugcucagguuacaagccucaggggucucuuggggucuucucucaccucccacaucggacccgggcagcucugacuucgaaacacccagagcccagcuacuucucaccaccacagcgugacuccugaggcccggcagcacuugccuggguuuacgucccacugucuccucuggcccucgcccccacccgguggccugaccucccccaucagagugauccuuuuaaaugaaacccaccuuggaucaggccgcuccucugcccagagcccuccagggcucccaacucccuuggggucgaagcccagguccggcccaaccugccccauccccuccucacucggcuccagccucccaggccuccuuccuauuccuccaacaugccgggacaguccugccccagggccuuugcacgggccgugcccuccgcucagaucacacuccugcccauucugacgcacucccucucugucauuuagaccugacuucaaguguccccucuucagggugaccagccccagcacagccacuuccuuauccugguacauguuccauuuuccaagcaucauccaacgcgacgcccuauauauucaucugugaauugucuuccccaaccauggcgccccccaccccccaagggcaggccuggauauccagggucuucaguagcacuuaaaggaacaagugagacaugaugagucacacaccacaucccauuucccagcccagcauccuucacguguggcccugagcaaagcucuucucuuccuguggccuccuucuccccuucugaagagugccugggcugaguucuggcccaggcuacuuugcugugaggauucaaaggugggaaaaugcuuugugaucagccgcuugcagcgugcugcgagggugggcccauuccuucauuccuccauggcguuuacaggaacgccuuccaacugcgccauuguaccgcgugccagaggcacggcagcgacugugcaucuggggguggccacagugacaugagguguccugagggucccuaggacagacuugcccuuggcacuguggacacgggggcuagaugguucucugggguggggccacccugggcacugcagggugcugagcagugucccuacucuccaccaggggcuucccccaguugugacaaccacagauguccccagacauggacuaguguccccuggaggcaggucauccacacugagaacccuggguuagacccucaaacugcggcuugucacaaaccccggauguugauggaaaacacaguggccuaggcugcacgccaggaauccugaccgagggcggcaucucaagguuucucacggcccgccggggugggacugcuguccaccaacauguaaaaccugugacugcugggcacgguggcucacgccugucaucccagcacuuugggaggccaaggcaagaggaucgcgggagcgcagaagcucaagaccagccugggcuacauagggaggccccaucucuacaaaaaauuuaaccagguuugguagugugcacccagaggcugaggcaggaggaucacuugaacccaggaguuuaagaccagccugggcaacauagcaaaaucuaaucucuacuaaaaauacaacaacaaauacuaagcugggcgugguggugcaugccaguuguccagcugcuugggaggcugaggugggaggaucucuugaccccaguagguugaagcugcagugggccaugaucaagccacuguaguccagccuggguggcagagcaagacccugucucacugucuccaaaacauaaaccccuagagcaguccugugagauuucugccucccgggcugcacaacagcuucuagaggaaauguuggcccucaggacuggggacggggagacuggaggccagggacgcugcucagcucccugcagggaccaggaugaucccaccccagagcacgauccggccccaacguccacauugccaaaggggagaaccuaggccagaggaagagagcggggccagugggagggguggacgacucuggccagggugcaugaccccuggaugcauccgagucauguugcguuggguccuuuccugcgugcguugcagccccaggcccugcgggcucccuggaucccauccuggcuucacuuuacccagccacagcgccgccuuuccauuccccgaacacacccagcuugcuccccgguagcuugcuguccugucccugcuuuugggggcuuugcagagcugucuccccaucggucaggacagggcccagagggacggccuuccugcccagcccacaucccccucugcacacagauuguuuugcugucuuuguguccccaccgucuuuauuuuuuugagacagagucuugcucugucgcccaggcuggagugcaguggcaccaucuuggcucacugcaaccuccgccucccggguucaaccucgccucccagauucuccugccucagccucccaaguagcugggauuacaggcgccugccaccacucccagccaauuuuuguauuuuuaguagagacgggguuucucuguguuggucaggcuggucucgaacuccugaccucaagugacccacccgccucggccucccaaauugcugggguuacaggcgugagccaccgcacccagccuacccgcugucuuuaaggaucugaucuagcuccgucccccuugccaggaggcaagccccaugaguacagagccaugaccauuggugacgcugacagcaucaucuccuaggugcucagucaguaucugcagcugggugaguccugggcagggguucuaagaagugcccuggggacggggcagcagcagggggaagcucuuaccagccugaagcaguccuggagcugggccagagugucccuggcuuggaacuggccgugcugcagguggcucaccgcguguucaaaugcccgcuggcggaagcugggacccaggucaccuaaacgaacgaaguagcuccccuguuccgccgacagcaccuuuggcccaggcugggaggcagccagcugagcuggaaaggaaggcgcaccgcucagucccggaagccccucagggcaucagggcuuuauaaaagucaagugagggccgggcgcggcgguucccgccugugaucccagcacucugggaggccgaggcgggcagaucacgaggucaggagaucgagaccauccuggcuaacacggugaaaccccgucucuacuaaaaaaauacaaaaaauuagccgggcgugguggcgggugccuguagucccagcuacucgggaggcugaggcaggagaauggcgugaacccgggaggcggagcuugcagugagccgagauggagccacugcacuccagccuggguaagagugcgagacuccgucucaaaaaaaaaaaaaaaguuaagugaggccaggcgcgguggcucacgcccguaaucacagcacauugggaggccaaggcggguggaucaccugggaucaggagcucgagaccagccuggccaacauggugaaaccuuaucucuacuaaaaauauaaaauaauaauaauuagccgggugugguggcgggcgccuauaaucgcagcuacucgggaggcugagcaggagaauugcuugaacccaggaaguguggagguugcagugugcugacacugccacuggacuccagccugggcgacaagagugagacucugccucaaaaauaaauaaguaaaaauaaaagucaaaugaagcuggguaugguggcucaugccuguaaucccagcacuuugggaggcugaggcuggaggaucacuugaacccaggaguuugagaccagccugggcaacauagagagacaaaaaacauacaaaaaaauacauagccgggcauggugguccuagcuacuugaggcuggagcaggaggaucacuugagcccgagagauugaggcuguagugaacgcaccacugcacuccagugugggugacagagcaagaccuugucucuaaaaaaaugaaaaagggccaggugcucucacguguaaucccaacacuuugggaggcugaggcaggaggaucguuugagcccacaagcuugagaccagccugggcaacacagggagacccccaucugaaacaaaccaaauaaauacauuuuuaaaaaaaaagucaagggcccagcugggcgugguggcucacgccugcaaucucagcacuugggaagcugaggcgggcggaucacgaggucaagagaucgagaccauccuggcuaacacggugaaacccugucucuacuaaaaauacaaaaaauuagccgggugugguggugggcgccuguagucccagcuguuugggaggcugaggcaggaggauggcgugaacccgggaggcggagcuugcagugaaccgagaucacgccacugcacuccagccugggcaacagagcacgacucugucucaaaaaaaaaaacaaaacagucaaggaccugcuagcagcugugccugccucagggacccaugaacccaggcguccccucaccuugcuccuccgcauucaugggguggaagaugucccccagccccuccaacucauucugcagcauugccaagcguggggcuucuucggggccgugugugguggccaaaagccccguguccucccugccuggggcggccccuugggugaacgucgccacgucagucgcaaggcccuugguaguggcugcggcuucccaggcaggcuccgggccuacacugagcacauccgggggcguggagaugccagagaacggggccucuugggggcucagggcagucugcuccccaccauugucugugguccuggaacuggugaguccaccccaggagguggcggggguacuagguaaccaguucuggaaggugcugaggccaguguggguggccccugucgccacguucccugaccccaugagcccagcggacacugcgucuuugguuccggucagcacugucuuggugguguccaggccccccuggacggccccuuuggccaugcucauggcaccgguaaccccacugaagacaguguccuugguacccauaagcacagccuuggaggcguccacgccggucugcacgguuccuuuggccacauucacugcccccgugacuccaguagucacugcauccuuagcgccacucagcaccgucuuggcuguguccacaccugucuggacggucccuuuggccacauuuacggcaccagugacuccacugcagacgguguccuugguaccggucaggacagucuugcugguguccacgccggucuggacagucccuuuggccaaguucacagccccugugagcccaguggacacggcaucuuuagugccagucaggacagacuuuguaguguccaggccccccuggacggccccuuuggccacuuucgcagcaccggucaccccacugccaaggguguucuuuguaccuguugcgauauuuugggucguuuucagcccaguuugcacagcacccuuggccacguucgcagcaccggugaccccacugcagacaguguccuugguaccggucagcacggucuuggccgugucuacacccaucuggacggcccccuuggccacauucgcagcaccggucaccccacugcacacagcauccuugguaccaguuaacacagucuuggugguguccaugccggucuggacagucccuuuggccaacuucacagccccugugagcccaguggacacagcaucuuuagugccagucaggacagacuuuguaguguccaggcccccuuggauggccccuuuggccacauucgcagcaccggucaccccacugcagacgguguccuugguaccaguuaggacagucuuggugguguccacacuggucuggacagucccuuuggcgacauucacugcccccaugagcccaguagugacuguguccuuggugccggucagcacggucuuggccgugucuacaccugucugggcagccccuuuggccacauucacagcacuggucaccccacugccaaagguguucuuuguaccugucgcgauauuuugggucguuuucagcccaguuugcacagcccccuuggccacguucacggcacuggugaccccacuguagaugguguccuugguaccgguuaggacaguuuuggugguguccaugccugucuggacggucccuuuggcgacauucacugcccccacgagcccaguagucacuguguccuuggugccggucagcacggucuuggcugugucuacaccugucuggacagcccccuuggccacauucgcugcccccgugagcccaguggacaucgugucuuuuguaccuaugaccacagacuuggugguguccaggccccccuggacggccccuuuggccacguucacagcacuggucaccccacugcagacgguguccuuggugccgguuaggacagucuugguggugucuacgccggucuggacggucccuuuggccacguucacagccccugugagcccaguggacacagcaucuuuagugccagucaggacagacuuuguaguguccaggccgcccuggacggccccuuuggccacauucgcagcaccggugaccccacugcagacaguguccuugguaccaguuagaacgaucuuggugguguccacgccugucuggaugguuccucuggccaaauucauggcaccagucaccccacugcagacgguguccuuuguaccuguugcgauauuuuggguuguguucagcccaguuugcauggcccccuuggccacauucgcugccccugugagcccaguggacaucgugucuuucguacccaugaccauagacuuggugguauccaggccccccuggauggccucuuuggccaaguucacggcaccggucaccccacugcagacaguguucuuggugccaguuaggacagucuuggugguguccacgccggucuggaugguuccuuuggccacauucauggcaccagucaccccacuacagacgguguccuugguaccuguuaggacagucuuacugguguccacgccggucuggaugguuccuuuggccacauucauggcaccagucaccccacuacagacgguguccuugguaccuguuaggacagucuuacugguguccacgccggucuggaugguuccuuuggccacauucauggcaccagucaccccacuacagacgguguccuugguaccuguuaggacagucuuacugguguccacaccggucugaaugcuuccucuggccacauucacugccccugugagcccaguggacacagcaucuuuggugccggucagcacagccuuggagguuuccacgccagucuggacagucccuuuggccaaguucacugcccccaugaccccaguagucacugugucuuuggugccggucagcacagucuuggugguguccacaccggccuguacggucccuuuggccacauucacugcccccgugagcccaguggacaccguguccuuggugccggugaggacagccuucgagguguccagacccccuuggacggcccccuuagccauguccauggccccugugaccccgcuggacaccaccuccuuggugcccguaagugcagaccgagugguguccaggccucccuggaccacucccuuagccacguccaccacgcuggccaccccggaggacacggcauccuuggcccuggacaucuuggaacacaccaggucuuuggccccggacaccaucugcugagaaaggacacagguggaucaagagaaggacugagagguguacuccaccccgaugucugccagcccagcccccuagugugcuuuggggcaaggaacugcaggcacccagaggccccaccuccucaaaaagcaagcugcuuccuccucaccccgaccccggucagccagacauucaucgggcugugguguggcacccuggcucuccgggaugaaguccucaugagcucacagcgccagccucuuccauucucacgcacccccuuucccggcugcaggcaggccucguccaugacagcauguccuaggcuuggacucagccaggguccccaggccuggacucaacgcagguccuacaguuacauuucuguuccucuugcuuauucuccauucauggcaaauguugagccuggcgucccagggacaccagggagacuaaauugcuuauuaaaaucauuauauccaggcugggugugauggcugaugccugcaauccuagcauguugggaggccaaggugggaggaucacuugagcccaggaguuuaagaucaaccugggcaaccaaacaagacccagucucuacaaaauuuuaacaacuggcugggcggggggcacaccuguagucccagcuauuugggaggcugaggugggaggauugcuugagcccaggagguugaggcaauagugagauaugaucguaccacuguacuccagccugggcaacaacaugagauucugucucaaaaauaaugauauacgccuguaaucccagcacuuugggaggccgaggcgggcagaucacgaggucaggagaucgagaccauccuggcuaacacagugaaacccugucucuacuaaaaaaauacaaaaaauuagccgggugugguggugggcgccuguagucccagcuacucgggaggcugaggcaggagaauggcaugaacccgggaaggcggagcuugcagugagccgagaucgcgccacugcacuccagccugggugaaagagcgaaacucugucucaaauaauaaugauaaugauaauaauaauaauauauucaggcugggcacaguggcucaugccuauaaucccagcacuauggguggcuaaggcaggaggauugcuugagcccacgaguuuaagagcagccugggcaacggugagaccccaucuuuaaaaaaaaaaacaggccgggcacgguggcucacgccuguaaucccagcacuuugggaggccgaggcagguggaucaccugaggucaagaguucgagaccagccugaccaacauggcgaaacccugucucuacuaaaaauacaaaaauuagccaggcaugguggcaggcaccuguaaucccagcuacucuggaggcugaggcaggagaaucgcuugaacccaggaggcagagauugcagugagccgagaucgugccauugcccuccagccugggugacagagcgagacugucucaaaagauaaaaaaaaauuaaaaaacacaaaaaugaaugaagaugaugauggccuaggaguucuaacucucggguguaccugugaggugcuacuuuuuuuguuuguuuguuuuuugaaacagagucucacucugucacccagacuggagugcaguggcgagaucucggcucacugcagucuccgccuccuggguucaguaauuuuucugccucagccuccugaguagcugguauuacaggcgugcaccaccaugcccagcuaauuuuuguauuuuuaguagagaugagguuucaccauguuggccaggcuggucucaaacuccugagcucaacugaucugccugccucagccucccaaaguguugggauuacaggugugaaccaccgugcccggccaaggugcuauuuuaauucaguaguuuucaacugggugauucugcccccagggggcacugggugaugucuggagacaucuguaguugucacaacuuggggaggcuccuggcauggaguagguggagaccagggaugcugcucggcacccugcagugcccaggauggccccaccccagagaaugauccaaccccaaauauccacaguacugagguugagaagcccggaaauuguauucucagaacacaucucccagcuuuggcucaggugggcaccuugggcccuguaguuggagagacccagguucaagucccagcuuuuuacccucuccugcucccgacacucgcuguguggccuuaggcaagccacaugcccucucugagcuaauauccucaucuggaaaaugcugauuaaaacagauccucuugccaggcgcaguggcuaaugccuguaaucccagcacuuugggaggcugagguggguggaucacuugaggucaggaguuggagaccagccuggugaaaccaacauggugaaaccccguaucuacuaaaaauacaaaaauuagcugggcauggcggugagcacuuguagucccagcuacucaggagguugaggcaggagaaucgcuugaaccugggaggcagagguugcagugaacugagauugugccacugcacuccagccugggugaaacagcaaaacugcaucucaaaaaauaaaaguagaagaaauaaagugcuuacgcugcugucgcuuuggucucaucuugccaggcacagcccuguguagacuggaaccuuacgugauuagagugggguagcacugcacccauuucacagauguggaaauagaggcucagaggggaagcuccgccugggauccccaggcugucugccuucccucaggcccacagcagccccccagauagcaggaacugaaaugucccaggagggagcagccccccagauagcaggaacugaaaugucgcaggagggggcacccccagggcuccugccacaucagacccugcccugcacauccucucaccuuuuccgaagguugcagcuccuucuccguccauggggccgucugcucugggugggcagccacuguggggacaggggccggucagggagagugagggaugcaguuagaaccaucuacccggcugcccauugcacaauagccaggcacagccuaaaaggucaggaauguuucagcuaccccgccagggacagcaggaggugacauccacggcuaccagccagaccuggucaccccccaaccccgcugggggcuccccccaagcccagggccgcuguucccugaaguagggcucuguggaacuuccucugcuggguggacacccacccugagucccgggguucauauagccuggcaugggggaacagccccuugcccagcccgccccgcccccaccgcagcugccugcugccuauugccaggccaaggcauguggagcagaagucagcugccuggggcucugggcccagagggaggcccagcucaggcggcugccccaacccuggguucccugucaccgucccugaucgcccaagcugagccacaggaggcuggggagccccugggcugugugaccccaggggagcuguugcuccucccugggagucuggaucucacucugaugagcucagaugggcagagcacccagccugggccauggugcaucagaaacggagugcagggugggggaacggccgagggacugagugggggggcauugcagggagacaggcuggguugaaagccaccuucggccacucaccccccauauuuaugccucaguuuccccauccaccacaagauguccuagugucugaugagagcacacagacaaauauggaggacuccccaaauggcuggaagucccugcccggggagcuccuucucccagguccauguguagaguccccccacgcccccagcugggccagccacucacccugagccugugguugggcagccucggcagcaggcgcuccuguggggucagcggccggccgggcucucgccgagcuaugugcguuggccaccagguuccgggcagagcugaagccaggcagggacccaaagaagcugcccagggucugcaugggggcggggggugugcaggaugagcaggccaagccucggcaggaacgggucagaggaagcaucgauugaucagcccaaugccgccccggccccuugcuccugggugaccucaggaaaguguuucagccacucagccucaauuuccacaccugggcaaugggcagacucagccugccucccaugcacagaggaaaagaucgucuacccgaucuccaaagaccuuuuccuuccaggauccccacugcacagauggggaaacugaggcucagagaggggcggagcugaggccggcccaaggucacuugcuggggaaggugucgaggucugcgugggucccccgccuccagcuugggucagaaaggaagggauuggcaucauggcucccagaccgcccccaccagcccaccagggaagcaccucuccagauucgagaccccaggacuguggaggucaccuuccccggcucuggggcaucuccaggccccagcaagaaucugccccauuuccccucuuuaccuugcccuucgguuuggggggaucccgucucccuucgucuggagcagacauagugagaacgugagaagcuggaagggggcagagaaggugcgugaauggggguucccuagccucccaucccacacccacuccccacugaaagccugagcagcccgacacccaccugcaggccuggccucacccuggugucaccgaagcagacgcggccccgcucaccuggacugcgcgggguccccuggaggacggaccggcccggcuggcagcuggcucuacccucagcuccc

SEQ ID NO: 18391 - RNA, 1427 nt, Homo sapiens
cacgucagagacaugggauuuggaguuggacuggugggguugacuuacagcuucacuugugggcugagagucccugcguggguuauuuuucugccuuucucagggccuuggguuccccaaaugucacaugggcacaguaacacccauguccuaggguugaagauggcaugauaugauguauguaaaaugcuuggcacaagguuucucaccgaagucuggaagagacaccauaaugucaucuuagcaggcagcuguuaccccagugagguaucuuaccuguugaaaauuccggacuugggccaggcgcagugacucacgccuguaauccuagcacuuugggaggcugagguggacggaugaagaggucaagaguuugagaccagccuggccaacauggugaaaccccgucucuacuaagaauacaaaaauuagccgggagugguggcaugugccuguaaucccagauacucgggaggcugaggcaggagaaucccuugaacccaggaggcagagguugcagugagccgagaucgugccacugcacuccagccugggcgacagagcaagacuccgucucgaaaaaaaaagaaaauugcagacuucugugugugcuuaucuggaaaauacuuuguuuaaaaauccauuacaugaggugcaggucuccagaaaugccaggcaccucagaccacccucucucguccucccccugcaaaaucagggucaaagggcucucccguuaccuggaggagcuguccaggguucuggagacgaaacggagcccgcugggaacuguccugagccccggugcugaaacagaucgcgguucucuucucggaccucccgagaggcgcuguccggauauuuggugcugaaauaaauagcauucuccuccuucggucgguggagagcugucccucgugcugaagaaaacuugauuuuccucucucuuuccccguucccccaccccucuucguucucgguuccuccgauucuugggaaaccccacccccacucaauuuauuuccccuccuagcuucuuccuggggagcuucagaauggcaaugggguggcgggggggagacacagaggggucgcaacuagcacugauaccugcuccucacccuguaccauguccccagaacuuaccucccaagcagucagcccugcuggucucugcuuuccagaccgucaaacuucgccgucucugucccuuucugggaaaauguccaugcgccaaccugcaaaccagccucauucccggcaucccacgucccucagaccaccccuccucccacgcagcugcgggccucccccucugugugccucaccugcuuccagucuuguuggcagaugcaggugucccguggcugccgaggcggggaccugcgcuuuuauaggcuucagggaaggcggagcgccaggaaucc

SEQ ID NO: 18392 - RNA, 1257 nt, Homo sapiens
uagucgcuuuuagccuucggucucgguccugauuggcucagagucgcucgugaucccuuuugggaaauguaguccuuaaggguaucgcgccugcuuuuucuauacgcucugacgcagagauagccacgggaaguacgucaccaaauuucgccgguucccacaagcuaggucgugugacgcugcaugacgggaauuguaguccucaaauugcuagcuuccgaugccaugcgcugcgacuggaacgccaauucccaccaugccgcgcgcucacagcucucaggggcuguccuguggccuuuggggaaguguagucuugagcccccaagauuccuuuucuguucuauggagugggcccgcgcaaaggacuccauuucccggcgugcugccauccgucgggucgcggcagccauuuuguuccgcccgaggagacccuaagauggcggcgagggggacggugaagguugccucccgcccguccgggcucugauccuccgucuccccgucccccggcggccggcccauggccuggcggaggcccgaaccauggaccuccgcaccgccguguacaacgccgcccgugauggcaagcugcagcugcuccagaagcugcucagcggccggagccgggaggaacuggacgagcugacgggcgagguggccggcgggggaacgccgcuacucaucgccgcccgcuacggccaccuggacgugguggaguaccugguggaccggugcggcgcgagcguggaggccgguggcucggugcacuucgauggcgagaccaucgagggcgcgccgccgcugugggccgccuccgcagccggccaccuggacguggugcggagccugcugcgccgcggggccucggugaaccgcaccacgcgcaccaacuccacgccucuccgcgccgccugcuucgacggccaccuggagguggugcgcuaccuggucggcgagcaccaggccgaccuggagguggccaaccggcacggccacacgugccucaugaucucgugcuacaagggccaccgugagaucgcccgcuaccugcuggagcagggcgcccaggugaaccggcgcagcgccaagggcaacacggcccugcaugacugcgccgaguccggcagccuggagauccugcagcugcugcuggggugcaaggcccgcauggaacgugacggcuacggcaugaccccgcugcucgcggccagcgugacgggccacaccaacaucguggaguaccucauccaggagcag

SEQ ID NO: 18393 - RNA, 10113 nt, Homo sapiens
uggaggggcugcggcgggggcugucgcgcuggaagcgcuaccacaucaaggugcaccuggcggacgaggcgcugcugcuaccgcugaccgugcggccgcgggacacgcucagcgaccugcgcgcccagcuggugggccagggcgugagcuccuggaagcgcgccuucuacuacaacgcgcggcggcuggacgaccaccagacggugcgcgacgcgcgccugcaggacggcucggugcugcugcucgucagcgaccccagguggccgcggggcucggggugggguggggcgggggcggcggccggggaccccuggagagcggcgggggaggcgggcgcccaaggcggccucccgggccggcacugcuuucccaccucgcgcugcccgcccggccucucuccugacccggccuugccggugucaggucuugcuuucgggcucucugucugugccuguuucucugccuguuucugucucugcuguuuuucugccucucucucuuuugucucugucacucucaucuuugucacucucucgucucugucucucaucucugucucuucuucuuuugucucugucucucaucucucucccucuucuuucugucucuugucucugacucuuaucucugugccucucuuugucucuuucaucucucucuuuugucugugucucucuuuuaucucugucucuuucaucuuugucucucucaucucuuuuguggcugucucaucuccaucucuuaucucugucucccucuuguuucugucucuugucucugucucuuuuaucucugcgucucucaucuuugucuccucaccucucucucuuuugucuuugucucugucucucucuccauuuuggucucuguuuuuuccucucugugugucucucuccaucucugccucuguuuauuucuuucccugaugauuugguugccugugauugucucugucucugucucucuuuucucugucacucugugucucugcccacuucucucucugcuguuuuccucccuguuucucccucaucucugucucccucucucuuuucugucucccucucuggucucugucuccccauuuuggucucugcuuuuuuccucugugugugugucucugucucucuuccccuuugucucuuugugucucugcccauuucugucucugcuguuuuucuccuugugucucucugugucugucucuuuugucucuuuguccauuuuugucucuguuuuucucugugucuguguaugugugugucucucucucccugucucucugucucuuuguccauuugucucugucucugcuguuuuucucucugucucucugugucucugucucugugucccuguccaguucugucugugugugcgcgcaucucucucugugucucugugagucucugucucuuuugucucugucucucucugugucucugcccauuuuggucucugcuuucuuuccucugugugucucuccauuucugucucucuuucucugucucucuccauuucugucucugcucuuuuucucucugugugucucuuuugucucucuguuucucugcgugucucuguccauuucugucucuucccgcuguguauuucucucucugugucucugucucuguuauuuuggucucugcucuuuuucucgcugugucucaacaugugugucugugucucuuuaucucucuggugucucugcauuuuucucugcuguuuuucucugucucugaagcucugucucucucuuccuucucuggucucucccuaccgccuuaucuuucccacagccccacuccaguguccguuacccacacucacacuuggauaucuggguccccaaagagguccccuggccaagacgacccucaaguggggcgucuucuggcccaaggaggggucugcagagaagggcgcuggggccacgggaacagcucacugccggccuggggcagcucugggaaaugggucgaggauggccgagagguggugaagaugguggggccucgucucagagccugggaccaccuccuuggaagcauugaacaggagagggacgggggccaugugaauuacccuggauuuuaugggggucacauucaccagcccucuagaggcuugagucaccgagccuggguugauguuuugagggcaggagccucagaugccaccccguugcaggagucuggggcugcaaugggggcaggagaggcccccuccccaggcccucuugagggaagaucuuagcggggacggggaggcugagaggaugaugagggauggagguucagagcuuggggcuaggagaggguguucucggcagcguaccuucuaugaggucugggggcuggacgacccucagacguccagacuguaauuaugcaguacagagucagcauuuauugugugccuacugugugccagacuccaugcuggacacugaaauucagcagugacccagagagaccagauuucgccuucacagagccuagagccaaauaauagcacaggagaaugucaacucgcaauuggcgcugugggggaugcagggaagguggagagggaucagugacugggggacgccucuccggaaaggugacaugucaggcuaugauguggaggaggugguuaaacagagagucagggaaggguguuccaggcaguaggaacagccugugcaaaggcccugaggcaggacugcaccuggcauguuggaggaacagcgaggaggcccguguggcuggagcaagggggagagagggaggaagggagggcagggaggggccagggcaguucaugcagggccuugcggacugcagggaggacuugggccuugacuccgagggaggugggagccauagagggcugugggcagaggagggacgggaccugacucaaugcucacaggcaaccccuggcugcagcggggagaacagacugugauggggggagggcuggagacaggagaccagggugaggucccagugagccaugcuggaggcagagaacagaagccuucagaggagacaguuuuggcugggcgcaaugguucacaccugcaaucccagcacuuuggggggccaaggugggcggaucaccugaagucaagaguucgagaccagccuggccaacauggcgaaacgcugucucuacuaaaaauacaaacauuagccaggcauagugauauacgccuguaaucccagcuacuugggaggcugaggcaggagaaucgcuugaaccuggaggcggagguugcagugagcugagaucgugccucugcacuccagccuggacaacagagugagacuccgucucaaaacaaaagaaaaaagagagaguuucaaccuccucugggcucccacccuguccuaaugcccugccccuugcccaucccugaccacacacacagcugggguugauggcagaguccagcuuugucuuccccaacagacaggggccccuaucugccuuugcuguucacuggcugugugucccgaggcagcuaacccacccucucugggcaucaaauggguucugagcuccccagaccacucccagaccucuagaggcagagcaggggcuacuaguggauggugcagcagcagccggggaggccucagcuuccccaugugagaaaugagaaaaacacuugggaccugucagcgcagacgguacccuagggagagagaagcugcgugggcugcucgggacaaaccugccaggcccucucucacuuccggguagauagggcccccucuucucccucccccagccucucuugccaccuccuguuucuacacucugugaaaugcaguagugacaacauuuucugccucgaggcagcagcguugcagggagacagguugucacgggagcuagcaggcacugagucauggucaugcuuugagagccuuugagaugcuaggggcuuuucacguggccuuaccgcuguccccuggcgaggaugcuuuuauuuauuuauuauuuauuauuuuugagacgggagucuugcucugucgcccaggcuggagugcaguggcgcaaucucggcucacugcaaccucugccucccggguucaagcgauucuccugccucagucuccugaguagcugggauuacaggcgcccgccaccaugccuggcuaauuuuuuuguauuuuuaguagagaccguuucaccauguuggccaggcuggucucaaacuccuaaccucaggugaucugccuaccucagccucccaaagugcugggauuacacgcgugagccaccgugccuggccgggugccguuaucauuggcgguuuacagguggagaagcugaggcagaguaagauuaagcugggaaggggcagagccagggucuaaacccagcuuuaaagccacgcccuucaucacuaaaccuucucccugcuccauuagugggaacaguuguuauuauucugauuuuauugacaucagucuauuccucucuuccucccaagccccucuaucuguccuucagcugguuccaucagcuccgccuucaaagucuaaccauaauccucccacuucucaaccccuggcccagcccaguugccccccaccaagguccgcagccccugcccuuguccccuacaagucuguccuccccguagcaggugccagagggcgccugugagccccugagucggggcgugucccuccucugccggcagcccuccauggcucccaccucccucagggucaaagcccaaguccuuccugaggcuugcaagacccuggaugaccugcuguauucccucccugcuugcuccuccucccucucuuccccuuccucacucugcuccagccacacaggccuccucgcugccucagagccucuggacaggcuguuccuucagccuggaaugcuguucccucagguccccaacucccucucuuccugcagcccucccugaccauccuguuuaaaauugcauuccagcgaggcgcagcggcucacacccgcaaucccagcacuuugggaggcugaggcaagcagaucacuugaguccaggaguucaagaccagccuggccaacauggugaaaccccaucucuacuaaaacuacaaaaauuagccgggcaugauggcgcaugccuguaaucccagcuacuggggaggcugaggcaagagaaucgcuugagucugggaggcggagguugcagugagcugagaucgugccauuacacucuagucugggugacagggugaaacuccgucucuaaagaaauaaauaauaaaauuuuauuucacgccaucccugcuuucucucuuuccccaucacuugucagcagccgacuucucuacguuuuacuuauuuuuuucaccugucuccugcaguagacuguaaacucugugaggguacugccguccaucuuguucccugcuggauugccaguucagugccuggcacauaguaggugcuuaauaaauguuagugagauguauugucucacuaacauaaucgugagcagaggcaaggauugggcugcucagaauauuuuucuggagcucuagcggugccuggaugcaggggagggaauuucugggucagaggugagcccuggcaggggcaggaagaggcaccagccagacagugggcagaauagggaagccuugaacgccaaggcaagggcuauguuuuuucugcaaccugugucuuucugucucccucuuucagguagucuggguuggaggaggcagagccaugaccaaggggaccuggguacuggcugaaggaauaggcugggguagagggcacuuuuggaaggcacuucuccugccucccgggagccuagaucucacuccagguaaguaauuguaguaguugagaaagagaaaggaccuuagagauuguggagaccauagauggggaaacugaggcccagagaggagaagagacagauguuauugaccaucaucccccuccauacacuuaugcuucuggccucuaggguagggacauggccuuggugucucauuucuuuuuggacuaacacguggaccagagccguguugccccugacuugcugggugaccuugggaaaauugcuucuccucucugggcucuguuaccugucuccuuacaauaaaggauugagcuuugauuuggcuuuacugcacucuuugccugcaauuccugugacugccaucagguggcagaaaacagccaaguuccaagagaaucgcuugaacccaggagucagagguuacagugagccgaaaucacgccauugcacuccagccuggcgacagagcaggacucugucucaaaaaaaagaaagaaaaaagaaaacagccaaauucaccaggggccaucccuguuccucuuaaaggacacaagggacauccacaggaggggaugacugcagaucacuguccgugucagggauguuagguaaaaggaaaggacaaauggcuggagaacugguguuucacccuucccugguccuggauugaaacggguuuacccuuccccuccuguuguuccagggucugggcucccagguggaccaugaaacccuggccugaccagcugaugcacacugcuucagacacuccugcuggagccccagucccugacaaggaccuaggacauuuuugcuccugcccagccuaucgggagggagccuugagccuuucagcucugcugugugacuuugagguuguugcuccccucuuggggcccugggugcccugucuucaguggaaagcacugugccaccuuggaaagcucccaugggcagccagagggcaucgcaagaagagaagcacagaaggggcaggagagacacucagaggcacuuccgcucuugcccaggacauuuucccagccacaccuuugcccaagccgugcccccugccuggagcacuuuucaaccucuucucugcagcuccaauacaccugggauugcagucuccuccaggaagucuucucagauucccuccuucccagccagagagcaccuagccuucuuuggggcccccacaggcccuuugugcagugaacagcccuggcugggggugcagccagucguguccgaacucuccaaugacuaagcggggagaugcggacauccuagcuccuucucaggccuccaacugugccccauuuccacccccaaauaccuccccaggaggcaccugugcccacccccugggcuguuucccccuuccccuuaaauccggaugccucgucuugcauagggucuuggggcagcggggaagggguucugaagaacucuggccaagaggacgaggaucuggggguggggaacugggccuagcugugggaggucaucgcggggcauugcagggagugcguugugggaauuccggguggagacccucagggcagugugccgggccuccguugcaccucugaccugcagccacgucaucguugcgcagccccuggggagggucuuuggggagggggugccgaggcuacgcauguccucgagggccguguacacucuccaggcaccaugggcggaggcgccagaggcugggaagaaauaauguuuuaguuaagaguccuguuggcugcaggacucagagcauggacagguggauaguaaaucaccaccacggggacagccgugcccagacugugcguuugcuuagcucggggacagcacuuggcccggggucuccugcucgccucccuucagagcaucugccaaacuucgggcaucuacccugcaauucccgcuuggcugagaggagggggagaaggaggggaagagagaggagccccacuucacuccggcaggcagaccugcuggagcugcuuugcagaaugacuugggucuugcuggccccugggugugccuggaggggggucuuccuaucccccuccaccucuccccuuggugccuaacccaggacuuuguccccagagacccacugugugcccccuggagcuccuccuagagcagagucugcugcugucuguucugcagaggguagccugaggcccaaggagguugucagggacacacagcagggggaggcagcccagaucccugcucaugcgugguuugggccucugcuaacagcugggccacaugcguguaucuagagccuggguccccucuguccucauuucccugugcauauucagggacaugccucgucaggguuuggcaagaaaauggggcauuuaauaaucuccccaguuucauuccuugguccuuacuccaugccaggacuugugcacaucuuuuuggagcccugucucacuugauugacagccggccaggcgcgguggcucacgccuguaaucccagcacuuugggaggacgaggcaggcggaucaugaggucaggagauggagaccauccuggcuaacacggugaaaccccgucucuacuaaaaguacaaaaaaaauagccgggccugguggcgggcgccuguagucccagcuacuugguaggcugaggcaggagaauggcgggaacccgggaggcagagguugcagugagcugagaucacgccacugcacuccagccugggcgacagagcgagacuccgucucaaaaaaaaaaaaaaaaaagauugacagccucacugcucaggggccaggauaacagcccauuuuacagauggcuuuuggcuugcccaaggucaccacccucugaacugaggcguccccaacccaugccgggagcugguggaggaaguggggaaggguuucccgcuucuccacuggggguggaggugggagaaagcauuuucaggguguuuugacauuuaacaaacaguaugcaaaucacaugcaaaucgcaugcaaaucaccacccauuucuuaagccucgacagcgcuggcauguucugaaauaauaauguuggaccugucccuugaugaugaccugggucgggaggugcacggccuuuuccuuccuccgucuucccuucccuucccuucccuucccaucuguucucccuuccuucgcccccuuccuuuccucucccucccuaucuuccauuuuucucuucuuccuucacaucauuuguccaagaccucccuggccugagauaaacauaaguugcaaaaguggcuuccugcagcccauuuuccagguugggaaacugaggcaugggccuaaggucccacagccacaccgaggaaagcagcccccacugaaugucaccaugcaccaaagugcaugguccucgugacacaaagaggggagaugacaguggcuggaguugucagagcugcuuugaggaagcuccaggccugauaggcuugacagggccaaggggaacuauuguggaaugucuuggccuugaaugacaggcugcugauuuuggaucuggagaaagcucacacugacucuuccugcucccccagucuguuuuucuccugcuacuccauccauguaucccugaguuugggccacagucccuccacuugguuugcaugucccaccuucuuuguuuggcaagcuccuauucauccuucaaagcccuagcuucaauaccugcuacuucaugcagccauugcuuauccuucaaggagagccuacuucccucaaggacccugcugcuuccagucucaccuucugacucacucgggauccacugaacugggaggucugugucuccucccagcagagucaucacuaccuuuggggccgcaggaucacccagcuuggaacuagauacagaaaugcuguuuugagaguguacugaauaaaagauuacauguuugaaaacaagauugaguuuaagcuuccuaacuuggccuuggagcucucuugggcuucauucuaccccaucuaugguuuugggcugagcucuacuucuaccuuccucucacuccccuccaggccuuugcacaugcuguuacuccaggugacgcuguuacuccaggugacacuguuacuccaguugaccccaggccagcccccucccauaucugggcugugaaacucagggaauccugcucgcuccccgccagggccucucagacucugggcuccacccugagcaagucugggcuaugaggaguuucgggugagacuuggcagcugccgucucgcuaaggcccgcggcguucuggggaggggccacc

SEQ ID NO: 18394 - RNA, 1423 nt, Homo sapiens
uagauaucccggaguuccgcgcggcgccagcccuuccgccacggccgucucuggagagcagcagguaagugguuucccgcacugccgguauccgccgccauccggacucccggguccucugugcagguuggaggaugguugguuguggcgagcgaggcugaaggagccgggacgcggggcucugggccucgggaacugagccgguacucaccuccgccccuucuccccgucgcuguccgcagccauggcccuacgcuacccuauggccgugggccucaacaagggccacaaagugaccaagaacgugagcaagcccaggcacagccgacgccgcggggugagugcgggugccgcgcggagguugucggggguuucuuggagggcggagggcauggcuugggcaaaggcucucgaccugaaagaacgcgcguucgggcgcagaacuaaggggggcuugaauggaagagauggggugggggagugggacuuccugccuggugcucgaaggcgggcacccaucuggguuuuucccaaccgugcaauccacgcuggggcagagggagcaccuugagagcggcgcggggcagcggguuugggguucugacgcaggaguaggaguucgcucauggagcuggcccgagguugcggugugugagguugagggauuucaggugugucaguguauugggcgccuuuauuaagcgggcagcggguuugggguucugacgcaggaguaaggaguucgcucauggagcuggcccgagguugcggugugugagguugagggauuucaggugugucaguguauugggcgccuuuauucagcaggcagcccagacuccaggugcguccugccaguguugcggagacugggacuuagggaggaugggagcugcuccgggcgcggcgaaaagcgcuaggcguuaauaccuugguucucacagcuacccacagaggggaggaaguagccagggaaaucgcggcagcgcgagagaagcugcuuaacuagaaugcagggaucccccuacccugacggccgccccuuuccccccuagcgucugaccaaacacaccaaguucgugcgggacaugauucgggagguguguggcuuugccccguacgagcggcgcgccauggaguuacugaaggucuccaaggacaaacgggcccucaaauuuaucaagaaaaggguaggugggcgcugccggccgaggggcggggugggaugggagucagggccgggcugacggcggccucgucccuggcagguggggacgcacauccgcgccaagaggaagcgggaggagcugagcaacguacuggccgccaugaggaaagcugcugccaagaaagacugagccccuccccugcccucucccugaaauaaagaacagcuugacagaagcccuggcucuccugcugu

SEQ ID NO: 18395 - RNA, 6697 nt, Homo sapiens
aguaaccccacgaccucccugcggccucggcccuccacccucggggcccggccggcgcucaccagcgacgcuggcaauacugguggugcuguaggcuuugcgguggcaaucggugccaucggggauaucccaguacugacgaaaaaccuucggcgccauagcccgcaaucucgaucccgcaccacggaccccgccagcucgggaagcgcaagggcagccgcggcuggcuaucgcgagacuucucgggcugcgcgcgcaaccuuucgggcuagcgggccggcaacaagugagcaacuuuauugauaggcgcggacauggacauggaucgcgcgcacgcgccggggaccggccuggaggaagagaguagcacgugcauccccaggccgauuccuagagggugaaacugaggacgacugcgaucagugcagacagauuucgcuagucccagcucagggaguccuagguuagggacuacuagaggcggggacuaucuacuaggggaggggccgggcucagacugggacgggcgggacuccaguugauaggagcaagacaugacgaaacaaugacuggggggcggggcauggcggggauguggccacacccagugucagaaucugcauagcgaguggucaugcccuguggucagucaccaagcuggagucugagcagcgugcuacuguuuugggccguggacaggaucaggggcggggauuaucgggaaagugaccaaugacaauacgagaagcucagcgggacguggccucuguucaccccgcggcugucccacgcccuaggccggaugaaguacacaggcgcuugacuugggggcguggcuagaauuggaggcauaaccuaaaagggacuugaccaaucugagacuguauaagggaugaaggggcgaggccgugccuggaucuaccccugacaggccacagguucggggggcguggucaggcuugcuguuucgcggaguccgggccaauccugguguuagcuuccaaguagggaggggacaguaucgaaggugugaccaaucuuguuuccagagccugaguugcgcgagccgccaaaggauguggccagccugggggcguggcugucaagaucuuguccaauccuagagugagcccaaacucaggggcggaguuucaugaucccggaaccggugguaguguuuggguuugaggagagcacgacccagcccucugggguggggucuagcggggucagcgaccaaucgcgccgaggucuaguggggcggggcccucccgggggcggggccugugccaguuccgggccgccugggggcguggccgggccuguacagcagccugggccaugucggcgccgccggcccugcagauccgggaggcaaacgcacaccuggcagccgugcaccggcgcgcagcggagcuggaggcgcggcuggacgcggcggagcgcacggugcacgcccaagccgagcgccuggcccuccacgaccagcagcugcgcgccgcccuagacgaacugggucgcgccaaggaccggugaggcccggggccggccagguggacuucaccgaggcgguaggcggaggcagagccgaggcuggaaagcgaggaagggcagggggaaccgugugcacuuguauagacgcuagacugaguaucggauugauaaaaacaccaaaaaacucgaauuaguaaucaguauguaaaguugcgagaagugacacagguguggaccucuaacuucaaacaggcccacuuucccacaggugcugagcgacgcagggaccacagaccgcccagcguaggcauugggagccauagcaggcucuucagcaggggaggaggggaucauaucagcauuuuaacuuuuaaaauuuauuauuauuuuuuugagacggaguuucgcucuugucgccuaggcuggagugcaguggcgugaucucagcucacugcaaccuccaccucccagauucaagcgauucuccugccucagccucccguguagcugggauuacaggcgcccgccaccacgcccggucgauuuuuuguauuucuaguagagacugguuuucgucacguugugcaggcuggucucuaacuccugaccucaggugauccgcccgccucagccuccuaaaagugcugggauuacaggggugagccaccgcacccggccuaaauuuauuauuuuugaggcagggccucacuccuaugcccaggcuggagugcaccucgaccuccggagcucaggugauucucccaccucagucucccaagcagcugggacuacaggcguccaccaccacgcauggcuuauuuuuuguauuuuuuuguagagacaguuuugcccuguugcccaguuuggucuugaacuccugggcucaagcaguccucccaccucacccuuccaaagugcugggauuacaggcuaagccaccaugccuaucuauuauuuuugagagagggucuugcucuguugcccaggcuggaaugcaguggugcgaucucgacucacugcagucucacccucccuccucagccucucaaguagcugggauuacaggcgugcgacagcacaccuggcugauuuaaaaaaaaaaauccuuuagaaauggggucagacuauguugccuaggcuggccuugaacuccugggcucaagugauccuccugccucagccucccgaagugcugggauuauaggcacgagccaccaugcuggcccauaucagcauuguugaagagucccucugacagcugaggaugaaagagaugagacaggcacccagggaggugggaggagcugggucccaggugggaacuauuacuucagagcuaauuggacauauucauuuuuaccgagcaccugcucugugccaggcacucauucauucgucuucauugagcaccuacugugugucaggcauucugcugaguacuggagcacaucaguaagacuuagccuugcccauuggguauccacaguccaguggagagacagacaugucacugggcaguuacaucauugguggccagcggccaugauggaggggcauauggggcucugagggaucucagagugaaggcuucccagaggaagagccuacuaagaauaggugggaaaagauaauggaaaggaacgaacugcaggaagagugaggggacgaaaugaggguucucauaagaaaaugccauaaacuggcugggugguggcucacgccuguaaucccagcacuuuggaaggcugaggcaggcagaucaccugaggucaggaguucgagaccagccuggccaacauggcgaaacccugucucuacuaaaaauacaaaaaaauuagcugggugugguggcacacgccuguagucccagcuacucgggagguugaggcacgagaaucgcuugaacccaggaggcggaaguugcagugagccgaaauugugccacugcacuccagccugggcaacagagagagacucugucucaaacaaacaaaaaaacaaaaugccauaaauuaaguggcuuaaacaagagguuuguuucucagcguucuggaggcuggacguccgagagcagggugccagcauggucagguuaugggagggcccucuuccgggcuugcagauuucuggcuucucucuguguccucacagggcagagagagccagggaguucuuuuguaucucuucauauaagcacacuaaucccaucauagagacccccacccugacaaccucaucuaacccuaaucaccuccaaaaagcuccaucucuaaauacccuucugcuaugguuagacuuuguguuuccacccaaaugucagcuugaauuguaaucccauaaugcccacgugguguggaaggaacuggugggagguaaaugaaucaugggggaugguuuccccuucaugcuauucucaugauagugagugaguucucaugagaucugauggcugggcgcaauggcucacgccuauacucucagcacuuugggaggccgaagcggucagaucaccugaggucaagaauuugagaccagccuggccaacauggugaaacccugucucuacuaaaaaaaaaaaaaaaaaaaaaaaaaauuagcugggcaugguggcacacgccugcagucccagcuacuggggaggcugaggaggcagaauugcuugaacucgggaggcggagguugcagugagccgagaucacaccacugcacuccagccuggaugacagagcuagauuccgucucaaucaauaagggagaucugaugguuuuauaagggauucccccuuugcuggucucucacugucucuccugcugcccuauaaagagguuccuuccaucaugauuguaaguuucccgaggccacccccagccauguggaaaugugagucaauuacaccucuuuauaaaucacccaguaucagguauguccuuagagcaucgugagaauggacuaauacaccucccauugggguuaggacuucaucauaugaauuuuggggagacagaaagaugcaguucaggcuggguacaguggcucagccuguaaucccaguacuuugggaggccaaggcggguggaucacuugaggucaggaguuuaagaccagucuggccaacauggcaaaaccuugucucuacuaaaaauacaaaaaucagucaggcaugguggcgcaugccuguaaacccagcuacucgggagguugaggaggacaguuugaaccugggaggcagagguugcacugaacuccagccugggcaacagagcgagacugucucagaaauuauaauaauaggcugggcgugguggcucacgccuguaaucccagcacuuugagaggccauggcggguggaucacguggucaggaguucgagaccagccuggccagcauggugaaaccccaucucuacugaagauacaaaaaacuagccgggcauaguggugggcaccuguaaucccagcuacuagggaggcugaggcaggagaauugcuugaacccuggagccggaaguugcagugagcugagauugcaccauugcacuccagccugggcgacagagcuagacuucgucucaaaaaaaaauaauaauaaaauaaaauauaauaauaauaauaaaaacaaagaaacauucuguucauaaccagggaggacccugaggcaguggugaggaaugcgggcuuuaucccaaaggugauggggaaccucuugcggguccagagcagggaggagcaggugcugugguccucaguucuguaaucaccuccucuugccuuccugccagugagauugccacacuccaggagcagcugaugaccucagaagccacuguccacagccugcaggccaccgugcaccagagggacgagcucauuaggcaguugcagccccgggcugagcugcugcaggacaucugccgccgccggccaccccuggcugggcugcuggaugcccuggcugaggcugagcgccuggggccccugccggccagugaccccggccacccaccccccggugggccugguccaccccuugacaacagcacuggggaagaggcggacagggaccaccuccagccugcaguguuugggaccacagugugagcccggaaugcagauuacagaauggagacagaaagccacugcugucaguguccuugggagucaccagcacccugcagggggacccuacggcagagccaaaguccugucuaagcaucagaacaggcugaacagucaaaaaguuuucaaauaggcccacaggccaggugcagacguuuaacccagacagaaguguucuuguuuguuuuuaagcuuugaaucagucacccuugcuaaaaaccuggcaaugcaaacacaaagaucuggauuucuggcaagacuuggccaagcuugccuggaguucagggcacccucuuuagccagggugugaguuucuguuuuuuguuuuuuuuuuuuuaagacagagucccacucugucgcccuggcuggggugcaguggugcgauuuuggcuaacugcaaccuccgccucccagguucaagcgauucuccugucucauccuucagaguagcugggauuacaggcgcccaccaccacacccggauauuuuauauuuuugguagagaccggggaggggaggggguuucaccauguugaccaggcuggucucaaacuccugaccuuaggugauccacccgccucggccuucgaaagugcugcaguuauagguguaagccaccgcgcccggcccuagccuagcuuuuguagcaugcaacugucuccuuuuuauacgcccuaaagaauauauuuuugaacuccuuguuucugcgcuguccuucuuagcccaggacauucagggugcuuugcuuguugucaaaccagggaaaggagaaaacuccugugccuuucugggccagccugucacccuggccuggucggcagccauuccccuaccuccucacucaggaacugucacaccaggaaccggcgaggggcacagccuguuucagaccagaaaggucggaggccacccacggccuucaggauggcgcccgccugccugccuggcaacagugaccccucagugcaguaacaaugggcccauuuucuccucuggaugaacaaggagggggguuguuuguacaaaggaaaggcaggcuggggccugucugugcucaagaauaaaccggaugauuuccuggccugg

SEQ ID NO: 18396 - RNA, 1790 nt, Homo sapiens
cugaaaggucaaaugugcuuuaaugcgggguggcucccagguccucccugggccccgggggaguggcgcuggcugggccugccggcugccuggccuuccuucccggcuuucccuucuuggccgucgaggccuuucucuugccagacagaaugggggccgggguguugguggcagggggccccggguggggcggcugcuccucgucgagcgccuugaaguugaagaaguagucaacguuggacacgguguccaggaucucaggcacgcuguagucaaaggacagcagcuccucgggcaggcacagcgagcggaugucaucggcugaguucccaccacugcugucaggcagggccggcccagggaccucgcacaggguacccucaggcucagaggcgccuggcaggcagucgaagagcuucauggcguccuccagcagaaccuugucaggcagugccaaagcucuggccgucuugggggccuuggccuugccugcucccagcagggcccccuccuugaccucggccaccuugagcucgcugaggcccgguggguacaggggcaccccaggucgggccccacugcccugcagcuccuugacggggaaggccagggguucgggcccagggaaguggccgaggugacccuggagguggcuguaggcgucugggggcagugugggcucugcaggcagcgugaugaguacagggggcggcuuguucuccuugggggguggggguggcagcggggccgggccuuccucuaggggcgguaggggcagcuccacgaaggcggcgggcccugcgucccccacaaaacccagagccucuggcccggggcccucaggcgggaaguagggcaagagaaacuggggccccccgggugccugcugguaguggggguauggaggcagccccggggccuugagguagggcugaggcuccaggagguagcugccuggggcggaggggacccccgcuggccccccgcugcuugcugccagcuuauacagggcugacuggcccaggucgggggugguccacucgauccgauagaugcgggggucgaagaagcacccgcauggggccaucuggaaaccugugggcggcaggcgggugcccugagagcagcugcugccugaggggcccagcccaagccugggggccuguuugggagaugccacaagaaccuugccauuggggggccccuuugggggacgacauagauauugcuuuggggcccuggcugggugauggaugacacagagcuugucuuuggggcucaucugggggaccugugugaagcauggggagcagaggccaugccuucaggcucccacuuagggacggggcaggggcaagaugggccugcacacucaaacccacucccagccucgucaagggcucaggggaggccgguaccugcugguggggcuggaaacaccucuuucucugggucugggggaugauacagguucaaggagccuguggacaaaggugcccagguggguagggcccuuaggcgggugggccccugaacccucuccagcaggugcucccacccacccgaucguacccauagcgggaggaggcucggcacaggugggagcaggcugguugcccagcaccucagcccccuccagacucugcgggcugaaaccuuccuggggagcugcaggggcacagaacgguuuggggugcugcauggggcagcggggggcccgguccagacaggccaggagggcggcagugggagugcaaguggcccaaccggagaacaggcugagaaccugg

SEQ ID NO: 18397 - RNA, 2460 nt, Homo sapiens
caacccugcccucucucaugaccccgcuccgggauuauggccgggacugggcugcuggcgcugcggacgcugccagggcccagcugggugcgaggcucgggcccuuccgugcugagccgccugcaggacgcggccguggugcggccuggcuuccugagcacggcagaggaggagacgcugagccgagaacuggagcccgagcugcgccgccgccgcuacgaauacgaucacugggacgcggugagaccggcagcgccgggggcgagggacgggggcucgucgggggcgcggccuggggacguggagcaucagauggggcggggacacgcugggggcgguaccuagagcggggauuuggagcggggacagaggagacgagcgccgggaccgggcagggccacacugggggcgguuacaguaccguuuagcgugggggcggggcuacggugcugggguuguggggccaggggggucgggcgcagggauggggcggggccacgcuggggcggggacaaaggagacagcgcagggauggggcgggggcacucugggggcgggacaggaggcgagcguagggacggggcguggccacgcugggggcggggacaguggggaccagugcugggauggggcguggccacgcuugggggcgguuacagcgcagucgagcguggggguggggccagggagucggguguaggguuggggugcgauuacgcugcuagcaguuacagugcagaagaacguggcggcugggauuggggcguggucaggucgucgagcgcauggauggggcggggccaagcuuggggcgggguccguggagucaagcgccgggauggguuggggccaugcugugggggggacggggaagucgagguuuagagagggcagaaccacgcugggggcggagauaggggagacacaugcugggauggggcagggccuuuuuggggucgguagcuauugcagggauuugggagcugggcuauggugggggcugggcugaaacucuggcugugggaggggcgggaccugggggaugaggaccuuggggucagggagagcacuuuugcgaccugggaccaagguuaggggcggaaacggauguggagccagaugauguugagagacagagacaggacacuuggguggggucaaguuguagggagauucagccaauugaaugcuggggccgggccagcauuggggaccuggaauuguagccucagggugaguacuaaggacugaggucacaccuagguagggccauaguugaggggcuaggggaguuugaguugagggcagggucaagagucacauagggaaaccagccccuugccguuuucugccccuccuugccucaguuuccuuguucccucugggagcucccaggcuuaaccgagcucucugugcaggccauccacggcuuccgagagacagagaagucgcgcuggucagaagccagccgggccauccugcagcgcgugcaggcggccgccuuuggccccggccagacccugcucuccuccgugcacgugcuggaccuggaagcccgcggcuacaucaagccccacguggacagcaucaaggugggcagaggacggugccuuggcacucccagccaggggguaggcaggcccgguuagauccugacccauccccacgccucuuuugcaguucugcggggccaccaucgccggccugucucuccugucucccagcguuaugcggcuggugcacacccaggagccgggggaguggcuggaacucuugcuggagccgggcucccucuacauccuuagguaccuccauccaggcagcacccaccccuccaagaaugugccauccgcccacccugugcccuggguacuuucccucaauccagcccuccccgaagacgccuuuaccccagggucugugugggaggcagcagggggcuggaauccaggaggcuggaauccaggucugccuggagcaggggcugcccuccuugcacccagucacagccuguuucuuccugcaggggcucagcccguuaugacuucucccaugagauccuucgggaugaagaguccuucuuuggggaacgccggauuccccggggccggcgcaucuccgugaucugccgcucccucccugagggcauggggccaggggagucuggacagccgcccccagccugcugacccccagcuuucuacagacaccagauuugugaauaaaguuggggaauggacagccuaacugggacauugcaguggcugcuugcuggggccgggauuugcaggggaacccaggauggcacuggcccauagggagcuccagguguggcuggcuggacacauggucaaagucacaaggccgggagagugguguccuuuauugcacucacugcuggucgccccagcccacuccccuccucguugucucugcauccaggucuccaauaaauaaguc

SEQ ID NO: 18398 - RNA, 11481 nt, Homo sapiens
ggagguuuuguuaucauuuauuugugaaguuaaaaacgagcgauaaaaaguaaaaacugccauacaauuuuuuuuguuguucucauuuuguuuucaguuucaaucuccucuugaacagaugaaaagacaacagaccaguccugggaggggggacgggcggggccgcgggagcugagccagggcgggagggagagaagagggggcuuggcugcugggggaagggguccugcaauacaacaccugguccaaggaauguuccaccucuaacuaaaaaaaagaaauagcaagagugacuuuuuuuuuuccuuuuuaaaaguuuauuuuaaaaacaagagggccgagggugggagaaaaugaauugcuuuauccucagagaggcagguucaggaaggcuggggggugaagaauagagacuuuuuaauauauauauauauaauuuuauaaguucugcuuugcucuuuguguuuuuaauuuuuaaguuuuuuuuuuuuuuuggcagagauuuagaucucgcuaucuucucuggcuggcucaacauggaaggaucccaauuuugaaagaaaaagcaugugagacacagaacaggcgagagagugagggcccggcaugcccccaagucccccccacccugcuugccgcgagggcuccccaguacuccccacggcagccaucgcucucucgccaaacaaaacagaagcccccaaacagaacaaaauggaaaaaaaaaagauuuuucacagaugaagaaguucacauucauucgauucauugagccugcggagagggaagagauaggaauuggucacuacggggagggaagggugggagacuagggggcggaagagaggaggggcuggaacaccguggggggggccaggaagcccccucccaaaccugcgcuggcucaggcuggaaggacgugcuuguuaacugucuagccaggugcucgcgggacucgcugaagucacgcugcucccugauggagaaggagggacagagcaggaagagaggagaggggccgcggagggcggaggcgcuagggucguaggggagcugcccugucuccggagggcgguggcucccggcgcagcacgacgacaugaacaauccagagaucaugguguccccacaacaccccugugagguagguuggaagguggcaacgaucuucacgcccacuucacagacaagcccgggacacaggcaagcgcgagcgcaugggaggcugagcccggcggggcaggggccugggccgcuccccgcguccccaccagucccugccagagccaggccgccugcaacacagucacuuggacacaggaaaaaagaucauggguuuaaaaaauaaaagaauaaaaagaacaaaaaccaaaaaagugaugcagagaaggggaaaaaauagacguuuucuucccaaguggccagauugugagcgaggugguggcggccgggccggugcccaccguccgcgcugucugccugccccccgacuccccagcaguucagaagucccgccugcgagucucagcgcuccccagcaucacgacagcggcacacaggaacaagcagccggcgcagggaggccucuucguuuaaccucuggacccagcgaaugcuucccuggcggugcguggggacucccggagaccuccggccacacggcccccgcugcaggcaucaagggcacaccccgcaggggaagggguuuccggcgcuacccacuaaggcaggauggacgguggccggggguuggaaggagaaaggaggaggaggaggguggcaauucccacuugccugcugcugucccugcugcgugggcggcggcugggggccgccaggaccuggggucuguccguaguaagcggccugcugucuguaauauuccgcccaggcggcacuguagucuggcugggagccugggggagcuccuggacccccuccgguggccacuugcgcuguggguggacaaaggcaggugagaggcugugggugagggcugccccugccccuguccccgcaugguggccacucaccuugcuucuuguaguacuccucccaagccuucguguaguccugcugugggggugcuccgggcugcuggggcugcuggccugugcgggcgccgagacaggucagaaaccacucccccggcagggcuggagcccccccgccacccugcagacucaccgaucuuuuuguaauacucuucccaggccuuaguguaguccgacuggccggugggugggggcugagggggcucacccugagccgguggggccgcaggggccggugcggggccggggacggggcccgggggcugcugguaguagugugaguaguaggcggcccacgcggcguugggguccgcggccgcugcagcugcuuugccugcaggagauaccucgggugagacggggggacagaacagggccugcccuccgccagguggcccaucacuuacuugggucaugaggagcaggcggcugccacuggggguagguauugccccagcccugggguggguacuggugaggagggggccccccggcacugcaggagagaagaaagggaugcuugagcaguggugcggggguggccgcagccggaccaccugggguggggauguuuuucaguggggaggcgccagagacccagaccaccaggcucaacggggcgccugggaaaggccuagacaagaagcaacucgaaggacgcgcagcgucagcuugaggacaugaaagaagccgcgaaacuugcacgugcacagagggaugcugaaaggcacaugcucuaccaguagacaggagagggccuguugaugguauccacaaaaaugggcuggaugaggccccccgccugcacuucuagggaaagggaaauggggucugcuauucuucuugccagcucaguaagcccccggccucaaaacccaggaggcagaggauacucacugugggggagccccggguggccccugguugaagggcccaggauugaagggccccauugggccagcagggccugggccaccugggccugguccaacugggcagagaggacccuagaaggaaggagaguaaccaagguaagugggcugggauccgggcugugagaccaaauccccagagcccgccccaacccaccucgaucuuuuccucgauaagcugcuuggcguggucaaucugcuggggugaaccccggaugaugaacaacuugaaguugggguccccguuggguggcagcugccgggagaucucuacgaaggcucccgucugcugguuuauggcuuucacauucucgccaccugcagaaacgcagaaggugaagguggccugcagugauggcccagggaagagggggcaagggauagggugcagggggccacacucaccucggccgaugaccagcccacacuugugaguggggauggagaaggucaucuccccgccagggggaccccaauugccuuggccucuuccucggccucggccccccgggggcaugccuggacccccuggaggaccugggggaccacucugcaagacaagaggaggaggaggaugaugaacccuggaagccggucuggucuugcacuccccuggaggcccugccagccccuucagcacccggggccaccuacccugaggcucuggaggaggucguugaugauccgggcugcgugcucgcaccugucugggggccccauuauaugagcaaucuucucgggcccugucccgucaucugaggccagcaccgagagagcagagacacaaguuuaaaagaagagcccaccccagagcccugcaacgccgccuccagcgcagacaccacgccggccugagaucucagacgcgcugcgccgcucccagccuccacucgcucagggauugagggggaggcggcccacauucccagagaaggaaacccacggccaagccaggagguggcucaagcuucuuccagcacacagcacccccagcacugagagauuuuacagaacaauaaaucucugaaaagccagaggggcccuucuccccacggcaggcagcucagagacugccugaggacuggcaagagcccagagcugagguggagugcccugauccagccugcggggcacccagggcuguccugucaggauaggcuccaucguagggggaggaagaggagaucugauagggauaggaacacacguucccccuggauguggaaagcccucaugugucugucccagagaagagaagggacuggccauguucugacggcuggacuaagagccgugaggugcuauggaggccaccuggcugaccacggugcccagcucccucagagccugccucccaaagagggugggggugcacuggccaggggcagggugggccaggcccugaccuugcuugaacuguauccgcacgccagcaucauucuggaucuucuugaucaucucuccacuccggccaaugaccacgccaacagaaugccugggcacuggcaccuggggagggaggcagcagcgucagcucggcccgcagcucugcugcccucugcugcccacuggccacaaggagccacucaccccggccccucccuccacuggcgggggagaggggggugaaggcagggcccacacucacaucgaugccuccgccaauccgagauccguacucauuccgguccccaaagccgccuuggucacguucccggaggauguccaucaccaucucacaggcuugcugcaaacacacaggaagcagcccccaugggugagcccugcugccccacacccccccaccuccucgggggugcgggccucaacuaaggacccacgaacccugggugagcccagcacagcacccuacugagcucucuaccugccacuuuaauggggaggcacuaccagcagccccguuuccagauaaaaaagcagaaggucagaggugaggccggugccucacacacacaaagcugggagucaguucagggccauccuacgagccagcgcucuugcaagccucuugguguuaugaccgacuguucacauaucucucuggcggaaugcagaccccgagaccgcuggcccugcccaccugcccgugccucuccagaacccccuccaccaccccagggcgugcucaccugcacuuuguaaggauccccaaugaugcggagagguuuguccacauucguauucugagauccguccugaauuaagaucaucuucacuccagcgcguuccuuuacaagcaagguuaaccguuagugcugggcucucccaggacuuccugggcugcuguggugguggcggugggguguggcacacggaugcagaggaagcugcccaggugcugcccucaccugcagcugcuuaauggucuccccgcccuugccaaugaccaggccggccuugcccgcggggaucaugaucuccugcacggugccguucuggcccccguuggcguugucguggaacuguccuggggggcccccacgaccccgagacacaaugucauccagcaucaucuuggcuuuccugggaaggggaggagcgggggaugagcgggugccaccgcuggagaaagguacuggucugguggcccacccagcucaaagggaaggcgaccccagagugugcaaggaugacagggaagaggggccagucacaggggcuguucaggcuccagguuccccaggucuugggcugccggggaaucagccucauguuaacauggcugucuggagaugggggcaagaauggaggacauggcgugcaaguugcucccaacuuucaauucaaacggacagagcaggcuucugccugccccccacaucacaaugagaggcccuguggggacuuacuggacagauucuggggcuccugucaaggacacacugcgcucggguaggccaccgcugucugaaaagaggagauagagucagugcccucccuggcccacaggcagagaaaggccugccuuggacacgaggaaacuuucagaacaaccaagggccacuucugucccauucagugccugacagaucaguuuacuuccccuaaacaccugggaggcugcucgaugcaaggccaagguugggaagagaucccagaagggagguaggacuuuaagggaaaaggaugagguggagggaguugcagauuccagaagguccaggagccggccacccccacuaccaaugaugaccagagccgcuucuauagacaacacgugcuacacgcccaaggaagccucagaacccccuacccagcaggcuuucuguagcucaggacucugagauucgaaagguaacuacauugccugagagcagaugugcagccagaaccgggauuugcuccugggccugaccucagagugaccccucuguccaaggcaccacccugucucacgcagucuugccggggugcuuucacccacgcggcaggucagugcagugcgucgaagcucggugucuggaaccaggccccugugcgaaaugcuagcccugccaccucaguccauacccacccacugaaaauaaaaaaagucacagcugugccccgugggcaguacuaguggagugagauacugcacugagccugguccguaguaagcaccaacaagcgccagcucgcuuccuguccacaguccccguggaaauuaaguaauuaaaggaaagugcaaagggcccaacccuggcccccacucuggcaggaaccugacgcucuuauaccuggagaaaucuguacuuugcagccugaauccuguuggauuuuguuaauuuguucaccuccucugccaaugacuggauggagaaagaaggagaaaagcaaagcgugaugagggaagggagcccaggccucaggagacuguguggccggggccccagccccucugacguucaggagggcagcaguccucuagagagcuccuguccucugcccagaggggacgaaggagggacaaaugagaacagcacauaggagcccucucagaccagggcuucugggcuggcaggagcucacaggacacuuccuccuggggaagagugggccuccccacccaaggugacccacacucacucaggcccaccaugccgucugggacccuguacucuucugucauugaaguccuguaaagagacacgccaaaggucaguccucaagugggaagggaggaggacagcagcucuggaaggucuacuugaagccaaggccaccauaggucuaagcagagucugaccacacaggccacaaaacugccaaggccucaguuuccccaucugugccccgagaggcuugcucugggcauugugggccuuggccuggugccgucccauugauucagggcgagagggagcacugaguagcaagcugacagucacucuaugucucucaguucuaaaaagcuggcuguauguccuuuucaucuuauuuuccuaguauuuuaugaaacuacuggcccauuaaaaacaaacaaacaaaaaaugaccccugacaacugcccugugucagguucaccucaguccaucugguggggcaaagagguggcaaagagcccugagcuccacagcacugagugggaugggcacuugcagaugugugagggagggaagcaaggcccuccuagccucuuccaggaagacgacauuugugcugcucagaguccccaccccagcggaggaagccauagggugcggagaccacccuaucacuacagugacugccacgacgcuccccucccacagcccuucagacaagggguacgaggaacggacacagcuccucugccucauucccgucugagcacucuggucaacuggcacugggggauaaaaccugagagaugugcccccagucagagcccucccaagucagcagaaaggccagucugcuggccaacagacaagaaagcagugugggccccaccauggcuuaccuugggggaggauggauggguccaaguugagaacugauugcuguagagagaaaacccaaagcaaagacuggcuuagcuccuccucgggcacuuggcacugccugccccgggucagugggagcugagcccggcaccacgguccccagccugcuccagugccucauggaugcuguggauuccuccccauaaaagcacagagcucaucucccucaauuucaggguuccugggaucccucaaacguaugggccccagaaugaagcaccaggggccucuguaaagagcugccaccuccucagugcuuccagcuccugacuccugaaaaccucaacccucugaagccacauaucugccaccagacccccuggacuuacagucucccugggaagccagcuucuugcucuccgguugaucugggaaagagagaggauggcagaugcagcacccacccacccacggccgccucgaaccugaugcuggugccacauguccaagguaaacagugccccucggcccccacccuuaacaggagcugagacaggagcccaggagagacuggccccugagggaggccagaccccgccaauuccgccaccaacgcucagaguaaaaaagccuucagaacacgcaaccaccaccaggcaccugaguccucccgguuuaggacaggaccugccucuagcagggagggugucguggauaacaguggaguuggucaggguugaucauccgcuacuuggggucacacuacgcaccccagagcugggccaacuucacaucaagccucaguaacugcuccagguugccucagccucccagaaagggaggaaucaucuugggaacuuacaacuucgacccagucacaaucaaucugcccuccucucugccaccugauaccucaggauggcagacggaacaagaagaauuaacaaggccgggauugcugagguuuuaaaagaccaaacaacagugacacccacccccucugaaccacacucaaacaaaagcaccucuuuaggcccccagcccuuccuccuaagcuaaaggcagcagcagggaguuaccuccaucuuccaacugucucuuuuggcccccaaaaccaaaaucaggagugcuguuauucacugucguggcagcaucgccuccaauuuuggcugcaaucuagaauaaaguaguaagcacagaagaauuaccaccaaaaacaacccuccauggcacccaggucaacuucucagaacaucuccuggacacgaaagcccaucaggucuuggugucuggcccuccaacuuagggaagagucaguugguuaagacauccuaggaguuuugaaccuaggccucaagguucucaccaguuaacugggaauaucaaaauuccccucuucccuucuccugggauuugugucuuaauuguggccagcccauaauccacacugacuucguucuaggggugacaaggaacagaggcucaggugucagggaggguucccaggucaucuccaagagcuuucagacacuuccuccugccaguggccccagcucagaaaaccagaaaguguguuuuuuuuuagccccguuuuccugggaugcugaagaguucaauuuuccccuaucucccccacucucaaaauccuuuuaucaauuuauugaauaaauuugagcaaagcgaucacuucaagggauaugaaauccucauuugaccaaaacagaagacucucuggauggcugggcacugugacuuaugccuguaaucccagcauuuugggaggccgaggcgggcagaucacuugaacucaggaguucgagacagacuggcugacauggucaaacuccaucucuacuaaaaauacaaaaauuagcugggugugguggugcacacuuauaaucccagcuacucgggaggcugaggcaggaggagcacuucaacuggagagguggaggcuguggugugcugagaucgugccacugcaccccugccugggugauauugagacuguuuccaaaaaacaaacaaacaaacaaaaaaccaagacucuaugggacacaaguuacaucucagacacgugaagagcaacuuuaaagaaaccucaacccagcaaacuuaggaucagagucugggguuuagaaacccaaaccauguuaagaaucucccuuuccaccagucuccauuuuucuacgcugcccuagagccaaaacucaugggaugcccacagggggccuguccccaccaacugacagcaccagcuuccucccuucaagcugucccagaaucagacgguuccaugggcaauaagaccaaaugcacgcuagaacccacccaacuccaagggugagagagacgacagagggccagaacacaggcguucacuuaacgggaccucccaccuugggaggagccagucucuagccccggaggcauugggacagcccaggagccggucggcggcaaaguccucccauucuaccgacccccaccccuccaggccauggggaggcugcaaauggagcuggagaggucaguccuagcagcaugugacacuuccuugucauuacgccucaauacacgggggugggagacccucccuucuuucccccaaagagacagaccacgcuuucaagccaccaaagcauccaagagccaguccccaugcucgucuuccccauuucgcccaagugcucagcccuagacagguccccauccacuuucccgacugaagaggaaggacugucccucccacccccacaaugucccuuucuccuagagaggggacagaaaugggacuggguugggggcaaacacugcccuuugcccugauauggaggggagaguaaaggcccuccgcccgggaagguggaccccugccuccaggcauguccuaaggccggggggcuaaggggggggucccaaaagugcgucuccgagcuccggggcgccugcacacccaggcgccgcuccuggugacccccagugcgccccuacucccugcaggggggucacccguugggaucccacucgaggcgcagcgggagggccaggcccccgccuaccgcccacgugaccccgcgacggccccggccccccuccgcgacccugcgcgcgcgcgcgcacgugacccccgcccccucccccgccugcgcgcgcgcgcgagcgcgccccucaggcccucggccuccucaccuggcgggcccgcugcacggcgucggcgaaagcguccuugcggauucccgggccgccuccgccggguggcugagaggggcccccggccgaccccccgcccgggccgccgccgccgggaccgccgccgccccggucccccgcgccuggcgggcccggcggagggccucccccggcgccuccggcucccccgcccccgccggcgggcggcggcggcccgggcggggguccucccgugcuguaguccgacauggcgcggcggggccgggccuggcgcggaggcugaagcugaggaggcggcggcggcggcggcggcucaacgcgggaacaaggccucgcuccacacggccgcggagcacucugggaacccagccgcug

SEQ ID NO: 18399 - RNA, 11481 nt, Homo sapiens
cagcggcuggguucccagagugcuccgcggccguguggagcgaggccuuguucccgcguugagccgccgccgccgccgccgccuccucagcuucagccuccgcgccaggcccggccccgccgcgccaugucggacuacagcacgggaggacccccgcccgggccgccgccgcccgccggcgggggcgggggagccggaggcgccgggggaggcccuccgccgggcccgccaggcgcgggggaccggggcggcggcggucccggcggcggcggcccgggcggggggucggccgggggccccucucagccacccggcggaggcggcccgggaauccgcaaggacgcuuucgccgacgccgugcagcgggcccgccaggugaggaggccgagggccugaggggcgcgcucgcgcgcgcgcgcaggcgggggagggggcgggggucacgugcgcgcgcgcgcgcagggucgcggaggggggccggggccgucgcggggucacgugggcgguaggcgggggccuggcccucccgcugcgccucgagugggaucccaacgggugaccccccugcagggaguaggggcgcacugggggucaccaggagcggcgccugggugugcaggcgccccggagcucggagacgcacuuuugggaccccccccuuagccccccggccuuaggacaugccuggaggcagggguccaccuucccgggcggagggccuuuacucuccccuccauaucagggcaaagggcaguguuugcccccaacccagucccauuucuguccccucucuaggagaaagggacauugugggggugggagggacaguccuuccucuucagucgggaaaguggauggggaccugucuagggcugagcacuugggcgaaauggggaagacgagcauggggacuggcucuuggaugcuuugguggcuugaaagcguggucugucucuuugggggaaagaagggagggucucccacccccguguauugaggcguaaugacaaggaagugucacaugcugcuaggacugaccucuccagcuccauuugcagccuccccauggccuggaggggugggggucgguagaaugggaggacuuugccgccgaccggcuccugggcugucccaaugccuccggggcuagagacuggcuccucccaaggugggaggucccguuaagugaacgccuguguucuggcccucugucgucucucucacccuuggaguuggguggguucuagcgugcauuuggucuuauugcccauggaaccgucugauucugggacagcuugaagggaggaagcuggugcugucaguugguggggacaggcccccugugggcaucccaugaguuuuggcucuagggcagcguagaaaaauggagacugguggaaagggagauucuuaacaugguuuggguuucuaaaccccagacucugauccuaaguuugcuggguugagguuucuuuaaaguugcucuucacgugucugagauguaacuugugucccauagagucuugguuuuuuguuuguuuguuuguuuuuuggaaacagucucaauaucacccaggcaggggugcaguggcacgaucucagcacaccacagccuccaccucuccaguugaagugcuccuccugccucagccucccgaguagcugggauuauaagugugcaccaccacacccagcuaauuuuuguauuuuuaguagagauggaguuugaccaugucagccagucugucucgaacuccugaguucaagugaucugcccgccucggccucccaaaaugcugggauuacaggcauaagucacagugcccagccauccagagagucuucuguuuuggucaaaugaggauuucauaucccuugaagugaucgcuuugcucaaauuuauucaauaaauugauaaaaggauuuugagagugggggagauaggggaaaauugaacucuucagcaucccaggaaaacggggcuaaaaaaaaacacacuuucugguuuucugagcuggggccacuggcaggaggaagugucugaaagcucuuggagaugaccugggaacccucccugacaccugagccucuguuccuugucaccccuagaacgaagucaguguggauuaugggcuggccacaauuaagacacaaaucccaggagaagggaagaggggaauuuugauauucccaguuaacuggugagaaccuugaggccuagguucaaaacuccuaggaugucuuaaccaacugacucuucccuaaguuggagggccagacaccaagaccugaugggcuuucguguccaggagauguucugagaaguugaccugggugccauggaggguuguuuuuggugguaauucuucugugcuuacuacuuuauucuagauugcagccaaaauuggaggcgaugcugccacgacagugaauaacagcacuccugauuuugguuuugggggccaaaagagacaguuggaagauggagguaacucccugcugcugccuuuagcuuaggaggaagggcugggggccuaaagaggugcuuuuguuugagugugguucagagggggugggugucacuguuguuuggucuuuuaaaaccucagcaaucccggccuuguuaauucuucuuguuccgucugccauccugagguaucagguggcagagaggagggcagauugauugugacugggucgaaguuguaaguucccaagaugauuccucccuuucugggaggcugaggcaaccuggagcaguuacugaggcuugaugugaaguuggcccagcucuggggugcguagugugaccccaaguagcggaugaucaacccugaccaacuccacuguuauccacgacacccucccugcuagaggcagguccuguccuaaaccgggaggacucaggugccugguggugguugcguguucugaaggcuuuuuuacucugagcguugguggcggaauuggcggggucuggccucccucaggggccagucucuccugggcuccugucucagcuccuguuaagggugggggccgaggggcacuguuuaccuuggacauguggcaccagcaucagguucgaggcggccgugggugggugggugcugcaucugccauccucucucuuucccagaucaaccggagagcaagaagcuggcuucccagggagacuguaaguccagggggucugguggcagauauguggcuucagaggguugagguuuucaggagucaggagcuggaagcacugaggagguggcagcucuuuacagaggccccuggugcuucauucuggggcccauacguuugagggaucccaggaacccugaaauugagggagaugagcucugugcuuuuauggggaggaauccacagcauccaugaggcacuggagcaggcuggggaccguggugccgggcucagcucccacugacccggggcaggcagugccaagugcccgaggaggagcuaagccagucuuugcuuuggguuuucucucuacagcaaucaguucucaacuuggacccauccauccucccccaagguaagccaugguggggcccacacugcuuucuugucuguuggccagcagacuggccuuucugcugacuugggagggcucugacugggggcacaucucucagguuuuaucccccagugccaguugaccagagugcucagacgggaaugaggcagaggagcuguguccguuccucguaccccuugucugaagggcugugggaggggagcgucguggcagucacuguagugauaggguggucuccgcacccuauggcuuccuccgcugggguggggacucugagcagcacaaaugucgucuuccuggaagaggcuaggagggccuugcuucccucccucacacaucugcaagugcccaucccacucagugcuguggagcucagggcucuuugccaccucuuugccccaccagauggacugaggugaaccugacacagggcaguugucaggggucauuuuuuguuuguuuguuuuuaaugggccaguaguuucauaaaauacuaggaaaauaagaugaaaaggacauacagccagcuuuuuagaacugagagacauagagugacugucagcuugcuacucagugcucccucucgcccugaaucaaugggacggcaccaggccaaggcccacaaugcccagagcaagccucucggggcacagauggggaaacugaggccuuggcaguuuuguggccuguguggucagacucugcuuagaccuaugguggccuuggcuucaaguagaccuuccagagcugcuguccuccucccuucccacuugaggacugaccuuuggcgugucucuuuacaggacuucaaugacagaagaguacagggucccagacggcauggugggccugagugagugugggucaccuuggguggggaggcccacucuuccccaggaggaaguguccugugagcuccugccagcccagaagcccuggucugagagggcuccuaugugcuguucucauuugucccuccuucguccccucugggcagaggacaggagcucucuagaggacugcugcccuccugaacgucagaggggcuggggccccggccacacagucuccugaggccugggcucccuucccucaucacgcuuugcuuuucuccuucuuucuccauccagucauuggcagaggaggugaacaaauuaacaaaauccaacaggauucaggcugcaaaguacagauuucuccagguauaagagcgucagguuccugccagagugggggccaggguugggcccuuugcacuuuccuuuaauuacuuaauuuccacggggacuguggacaggaagcgagcuggcgcuuguuggugcuuacuacggaccaggcucagugcaguaucucacuccacuaguacugcccacggggcacagcugugacuuuuuuuauuuucaguggguggguauggacugagguggcagggcuagcauuucgcacaggggccugguuccagacaccgagcuucgacgcacugcacugaccugccgcgugggugaaagcaccccggcaagacugcgugagacaggguggugccuuggacagaggggucacucugaggucaggcccaggagcaaaucccgguucuggcugcacaucugcucucaggcaauguaguuaccuuucgaaucucagaguccugagcuacagaaagccugcuggguaggggguucugaggcuuccuugggcguguagcacguguugucuauagaagcggcucuggucaucauugguaguggggguggccggcuccuggaccuucuggaaucugcaacucccuccaccucauccuuuucccuuaaaguccuaccucccuucugggaucucuucccaaccuuggccuugcaucgagcagccucccagguguuuaggggaaguaaacugaucugucaggcacugaaugggacagaaguggcccuugguuguucugaaaguuuccucguguccaaggcaggccuuucucugccugugggccagggagggcacugacucuaucuccucuuuucagacagcgguggccuacccgagcgcaguguguccuugacaggagccccagaaucuguccaguaaguccccacagggccucucauugugauguggggggcaggcagaagccugcucuguccguuugaauugaaaguugggagcaacuugcacgccauguccuccauucuugcccccaucuccagacagccauguuaacaugaggcugauuccccggcagcccaagaccuggggaaccuggagccugaacagccccugugacuggccccucuucccugucauccuugcacacucuggggucgccuucccuuugagcugggugggccaccagaccaguaccuuucuccagcgguggcacccgcucaucccccgcuccuccccuucccaggaaagccaagaugaugcuggaugacauugugucucggggucgugggggccccccaggacaguuccacgacaacgccaacgggggccagaacggcaccgugcaggagaucaugauccccgcgggcaaggccggccuggucauuggcaagggcggggagaccauuaagcagcugcaggugagggcagcaccugggcagcuuccucugcauccgugugccacaccccaccgccaccaccacagcagcccaggaaguccugggagagcccagcacuaacgguuaaccuugcuuguaaaggaacgcgcuggagugaagaugaucuuaauucaggacggaucucagaauacgaauguggacaaaccucuccgcaucauuggggauccuuacaaagugcaggugagcacgcccuggggugguggaggggguucuggagaggcacgggcaggugggcagggccagcggucucggggucugcauuccgccagagagauaugugaacagucggucauaacaccaagaggcuugcaagagcgcuggcucguaggauggcccugaacugacucccagcuuugugugugugaggcaccggccucaccucugaccuucugcuuuuuuaucuggaaacggggcugcugguagugccuccccauuaaaguggcagguagagagcucaguagggugcugugcugggcucacccaggguucguggguccuuaguugaggcccgcacccccgaggagguggggggguguggggcagcagggcucacccaugggggcugcuuccuguguguuugcagcaagccugugagauggugauggacauccuccgggaacgugaccaaggcggcuuuggggaccggaaugaguacggaucucggauuggcggaggcaucgaugugagugugggcccugccuucaccccccucucccccgccaguggagggaggggccggggugaguggcuccuuguggccagugggcagcagagggcagcagagcugcgggccgagcugacgcugcugccucccuccccaggugccagugcccaggcauucuguuggcguggucauuggccggaguggagagaugaucaagaagauccagaaugaugcuggcgugcggauacaguucaagcaaggucagggccuggcccacccugccccuggccagugcacccccacccucuuugggaggcaggcucugagggagcugggcaccguggucagccagguggccuccauagcaccucacggcucuuaguccagccgucagaacauggccagucccuucucuucucugggacagacacaugagggcuuuccacauccagggggaacguguguuccuaucccuaucagaucuccucuuccucccccuacgauggagccuauccugacaggacagcccugggugccccgcaggcuggaucagggcacuccaccucagcucugggcucuugccaguccucaggcagucucugagcugccugccguggggagaagggccccucuggcuuuucagagauuuauuguucuguaaaaucucucagugcugggggugcugugugcuggaagaagcuugagccaccuccuggcuuggccguggguuuccuucucugggaaugugggccgccucccccucaaucccugagcgaguggaggcugggagcggcgcagcgcgucugagaucucaggccggcguggugucugcgcuggaggcggcguugcagggcucuggggugggcucuucuuuuaaacuugugucucugcucucucggugcuggccucagaugacgggacagggcccgagaagauugcucauauaauggggcccccagacaggugcgagcacgcagcccggaucaucaacgaccuccuccagagccucaggguagguggccccgggugcugaaggggcuggcagggccuccaggggagugcaagaccagaccggcuuccaggguucaucauccuccuccuccucuugucuugcagaguggucccccagguccuccaggggguccaggcaugcccccggggggccgaggccgaggaagaggccaaggcaauuggggucccccuggcggggagaugaccuucuccauccccacucacaagugugggcuggucaucggccgaggugaguguggcccccugcacccuaucccuugcccccucuucccugggccaucacugcaggccaccuucaccuucugcguuucugcagguggcgagaaugugaaagccauaaaccagcagacgggagccuucguagagaucucccggcagcugccacccaacggggaccccaacuucaaguuguucaucauccgggguucaccccagcagauugaccacgccaagcagcuuaucgaggaaaagaucgagguggguuggggcgggcucuggggauuuggucucacagcccggaucccagcccacuuaccuugguuacucuccuuccuucuaggguccucucugcccaguuggaccaggcccagguggcccaggcccugcuggcccaauggggcccuucaauccugggcccuucaaccaggggccacccggggcucccccacagugaguauccucugccuccuggguuuugaggccgggggcuuacugagcuggcaagaagaauagcagaccccauuucccuuucccuagaagugcaggcggggggccucauccagcccauuuuuguggauaccaucaacaggcccucuccugucuacugguagagcaugugccuuucagcaucccucugugcacgugcaaguuucgcggcuucuuucauguccucaagcugacgcugcgcguccuucgaguugcuucuugucuaggccuuucccaggcgccccguugagccugguggucugggucucuggcgccuccccacugaaaaacauccccaccccaggugguccggcugcggccacccccgcaccacugcucaagcaucccuuucuucucuccugcagugccggggggcccccuccucaccaguacccaccccagggcuggggcaauaccuacccccaguggcagccgccugcuccucaugacccaaguaagugaugggccaccuggcggagggcaggcccuguucuguccccccgucucacccgagguaucuccugcaggcaaagcagcugcagcggccgcggaccccaacgccgcgugggccgccuacuacucacacuacuaccagcagcccccgggccccguccccggccccgcaccggccccugcggccccaccggcucagggugagcccccucagcccccacccaccggccagucggacuacacuaaggccugggaagaguauuacaaaaagaucggugagucugcaggguggcgggggggcuccagcccugccgggggagugguuucugaccugucucggcgcccgcacaggccagcagccccagcagcccggagcacccccacagcaggacuacacgaaggcuugggaggaguacuacaagaagcaaggugaguggccaccaugcggggacaggggcaggggcagcccucacccacagccucucaccugccuuuguccacccacagcgcaaguggccaccggaggggguccaggagcucccccaggcucccagccagacuacagugccgccugggcggaauauuacagacagcaggccgcuuacuacggacagaccccagguccuggcggcccccagccgccgcccacgcagcagggacagcagcaggcaagugggaauugccacccuccuccuccuccuuucuccuuccaacccccggccaccguccauccugccuuaguggguagcgccggaaaccccuuccccugcggggugugcccuugaugccugcagcgggggccguguggccggaggucuccgggaguccccacgcaccgccagggaagcauucgcuggguccagagguuaaacgaagaggccucccugcgccggcugcuuguuccugugugccgcugucgugaugcuggggagcgcugagacucgcaggcgggacuucugaacugcuggggagucggggggcaggcagacagcgcggacggugggcaccggcccggccgccaccaccucgcucacaaucuggccacuugggaagaaaacgucuauuuuuuccccuucucugcaucacuuuuuugguuuuuguucuuuuuauucuuuuauuuuuuaaacccaugaucuuuuuuccuguguccaagugacuguguugcaggcggccuggcucuggcagggacugguggggacgcggggagcggcccaggccccugccccgccgggcucagccucccaugcgcucgcgcuugccugugucccgggcuugucugugaagugggcgugaagaucguugccaccuuccaaccuaccucacagggguguuguggggacaccaugaucucuggauuguucaugucgucgugcugcgccgggagccaccgcccuccggagacagggcagcuccccuacgacccuagcgccuccgcccuccgcggccccucuccucucuuccugcucugucccuccuucuccaucagggagcagcgugacuucagcgagucccgcgagcaccuggcuagacaguuaacaagcacguccuuccagccugagccagcgcagguuugggagggggcuuccuggccccccccacgguguuccagccccuccucucuuccgcccccuagucucccacccuucccuccccguagugaccaauuccuaucucuucccucuccgcaggcucaaugaaucgaaugaaugugaacuucuucaucugugaaaaaucuuuuuuuuuuccauuuuguucuguuugggggcuucuguuuuguuuggcgagagagcgauggcugccguggggaguacuggggagcccucgcggcaagcagggugggggggacuugggggcaugccgggcccucacucucucgccuguucugugucucacaugcuuuuucuuucaaaauugggauccuuccauguugagccagccagagaagauagcgagaucuaaaucucugccaaaaaaaaaaaaaaacuuaaaaauuaaaaacacaaagagcaaagcagaacuuauaaaauuauauauauauauauuaaaaagucucuauucuucaccccccagccuuccugaaccugccucucugaggauaaagcaauucauuuucucccacccucggcccucuuguuuuuaaaauaaacuuuuaaaaaggaaaaaaaaaagucacucuugcuauuucuuuuuuuuaguuagagguggaacauuccuuggaccagguguuguauugcaggaccccuucccccagcagccaagcccccucuucucucccucccgcccuggcucagcucccgcggccccgcccguccccccucccaggacuggucuguugucuuuucaucuguucaagaggagauugaaacugaaaacaaaaugagaacaacaaaaaaaauuguauggcaguuuuuacuuuuuaucgcucguuuuuaacuucacaaauaaaugauaacaaaaccucc

SEQ ID NO: 18400 - RNA, 2487 nt, Homo sapiens
cugcugggcugggacuuuugacaguugcugguggguguagcaggggaauucagggcuccugguuccucccguggcuggaggugagcgcgcucugccagcagggcuuugggaggccgggcucugggguccuccagagaacuggggucugaggaaggaucaaggggcugggacguccaggcuauaucaaaguugggcuuugugggggccagaauuugggggcuuucuggagggcugggcucagugggugcaguggagagccagggagugggguuuuccugggcuguagaaucuucagcugccuugugggaaggggugagaugaagaauuaggggcucugugagaggagaggguuugggguccccccagaugcuugggucugcagaagcuguugaggacugggauggagacgugacuucuuggucggacucugaggguaucagcugggaccuggaguccuuugaagagcugguggcauccaaagacgaggcauuuugcagggauggcagggaaaggggcuggggcuccggcucugguaguuucuuaucgucugguugccaucuugguauguugggcuaggugagauggauagggaaguuguggcuuuuagauggcagaggggcuggcaaguuggauggaccauuaggggaagacuugggguaggguugggggagugggcgaggcucucaccaggcugaagcagcuguccaggucuccucugugacagcagucuaaacucuggcucggucucaggcugccugcgcucuuggcucccaugcuaagacuguccagaaucucgcucaacaaauccaguucuucuccagaccccaagaagcugcuguccagagcuucuucugcccacgggcaccccucauccucagggcucaguggggguguccugggugaggaugggcagccucagauauuugcccaagacccccagcccuggucaggcugcucuggaguuugggaacccuccuccccaucaguccuggccucccacuuucaacacugcuguucccuuuuugccuuaccccgccccugggggcucggaaguucccucuuccagcuggcgucuccugcuggggcgaaggggccgguucugcaaagggugggggcgauaggaccucaggagacugcagaaucggggggcugaggcuugcuggagaagggugagugugaagugggugccacauauuuggggaguugaagaaggaggugagaugucuggauggggacugggauggguagaggauucagugauaauuccaggugugugcauggggggaggggcgcucucaccuuuccaaagugcugagugauugggaggcguugcugcaggcggucugagcggcuggggagggcuggggcccucagagagcccccccucugcaggacagaguccccauccuaggaagagaagagugaacugggaaccucugccacagagucuccccaccacccccuaccauuggucuuuaguuagucuuuuuuuuuuuuuguuugaaaugaagcuucacucauguugcccaggcuggagugcaguggugccaucucggcucacugcaaccucugacucccagguucaagcgauucucaugccucagcuucccaaguagcugggauuacaggcgugcgccaccauacccagcuaauucuguauuuuuaguagagaugggguuucaccauguuggucgggcuggucuagaacuccugaccucaagugauccacccuccucggccucccaaagugcugggguuacaggcgugagccaccgugcccagccacagucuucuuuuuuuugagacagggucucucugucacccaggcugguguacaguggcgcuaucucagcuuacugcaaccuccgccuucuagacucaagcaauccauauucagauaauuuuuaacuauuuuuuuguagagacaaggccccacuauauugcccaagcuggucucaaacuccugggcucaagcaauccuccugccucggccucccaaagugcugggauuacaggggugagccacugcacccggccaguugaucuuaccuuauacauuagaaggcucugcacccccuucaagccacucuuggccuauaaaggaguggacagagaauuacccaaggguggugggauccugggcauuugagagcucagccuucuguccccuaagauagcuuuuuuuuuugccaucugcaugucucaaauacguucaccaccccccauacaccaccuaagaagucaaugcaaacuuucaccccuuugacuaauauaaaaugaguauuccuggaggcagucauccccaaagaaaauggggaguggcaaagcaacagggcaagguguuccuguuucaaagcggugaagaacaaaaucgcacggacaauuuugagcugcaaaaauuggccccaggaaacuucugagcuugggagauaaaaggcagaaccuggaauuguagcauccaaggacaaaaagaauguuugccagcaa

SEQ ID NO: 18401 - RNA, 4222 nt, Homo sapiens
ggaccccgaagccccguggccucccgcgccccgcgcucgcgccugccgcguacugccuugggcccuggucgcggggcugcugcugcugcugcugcucgcugccgccugcgccgucuuccucgccugccccugggccguguccggggcucgcgccucgcccggcuccgcggccagcccgagacuccgcgagggucccgagcuuucgcccgacgaucccgccggccucuuggaccugcggcaggugagacgugccccgacccucgguagcuggucucgcgggagaccccuaccgccccucugggacucccuucucccucccgcacccccagggacaccuguucuacacucccggccggggagaggagacccaccggggcucccauucuccaucuagcaccgaggccgggggggcacaccuuucaucccgcaccccuacgacaccucaucuguaccccaggccgggggcggggaggagaccgcccaacaguucuuuuuggaccccccaagggucuccuucuucuaguccggggggcaccccuuucauccugcgcccgcuacgagacccuaucuguaucccgggagggggagaggagacccccacaaguucuuuuuggaccuccaagggcucuccuucuccgucuugcacgggagggcaccccuuucauuccgcaucccgagaccccaucagcaccccaggccaggaggaggagacccccacaguccucaaccccucagggauacgucuucugcaccccgggucggagaaaggcuggcuucccuccauguggcagugggugggggcaccccucuucauuccgcauucccaaggcaccccaucugcacccuggacgggggacccuccgcgguucuccaacccucgacggcuuccuuucucuauguaggacuuaggacauugagggcaccucuuuuuaccccgcacccccacaagcucugcaucucuggggggaaccuuuuuuccauccccgauccgaggggggcacuuccucuuuaucugggaccgccaaggagacccccaguuccuuugcuaacucccaaagagccuuauccccaacaucugagguaccccucucccuuucaagacccccaggggaauacccccaagggggcuggaaagaagagggaucgcuuuucccuccugaauucuuggagaucuguccuuggggcagguugagccaccagcuucguguguguguguguguguguguguguguguguucguguuuguguggguguuuguguucguguguguguguucgugugggggugcguauguguguguguucguggguguguuuguguucguguggguguguguucguguggguguuuguguuuguucguucguguggguguuuguguucauguggguguguuuggauauuuguguucgugugugucuguguguguucguguggguguuuguguguguuuguguuugcguucguguguguguucguguuuguucgugugucuguguguuaauguggguguucguguguguguucguuuguguuuguguucguguguuuguguguuugugugugugugugugcggucucuguucuuuaguugggagggaagggaagcguaggcuucaggucggcacagacucuggggacccugacagcugaagugaguggggacagaaccuccauuuucuaggggaacccccauccacuuuccuccuuucuacuuuuaacagggcauguuugcgcagcugguggcccaaaaugguaaguauccuccgccacuuccggucccuggccccccaccauccccaccccgggauacgaagaagggggaaccuggagagugaggcucugccgcacacuggcuuugacccuugaccgcugcugucucugaaagcugcuacuuccccucuuugaacgccaccgaucccucuuucugacuugcucugacucucuggaugccauggccuccccaucagacccccaucugggcccaccugggaccccugcccucucagagcuggggcuugacacccccaacccccagccugguuuugugucucuggccuccuucuuuucgaaacccucuuccccgcugcuuuucuucccucuuuccugccccuuccccacucucccagccucucuucccuaccucuuccccucgcccagagccuccuccuuacucccauucucuuccccauccccaggcccuccuccuguccccuucccucccccuagacccuccucccugccccuuccccaaacccuccccagccccaugcucucccaguuuccaagacacuccucccagcaccuucccuccccguccagagacuucuuccccgcucgagaccucuucccccuuccccucccagagacccccuucccccuuccccucuccaucuagagaucacuucccccuuuccccucccccuccagaaaccccuucccccuucccucuccccuccagagaccccuucccccuccaaagaccccuucccccuuccuucccccuccagagaccccuuuccccuucccuccccuuccagagaccccuucccccucccccuccaaagaccccuuccuccuuccccucccucuccagagaccccuucccccuucccucucccuccagagaccccuucccccuucccugcccccuccagaguccccuuccccuccagaggccccuucccccuucccccucccccuccagagacaccuucucccuucucccccuccagagaccccuucccccuucccucccccugccuaagacuccccucccugccaucuucucuccuuggugcuuccuucucccuaaccccucccccaccccuuccugcucccuuugccuuucuucgaaguccucucuuaccagguccccuguccaccccucuuaaaguucccuugauucccugauggauccuuccucuagaacuuccuccuuuccuaacagucuucccucucccuccuagcucccuguccaccucuccucuccccuuuccuuccuucucucccuucuccuccccccaucuccauccuguccgagaucugcugcucccuccaacccccucaccgcccucuccaggaguccccuuaccccuccccgaggccucuuccagccagacucgccuggccuuuugcuuuucacccccucuuccucuuccugcaugucuuuccccgcacccgcaucacuccuuccccacccaaccucuuggaguuuugcccugucccgacucuuguccuucucccuggauucccuuccucuguucuauccccgucuuucccuccccuagcucuaccccugcucagagucccgcccccaacaaccucaguucucuucaaucagcacccccccaacgccccccccacccaggcuccccgcucugcuccccugucccgcucccugccccgccauuccccgccccccggccccugacccguucuuuucucccagggcugcgcugacauguucggugcucagccacgcucagcugugcugggacaugcucagcuaagcuaagugcaugcuuuccucccacaguucugcugaucgaugggccccugagcugguacagugacccaggccuggcaggcgugucccugacggggggccugagcuacaaagaggacacgaaggagcuggugguggccaaggcuggagucuacuaugucuucuuucaacuagagcugcggcgcgugguggccggcgagggcucaggcuccguuucacuugcgcugcaccugcagccacugcgcucugcugcuggggccgccgcccuggcuuugaccguggaccugccacccgccuccuccgaggcucggaacucggccuucgguuuccagggccgcuugcugcaccugagugccggccagcgccugggcguccaucuucacacugaggccagggcacgccaugccuggcagcuuacccagggcgccacagucuugggacucuuccgggugacccccgaaaucccagccggacucccuucaccgaggucggaauaacguccagccugggugcagcccaccuggacagaguccgaauccuacuccauccuucauggagaccccuggugcugggucccugcugcuuucucuaccucaaggggcuuggcaggggucccugcugcugaccuccccuugaggacccuccucacccacuccuuccccaaguuggaccuugauauuuauucugagccugagcucagauaauauauuauaua

SEQ ID NO: 18402 - RNA, 915 nt, Homo sapiens
guuguucaaaggagcucucuccucccgcugcccaagaugccgaaaggaaagaaggccaagggaaagaagguggcuccggccccagcugucgugaagaagcaggaggcuaagaaaguggugaauccccuguuugagaaaaggccuaagaauuuuggcauuggacaggacauccagcccaaaagagaccucacccgcuuugugaaauggccccgcuauaucagguugcagcggcagagagccauccucuauaagcggcugaaagugccuccugcgauuaaccaguucacccaggcccuggaccgccaaacagcuacucagcugcuuaagcuggcccacaaguacaggccagagacaaagcaagagaagaagcagagacuguuggcccgggccgagaagaaagcugcuggcaaaggggacgucccgaagaagagaccaccuguccuucgagcaggaguuaacacugucaccaccuugguggagaacaagaaagcucagcugguggugauuucacacgacauggaucccaucgagcugguugucuucuugccugcccuaugucguaaaaugggggucccuuacugcauuaucaaggggaaggcaagacugggacgucuaguccacaggaagaccugcaccacugucgccuucacacaggugaacucagaagacaaaggcgcuuuggcuaagcugguggaagcuaucaggaccaauuacaaugacagauacgaugagauccgccgucacugggguggcaauguccuggguccuaagucuguggcucguaucgccaagcgcaaaaaggcaaaggcuaaagaacuugccacuaaacuggguuaaauguacacuguugaguuuucuguacauaaaaauaauuaaaauaauacaaauuuuccuuaaaaaaaaaaaaaaagaagu

SEQ ID NO: 18403 - RNA, 2536 nt, Homo sapiens
aagagggcagcaaauaugaagccuuaaguucaaaauaagucauucuaccuagaaauacagaccccagagcacauugcaugaaaauaccuguacucugcaguuccucaaagcaguauucuuccugaaaagccaaacaccacaccuauuuuccuauuugcuaagaaucagaauaagcacguuguaaauaguauccaaagcagauucuaaaaugacauaguaagaagccagauucaaauuguaaccaaagaagacaauagaaaucccacuuuaccccacugucaucaguuagaacacccuugcaaaaacuguaaccacuuaagcaauucaucugaucccagaagaucauaccuucuuuugaaaguauaggacagauaucagugggaaacgucggcguucugagcaacacaggauaaauguaggagggccuuaaaaaauaaaucucaauucauacacuggagcagcaaaaaacugagcaggaaaggaaacagaauccaaagucauuuuucauauagcuguugucaaauaguauaaccuuggugucuucuuugaguugccuggacaguauuuaugaaacaaaaaacuaaaugccccccauuuggggacggggggagggguucagaccucuaaccuggauucagagccuuagaggccgagagggaaucuggaaucugguauuacugagauccuagguaaaagaaccagccuggcagucuuucccaccucauugguccgugcuuuuauuuuuaaacccaaaagaaagaaagaaacacacccucuuauguaggaauuucccuuuuacaaauaauuugaccugguagaaauaaacuugccugccugcucuuaaaugccagacaguuggaagcaaaugccgagggaaaggugcccagagccaugcuugauaggacuuugaauauuuucuccuuaauuaaaguacguugcuuguauuuagacuauaagaugcuauggaggucuaucccaugccaugccaaugugaauugcuuugcuucaguaacaaucagaagaccaguccaacagaaaauaacuugucauaauuccaccuuagauucuagaccucucauaccugcaguguacagaauauguacauguuccaauggaauucacuauuuuuggcuuuagugucaaagagauugguucuacaagguucaucugauuucccauaacaaguaaauuuuauaauccuaugauucuaaauucaauccccaauauagauucuaagcaucaaaucaaaaucacagacaaaggggaacuggucgagaggggucuuaguuauuucaaauccaugaccaaaguguccaaagacaugaaacucuuauaccugcugagcauuucacuuuacuauacaaaaugucagcuacccaguugcauccugugacaugaucagacugucaauguggaccaguggccaggagcauauuuaugggccauuucuguucaucauucuuuacagagcauugagguuucccacugaaacagcuucuuuagucagacgucuauagauuuuacauaaauuuacauuuaaaugcauuaaguuagauggcccaauugagcaucugaaugaauauaguggggguuggugguggugcaaauucugcuggcuuuauguuaugguuuucuucguguuuuuucuugguuuugucuggcuucuucuggcaagugcccuaaaagacuggaacacuguauaaagucauagacauagaaccauaugggaaagcccagaugaaaaaauggaagaauaaaaucaaguugucaaaguuccagcaacagcccugacuucuucaggaauccaagcaaauugaaagccaagacaaaauguacaaauggugcccaugccauucauuugacuguggguggcccucuagucuagggcucucuuagugaaugguuguggaaauaugauuuuucuaaguuccuuccuuuuccuuuugauagaugaguuugagaugauggaguaggaguggggcccucaggcacuucugguaaagacauuccaccugcaagcagcauuuugaguaaagcacugcugugguuugccgauuuaugguccauuuaauguuaggcuaaagcaccuuuaaucauuuuuguuguuuuaagauaauguauuugugaaguggauaaacacuggaaauagggugcuucuucuggaaaguucaguguaaaacacaaacaaggcuuuggcggguuuaucuggcuuuauaaacaagucugaaaaauggaugaaagcuaaauauauaaagcaguugguugucuaucuuuuaucauuuuuacucagaucuguauuuaacacuuauuuauuuguuaguuuuuacauucaaaagaaauacacuuugaacuuuggcuaacauuguaggauauuuuuuaauuguuucuacauuuuuaaagcaugauucaucauuuuuguaaacuuagaucauuuuuuaauugucuuuucuuuuccaauagaccaguuaccacucaugugucugcagaaccucuuuauuguauuccuauaauaaauguaaaauauuuguagcaaacu

SEQ ID NO: 18404 - RNA, 2536 nt, Homo sapiens
aguuugcuacaaauauuuuacauuuauuauaggaauacaauaaagagguucugcagacacaugagugguaacuggucuauuggaaaagaaaagacaauuaaaaaaugaucuaaguuuacaaaaaugaugaaucaugcuuuaaaaauguagaaacaauuaaaaaauauccuacaauguuagccaaaguucaaaguguauuucuuuugaauguaaaaacuaacaaauaaauaaguguuaaauacagaucugaguaaaaaugauaaaagauagacaaccaacugcuuuauauauuuagcuuucauccauuuuucagacuuguuuauaaagccagauaaacccgccaaagccuuguuuguguuuuacacugaacuuuccagaagaagcacccuauuuccaguguuuauccacuucacaaauacauuaucuuaaaacaacaaaaaugauuaaaggugcuuuagccuaacauuaaauggaccauaaaucggcaaaccacagcagugcuuuacucaaaaugcugcuugcagguggaaugucuuuaccagaagugccugagggccccacuccuacuccaucaucucaaacucaucuaucaaaaggaaaaggaaggaacuuagaaaaaucauauuuccacaaccauucacuaagagagcccuagacuagagggccacccacagucaaaugaauggcaugggcaccauuuguacauuuugucuuggcuuucaauuugcuuggauuccugaagaagucagggcuguugcuggaacuuugacaacuugauuuuauucuuccauuuuuucaucugggcuuucccauaugguucuaugucuaugacuuuauacaguguuccagucuuuuagggcacuugccagaagaagccagacaaaaccaagaaaaaacacgaagaaaaccauaacauaaagccagcagaauuugcaccaccaccaacccccacuauauucauucagaugcucaauugggccaucuaacuuaaugcauuuaaauguaaauuuauguaaaaucuauagacgucugacuaaagaagcuguuucagugggaaaccucaaugcucuguaaagaaugaugaacagaaauggcccauaaauaugcuccuggccacugguccacauugacagucugaucaugucacaggaugcaacuggguagcugacauuuuguauaguaaagugaaaugcucagcagguauaagaguuucaugucuuuggacacuuuggucauggauuugaaauaacuaagaccccucucgaccaguuccccuuugucugugauuuugauuugaugcuuagaaucuauauuggggauugaauuuagaaucauaggauuauaaaauuuacuuguuaugggaaaucagaugaaccuuguagaaccaaucucuuugacacuaaagccaaaaauagugaauuccauuggaacauguacauauucuguacacugcagguaugagaggucuagaaucuaagguggaauuaugacaaguuauuuucuguuggacuggucuucugauuguuacugaagcaaagcaauucacauuggcauggcaugggauagaccuccauagcaucuuauagucuaaauacaagcaacguacuuuaauuaaggagaaaauauucaaaguccuaucaagcauggcucugggcaccuuucccucggcauuugcuuccaacugucuggcauuuaagagcaggcaggcaaguuuauuucuaccaggucaaauuauuuguaaaagggaaauuccuacauaagaggguguguuucuuucuuucuuuuggguuuaaaaauaaaagcacggaccaaugaggugggaaagacugccaggcugguucuuuuaccuaggaucucaguaauaccagauuccagauucccucucggccucuaaggcucugaauccagguuagaggucugaaccccuccccccguccccaaauggggggcauuuaguuuuuuguuucauaaauacuguccaggcaacucaaagaagacaccaagguuauacuauuugacaacagcuauaugaaaaaugacuuuggauucuguuuccuuuccugcucaguuuuuugcugcuccaguguaugaauugagauuuauuuuuuaaggcccuccuacauuuauccuguguugcucagaacgccgacguuucccacugauaucuguccuauacuuucaaaagaagguaugaucuucugggaucagaugaauugcuuaagugguuacaguuuuugcaaggguguucuaacugaugacagugggguaaagugggauuucuauugucuucuuugguuacaauuugaaucuggcuucuuacuaugucauuuuagaaucugcuuuggauacuauuuacaacgugcuuauucugauucuuagcaaauaggaaaauaggugugguguuuggcuuuucaggaagaauacugcuuugaggaacugcagaguacagguauuuucaugcaaugugcucuggggucuguauuucuagguagaaugacuuauuuugaacuuaaggcuucauauuugcugcccucuu

SEQ ID NO: 18405 - RNA, 180236 nt, Homo sapiens
ggcgcugcgggcgccuauugacccagcggcugcugcgccgccgcugucuccuccugcucguggcgggcggugcuggagcgccaaguggcgcuggagaaccggcgcuuccuuucgccgcuuccgccgccaucuccgcguuuguggggcgggaaagagggagggggcuagcggcugcagcuggagcgggcuucucuccggggacgguccuuuccucccugcucuccuuuuccuucuuuccgcguugccgccgcccgcccccugcgccuccccgcggagccuggguccgggagggggaagguaggggcggcggggggcgggagagucuggcgagcggacgcuagcucugaggaaacucaucaauccgugagccccggaguccggggugcacaucggcccagccgcagcgucggcggcggcggcggcagcagcacgaaggggcucagucgggguaggcgggggcggugccggugccgcgggggcgggcccgaccgucccgcccagaaguuguagggcuuggcuccucgcgaucuuguuccuuuccccuccgcuucucugaccuagcugcgcggccccggcccgggagcugccgaacccgcgccuccccugggugaggaggacacgccugcccucgucgagaaaacuuuuccugccgacucaguuggggcggcgguggcaggaagugcgggcagcgaccucuccuccgccugccccgcgcgcccugccggaggucggcgcugagcuugcgaucaaguuugugggggccccccuucccaguugccggcgagucucgccucgagaggggcgcccgaccccggggagggcggcaggccagggcgaaggccaagggcgugugguggcgccggagacuaggugcggagcaaggcggggacucgcacccgcauccgagagcgcggaggucgcgcagcccgggagaagggagccuccggcggcugcuuccuagaguccacagugcgcugucuccuuuggcugaggagaguguccuggccccgagucuaucgaggaaaaugaaguuaagccgccaguucaccguguucggcagugcgaucuucuguguggugauuuucucgcucuaccugaugcuggaccggggucacuuagacuaccccaggaacccgcgccgcgagggcuccuucccucagguaagcaccugggaagggggcgcggggcuccgaggggccaggcgugcgggccccugguuagcggcugcuacccaaccucuuccucccgccgcggccccacacccgugcugggcgaggccaggggcucuguagcucucggacggcaaugaucaccuccugggagccaccucgcccgggcgcgccaaguuaacaaagugcugggcggcgugcggcggcggcggcggcaucaucccgcucaggaaaguggccauguuccggcauucgcacccggccuguugggguggcuucgggcaccugcuggcgggggaacgggcgcggcgugaggcaccccccgccagcccggggcccgcguaucccgguggggucguucucggcucucacaggguuaagccgcccgcaccagcccagagccccugagcgcacggagucgcggaaauggaucaaaccgaacccaccuaggcuuuuuuuucuuuuucuuccccgcugccucugaagagagagaaguuuauuucguguugcggcccuuuuagaugugaaucucuagguugauuuuagugucgucauucuucagcuauuacaucugguuuguuuguggcagacagggggaaccgaguggggaagcgcguguuauacuccggccgaaagcuguggggcgcucaguccugcguccagugguuaaauugguaaaugaguugggaagacgacccauccaaagucuuauuuaaaguuaccaaaaauaagcaaagcggacacagucuguucccuuuggaaggguauccaccgcgcggcaugugcgaguucaguuucaaguuacuugccaauauaacccgugcacuucagaaauugcggugaaacuggguauuguguaguguguagugugcucuguaacgaaugaaccugaagaacucaaacccugacagggcaaucuaacuauuccuacuugacuuacgagaaagagaagccuagacgugaaguugauauauauuuuuuucucuuuugugauaacuuaaaugaccaaagaauauccuugccauuuuuuuuguguuaugcuagagcaaauggcuugaauuuaauugagauuaaaguaaaaacuuuacuggaauuauugugaaagugaaaaaagacccuuuuauggaugcugucaucaauacagagcacucaacauguuuugucggugagagguuuuaaaaaucuugcugcagagagauguaucaaaauuuuaaaagccucugcuuccccuagguaguaugacagagaaaauagaaacaagcacugagggcaucuuuaaaucuugagcucagagcuuguccagugcuucuugaugagguugaagaaaacaguuggaaaaagguaaggaguuuuaagcuuagcuugauauguuguguaauuuugggguugaaauuacuguaauuuuuuucccuccaguaaccucauuuucagauuuuccuccauuacaggaaaaucauaaaaagugauauuuuuacuuaaaguguuuucuaaaauaauguccuuuggcuuuggcuugaugaucacuugaaaaugguuuaugcaaacaucuggaccuggguuuucuggcaaccuugacauuuucucuguucagaaucuaaagacaugagugacucauucaguuacugagaaaucuuaggcaaagcuaauuccaguauuguaauaucuauccuuaguccucaaugagaggcugaaguucugcuuuaagcguaaagcauuugaugaaaggucaaaguggcugcuggaggggaaggcuguugguacucaacugggagguggaacauuuugcauuuaagauugccuuucucagauuuucuguacuggauuuucacugcagaaagaagguauucuuuaagugcuuggacggccacugaauccucaagcagauagacauucuaagaccccucuguaagcuuaaccguuaugugugugacauuagccuucguaucuuacaggguaaaacuuaaguggcgaggggacugaggcacugaggcacggagagauuaauuagcuugcccaagaucacacagcugcaagcugagauuugaacagguagccuuuguagcccaggcucccagccacugaguugucuugccucuuaggaaucuguugccuacuguuuaggcugccauuugcuuauggaaagaucugauguaaaauauagagcagugauccucaaccuuuuugguaccagggacugguuuccuggaagacaguuuuuccacagacagggguggggauggggggagucggggguuucgggggaugguuuggggaugaagcuguuccaccucagaucaucaggcguuagauucucauaaggaccaugcagccuagaucccuggcaugcgcaguucacaauaagguucgugcuccuaugagaaucuaaugcugcugcugaucugacaggagguggagcucaggcgguaaugcuugcugaccugcuaugccacucaccuccugcuguguggccugguuccuaacagguccauggcccugggguugguugcccccuguauagagcauguugcucucugguaccuuagcuuaugacuaaaggaacuuuuauuuugaagccauaaugaauaugguccuuuuucugaaacauuuacugcuagagauuuauacccuucccagaaugucuuugagcucauuucagagcuaaacauuauaaugaaaaccauuguguaguccagcauccagaacuugaguugauucuuuuuuuuuucacugcuucuaacuuauucuuaauaauaccaaacauagcaaaaggagguugcaauacauuuguuuggcaaguuuggguauugaauucuugaguuuuaguagagccaagcaggucggucacuaugugucauuuuuugguaucuaguagaacgguuuauuuagauagguauuggguuccucuaaauugcccauuuaguugguuucaguugauacggaaccuucacuaggcuuuaggucuaucuuguaaacaagauauuuuuaaagaccauccuagauugagagcaaucuauuuguuguuuuuuuggagagcggggguuuguucuuuuucucuucucucacaacucugguguuuuccaccauuuggcuggacucuggggcaagagugggcuggccgagggugcuccaguuucucucaccccggaacagcugccugccucuaagauauucuuuggaagucuauccugaagcacuccgaagccuugcuucugcuucugggaggaauuccuuggaggacuagaggcaacagggggccuaaucuguugaaacuuguguguauauuucaggguuaauaaaucucagcuaagaaaauuaauaaaaauuccacugugaaugagagguuggucagagacuaaugucuugaaaaugcuuuaugauaacuuggaagaauuugagcagauggaaaggagaaacuuuguuaaggucucccugaaauuagucaucacuucuuacaagcagauuucacaaggugcuuacuaucuaugguguguauaauaggguugucuuauuaauuagucugauguuuggaucuggagaaguaaauuaaugagucagguuuuguauaacaaaugaucacuuuuuaaguaauuaguguagcauaugaccguagagauuaauauuaacucuuaaaauauggaaauugagacuccgauggaaaaugugaaagugaaguuaaaacuuuaucuuuuugccuauguaacauuuaucaagugagaaagugagaaugccuuuaaauaagcauuugauugaaagccauuagaaggugagaacuuguauaccuuuuuuuuuuuuucuuugggauaggguuuugcucugucauccaggcuggagugcagugauggaaucacagcuuacugcaguggccuugaauucuugggcccaagccauucucccaccucagccuucugaguagcugggacuacagguguguaugccacugugcccagccaguuuuaaaauuuuuauuuuguggagacggggucuuacuauguugaccaacugguuucaaauucuuggccuuaagcuauucuccugccucagccuuccaaagugcugggauuauaggugugauucacugcucccaguugccuuuuguguuuuuuuuuuuuaacuuacuguaauacacauacagaaaugugcuuacauacuuuacaucaguaguacuuaagaguccagcauaguagauguuauuaaugaaaguugacucauggcaauacauauaacuaggacuuugauuccccaguuuuuuucuugcuuucauaaaucuguaaaucuuacuuaagaaugacauauaaggaaaauaugaucuccuuccccuuccuugagugcagucuauuuauaaacaauagcacuuggugcugggguuuguucacguuuguaugagggagauugucuuauuuucugggauauaaugcggagaucugugcuuuuugggaagugauggaacguugauagugcauccagcauuuaggaaugcaagaacaaacauuagagccuuuugaggaugguguccucuaacuccucuucaguccaacagcccugugggucucuuccugaucagcauuuuucacuaagacccaaacuuauuuccuguaaaccaacugggccagauacucaugacugucuguggucugaagauaguaguuuauguuuuguuuuuuguuuuuuuuaaauugaauuggguguguuguucccagaugaacacuguuaucagggccuaaacaaauauuuuugucagggagaugucacaauuguauuauuggaaggggauuuucucucuuagcuuuuaauuugcauuaagaggugucugggcugugggcaaaauaguggcuaaaaugaccacuuuuauuuguuuuugagucagcuauugcuuuuugugauaacugaaaacuuuagucuuuuuugaaggacugaaguguugagaguuuccuggaaugagugguucacuagcuguugcugaucaccugguuuauucuuagcuuuuuuugcauucaggagucuuaguuuucccuuguucuccaacuucuguaaucuuuaagaaaaugaaaggauauuuagcagcucugaugaccuguauuugcuggauuguaaaggccuuauugcauuuuuuaucccuucugucuugguaaaaguuccugauagcagcagcuuuuauaaaaguuugagcagaacuaaggcaaggaggaagaacucuaaaauagugauuuuugcuucucaguuguuauuaguagguuaaucaggagaggaaguaggacauuuuaacuaaaauggguuucuguuucaguuaucaagccaagcugcuauuuuuaaguuugaaaccauuuuuaaauucagacagguuugaggauuaauuguacugaaauggagcucacaucuagugcuuuagugaguauagcuaaaugugccuauaauagggaggaaguaaaucauuugguuugaugaacucugucacuugaggucauaucauagcuuuucugaaagagugcccuguuuaagguaauuauauuuuaugcagacagguggauaguagguaucuaguauauaucuuuuuuuuuuuugagacggagucucacuauguuggcagacuggagugcaguggugcaaucucagcucacugcaaucuccaccucccggguucaagcgauucuccugccucagccucccgaguagcugggauuacaggcacaagccaccaugcccagcuaauuuuuguauuuuuaguagagacgggguuucaccauguuggccaggauggucucgaucuccugaucucgugaucugcccgccuugaccucccaacauguugggauuacaggcgugagccucugcgccugguugguaucucuuaaauaucuuaauguuaaauuucuaaaucuaacauacuguuuucuaaagaagagaaaguacuuuaguuuaaaacuggacauacucuaccauuugcugccucuauccaggcuuuguaaccucuuugcuguugacauuuugggccagagaauucuuucguguuaagggcuguccugugcguuguagggugucuagcagcauccuugcugucuacccgauaucugccaacaucacuguucucucucuguaccccuaguuguaggaaccaacaaugucuccagacacugcucucaauauccucugggagugggaaucaucccuguugaaacuguguuggcuguggccucuucuuuauacccaguacaugucguuagcacuucuguguuuuaggaaggauugaucaaaaggccgaagcucaaaaagccaauuagcauuuuuugaugggugaacucuauucuuucucaggaugccugaaauucacuuacacauuuaggauucuagauuguaguauguuacaaaaaauuucaaggauagauuauguucauagguaaguugaaggaaaaaauggaagauucuuauaauggaacguaaaaaaauucuuuuccaauuggacguguguauucugagaaaaacauuagggucaggucauuguaaauagaucaucuuuuacuuucuuccagcugaauuacagguuggcacuuauccagauuuauuccucuuagcauaggaagauaagauauauugauuaauaagguaguauaaaaauugucugcaaaaauguuuugaaaugucugcaguuuucucaggcagacuguuuacuuuucaguguauuguuuuuauuucuguuaauuuugaugauucugguuacaacauuuuaaauaucuucuugagaugagaaaaagcagggaaagaaacuggaaaauaaggagaguggauagagacuuuccuccugaucauuucauuuuguccucuaaauagcauuuuuuacgaaagugggguggaggugggagguuagggaaagaaugaaguucuugacaaauaaucuuccuucuuuugucuccaaggccucugguuuugaacucugcugagucagcuaacuaugagugaaaucugucugccaccugucuuuauagggccaugugcuaagaaugguuuuuacauuuuuaagugguuuaauaauguuucaugacauagccauggucauucaucuaccaauugucucugaccacuuucacacaacaguggcauaguuuaguaguuaagacagaaacuggcucacaaaaccuaaaauauuuacucucuggcccuuuucagaguuugccaaucccuaguuuaaacuauauuucucuauuguuaauauuggaggcaaauaguauuguuagaucuguuaaaguagaugugaguuaauuaaagacaaacaaaauucucguaaauugguuauuagauaagcauuggucaaacuuuguguuuuuagagagugguuuaaaacuuguguuaucuacauguuucauagauuuccagguauccuuggggaacuuugaugcuagagcaucgacaugcuugaugaguuuguuucucuucuuucaccugaagguuuugcacuguaggacugcucugggaaggaagguucugggccaugaacuaggcaaaauugauccauagcuucaagacugaaaaccaugacuuuaugacuuuuuggaucugcuguaauucacagaugggcuuaauucugagcccagucugauugcuuggguuaguuaguccugagaagggagagcucagguauagguaucuucuucauaagcuguaaauagaagauggaacucagccggucucugggauccugagcguugcucagcuuggaggcaggguacuuucagguugucagcagagguacuggccugcucuucugcuuaucaaagagcaguucuugcuaauuuucaucauuuucuucacuuuuaaagauuauaugucacuuucuuugcuguguugcugugacacaggcuaacaccccauuuguguccucacagauuuuaguaucaucuuuaaauugcaguauacugaguccgaacaaaauggggguaaugcgucucaucgaguaguauuaagguuaguguuaaguagaguuuuuuaaguauuuguuuuuuugcauuuaaaaauguaugcauuuguguauuuuucacauguaaauggauuuaccacuggccuccuuugcagguggugccuuuggaaguccagagaaauuaaaugcuuuuuccaagagcagagaagacucuaaauuugacccuguccuauguucuugcuggugcacuucauuggcuucagugaggaguccggagagcugggacuuuaccaaugauuuuuuuuuucuuuuaaacauguaaaagguauaaaugcacauagaaauaauucaaaugacauagaaagguacacauugacaauagaaucccucucccuuuuuuccccaucuuuaguccacucuucucugagucccacuucugaccauuucuuuauguuccaugugugguuccuucuuuaaauauaugcauauaccucuguuuugauuuuuguuucaauuuugagcuauuguuucccuuuauaagagaugaagaauuuaacucaauacccccuacucuucccaguuuuuaaaaaaguuuuguauucaauuucuguuugauauacauuaacagcuuucaaugauguaauugcauuuguuuucuugauucaucaacuuuaggccuaaagugacuccccacucugucagucaaggaauuugguacuucucagccuucucccacucaauuucucuuccuucucauuucucacccucccucagccaucaguuuuuuuacaucaacauaccuuauaucaucuacauuucauucugugacugaauguguuauguacucugacuauagguugguuacaaaaauugaaaaccaguaaacaaggauacggaauuuuagguaggaggaauaaguucaagagaucuauuguacaacauacugauuauaauuaauaauaaagcauguaguuuugaaaauugcaaagaguagauuuuaaguguucucaccacaaaaaagaauaaauaagugauguaaugcauauguuaauuagcuugauuuagcauucuacaauguaugcauuuuucaaaaugauauacuugauaaauauauacaauuuuuauuugucaguuagagcucguuuggagguuccagcaggggagugcagcuccuuguauacccuugaccgaagacccguccuccaucagggauggucauccucuacgacugagcaugcagcuucaggaggggcucacauagaguggugagggaggaaggggacacccgccuagccagccagaucagccgaaucaacccuggcgaucaauggggugacagauuucgcagccagaucgcccucacauccuauuugucaguuaaagaaauaaaaaauguuaaaaaaaagaaaaccaguacauaguguuuucaauuuuaugauauuaaauaccaugcaguauaugucagguaguuuggcuucauaagaaggagggauaaucuugauaauuacaccugugccacuugaaggaaauauucugagcauuagagcaaguggagucucuuauauuccagcuggugagaaucaugcuauauuucaguuuccuuaacuucuggaccaugacuuccugauauguaguuuuuguuuuuucugucuauuucuaauuccuuucccuuuuuguuagcgucagaggaaauagaaguuauugauuccugucucuugaaucucauuauuuaaaaaaucauuuuacaacucauuaugcaccaacauuuuggucccuugugccuacucaggauugaaaguaugaaguuuugccgguuuuuuuuuuuuuuuuuggucguucacaauuacuguuuccucaaacugccaugcuucuucuagaacugauagugcuuuguuuccuuugugaugagaagccuuucccuucagggugaggacuucggggcugaagauguacuuugcagcaguucccuucuguuucuucauaccacagauguagaggaauguggcauuuauggguccuggccuuggugguaacauuuuaccuguagagcaucggaacauugaagacugagaaugugaaucauucuuagaaucauuuucuacauaaaguccugaauugguguuuuuagaauccagugaagcagucauucuuuuaacagucaccagcauuccagaaaagucaugaaaaauucaggcacagaauuguagaguaggcuggguccuuccaggucagguaauuuuuagucuuugauuuuucagauaagggcaccgagucacacauaaacuagaccucagcaauuugcccagucacaggauaccugggacaugcauccugacuuauaauucacuggccuuccacuguacuauacccauauccaacauauauuugaaaauuuacuggguuagguaauauggaaauugugguagacauauguuacuuguuuugaaagaacuuuuuaguuauuuagggaaacaaaacugccguuugugaaacuauuagagccaguuaagugcuauuauucauuagaaguuaaagagguuagaauguugccuggcauauaguaagugcucaguaaaugcuaguuguuaccaauggacagagauuuguagcauaccuauuauguagcaggcacuguucuagguucugggaauacaggagcuaagacuaaaacaagagucaaugauauuauuuuacauuccugauauaaagacaaaggccuuaaagagaacucaaaaacagaaacaaguuuuggugauggccuggcuuaaguugacuaaaggagaggguaaagaagcuaagcuuucccuaugggacgauacuuugaagggagaaagaaaauugcuaguguaaaguacggugcuuaugaaggcuuugaauccuggaggagauuggcuugauuuagaaucuuuggugccugugaagaguaguugggaaaacacuguagguaguucaggaucagauugcaaauugcccugagaguuugucugaagaguuaugaguuagaugguagugaaucacuccaaguuauugaauauaccaggaagcugcuugagaaaagcagugugagagaauuaauuuuguagaaaauuucagaccuggaaaggagcuaagagaauauucaaucuagauuauucugguagcuguguguaggaagauucaaguaggaaggcagcugagaaucuguuugagguaauauagacauaaggcaguaaaucccuguaccaguauugaauuggcuagaaucgggaggaugaaaaauguggagacauuuuguaaagagaaagaccaaagcuuuuuaacagguuugaucaaggguaaugaugaguggcuugaaucagaaaauuucuccuaccuuuuuccauugggguguuggagacugguuguacuauuugcagaaggagauagggacaagcugaucuggaaagucaaguucauuucauuuaugaugacguggauguuaguggaaauaaucaagugggcuggaaagccagugagagaucagggaagggagaugcugaucugguagucaucagcauagccgagaaugaaugagcucacuuggggacugugcuuagugagggcagggccaaguacauuucugauaaccaaaagcugcacaucuuacauuaagaauauuuuguagcagauguuaaugaaauaaagcagcuuguguucaaauugucagaaaccagcagcucauggaucagcuuaccuaagaaaagauaagaugaucagaaggaaggauuucaaagaagcguuuuaguagaguuuaaaaaagacccuucucaucuuuggcacaaaugauaagacuaaauuauuuuuuuucuggguuaagacagaacauaaauugugugugugugugugugugugugugugugugugugucuguguguguagggaggaugggcagcccggugguggagagggagagagagauuuauuaaggaucaaaaugcaacaccccaaauagggggcugaaguuugaaaguuguucugaaagucagacagauuucugagaauacccuccaaacugccucuuguugauaguaaagaaaaacucccuucuguugggcugguaggugaccccaugaacuggagaaguaaaaacugucuuugacccugggcuaccucuggaaaauuuguagggucaaauaacaacacuugauguauaggauauuucuugcuacuuuuagguagaagauccaaccaauaauuguuuuaaacaaaagagauuugagaagaacuccagaaauuuguauccuuaacucaucuuugauaaccaaugguaugauauuuagaaguuugcuauuaauguauuuuuauguauuauguuaugucuuacuacugcauuuguugcuucugugucucaccuugcccuuguagaccaguuguuacagauggauuuuuauaaagaaaggcaauaggaaagaauuuguaaaacuuuagagucuguagugcuuguauaaagaguaguuuggaaauucagaauuuauaauaauucagaugagacuugccuaaauaccuguccccugucaauaagaaauagaagggacuuauucaggagaugauuaguauaaauaagguugaagggggguugauuaucuacuuaauacaacccugccuucagaggcuuuccaaaacuauuucuguaugaaaaacgaucucagacaugucaguugcauuuauuuuaauaggccaacacuguuuagguugauuacugacaauuauuuucuuuuuguuuugaaauuguuugucaaaauuacuuguuuaaaauuauaagauguugacagaacuuuuguuagcauauccuaacaugcaauacauggcauuaauucaugguaaauguguuuagguagugugaauggauagugccuaguaaccuuguguacaaagauaagcauuugucaaacauguaagacagauuaccaacauagaccagcaaccauugccuauaugauguguuaacaacaugacccuguuuagcuagcugagaauuguuaaggccugaaagcauaucacaugaaccuucaugcaaguucuugggugggauacacuguugacagauucugucagagugcuaagcauaagaauauaaauuaaaaauaaguuuuagaaguaaagucggugugguuuuuaaaaaaaaauccugcaaagaauaguguuccauagaacagauugggaagugcugaauuaaagaaagaguucuguuagucaacaguuaauauguuuagugccacuuaauugcaguuauuaaauggauuuguaaguaauaaaacugcauuuuauuaaaauuuuauaaucuacacauuuugcccuaguuauacacccuucuuccacucacuuuuaagugguuaucuguuuugcauagucucauuuuauguaauagcuugaugucuaaaauguugccucaacaggagguaguuucugugcagccauauugggcuggugcagauagggccauaugguucuaaucuaaacauacaucuggaaacucauaggguggagcuggugcugucuccuggaaccuguagaaaacgucagcaacuggaguccugaccacauuuuuggaggaggguggugagggaaugagaugcuauuauuugaggucagggcuuggauccuguguagugauucuggcagcuacuaaguugguggcccagcugcaguagucaugagucccuugagugcucugccagaacaagggauguugggcuuggagucccagcuuuucccuucacagucauuuggcacucuuaccugcaucugagcagccucuguuacugucauaccuaggcaggugugagauuuaugaaaaaugauuugccugggcaaagaguauauugcuucugcaauuugguaagguauucuguagcuacguauuuuuugugcucacaucgugagggcauuuauuucuuugaauggacaaguggcugcacaaagacaaauugcacaauuuggaagaaauucaggcauguuaggcucugagucuggaaaauaccauuaaaagguuauuuauaacuggcuuguggcucauugacagacagguggagauacauacagaaucguggccacagccccaguucacacucuuuuuggccucagcacuacacaucuuaagggguggagugggcgcuuggaggguuaccugucauuuuaucaagcccaaaagccuuccuguuaaguuccagagaucugacuaaaggcaggguuuuucuguagagauugaauagugguugacugaccagggacugcagcaauaacgaugacaccccugcuggaaauacagacucucuuuuaccaaaucgcaguuccuauauuuagcuuuaaugcggcgcuucuuaacuggggaugugugagaaucgccuggugagccauuuuaaauuauaaaaggcagaucucugcgcuuuucuagguaaucccauuuguucccauugcuugaaauucauauuuauucuggccacucaaguuuauauauuuagcccugacuucucucuugaguuccagacuugcauguucacugacaccaccauucagcuaucuaauaguuucagaauauaacauuugcccuucugucuccuccccaguaacuggcuugugggccuguuccucuaaaaugccacccauaauccucccccuugcccuagcaaaaaacucaaugccaauuuuuuuuccuuuccugccccucccauuccuaacucaucuuucuugucauucuuucauguuccuucccuuccuguccaagcuaccauggcuuuuaccuggcaaacugcagucuuuuacuccauaugcccuacuguggcuccagaauggcuuaaaauuuuuuaauugauugauucuaaaacucagucuaagauaaagauguugaugcugcuuuuucugaaaauuacuuugaaccauaaagggugacucugucuuuucuuaacuccuuuauucaaaguuagguguagagccuuguuagaccaaauuaugccccuggaagacaguuuaugagguugcacggccucacccuccauugcuugggcucacagcuccuuagggucauggcucuccagcucugaugauggagauuugggcaagaauuucucuaaaaaggacuaagcauaagaauauaagcuuuauuuuuguagggccaacuauuugcuaaguauauuaguuucuuauugcugcuaucaccacaaacuuaguggcguaaaacaagaaaaauguguuaucauacagaucuuuaggucagaagucugaaacaggcccuacuggacuaaaauaaagaugucugcagagcugcauuccuucuggagcuccaggggagaaucuguuucccugccuuuuccagcuucuggaggcugagugcauuccuuggcucaaggcugccuuccagcaauagcaucauucugauuucuuguguccucacaucucccucucuggccugacucuuccauuuuccucuuuuccuuaugauuacauugggccuacucagauauucuaggguuuucuucccaucugcaaagccuuaaaauuaauuacaucagugaaauuccuuuugucauguaaggcaagguauucacagauuucagggauuauuaggacagggauaucuuugacuaaacauuauucugcuuacugcaccaggcgcuauuuaaauuuacuugcauauacuaacuaauccucauaacaacccuaugaguuagguauuauucuccccauuuuacagaugaggaaacugcagcacagagaaguuauguaacuuugaacuugcccagaguuacauagccaguaaguaguggugccagaauucaaauuuugguuggcuucagagucuguucuuaauuaugacacauacuaucuggaggugcauauuguaguacccuucaaagugauuuuucaaaagccauacuuuuacuauguagcagcagcugcaauaauacuuucuucacugcuuacuuguuggcagguccugugcuaaauucuuucacagccaguccaagcaauggauauuaguaucugcauuuugcccauagaaacugaggcccaggauuaaguuacuuccccaagaucacauggccaauaagugcggaaacuaguauuggaagccagauagccugaacaggagccaaugcuuagccauuaagcugaauugcuuccaccuuuaucuggugaaggaugucauuaaagauaaagguaaucuuugcucuuacauggugggcacauuugaugacauaaucagaguccagaaagaacuugauguguuggagugauauguugaaucuaacacaauuagauuugaaggaaaaaaaaaacauaaaugaaaggugguauagauccuaaguuucagauacaugcauacacuuugggguaaaguuuuguuucuuuugaaugcugcuaucgguggguauauuauaaacauauauaucuucuacagcucuuauaacuagaaacuugauuugguugagugcagaucuuauaucacuaccaugauaggaaauaguccagaauuaucuugggguucuuuuuccaaacuuccuucacuccccacaagaggugaaaauaauagucucuugagccagguuagugaugguagugaaaauggaaaacuuuugauuggacuguacagaauccauaaucuuugcucuagaaagggagccacauauuguauucuauucaccaggucaugguugucauccuguggccaacgugggucccauucuauguuauuucccaaacagcccaugaaaaccacccuauuaauuagcucuuuccuucccauucuuaccuacuuuuugggaugcagugaagacuucuuuuggauuuucuuucuucaaaaaugguguguuuuguuuuuauuuguauuauuuuugguguggguuuguaugccaaaacauugaauacuuagaaaaaaauguuacaugccauuuuucuuucuuuccuuccuuuuuuucucccaauaaauaccuaagguccugcugugugcuagguagguaggcaucaggguacaguacauugaguaaaacagcuauggugccuguugucaauauagggauucauuuagugaggaaaagagggaagcaauacaugaauaaaauagauaauuguaauaacacuguggaggaaacaagaaauaaauugagauaaaccauaacaugaggaggccuguuuuagacuggcuggggaaggcuaugcagaggugacguuuggcaugagaguugaagcauuauguaaacagagaccauguacaaagguuuuaggguaggguggggaggagcuggcuuggaacggagauaagaugaaggugaagcuaaguugagagaaagagauauucaguccuuacugacugugguguacaauguuuugauuuugagggugccuaacuagguagagauuaaagcccuuuacuggagaucugaggacuguaggugucuuuuugaggaggaugauuuuuggacuuaaguuugaaagccaauuugaggcaucaggcagguauuugaauauaugggucuguuuuucaggggugagguuucagcgggagauacaaauaugggagacaucauggaauuuaaaucauggaguggaugagaucauguaagagaguauagagagguaagaggcucaagaagcuaaccuugaggugcucuaacauuuagagcuugggagagaaggagccagcaaaggagacugauaaacaguuggcaggaggaaaaccuagggcauguuguauugggaaugaguaaagaaaacauuuccagagggaaggagugcuccauugugccuaauacucccugagaugacggauaagguaagggcagagugcuuuucaucaggcuugaaacaugggagccucugggaacuuuacaaggucaguuuugguggaguggugagcagaugcugauuguaaugggcagaugaaugaaugggaguuuguaaggaagggggauaaugaguagagagaaacuuuugauaaucccgguacaugaaguggguggggcccuggaggggaaugggaauguaagauguuuuauucaggguucuccagaaagacagaacugauaggacacacacacacacacacacacacacacacacacacaugagaagggaguuauuaggagaauuggcuuauuugauuauggagacugagaaguuccacuauuggccaucugcaucugcaugcuggagaaccagagaagcugguagcaggacuuagucuaagucugaaggccuuagaaccagagaagccaauaguggagcucaguccaagguggaaggugcaagagcccagggaccacuggugugagucuggagucuaaaggcuggagaaccuggaguucugacauccaauggcaggagaggaaaagcggccaggcucuuagagaggaugagaauuugcccuuucucugccuuuuaauuccaucugggcucccaguugauuggauggugacuaccacauuuagggcacaucuucuccacuuaguccacucacacaccgucuccucuggaaacacucucacagauacaccuggggcagcucaauaauucuaaucaauugcuaaaccaccuggguuucacuuugaguagauaaaggaugggcccagugccuacugaagcccugaagaauaaucaguguuugaccagcuaucuggauauucauuaaucuagucaaguugaaccccaaauuaaccaucacaugggguuaagcacaggaggguggaagcacagaguuugacuuuuuuagauguauauagcauauaauaaauauuaaguucaaccuuacgaaauuggugauauuugacuauguuuuaccuaugagaauggcauuuucguauaguuugaucuaauagaacauguuacauuacugagaaugaguugcuuuuagaaguggaacuugauugagcaauauugagaggguuuaaucaaaagggcaaagaacaaagccuuggagcaguugagauaaaugggauuguugcucggcagaggguuggccuuugaagcagggagaaggaaaggcacacaguuuuccaggaaggcaggagaagauacacagauucagccaugcuggaaggaucacagugaggccaauaccagcggguaguguccuauuugaggcaaauaauuauguaauaaauuuacggauuuagcuguagauacacauugauugauuuuguucauaggacugagugguaacugagccuguucuaccuugugguagacucuaaauuuguucucucaaagguauuugauaugugauuuuuugcuugguuuuucucuuucacuaaaagcggaguaaaucaaauaucaugaccuccuuccccacuccugagcggugcaaugcuguggccucccuguagaacugauuagcaaaucaaagaauaaaguaguuuucucauaagugauuuucuugcccuacagaaaauugucuuuuucaauguuacuauaaguauucuuugacuucucagcauaauugaagcauuaucuaugauuucuguuucuuuaaugcagacuacaagugcauccuuuuaaggucauuccacucuucucugucacauguacagaauuugcuuaugaggguguucauuucaagaauuucaccuguuuggagggagacuuuauuccaccgcauaauauaauuuuaaaaaugauguucuuuagaccauugugugcauauaucccuaggccauaauuuucuccauguacuuaauucaguacagaauuccagguacugaucauuaaugauaucuuuaaagcuaaaugagauugaaagucaucuuuaauggcuguaggauccuuuuuucaugaacuaacuccucuagcuaauguuuauuuugaauaauacucuuauccauggauuaugggaccaaagccauaauaaaaauauucccaggaaggguugucuucuuauucaguguguacuuguugagcuauaggcaguuuugcuguguauauggcucuaaaaugaucuuuuccucaaaguacagaaagaucuggagaaaugugggcacucauguauuaaguuuguaguauuauaauauuguaaguauaagauaaaaugugguauuuuuuuuuuuuugagacggagucucgcuuuaucgccuauguuggagugcagugaugcgaucuugguucacugcaaccucugcuucccagguucaagcaauucuucugcgucagccuuccgaguaucugggacuacaggugcaugccaccacacccagcuaauuuuuauuuuuuuauuauuuaccuauuuuuuuuuuugagaccaaguuucgcucuuguugccgagccuggggugcaauggugcgaucuuggcucaccacaaccuccgccucccggguucaaguggcucuccugccucagccuuccaaguagcugggauuauaggcgccugccaccauguccagcuaauuuuguauuuuuaguagagacgggguuucuccauguuggcuaggcuagucucaaacucccgaacucaggugauccgcccgcuucggacucccaaagugcugggauuacaggcgugagccaccgcgcucagccgcuaauuuuuguauuuuuaguagagaugggguuucaccauguuggccaggcuggucuggagcuccugaccaggugauccacccaucucagccuaccaaagugcugggauuacaggcaugagccaccgugcccggacaaaaugugguaucuuuaaaagcucuguggugauggcauuuuagauuaagguaauguuuuauuuuaugaagauguguagcuguacugcuggcgagaugaaucaacauguucuaauacugcuuguaauaagaguaacuugauuuaccauuaccugcugugguaaauuuguaucuucaguauuggaauuauucaacagaaucuaucagaagggauuucaaaagcugcagucugugguguugugauaagugaagaaaagcauuuccccuauuucagacagccuuugauagcauauguauuuaggaaaauauauacagauucaucaacuguaccugacucaaauauuuuuagcuucuuuggguugaacuuuggguuaugccaagggauccccuuucgucuuuucauggagaaucacuuguaaccaauguugaugugcacuuacaaagaaggguguaaagguuuauaggacgauacuacucgacagcucugaggaucuggaaucuacaugguucaacuagcuucucuauuugagcccugaacuaguguugcacucaucucccauuuccuuugcuuugccauuuccaguuguaaagugaugugugcucccucucuugccuuucacuggugcaguggggcuugucuuucaggaugggaccugugcuaaaacuuuuucuugucucuguguaugcugauaaacaggcuuuagaguucuaucuuguggugacuuaucaccccaccccaucuuagagaugacaauugccuuuaaaggacuauaguuuuaauguguagaggggcucuuucuguuaugugcuucuaaguagagaggccugugagagcaucuuucaggucugagaagguacauggcugucuugugcuccuuucuucucuagcaucaggcuguagauauucaccccuaguguuguauugcccccaaccacugccacccccagugauuugcugcuaauuuuggcuacuuuuuuuuuuuuuuuaauuccaaaaucuguugcagucucuucggacuucugccaauucuggcauaguuugcucaaaugauuggccuuuucuugguagaucucagucucuuaacuucucccuuuccccuuguugaacugaccaauaaccugugaguauaaaccuuauaucuuguguguuauauggucuuucauauuuuuuccuaaagcauaucaugucauacauacuauuuuuaaacugccuuuucaccacuucugaaaauaccuuuccuuacuuuaucuucugaaaauaccuuuccuuacauuucuauuuuaaaacaauuuauauuucuaaauuuucaguggcugacaucccuuccaugauaaugaaucuaucguuugaccaguccccuacuuuugggcguuuggauauuuucuauccuuuucucuuuucucuucuuccuucuuuccuuucugcuuuccuguuauuuccugguaaugaguauccagaguuguuuguucaccaugcauguaguuuuuuaaaaccuuaauguggguuuuuugaggcuuuugcuaguuauaacaucaccuuguguguucaaagacaggggcccguaucuuaugcaugucuuccuagcauacaugccugacacaguggccauucacuaaagaauuauuguugaguuucagaaauaugagggccauuugacaaauaaaugaguaccuucuauguacuuggaacccaggauauaggggugaacaagguaaagauugucccugcucucauaaggugagguauuauuuuguauaacgagguuuauguuacagagauggcaacccucuuaaugugaggaucaaugaaaaaaauuuaagacacacaguauagcaaaagcagacugaaugacuucggguaugguuacuugggagauguucaugcuuauggcugaauugacuaauugauuuuuccauagaugauauuucuuauuuaggauuauccacuaguguuaagggauugagauggaaugaucuuuuucaaguucauacuuuuuugacccuugugaguaacuccagucaauuauacuuaaauuaaaaauuucauaccugaauauaauaugcuguuguacagugauuccagggacccaaagauauuuuaggacugaguuuggggggaacagaaauauuucccaaaauauuuuuggucuuucuguugcacgucuuaaaauaugauuaagcaaagauugcagccgcggagaagauuuucugcuguaaauugguguuucaacccugccagcuguucaugcuuucugcgaucccacuuauaaaaguggaaagugaagggugaguggcugcccucguaggcaaccacauaauuuaaaaaaaaaaauguguaugccucagcagaucuauauuaguauuucauauagcugccuuuuucuuuuuuauuguagggccagcucucaauguugcaagaaaaaauagaccauuuggagcguuugcuagcugagaauaaugagaucaucucaaauauuagagacucagucaucaauuugagugagucuguggaggaugguccgaaaaguucacaaagcaauuucagccaaggugcuggcucacaucuucugcccucacaauuaucccucucaguugacacugcagacugucuguuugcuucacaaaguggaagucacaauucagaugugcagguaauguauacauucguuaauaaucacuggccuuuuuuuuuuuuuguucuuuuuaagauuugaccugaugucuguucugacuugguaaguugcuuaaacucuuuggauucuaguuucucuuuuuguaaaguauuuugauuagucacaugaacauuaauguucuguuuagugauaaaauuccauaauucuauuucucucaguuuaucuuacuauuuuauacuuacgugaauacagucuuuuuguaugcuuuucaggucuuauuuucuguaauaguugaaaaccuuuaaagguuuaaauuuugccagagauuuuuuuuuaccuuccuuuggagaauacaagaaaauccauguucuuauuauauaucaguuguacauuauagauuuuguacaaaguaagguuagacuuuuuuuuuuuuuucuuaauauccuuuugcaagagggaagggaaauauucuagagcuguacuuuccaguauggaagccccugucugcguguggcuacugagcacuugaaaugugacuaauguggcuugauaugugcuguaaguguaauguacacacacaguguuucaaacuuagugugcaagauaucuuaauucauuuauauauugauuaugaguuaagauaauauuuuggauauacuggauuaaugaaauuuuaaaauuaauuucaacugcuuuguuuuacuagaaaauuaaaaauuugguuuguauuauauuucucuuggacagcgcuauuauagagggcaauggagucgaaaaccagcauuggaaaggacuucugccuuucuuaaacucagaguguuucacucacauuggcucugcaaauuagggcaaggcuguguuuaaccuugugccuuagaccagaaacuggauuuugggggaaggauccuaagggguaaauauuuuaaaguuggacaaaauuauuuggcuucuggccucguuuucgaauauguacuuuccacuaacugcugagggcagagaacaugauaugaucuugaggucguggcucacaggccaagcuggaagcuggggacaguggagcuggccaggucuugcaccugcaaccucaucagcuagaguguagccagauucugauaggaucagaauccugugcuuacagggauagcuguuucugugagguuuggcuuuauuuaguuuuuuguugaguacuucuugaguaccuagccuuguugucauccaugauaagggaacagcaaaaaaaaaaaaaaaaaauuauuuuuguuguguggucuaaaucugggcuggacagaaaggaguugcagagcaaccauggaagucaggcagagcaagucaggaggguacugggagagcugcaggacugaaggaagaaacagacacugcuaacacauccuccugcccagcuuguuuccaaagauuugucagcuuauccuugagaagauuuuauuuuauuuauuaaacucauauauuccauagggagauaaauauuauuggcuuaaaauacuuuguauugacuuucauauaauuuguuuggccuuuaaauuuuuuuuauaacuuauauuuggaugugauuuuugcagucuaguuuuaacauaauuuaaauuuuacaaaagguuguuugguuguguugucacauuuaauauuauagagacuaugaagaacaaaaguaaaguuuuaguuuuuuucccaccguuuuuuccuuugcaucccaacauuauuagccagaaggaaugcugcauugaaaagcuagaaaacaauaggauacauaaaagcuaaaucucaauuuuaaaauuuuucucaauuuuuagaugauuaugccugguugacccuguuguaguuuuacuucuaggauaagauagguagauauaacauaugcuacauggcagaauagcuauagauagauauauuuuuguucaggcauagauuuuuaauauacaugagauuuacuauaaaauaaagauagcacaaaguaaaauaucauuuucagaacuguuuuugaaaaugcugaaauaucuggucauaaucaaauuucaucagaaauuuuuuucaugguucuuuuucuauaaauuucuauuaaauuguuuuggaaguaaaguaggagaagaaggaauagaaugaacuuuuuuuuuuauuagaagcggaugggagggauuauuugucaggguaguuuuguagcacaaauagcauuucaagccuuugaauggugauggaauauuuucuacucuaaacuccucaaugucuacagaaauaguuuuauuuuauaaaauacauaugcagaguauagcagugaauaauuuugagcaaauauuuaccaacauuaaauuaauaauuguuaaacuuuaauuuuuuuucuuuuacauuuuuagauguuggauguuuacagucuaauuucuuuugacaauccagaugguggaguuuggaagcaaggauuugacauuacuuaugaaucuaaugaaugggacacugaaccccuucaagucuuuguggugccucauucccauaacgacccagguaaaauuugcacuucaaaaagacaggagguuauuaaguuucuuuaggccuagagucuuuuaaugagaaucugguagaggccacuucucaaauuuuugagacauuauucucugacuuuuaacauuaauauauuccuuuuaugugucauuauguuuuaguguucucauuuuaucaguuuaugugccauucaaggauaguaucugugcaguaugaaaugguaauaaacaaaaaagaagggcuugccuuuggggacaaaacaguauauaguuuuaagagacugcuuguucauuuuaguaacuuuuuaaaaaauauugcauaggaaaauuauuucaugucuaugaggucuacuuuuagaaaaggcagaauacucaugggaaaguuugaaucuuuaaaauaaagaagcaguauuaaaugcuuuaagaaccuugguguugauugguuucaggcacauacgaaugugagucucagcucucuguauuuaucaguguuagaugacuuuaggcaaguuacuuaaucccucugagaccaaguuuuuucccugguagaaugaggauaguaguaucuguuucaauagggugcaaagugaaagaaucauguauggcacaacaguagcugcuaucauuauuguuacugcauaugauggcguuuauuuauugggaccacagauuccucccuucccccaccccugaccccgcccugccaagaugaggggaaguuguuucaauuauaaugggacauaggauuugauauacauauuuguugguuugaguacccagucacagauaauuuaguugcagcauuuuuuuuuuuguggggauuggagagggggguguauuuccaaagacuuauuuugaaggaguguguuacuuuucuuaauaucucgauuucaugauuacugucagaagcacugguaaccuaauaauuugaagguuuuuuucuuugcuuccagcauucauuuaucuucuacuuacauuuuuuccccauuaguuuauuggcagauauuccuauuuuucuauuuugaagacaacaaaauauguuacuuuaggucuggacacaugauuuagugaagcauuuuuuuugugcgugugugcugcuuuuggaugugagagguagucugcaagcuuggauauugaaaugcuuggauuucuagacuacagugcaauauuuagugugcacugacauguaaaauauaugaaaucaauauucuggaaauuugugaugagcaguuauuacaccucaccuucugacuugauuucccuaucuuugaucuuaaugucuuuaucuuuuccuacauauaccuguuaguguuauguuuuccucauauauauuuuagauugucuuucuccuuaaucuuagccuguaccuuuuaaaucaaaacucagggaaggcugggcaucauggaaggacuucagggauuuggagcuaggcagaaugaggcagguaucuuggcucugcgguguauugccuguguguccuugggcacauugauuuguguaucuguaaaauggagaucauacagguggaguaacaucuuaagccaggguuaguuauaaaguaauuauaaaaggugaugaaaauuacauguaauccaaauuucuuugcuauuuauucacuugagugcagauuaguuaguauauuugcauuuaggggaugcauaugaaaaacacguaucuuugauuacuagacucacacucagugaggugaggugcucccacuuaauguaggaucuagauggcuuauggcacugcagauuuuuuuucucuauaaaucucauaaucacuugacuauucaauuauugagugaaaugguggcagagccacuuguaauaucuaaguuguucucccuucucuuucugccaaucauguuuaguuuaauucuuguuacuuaauugggagagugaugugauuccauaguguaaucuuccuuguaggcuuauaaauauacuucaaagugugucuugugagucuuccucauaugaagcccacuucuucccuuuucuugauuuuuuaaaagaccuuuauucuuuuccuuuuucugcaacuuuuaauucucaccaaucucauuucuuguuauuccauacaugggcacuuaacuguaauaauaaaauccaugguuuacugggcagaaugccaaauguuuuacaaacauuuagugcauacgcaugaagguuagugccaugauucacgaugaagguguuaccagguuacauagcuaacaaggggcaccagaauacuuuccugacaauuuaccuggaucucccacuaaaguaaauucuagcggcaaagaacauaugccuccuauuaaacacacucuccucauggccuagcugaacacuuggcauauagaauaauugccaaauaaauaagaccucuuugaccuuucucaaagccccuccaccacauacucauacugcacacacacgccuccacgcuugcaggucuucgcagauguaaacauuuacagcacuuuuacuuggucuccucacuagaauguuagcucauuaagggcuggaacuuuguuuuauucacugcuguguugggaaugccuagaaucauaacuggcacaugguacugagucauuagaguuugguuaaauaaguuaaugagcuaaugaaucugacucuucaaacuaggaugaaacauuugacuuauucuuuggcguaggcuuuucuuuuaaguucccuccuuccugauggcuacuuauuucuauucuuaaaaaaaaaaaaacuuauuuaaaguacucuuuuguaauuuuauguacuaaaaacaggcaauaauaagcucuuugagggcagggauugcccucgauuuuuagauuuuuuguuuguuuguuugcauuacuauuccugcuuaguuaguaggucaucuucugaguagacaucccuaguaaguauuccugacuauaaucucuuuugguauccuaguaacuauagcugaaucuuuuugucuuaguaaaagauguuaaugacccugacucucaaacccuucuccacuuggaaaaaauaauugucagaaacaaacauuuuaaaacuacagugauuuuugcugucaagcaaaaugcuagagagaagaauccacugacuuaauaauuuucacuauuccuuaacuuaacaaaaguaaaauauugacaaauaaauuauucugugaaaaacugaauuauucacaucaugaaaagccauucuuuuuuaauagaggaaaaagagaaaaguguguucacauacacugcaagucaaaaugugacacuauaaugggaaaucuuuguauaauacuccuaaaugaaugugcaauuaggcaguguucuuucuaaaugagauuuauagagauuuguuugcauuuucugcagcaacaauuuaaaacaagcuuuagcauaguaguuuguuucaucgguggauuuucgucuauugggaauagaaauauuugaaauagauuuuuaaaaauuuucuauauuuaguuccccaacuuugugaauuuauguugcuguguuuuucuauauauagauauuuuucuuuuuggacugaguugguaauaucucucaagaaaagguaaauuucaaaauauguuuguauuuuaauaaaauuccaaauuauguuacagucugaaaagaucuaacaauugucauaaaauauuuaaguguuuuacaugaguaaaaacugaauuggaaaagaauugugaaguaaaugcugauaacuuuguacuguuaugcuuuugaaaguuuugaaucauagaccaugaaauuaaauguuaguugauugauacauguucauguuguauuuaauaagcugauuaaaacacaauuacagcaccucuguaucuauaaucuuaauucuuugcuucccacuaguuaaacugcugaaauauuugguuaauuuuacuucaaagaagucacaguguguggagagaagauaagguauacuaaaugaaagauuggacagcauauuguuaguuaagcaauuugugaaaugaacauuagaaaauaaucccccuugugguaugacucuaaaauaguaggaagaccuaggcccaagaguuacacuggaaaauaauuuucuuuuguacauuugcaauucuuuuguagaacuuuuuauugacucagagggugauuaggacuuuuugcuuuuuuguguguguaaaauuaagaaacagauguuugcauuuaguauuaugauaauuauguauccucuaaaaaaguuuguaaaaaaagaauaaaaacaugaggaaaucaguguaauauuuccaaauauuucuauucaaauauuuucaaguauaguuagaauuugaaaauaguucuggucagucauaguuggcuaauaucucuauuagggguguccaaucuuuuggcuucccugggccacauuggaagaaaaauugucuugggccacacauaaaauacacuaacaauaggugaugagcuaaaaaauaaaaucgcaaaaaaauuucaaaauauuuugagaaaguuuagaaauucauguugagaugcauucaaagccguccugggccacaugcagcccgugggcugcagguuggacaaacuugaugagaggugguggagacuuagaagucugguugcuaaaggaacuuuacugaucagaaugagauggucaucggaaggagaaguuguacgugaacacuguuuggagaguacuuuauuugguuuagcuacugcaggauaaaguggauuguuugauuuuggcugccaugaugggaaauuuuaguuucuggagcuaaaaucguaugcggaacaacugaguucuggcauuuauugccuguacggcaucaggggaguugcaggucuuuguuauuuuuuacuuugugugauuuuuuaacccugaaaagugguaaaugaagccacauuuaacaggugagggcagcgaggcuaaguuaggguaauuuguucaaagucaguuaauuuaauuauaaauucucagagguuggugaauugaagcucaggauugccugauuguaaaaucuguguuuuuuccauuuaccucuuuuuauugccucuuaagauacuuuauuuaguucaaauuauucuauuucuuuucuucuuguguuguaggcauuagcuaauuuaacacauuuaucuggacuuuggguuauuaauaggguugucagauuuagcaaacaaaaauauagaaugcucaguuaaacuugaauuuucaauaacaaugaauaguuuguguguguguguuuguaguuuguguguguguguuugugugucccaaauaucacaugcagcaugcuuauacuaaacauuuauuuguuguuuaucugaaauucagauucaacuuggcugugcauuuuaucugacaaccuuaauuguuaagaaaauuguagcacuugaguuaaauggcgcuguauggcuauuuagaauucuguuuuuagagaucucuaaaauauguguauugagauucuguuuuagaggaagaauagaugguuuggucucucauuggacuuuauucuuugaggagcacauauguuaagcagcugcugagaaauuuagaugaucauuaaauagcucuucuuucuccucaguuucaguuaccuuugucugucuuucaagccugggugcuucaaaacucuccagugcccugguaauacaaauaauuacuaacacuuagggaauuauuauguucugugcacuauucuaggcauuuuacauauaucacauccauuacuccuuucagcaacuucaugacagagucuguaauuacccucccuucauagaugugggagaaguggcaggagagagcauaagugaucuguucauggcagggcuagguuugaaaucaagugaucuuuuuccagaaccaguacuuguaacaguuuuuaacauauugcguuuuuuggauaauucuucugaaaccacaggcugagcauauaggagggaagucuuuuaaguauuuccaagccaaaugucaacuacuuuaguauuauuaaccauaaaaaagauuuuuuucagcuaucuugcaaaaguggacaucucacugcacuaucuccuauccuucuuuuccuucugauuuaucuuaauugaaaugaaugucucugucccuaaauacuauauuaguacaugagauagugagugauuuuccugauugccacauuuucuacaauuagaaagugauuuacaagcaauauuuuccagcuuuuguuuuguuuuguuuuguuuuuugagauggagucuugcucuguugcccaggcuggagugcaguggugcaaucucaguucacugcaacuucugccucccagguucaagcaauucuccugccucagccaccugaguagcugggauuacaggcacacgccacagugccuagcuauuuuuuuguauuuuuaguagagaugggguuucaccauguuggccaggcuggucuagaacuccugaccucaagugauccguccgccuuggccucccaaagugcugggauuacagacuuaagccaccguaccuagcaauauuuuccagccuuuaaguugguuucuuuuagagacuuugauaauuugcccaguauuugucuaaagcuaaguagcccccucguguacccuaagaguaacccaccaaagaaagucacuuuucuuucuaacagugucugucauauuuuagacaguuuucucauuauuucaaauaaccaagcucuguuuggggaagacuuacuaugccugaaguauugucagucaguguuagaugcucauagaugggaucauuaaugagggaggggaggagcuuuagcacagauuuagaaauuaucuuggagauugaucacacaauugcagcuaugagaaaaaguaugcaggucuucuaaggggcacuuagaaaagcaauauaauaaggggucacaguuguacauuguacguauagggcugcaggaugaacaaaacgccugcuguccuaacaauaaugcaaauagguuccucuggugugggguaaaauuuccagugacagcaucuucauauggauucaaaaaaugaucucucucaaauaucuucauugaauuaaagcugauaugcuuagaaaacuauuaaaugacacugaaucaacugagaaaaacagguuagauuauuuuggaaaccuggguucaaaagcauuuagaggcaucagcagguuucuagguuuuccaagucucacagaucucuggaagccucagcuucaucugugacugucuucuuacccucucuuggaaacuuagucgauuacuaaguucucuucauuuugucuccuugaccucuuauuucccucuguuuauuucaacugcaguccauaaccauuuuuuacagaauuuugcaguggucucauuuucuguuucucugcuucuacuuugccuuuuuagucuucacacucuuaguacaguuauuuuugaaagcacaggucagaaaacccucauguccucccuccaaaguucucuguaagaaacaggaaugguuuagaagguuuucaauaaucugucucccacuucuauuuuuauauuuauuucucaccauauuugcaucauguacccugcaaugcagccauaaccaacuuccugucuuuuccauaugcucuucccucuauuuggaacuaccacccuuuuucucucuccagaugaugacuaaucuaagaaucuuucuucuuuucuuuugguaagacuuuaccauuucuuuauuuccauggcauuuuauucauauuuucacuguagaaucuguuuucauuuagcuuuauugcuuugcccuuauuagaugcaagguacauguuugaaugaauaaaucagaacguuaauuaaaacucuuucacaguuuaucagggaggaaaagcaagcuuaacuuauaauagaaguguuggaauuaaaauuaaucagcagcguauuugaguaauaguaauaccauuuaagauuguauguuaccccauaaguauaugacuagaaguugcaguugaauauugaaggauuaaggagugauggaagaaaccuguucgucauuuuuucauagaaaauaccuuaauuacuagaugagaacaauaaacacugaggauucugaaaggagggagagagggaagggggaaaggguugaaaaacuaccuguugggcacuguguucacuauuugggugaugggaucaauagaagcccaaaccucaacaucaugcaauauacccguggaacaaaccugcaaauauaccucuugaaucuaaaauuaaaaaaaagaaaauaaauuauuagaugaaaggauauuucuguuuuuaaugaacuuuauuuuaaaauuugagaauauuuaucacauugaaauggaaaaaaaaucuugaggcuuaaguugcauguguuguuuauuaccaauguauuauuuaucuggauauaauuauuuuuuauucaaaaacuuuucauguuuuccugaagauuggugcuuauuuaacuuuugaguggaauuaauauacuuaaaaaaucguuauuaauaaaaauaaaaagaaaagaaaaaaucauuauuauagcaaucaaaaccauagcaguguaacagugcuuuguggagcggggugccuucuuagggauggguguuuuaaucaucuuagggcucacagauccucuuaaaauauaaguauuuuggaaacuuaaagauaauggacaaugauuauuagguauagcaucagaacagagagugaacauauuaaagcuaauaugguuguauuauuuuaucuuuaguuucauuucuagcugaaguaauaaauuugcauuuguacuuuuuuccuaguccuuuuggcuauaccuuucauucaucuuauuaaguacuuauugaacucuugcucuuauauguuugcaguagauacuagauuaaguuugagugguaugugugcucaggccugcuucuaaaauuugcaggaacuggggcaaaguacacagaggcccacauacccuguguuuaaacauuuaaguuauaaaucaaagaaauaaauuacuaaagaaaaauaggucuucuccucuugccuggagaaauagcucagugaucuagaagaccaaauguagguuuagauugcuguugcucuaguuccccacuggaauauggugguguguauggggagagccagccuguggggcaggccagcugccuucuccucccaggccuggcccugucccaaaccaggaaggaccuugauugaagcgguccuggugccaggucuacaccccuacaaacuacagccucuuggccacuguuuaggcuagagagggucggucccauuuguuaggguuaagugcccugauggggagagacuuauaagaaucccaguaggcuuccagucuggggcuguuuagacagauuucuggacccugguacucagaagggcagggcaggcucugggucaguuuguccuguggauuuauccaauugaaagggguguagucagaagaauagggagguccuucuagaguccagggcucagggccagguaacucuugcccacauccucauggugguacuuaguguauaugcccuugaaccaaauaaaacuaaauguuccugaagagcaucagaacuccacauaaucucuagauuuccaaccuauggcugagagcucaaaauuuuaaaaauaaauugugauuugugaacaguuacuaggugcuuaauuguucaugaacauugaauguagacaauagaguuuccagcuuuauuggcuuuuuuuauuuuagaacuuaaaaaaaaauagugguaucgaauuuggguuuaugccugcuuuguggaacuuguaauuaugcacucuuuguuuuaaauauuuccccacuuauuuaaaauagcuauuagcuuuuuuaugggugguaauaguguuagaauggaaaagaauaaauugaaagguauucuuaaugcuguucuagcccucguucaauuuucagggauauuccaacagaaagaaaaaaagcugugaauugaccacuuaaguaaaucaguuugcaacucaguguccuaagauuauuaaaucuagagguaggaauauaauuuuaugucaugaaaauucauccccuaccacuuuuuauaaaauacuauauuucugguuggucucauguuaauauacaauuguaguuuuuacaguaauuuagaaaacgaaagaaccaauucaguguaaaaggaaauacuugauuacucuguuguauaagagcaauaaaagcuaauuuacuguuauauuacucaguacugaaagcugcaagaggcuaucuuucaguucauucuucauuaauuaugcuguaugguggugauaucaguaugaguuuuauggaacgcuuucagguugaccucucugagcuuguauuuuggcucaugugaaugucuuuaccauauuuuccucaugauuguugaggggugaaugaaguguugaaggcaaaauggacuaaucaaucacugugauuccucugugaaaacucccaugauaaacucuuuuuugaaauggccuuaguucauucaucacagauuauaacuguugaaaauaaauaguugugcuuaacaaaaaacauacaaaaaaacuuuuacuuaucaaucuucauaaagacuaacccuuaaaaauuugccuuuuaugcuagauuacuggaguuuuauuaucaaauuaauuuggaggcauuucacuauuuauaguucuuuagcuaguagccagauaauuaggaauuaguuugaaccuuuaaauuuagguaaaagauaucaugugauaucuuaaagacgauaauucuaauagaaccauuucauuuacaugguccuuguugcacguguauaauaaaagcacgguacagaaauagauuuacuuacguacauuugaauuuagcucaguuuugcaauauguagguagauauaguauauucaguuaaauauuauguugauauuugauaaaauaaauucuucccacauugcaaucuuuauuucuuggaugguaaugacgcugauuuguucuagggcugaauaaguuugcuagggcugccauagcaaaguaccagacuaaguggcuuaaacaacagaaauuuguuuuuuucacaguucgaggcuagaaguccaagaucaagguguuggcaggguugauuucuuuugaggucaucucuccuuggcuuguugauggcugucuucuccuugugucuuugcauggucuuccuuguguaucuguguucuaaucuccuuuuguuauaaguacaucaauagucauguaggauuagggcguaucuucaugaccucauuuuaccuuaauuaccucuuuaaagaccugucuccaaauacagucacauucugagguggugagacuucagcauaugacacagaucuguccauaacaagggcauagagugaauucagugcaaacugaaauuuuggguaaccaauauauguuuuaagauguggagcaguuuauauaaguguuuuaauuguauacuuuacaaauuggguguucagaauauuuuuuauuuccccuuuaccuaauuuaauuguacagaugugggaaagggcaguuaaagacugaugaugauaucaguucugagcacuugauguuuuuuaacuugguaguguugguauggucaucagggaguuagggcaucuggguugguuggacuuucugggcuauucccugggaauccagagguggauccuggcucagugcucugggggcaguguuccagguuaguacuuuggugaagcuaggugggauucuuugcagaccaccauuucaugaaauaucuuugagguuuuaaaaauagacacaguuuuuuuuaguuaaauguggaaaaauugaaguauccaggagguguucuuugguaccaaaucagguuaaaagugccccagaucaagaaaguccuauaaagacuauuugacauuauauuucuauuuggccuauagcuucauacgugccacauuguaggugcucaguaaauaauuguaggauggaugaguagauuucaauuaaagcaagaggaauaaauaagucauagcugcagugcucuuuucaaaagcucauauucacauugucagaauaguuuugucuucucugcccuggcaggcuuuuauuuuuuauuuauuuauuuauuuuuugccagcaaauauaguauacauauuaauuuaacuauauacagauaagaaacagccauuuggacccucuuacucuuuaauucucucacauguaaguuuggaaacaauagaccaauaguucagcuuggauauacaggaacuucuccuuauacgauuuuuuagaugggaacggguuauuuuuuagggggucugcuuugccugccaccaguagacagaauugguggcuguguacguuuuugcuuggccguuuuaguagucugccuuguggugcuauguuugcaccuguugguguuaaaaauguuucuuauagccaaauugcaacuaucuuuagauaaaauuuccaggauauuuggaaaguagaggaaaaaacaggagaagcaaacugucaacaucuacaguucucuuuuugaaaaauuuuaccuauaugcauucgcauuuguuguuugauuaguguuacuuugugcuucuaaggaauugaauaaugaacagcuuuugggaacaaaugccuguauuuugcagaauucuaccucucaguguucauauuuaugguguaauuaccuuauuggucugcugaaagcuuuuagguauaguuuauacuugcaaucucuuuuuucuuaguuuaacuuauuuaaugggugaagaauuuuagauguggcaugagaggauaaaauuuggauccccuauuaggauaacaguacugccaacuuguaaacaguguuuagauuuuuaaaauucaaaaaaaauuccuuagagauaaaaaauugaauuagauacuauaauuauuaaaauauaaauaacugcuuuuuggccuuaggucaucuaucuuauuuuucucauuucuaucugaauuugugcaguuuucagaguguuuucauuguuuuaauauuaguggguuucugagucccaugacaacuaaaauggaguuucauuaauugaaaacaccuguuaaauuuaaaaauaugucuaugaaugaaaauucuaacgauguccaaaguaaugcaauggaaugugacugaguugaaaucagccauacgaauuagaccuuugugguauauuugugucuugauuuagguugguugaagacuuucaaugacuacuuuagagacaagacucaguauauuuuuaauaacaugguccuaaagcugaaagaagacucacggaggaaguuuauuuggucugagaucucuuaccuuucaaaguggugggauauuauagauauucagaagaaggaugcuguuaaaagguuuguuuuaaaacuuuuuuggaauuugguaauauuaaagcuuaauuguacaaugaacuaaguauugaauuuuuagauggugaaaauucuuagcuuuauauuugaaacuuaaaauauuucuucacauaccguuuucguugauuuugguucaucucugaaaaagccauuugaaacuuuuccauuuaaauccuguguuccacuggaagcaguggcuuacugcuguaauccuagcacuuugggaggccgaggugggcggaucaccugagggcaggaguucaagaccacucuggccaacauggugaaaccuugucucuacuaaaaauacaaaaaaauuagccagguggugcucacgccuguaauuccaacuacucaggaggcucaggcacgacaaugcuuggacccagaaggcagaggguuguagugagccaauauagugccacugcacuccagccuggguaacagugcaagacucugccuugggggaaaaaaauccuauguuacaacuuugucccacaaauggaauuacuaggucaaaguggcuuaauaguuuaaaaguuuuuuuuaaguauauaauuaaagugacaccuguauaguuuguuucaauguauauuucaaucuuccauauagaaaguaucaauuuauuugcuuuuuagucagcaauauaauuuuugaaguuguuggccaauuugaugguugaaaaguuuaauuuuaauuuuaauuuuugauugguaacaguguugcauauuuucucauacagguuaagguuuuugugacuugcuuauuguacuuuuucuuacugauuuguaggaguauuuauacauauacuccuuaacucauauuuuuccucagauuuuuauuuucaucuuuuaguguuugauauacaaaauuuuaacauauuuaucuacucaaaucuguuauucuguuuucuucagauauugcuuuugcugucauguuuuaaaaaguuuucuccaaucuagaggucaaauaaauagugcuuuuuuucuuccuaauuucauuuuuuaccauucacuuuuuaaaaaacugauuaaaaaaaauacguuacgaugggagguuuucugaucuccauguauccccuggaguuaagaauuaucuuauaaugaauuguuuucuuuaauuuauuuaaugucacuuauacagcgcuuacuguauuagucccuguucuaagcacuuuacaaauuguaacuaauaaucuucuaaacaauucugugaaauagguacaauuguuaucauuguuuuacacauaaggacacugagucguccaggaucacagggcagccuggcauuccauguaguccaggcuguccaccuccagaggcugucuucuuugcacacugcgccauccugccuuccuaagauugaauuaguccauccuuuucuagugauuugaagugcaaucuuuauuauauuuaaauaugcauuaguuucugggcauuuugacuuguuucauggacuuuucuguuugacuguaauuguugugccuuuauaauauacuucguuaacugacauuugacguuccuucucaucuuuuuguuuuuaauauuuuuaguuauuauggauacauaauaguuguacauguuuaugggguacaucugguauuuuaauauaagcauauaauauauaaucagaucagggucauugggauaucugucaccucaaacauuuaucauuuucuugucuuaggaauguuggaauucuccucuuuuaguuauuuugaaauauaugauacauuauucuuuuuuuuuuuaagcaauugaccaaucaauuuuaauuaacucauucuguaugacuaucauaggcuauuaaaaauaggaaagcguguuucuuuuuuuuauuauuauuauuauacuuuaaguuuuaggguacaugugcacaauguucagguuaguuacauauguauacaugugcuaugcuggugugcugcacccauuaacucgucauuuagcauuagguauaucaccuaaugcuaucccuccccccucccccaaccccacaacaguccccagagugugauguuccccuuccuguguccauguguucucauuguucaauucccaccuaugagugagaacaugugguguuugguuuuuuguccuugcgauaauuugcugagaaugaugguuuccagcuucauccaugucccuacaaaggacaugaacucauccuuuuuuauggcugcauaguauuccaugguguacaugugccacauuuucuuaaugcagucuaucauuguuggacauuuggauuggcuccaagucuuugcuauugugaauagugccgcaauaaacauacaugugcaugugucuuuauagcagcaugauuuauaguccuuuggguauauacccaguaaugggauggcugggucaaaugguauuucuaguucuggaucccugaggaaucgccacacugacuuccacgaugguugaacuaguuuacagucccaccaauaguguaaaaguguucccauuucuccacauccucuccagcaccuguuguuuccugacuuuuuaaugauugccauucuaacuggagugagaugguaucucauugugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugcaaaaauuuucucccauuuuguagguugccuguucacucugaugguaguuucuuuugcugugcagaagcucuuuaauuuaauuagaucccauuugucaauuuugacuuuuguuuccauugcuuuugguguuuuagacaugaaguccuugcucaugccuauguccugaaugguaaugccuagguuuucuucuaggguuuuuaugauuuuaggucuaacguuuaagucuuuaauccaucuugaauuaauuuuuguauaagguuuaaggaagggauccaguuucagcuuucugcuuauggcuagccaguuuugccagcaccauuuauuaaauagggaauccuuuccccauugcuuguuuuucucagguuugucaaagaucagauaguugcagauauguggcauuauuucugagggcuguguucuguuccauugauguauaucucuguucugguaccagucccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaaaucauugguagcuugauggggauggcauugaaucuauaaauuaccuugggcaguauggccauuuucacaauauugauucuuucuacccaugagcauggaauguucuuccauuuguuuguauccucuuuuauuucauugagcagugguuuguaguuuuccuugaagagguccuucacaucccuuguaaguuggauuccuagguauuuuauucucuuugaagcaauugugaaugggaguucacucaugauuuggcucucuguuugucuguuauugguguauaagaaugcuugugauuuuuguacguugauuuuguauccugagacuugcugaaguugcuuaucagcuuaaggagauuuuggauugagacgaugggguuuucuagauauacaaucaugucgucugcaaacagggacaaugugacuuccucuuuuccuaauugaaugcccuuuauuuccuucuccugccuaauuucccuggccagaacuuccaacacuauguugaauaggaguggugagagagggcaucccugucuugugcccauuuucaaagggaaugcuuccaguuuuucccauucaguaugauauuggcuguagguuugucauagaaagcucuuauuauuuugagauacgucccaucaauaccuaauuuauugagaguuuuuagcaugaaguguuguugaauuuugucaaaggccuuuucugcaucuauugagauaaucaugugguuuuugucuuugguucuguuuauaugcuggauuacauuuauugauuagcguauauugaaccagccuugcaucccagggaugaagcccacuugaucaugguggauaagcuuuuugaugugcugcuugauucgguuugccaguauuuuauugaggauuuuugcaucauuguucaucaaggauauuggucuaaaauucucuuuuuugguugugucucugucaggcuuugguaucaggaugaugcuggccucauaaaaugaguuagggaggauucccucuuuuucuauugauuggaauaguuucagaaggaaugguaccaguuccuccuuguacuucugguagaauucggcugugaauccaucugguccuggacucuuuuugguugguaagcuauugauuauugccacaauuucagcuccuguuauuggucuauucagagauucaacuuuuuccugguuuagucuugggaggguguauguguccaggaauuuauccauuucuucuagauuuucuaguuuauuugcguagagguguuuguaguauucucugaugguaguuuguauuucugugggaucgguggugauauccccuuuaucauuuuuuauugcgucuauuugauucuucucucuuuucuucuuuauuagucuugcuagcggucuaucaauuuuguugaucuuuugaaaaaaaaaaaaaccagcugcuggauucauugauuuuuuugaagaguuuuuugugucucuaucuccuucaguucugcucugauguuaguuauuucuugccuucugcuagcuuuugaauguguuugcucuuguuucucuaguucuuuuaauugugauguuagggugucaauuuuggaucuuuccugcugucucuugugggcauuuagugcuauaaauuucccucuacacacugcuuugaaugugucccagagauucugguauguugugucuuucuucucauugguuucaaagaacaucuuuauuucugccuucauuuuguuauguacccaguagucauucaggaacagguuguucaguuuccauguaguugagugguuuugagugaguuucuuaauccugaguucuaguuugauugcacuguggucugagagacaguuuguuauaauuucuguucuuuuacguuugcugaggagggcuuuacuuccaacuauguggucaauuuuggaauagguguggugcggugcugaaaaaaauguauauucuguugauuugggguggagaguucuguagaugucuguuagguccacuuggugcagagcugaguucaauuccuggguauccuuguuaacuuucugccucauugaucugucuaauguugacagugggguguuaaagucucccauuauuauugugugggagucuuaagucucuuuauaggucacucaugacuugcuuugugaaacugggugcuccuguauugggugcauguauauuuaggauaguuagcucuucuuguugaauugaucccuuuaccauuaaguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauacagcacacugaugggucuugacucuuuauccaauuuuccagucugugucuuuuaauuggagcauuuagucuauuuacauuuaaaguuaauauuguuaugugugaauuugauccugucauuuugauguuagcugguuauuuugcucguuaguugaugcaguuucuuccuagccucgauggucuuuacaauuuggcaugauuuugcaguggcugguaccgguuguuccuuuccauguuuagugcuuccuucaggagcccacugucuggcacucucuagugagaugaacccgguaccucagauggaaaugcagaaaucacccaucuucuguguugcucacacugggagcuguagaccggagcuguuccuauuuggccaucuuggcugcucccugcacauuauucuuaacuauauuaaaaaguucuuucaaugagugaacauugaauuuugccaaagugcuuuguaauuaauuuguuaaauucuucguacuccaucaaaaaaguaaucuuuuuggauuuugaugaaaauugauguaaacauuuaaagauaauuuggggagaauugacuuuuuauaauuuccauuggaguuuuuuuuuuuuuuuuuuuuucccucuugauaggaggcuuaaaaugcuuacagguuugacuaggaagugaaggguauauuuucuaccaguacugggauuaauuaacuaccucauccaaaggggcuagccacauccacucuaggcaugugcugcuacuggaaccagaguugucaggauaucccuccaguuacucaagacaaacuagaauuccaaaauauuauguaaaauaccuagaguuuuuacacugaaauguuagcuauuaauuuagauuaauauaccaggauaugcacacauaugcaugcauaaacacacacacacagaguugcagacacacucacacagugcuaaacagaucacaucagcauuucugaaucuguaguuuagauacacuaguuugcaaccuuuuaaacauuaauaacugucuuggaaaaccacauaagcauugauauuuguuuuauaaaggcaauuuuuugauuaaguuuuaaauuuuuugucaagugcaguggcuaauggcuauaaucucagugaccugggaggcugagguaggaggaucaacugaacccaagaauuggaggcuauagugagcugugaucaugccccugcacuccagccugggugacugggcaagaccggaacucuaaaaaaaaaguuuuuuuuaggucuuuagguguuaccuuacuucuugagcaugaaaaauauuucguauuuucuaagaaaauaauuuuauaguuacucagauuguuucugauuuuaagaauuuaucccauguguaguuauuuuugcuuuuuuguuacuuguuuugggaaucugauuuuuuucuucauuuugauuuacuuaauuuuguugguuuuugcccaccuuacccuccuagaaccuguuuauauuuuaccaguuuuuacucuugaccuaucugcuuucaucuuuccuaauuccuucuacucacuuucacuaaugcuaaaugagccaguccacuuaauaaguucaucuguguguuuaccuuuuagcaauagucugacuagcuuuuauguuuuuauaugcuauuuucucauuauuguauuuuuccuacauauuuaauaacuguacuacuguuuucuuuuugacuuagguauguuagaaaaauaauuuucaauuugcaagugcuauuuuuucccaguuauacuuuauuauaaacuagcuuuaaugucuuauggccauagaauauggacuguauacucuuuuuuuuuuuuuuuuuuugagacugagucucgcucugucacccaggcugaagugcacugguguggucucagcucacugcaaccucugccucccaguucaagcgguucuccuccuucagucuccugaguagcugggauuaaggcaccugccaccaugccuggcuaauuuuuguauuuuuaguagagacaggguuucaccauguuggccaggcuggucuugaacuccugacaccugccuugaacucuggucuugaacucuugaacaccugccucagccucccaaaguucugggaucacaggcaugagccacugucccuggccuguauacuuuuuauucuuuagagauuuuugaauuuuuuuuuuuuuuguuacuuaaugugugaucaauguugaugaagcuucuacugguguuugaaaaggugggguuuguagaauauagaguuugguaucugcuaauuccguauuuuacaacuacuguuuuuaucuucguacagucaguuuugcugucauauugcauacacguucuuaaaaauaauguuaugcaaaauugugcaauauuaaacccagggcucaugaaaaaguaucguuagaguguagcacucuaaaacuucauuagugauguagacacacacagaacauggaaaccuaauaaagaugcuaauccaguuuuaccuguguuaaauugguuaaaaaaugcauaaauauauaugucaguuuaccuugaaaaaggccuaaaguuugcuuguggaaggguguauuggaaggaguauagauucgaguuauuacugagaagugauggcaaguagguuagcugaaaucuuuuggaaaguugaauagcagauguggaugacuguggcucauaacccuugaugaacugagggagcugguagauguuugaggugugugcgugugcuuugugcauuccuuauacagcuuuguucagcugcgugaaguuuuguaccuucaucuaauguuucuuggagacuaaauugugcauaagcaaggcaaaauuuauuuccucauguaaucaaucaccugggaacucauucccauuuuugaaacaaguguuuauggcagaacugacuguacuuauuuuuugcuacuguuccccuaucagcuuuuauuuuuuggguauuuuauguuuuuuuuuuuuuuuuuuccauucuugccugaucuuuguuggcuucuguauuagcucauucauucauucaacagacacuucccgaacgucuacuaugggacagggacugcaaggugggcacuccuagacuaagauuuauuuuucuucauuguaaacuguauguaucaucauugauaccaucuuuucucuuuuuuauaauuaauauuguuauacuaccacucuuuuguuguucguuugcuugaguuugcuguccuuuuuacuugaaggacagucagcuuggugguucuaaaggcugggaacuggaaccaguccgccuagguucaaauucugccaagucccaucuacuguguggcuuugagcaaguuauuuaacuucucuauaccucaguuucuucauuugucaaaugaggauaauauugaaaccaauuuuauuugguuuuugugaggauugaauuaauucagacaacaugcuuagcacaaugccuggcacauuuuaaaaccccaauaaacauuagugcuuuuuuaacuuuuauuugagacuuugaguauuucuccuggauaccauauguaauuuuuaaugcugaagucuucuauaaugggagacuuuucuuuuaguuuuuguuuuuuuuugaaacagggucccacucuguucucaggcuggagugcagugguaugaucacagcucacugcagucucaaccuccugggcucaggugauccucccacuucagcuuuccaguagcugggacuacaggcgcacaccaccacgguggcucauuuuuguauuuuuuguagagaugagauuuugccauguugcgcaggcuggucuugaacccuugggcccaagugauccaccugccucagccucccaaagugcugggauuacaggcaucagccacugugcucaguccguauaaugggaagauuuuaacuguaauuuuuuuuucucuucucucuuaaagcuuucuuauauaaugcuucauugaagguaacuuuuuccccaugcucacuuacuuuauuuaugaaauuucaaauuuucacuaaguuauauaucuagguaguauaacuuuucauuaagauuuccaccuaucaauucaaauguuucuuuagcuuauguguucuguacuuacugauuuacuacugcuuuuguuucauuuguuuuagaauucaaguacguuguuauugugucucuagucucucuuuuucauaugcauuuuuaauuuguuguauuuacuguguuuugggagauuuuucccaagagucuucccugccacucccucgguucaguacucugguauugagucuuuucuggcuuugaguauuugguucuaacuuuacuucugugcuuuuuguauuguuguccguaaguccaaguauuucccuccuuuuuuauuuauccgugagcagcaacagcuguauccacaccuggaauuugucccaaaacaugguguaacuugccuugaaucccuuucuuuucuaaccauauacuuucaguuuccuugcuguggguacuaguuauuacuggcugaccagcauccacuucaccugauuuccuuuugggaaguggucucucacccaaggaagucagcuccucuuccuuguugccuagcccagacaagucagcugugaccugagcucaguuaaucagcauauuauuucccagggcuuugaaucuuuagagagcgaagugagggcugacagauggagggagggaagcagacacagaagaauguuuacuggucauuccucacagcaccuugcauuugcaagacucuuccuguaauaagaucccuguguucccugcagcaugauuucucauuuuccuccagcccuuuguuaagccuggacuuuuagccugucuucaguucuguguguucaagacaguauccagcaucaguuuguauugcuugcaaaccagaaagcuagcugauaggaacuuacaacgucuccuuaguuccucuguuggagaauuacauccugcaagauuauaugagaaucagggaucagcaguuggggaagguguccugguuguaaauaggacagagugagagaagagaggagcuggggcuaugagaagaucuggaaaaggagugccccaucuaugaaagguuuucuguuucuuugguguagcugcugagccuggggcuggcuuucucccucuagcuuuguuuuuguguggccuguaagccagguaggagaugugugucugaaugugcugcuucacagaguccagccaccucagaaggaaacugggucugcugcuggcugcuuguggucaggugaggccagccaugcuuggcucucucccagcauggcuucauuaaggagacugccucugcagcagucacagugcaugggcagagagacuucugcagagggggacucacacaagugccaugagggcgaagagucugugauuaguaucugucccaagacucagcuuugccucagcccuuggcccuucaguuuaggagcuguugaccgaaucucucagaaucuucuuauuuaugcugggauuccaugcugauuuuucaugcagggcaguugcaggucaguacuugaauuauuucaguuuuacuuuuaccauaucugucagaaaugcugccaauuuuauggccugcggauggccuguuucuccugacucuaccuggaugcaaauuuuccuccccucucucuuuuuuuuauucuguugguuauuuuucuuagguugaaccauauaaaauugccaauauuugacuacuuuugauauacaaaaauggcaauuucaugcaucaguccaauauuacacauaaaauaugguaagauauuggaggggacugcagauuagaaucuagugcucaaucuuugucucacucagauuugucucacucagauuccuucugagugagaacagcuuuuuuggcauuggaaaauauucuggaauacaggcuugaucgugaacaguaucauuuugcuugaaggaaaaaugguuuuauagccagauuagugcagaugaauucuguuucuggucaagauuugcuaaaguucucucucuucuagcuguaauaauucacuuuuauucacuuauuacauuuguuuuuagaacuaggguaauagcauucccccccacuuacuugaacaaaacauucuuaguguuaguugcuuaaauguauguuuuuggaggaaaacuuaauagauauuuaaguuugcuccuguuauuuaaauucugagcuuguacuaaguggcauuacuaauagauuuuuuugugugacuucuaguguaaugcuuaugcaguggcuuuucucuuuuugaagaugagcuauggauuaaaucuguaccuaaauuugcaagcuagcuguugcagagcagaaccuguuaauuccagcagaguuccacguaagcuuucauugucccugaagaauaccaauugauugugggaacuuaacagaaacaaaacucaaaugauccuuauaaucuauucuagcagugacuuguuugauucuuauccccucccccagcagcauuauuauucaacucuauaagcuuuuaaaagugaaaaucuaguuaacuaaagagagaucuacguaaacaacaucuauauuuucuguuuuuuugugugaucugaaauaauuuaaucaauuauaaucauaguaccuacugguaauacauauccaguggauuuaaaagaagcugccuuccauuaaauaaucaguguauuguuuucuaugcuuguuuuauuuugaaaaugacuggugguguaauuuuuuaaaacuuuuuaggcuucacauuugaauauuuuuuggcuaaaugcaguuaaauacugcaugauguuuauaauacaucaaaaugugaacccuuauugagagucaggcagcugaaacauuagccuuagcauuuccuuugacuagcacacagcauguuacauauucauuguuccucucugggcucugagauauuggaacagcuuuuauauugcaucugcucuugcuauugagaccaguguugaguggagaaacccacgaauuauuagaaccuaagaacaguuuauauauucaccaaagucuugaccaguuucucuuuguggaucuuuuagugugaaaaggggcuccaaaugugugcugagaugaagguaccaucaguuaguauagauuuuuuaucuucaccaaauugguggguuucauugcuuuagcaagaaugcaaacucuuuauuuauauaaucuuuguacuaucuucuuacaauuuuuccccuagguuuauauuuaagugaaccuuccacugucuucucaacuaucucugcuugcuucuugaaaucagagaaauauuugauguuacauuuuuaaauaagaauccaaacuuaacuaaugugcaucuuggguuuucuaagaaauuggacuauuaaucuuccuaaacagacuaauucauuauacguuuuauacagguuggauuuuaugguauuuaacugaagguugcuguaaaauuuauagagcaaugggaaguuacagugugucuugugauauucagagucauuugcagauuuggauugaguuuagaaucuaaagauauuuagcauuucaucaaagcacugaaagcaaugcaccagggucuaaaauaacuuuaguucuaauaguugaagcagugguuuacguuuauuuuagaaagcauauguucuaucccuaccuuuucaauuccaguucgucuugagugagacggcuauccuuccaccucucauucccuucaaccacuggcaucuauuuaugucauggagaccuguaaaagccaugagggacuucucaggugcucugcccaucccuuggauacuuucucaagccucagagaggauuuuuuugcagcauugacaucgaucacuccauucuccucgaaauucuguccucuuuuggcuuugaagugaccuugagcucuuucacuuucgggucuauucuggcacugcugaccauucauuuuucaucaccucucugauuuccucuucugcuuacuuccccaauguuccuguucucgccuguuggggaacacugcuuaguuuucuucauuuugcaugcuuuuccacacuguuguuuuaauuaccaggcauuuggacuacuuccagaucuaaagauccaaccuggacuucuuguucucuaguuaguggcaauaguaagagauaagcacucguuuaauuauucagccaauccuguagcauucucuugaguuaagguucuuuaucaucuucauucuccuguugaggaaucugaagcagagguguuaaggaaagugccuaaggucacccagcuaguaaguguggaaauaggacccaagccaggcagucuugccccagaaauagugggcaaauaaucuucaccucuguggugcucugccuuuccaccucccuuuccugugacauccaguuagucccuaaacucugugacuucugccucuucagugucuccagacucugaccccugcuuuucgucuccauugcucuugucucguacuauugugaaaaccuccaaauggccuuuccauuuccagcugugccacuucuaagugucugccauuucaucaacagaguuaguuuucuaauaugugagucccaccauguuugcuuuaaaaugcuuuguggugcuucagucucaaaaggcacaggccacuauccuuugccugacacauacugacuuuuucugucugauuccucccgacuugcucauccuuaucuccagucacuuccugcuucacacucuacucaggcauucugagccacggguguccucagacacaugccguuuugugcuucuuaggaauuugccuguguucagcuuggauuuuuauuuuuuuccuuuugugcaguggauaauuucagucuuacucauuuuuaacacucagcugaaauauuaccucaucucugaaaccuucccuuauuuacuucuaccauucauucagcaaauauuuauuguguuaugcuccagaaauguaggagguaagcaagacugaccuggucccagcccucagaaaacagcagggaagacauguaauuaaacacaguauaauaauaaaggguuuucuucuauagaggcaagaagggggucuuggaaggccuccugaagcaaaugauauucaagcuuaaaccugaaugaugacuagaacuagccagucaagaagugggugucagagggcagagaaggaauuuuagguugugagaagagaauggugauuaugggccagggauuaacaagggcauguuugaacaucugaaagauguuuauuagacagcagcaguuggggagggugggcagcgaggguguguguguagaagcuggguaaaucuuggccaucagggagauacauaucaaaacuucuagaagauacuguuuccaacccuuuuagaauggcuaaaauaaaaaagaugacaacgucaaaaguuggcaagaauguguagcaacagaaacucauauguugcgggugggaaugcaaaaugggggcgacuuucugaaaagccuccaaagaguuuuccaaacuuaaaauauauaccaugugaucugggggcuccacuccuagcaauuuacccaagagaaaugaaaaaauguucacaaaaagacuuguacagacauuuucauacaggcuuuuuccuaguaacuucaaacugcaagcaguuuaaauguccuucagcaggugauggauuaaaaaauuguuguauauucauacaacagaauaccuagcaguaaaaaaaugauaaauuacugaaauacacaguaauauggaugagucucacaaauguucagcagaagaagagagacagaagaguaaauauuguuugauuuccauuuuaugaauucugagaggagacucaacugaucuauugugauagaaauggaaugucagaguguuuuuugggggcagggugagugggcgagcauggauuggaacggggcaugagggaacucucugaauugguggaaguagucuauauuauuuuggauagugauuacaguugucacaauucaugagacugaaaauauguguauuguauauuguuauaucucaauuaaaauauuuuagaaaauguaauacaauauaaacauacaauacaauaaauacaauaauauaauacaauacaguaaacauaaugauauaugucucucuugauauggaaagaugcucaugguauaauguuaaguaaauuaacuugguuaaaaacucuggcucccauaacccuuugugcauauauaucaagguagugaguuuuuaaauuuuauucuuuaacgucuuucacauuuuucaacuuauuuugaaugaguauuuuaugaauaaaguauuguuuacuauacagugaaagauuuaaaguacauccccugcuuauuaaaacuuugcagaaauuauugaaccauaugagaaauuuauuuuuauuucuauuaaauuaaauuaauuaauuaauuuuagagacagggucuuugucacucaggcuggagugcagugguacuaucauagcucacugcaaccucaaacuccgggcucaagugauacucuaccucagacuccugaguagcuaggaucuacaggugcaggccaccaugccuagccaauuuuuauaauuuuguagagauagguuuuacuauauuucacaggcugguccucaaaccccuggccugaggugauccuccugcauuggucucccaaagcacagggauuauaggugugagccacugcacuuggucccaagacauuuuuaaauaaauuuucaugacuauuuuuaagcuacaguucuguuacuuuuuuuuguuuguuuuguuuugagacagaucuuuacucuguugccuaggcugagugcaguauugcagucuuggcucacugccaccucugccucccagguucaagcaguucucgugccucagccucccgaguagcugggauuacaggcaugugccgccacacccagcuaauuuuuguauuuuuuguggagaugggguuucgccauguuggccaggcuggucuugaacuccugaccucaagugaucuggcagccuuggcuucccaaagugcugagauuacagaugugaaccaccgcgucuggccucaguuuuguuaguuuucagugcuuaggagacacagguuauagcauuuauaguucagaaaaaaauuuaguuuaauuuacuuuuuaauauaugccccaauauauacaaaggauacacaaugaaaaguaagguacucagccacuccugucuccuugucauuuugcucuuuucacaggagguaacuacuaugaccaggcucuuauuuauuuuauggauguaugggaaaacauaugcacauguacauaaaggcauaggcauauauauuauacaaugauagcaugccaugcacauugugcugguuuuuuuuuuuuuuuuuugagugggucuauuuuuuaaauuguaaauaagcauaacauaaaauuuacuauuuuaacaauuuuuaaguguacaguagcauuacaacauuuacaucauugugcagcuguuacuaccauccaucucuagaacuuugucaucaccccaaaugcaaacuuuguaccuguugaacaguaauucccguuccucuugcuccuggcaaccacuguucuguuuucugucucuacaaguuugacuacucuauuaggugccuuauguacguagaaucauauaauuuuuguccuuuucugucugccuuacuucauucagcauaguaucuucaaggcucauucauguuguagcauguaucagaauuucuuuccuuuuuaaggcuacaugauauuccccuguauguauugaaaguagugacaaaaaccacaauuacuuuugcaccaaccuaauacauaccacagcuuauuuauccauucauccuuugauggacauuugggugguuucuacguuuuggccacugugaauaaugcugcugugaauaugagugugcagauaucuguccaggucccuucuuuccaucuccagaaauggaacugcuggaucacauaauaauucuauguuuaauuuuuuuuuaaucacugucauuuagguguauuuuuuuggcagaguaaaacauuuaaauauuuuacauagacauaaauaugagcaugauaagcauugacaugaaaauggcaguaauucuguaugugugcuucuuguauuuuuguuauauuuuuaugucaugcuuuuuugcaaaauacauuauaaacauuuaugaauuucacuaguuuucugugauaucguuuuuaauggcugaauaauguucugucacuguauggaugaguuaacuugacuaaucucuuacuuuuggagaucuagguaauuuuuuaacuuuuaucuuugaaaacaucuguuuguauccaugaucucuauuuauaaucuaauuuuauacaaagguaacaaagagcuggggggagaggguggguacagcaguuucauuugacugacaauauaaucaacauuuagcuguaugauuuuguccucuuuguugccuaaaacauuauucucuagggcuuuccccaaauuguuuuagaacaagcaaguugacaugcuuuuucuauaggguauacugccugggaauaauguggaauugcaccaaggaaucaaagggcaguauaaggacauguguaauacaagauucgugcauaauuuuuucaucaccaugcuguuuuccauacuacuguaccauuuuacaucccaccagcaaugcacagauuucuaguuuccucacauccuuaucaacacuuauuugcuguuuuauuauuuuaaguaauaggcaucccuaauggguguuguaccgugcuuuuuaaacauguaucuuggagaaucuuuuaguaaagucuguuaugugaaugggacuuguuauuuaacuacucccgauuuucuggccucuugguaauauauuuaguguaucuuuugucuuuaguauauauaaugcucuuauuuuaaaauacaauauuuucugacuuauuuucagugagcauggaugaaaguacauaugcauuuuacaguuugauaguuauugccagcaguaugugagacuacuuaugucuacauccuuaacaucacaguauguuauacaacuuuuugaucuucuuaucugauaggugaaaaguggcaucuuaaugaaguuuuaacuugcauuuccuuaugagugagauuaaauuucuugucauuuuuaugagccaguuauuucugaaauaucugcauuguaucuuuugccuuuuuuuuuuuuuugcauuaucaguacccauuucuuacaauuuuaugcuaauaggaacaaucaguguuaaaugaugaacaaaacugaugugauuccugcgcucaugguacuuacagccuguuggaauagaaagauaguagacauacaaauaugcaauuaaauuuuguuguaaauguuauggaagaaaaguuagauuuucuguaagauaacaguucaggcuggauuuggguggaaugugguggccaguaacagccccuaaugaaccuguaagaaccaaugaggcaaauauuugaagggaaaacauuccaggcagauagacagcauggacagcuagcugaaagaagggcauguggcuggauugcaaugaggaagaaaugaugagagaugacugauuugcccucuguuccucauacacuaaucuguauagauaugugucaacaauguucaaaaguauacagugaguuucuccuaucauuauauaaggggcuuuaaaacaaaucuuuuucccugccuacuagauauucuccaggaaaggaauaugaaucagacaaucugauuagcagaaugucuuuaggauauaaguugauucauugggagcuucuguguuuuugaauuuuucauuuaaaauuuuuuuaaaauuuaagaaugaaauacuguaugucaucuuguauuauuuccuguuucuccagaugugucauuagaaauucagcugguuuucucaugugaaauuaauuugugauucuuugaagcuugcuaaaugaugcauuguuugcuacuaaguugucuguaacaauuuccccauuagggagaaaagcucuuugaguguguccuucugugugugaccaaauuccaaaugucugaugauucuacauaggggaaaaagugacacucagagaaaaugauuugcagcuuguugugcuuugcaguaaauucugcauuuuagguaaaaugcggaaugacagauaugcucagcuuaguuuugaucaguaauuuucuuaagcuuucuguaucaaauuucucaucauugaaauagaaacauggugguauuuuaaugucuuuuaccauuaguuacaagucaacucaguguaaaaagugaaagacaaguauuguuaauuuugaaaauuaguuccugguuucuuaguuucuggauuuguuagauaaacauauaccuuuguuucccuuacuuacccaauauccuuucacuuuggccuuuagguuucauguuuauuaggaaauaucaugaaguguacauguaaaauagacagagaaugucuugguagaaauuaagcaauagacccuguggugugggcacaucuuuuuuuuaaauuuuaauuaaauuuuaauuuaaauucuaauguuuuuaauuaacuuucuccacuaauauuccccugcuugucagagaaauaguucaauugauaccuguugaacacugugaauggaaagacuuggaagugccuguauucauucuaaguaaauuuuuuuauagauacggguauuucucauuacuuuuaaaaaauuguuagucuugaauguacagcuacaauccaucuucaucuuauuuuuaucaucacuaacaacaguggcuuuaaguaugguccuuuuuuagguuaacauagcuuuucuguuauugcuuguaaauauuuuuuaaaguauuuccagacauauuguuucuguuaagacuuuuaguccuagguuuuguaguuaucacuaaaugaugaugguuauugcuaugcuucucaguaauuagguugacaauuuucuuuguuuuuuggggacuauuucuuguuuuucuuucacucaucagaugcuuccuuaagugcuuaucauguauguucuagaauucagggcaaauuuguguccuucugauguuuuuggguuuuguuguuguuaauggcaaguguuuuugcucaacacaguaaauauuuuauaucagaccaaaucuuccugcuuguaagaaucuucugguuuauuaucuguuuuucuauucuuguggauggauuagaggguaauacccuaggaaaaacaggcaguucaaugaaauaggaguacucacuaaccugauuauucuaccagguaucauacuauuacaauaugguccauauuaaaauaauguugucucuuuucuuccaugggauguuuuguucuaucuuauaaaagaaacuaugcuaagaggaacuaaaagcuaugugcuuucuggccuacuauuaugaugucauuuauauaugauaugauauauuugccuauuuuugaccuagucaugcaauuuuucugaaaaaccuguaugagcauaguauuuugaaauaugaaucccuuggcuuccaugacauaauaucuuggcauuuucuuaugagcugguuuuaagucacucugauugagucuuaaaaagaaaaaauauaacucauucuuucuccacuaaaucaauggcuguuuuauuguauuuuuauauuuuuaauugaugcaaauauuuguacauauuuaugggguauaggugauauuuuguuacaugcauggaauguguaaugaucaagucaggguuggggcguccaucaccuugaguaucauuucuaaguguugggaacauuuccaguccucuuuuagcuguuuugaaacauacaguacauuguuguuaacuauagucacccuacucugcugucgaacauuagaacuuacuccuuuuaucuaacugcauguuuguacccauuaaacaacuucucuuaaccccucuucccaaucgcuacccuaagucaaauacucuucccagccucuggugucuguccuucuacucuccacuucugugagaucaacuuuuuuuuuuuuuagcucccaaauaugagugagaacauaggauauuugucuuucugugccuggcuuauuuugcuuaauagaaugaccuccaguuucauucauguugcuacaaaugauaugauuucauagguuuuuaugacuaaauaguauuccauuguuuauauauauaccacauuuucuuuuuccauucaucuaaaucaacacuuagguugauuccgaucuuugguguugugaauagugcugcaauaaacaugagaguccaaacaguacaucccuuugguguacugauuuuuuuccuugguauacuugaguuuuucccaguagugggauggcuggaucauaagguaguucuauuuuuaguuuuuuuuuuuaaauaaaucuucaaugccuauuuuaauaauguaaauguuuuuuaaaaaucuauuuuucaacuuccuauucugacucacugauguguuuauuucuaagucacaguuaugguagcuuuuuaauggcuuacaccaacuggaaggacagauugcucuuuauuacucuucucuagacuguuucaggcuaaauucagauuuauuauuuuugucauuuaacauuucuuaucuccauuucucuuauauuuuccuucagcuugaucuuugacucuccuuuugcuuguuuuuuguuaacuucucaucauucccuauuuucucuuuuguuaauaguucuuugaaacuuaacuuuuuaauuggccccuuuucuuaaacuuacucuucuuuuucacuuaacuccuuuuggaugucacacugucaucaaaaagcccuguccaaauuuguaugcauuacuacaaagugacuuccuuucucaacgcaauugcacuguuuguguauuaauacuaccauuccguuagacaccuggaauuaaaacuguaagucauauuugcauuaaucuuuucaucuaucuucagucauuuucuaauuaccauugauacuuuuucaugugaugucucccgucuuccuccuccuccauauuucauaauuacuacuaccauguucuagaucauaucaucucauaccuagauaauugaaacuucauucugacugaccuuucucuuucuauuuuauuuugcaaauaucugugagcuucuucuaauauaaaaacuguagguaaauacuaauauuaaacugauggccuuauucauuaauuccucauuuauguaauaaauauuugaaugaccauuaucugccaagcaagcuucugagugccggacgugccaacgugaacaaaacacauucuaguccaugcucucuuggagcuuacauucuaaugguggguagaggucgggagggaaagaguggagaucugacaaugaacaagguaauuuugguuucugauaaagacugugauggauagauagaaugggggguacagugggaguguuaguuuagcuugggugcacaugaagacaucucugagcugagcuaugagggcaguugagaccagccagacugggaaagauaggguagaagaaaauagauaaaugcuggaaaacauuuuaauaagugggaaguuuuucaugccuccucaaaauuaauagacagaauagucuuuaaccuuuaaguacagauaagaauucagucuuugaugaaaguagcaucccaggcaucauggaggagaaauggauuauuaacaaauggagcugggaaaauuaguuacuguauauacuguaauucuuggcugguugacuuucuugaagaccauugaugccugugggacaggaauuauguuguaaauuaaaacuaauauagaugaaaaaaguucuaucauuggaguaaauuuuuuccacuuaauuuuuaguuuucuuaaucugcaguuuuuuucucuauucaacaucagcgaagaguuuauuuuugauuuauaucugaacuuaugucugaaauuuuccaaaagaucuauuuauugauauauugaaauaaugaagucaaguuuccguauuugauaauuagauaauaaaucucauacuguccugacaucucaggcugcgaagcauaacgcauaaggggcagguuugguccauagccucuagacuguggcuaaaucaggcaaucaccagaaagauaagaaaaagaacuaauuguaugcauaggucuauugacaguaaaggugggaccgguagccuugaauuuaguuguguucuuaaagaagggcguuuuuuagaaauuuccagcuucuucauuguagauucuugauuugggccuuugagaaucugaaguuugauuggauauuguguuucuuuagacauucuaaugagucaucauauucuccaugugaaauuauauuaguuggugauccccauggcaacauaaauuuauuucuuuaauuuuugcagggaauuuauuauuugauuguuuuuuagaaauuacguccauuauccacucuguuacugguuauaugaucaugcauauguuugaauuacauguuguguuaauguuguggcuucuaucauaugcuuuguaggaaaauaguuauucauccucugugccucuggucugcuucaacuaaauuuggcuugagaguuggcuguuagcuguaggcauccagugauguauguccuuuuuaaagcugcuuugcuucuuucugaaauuuuaccccauuuuccaaaccaucuuguugcaggcuggcaagucuguggcacuuaagauagauacuugcucaauuuuuuuuucuuuuuucuuuuucuuuuuuuuuuugacacaaugucucacucugucucccaggcuggagugcaguggcguaaucauagcucacugcagccucaaacucacaggcucaagcaauccucccaccucagccuuccaaguagcugggacuacaggcaugcaccaccacaccuggcuaacuuuuuaauuuuauuuuguaaauaugggaucuccuuauguugcccaggcuggucuagaauuccuuaccucaagcaauccuccugucuuggcuucccagagugcaugaacuacagggcugagccacugugccagaccuugcuuaaauucuugacuuuuaugcuuccuugggcacuauuucaaauuuuuaauaguuaaugauuuuuuuuuucuucucaggggaaaguaucuucucaaaacaauuuuauuaggauuagggaucuuguuaccugguaugguauuauggcaaaggaauacccaauagacaaguaaugaagcuguuagagccuuucacucaauaaugaaaaauaaacuguauagccuauauuucaacugaaucuggggcaaaguacuuuaugauguuaucuguauucccagagucaugugguauuuacuagcuuuacccuuguuauuuuuuaggguaguuugcaugaucaacuuaucagugucagaaggacuaaaguaaauauugauuuuuugauaaaaguauauugaaauaaauaaugugcuuaaagugacagcccuccaauaaacacucaucaagcauauagucuguguaaaacaccuuucuaggugcucugcaagauucagaaauaaacuagauaugggcugggcgugguggcucacgccuguaaucccagcacuuugggaagcugaggcgggcaaaucaccugaggcuggggguucaagaccagccugaccaacauggagaaaccacgucucuaccaaaaauacaaaauuagccaggcaugguggcgcaugccuguaaucccgguuacucgggaggcugaggcaggagaaucgcuugaaccugggaggcggagguugcagugagccgagauugcaccauugcacuucagccugggcaacaagagugaaacucugucucaaauaaauaaauaaauaaaccaaccagauguggcuuuugacauuaagaaucuuugaggcuguaugggaguuuauacccauguggaaggaaccuccagaaugaccugcguggcuuuuccugcagaagggcagggguuaccugagacaccgggugcuaucaugaggucuugaaguugaaauucauucacugguuuaaacacauuuuuugacaacuaguauacauacugguuauauuuaaaggcuguucuuaauguuuaugcuuguuuaguuuuucauuugaacuuuucuuaacauuuauuaauguagacucuuguuauuuucucucuaguuuaauagaaaauggucagcuugaaauugugacagguggcuggguuaugccugaugaagcuacuccacauuauuuugccuuaauugaucaacuaauugaaggacaucaguggcuggaaaauaauauagguauguauugguauauucuuuauuugggcuauuuuggacaguuaauuuucgggaugugaagugaggcucuguucuuuuuucgaguaacuauuuucccuguuagucauuauuguugaauaauuuauucuucauuaauuuaugauauuucuuagcucauaaacugaguuacagagauuuacuauagucacuuuuaggaucaucuaccuuguuuaauguauuauuuaucuauauuuuuauugguuuugggauuauuuuaauuguauguuaagacuugaugacaagaggcaaaaaccuaauuaugguagcuuaaguuuuuuuuuucagcaaaaaaaggaaagaaagauauucauuaugucacugaguguuccagagauacgguagcuucagguauugcuguauccagggauccaggggacuuaaauuauguugucugggcacuguaucuuugggcucugcuuguuuugcuggguuucuucacaaggugaguaagauggcucuaggcagccgagacuaauuuuuccaaccuagcaaccaggaauucucuuuaauacuuuaucuaguuggcccaacuugagucaguuccuuaugucugagccaguuacuguguccagagguauaggaguucaaaucacuaaggucuagucauuuugguggaaauggucuugggggaaagggaauuguggagagcagggucagcugcaccuaaaggcaugagaauggguccuccauaugaguggccucauggaauggguccaguucaacagaauaauucuguugcuacaagaaaugggaaaaaagaugcuagacugauagaaucagauguccacuauaaaaacuugggacuaauagaaaacuaugugauauuuaauauuugcauuuuguaacaugguauguaaauccuuucaaauauuuuauaucucaguauaauaauguaguuuuuuauguaaguauauguguuuuuuauugaaguuauuuuuagauauuuccuuauuuuaaaaaauugucccuuagagauaaaauucuuaaucccuauuuuuucuuuacuuuuuauuuugagauaauugcaaauuugaagaaauguauaagaauacugcaaaauauucucauaaacccuucacccagauuuaccaguuguuaacauuuugacacauuuacuuaauuuuuucuguuuccguguuguuguaguggugcugguauuucuuauuaucagaaccauuuggaagcauguugcagguaucaugcccguguagaaaauaguuagcauagcaggucugcuaucuuuagaaaggccuugcuugcaagauuggcccuugguuagugucugggaacauggauauccuaacgauaagaguggcucacuguuuuuaaucuguuuguacaaacaaaauaguuugugcuaaacaauugcuuuccuucugggagucugaauucuuaguaugugcugaacagagggugccuacaugaccagcccccaacauuggacacugagucuguaaugaguuuccuggucaacagcacuucacacauacugucacaguuucgugcuggagcauuuaaacacauccuguaugacuccauggggagaggacgcuuagaagcuugcaccugguuuccucuggacuuacucuguaugcuuuuuccuuuugcagauuuuuuuuucucauuucacuguaauaaauuauaggugugaguacgacaauauguugagaccugugauuuuucuuaacaaaucaccaaaccugaagguggucuuggggacccucucuacacaaugcccuuuuucuuaaauacuugauaugcuaacccaagaauauucacuucauaaaccuccguuaugaauguuuuuuauguuuuuauugaaguguaauuuacaugcaguggaauauauaaaucuuaaauguagaggucagugaguuuuaacaauguacauacccauuuaaucuauacauuuauuacccaaggucucucauccccucaucuuuccacuugcagccaacugcucuuugauuucugucauuguccaugaguuuuguuugaagaagaauuuauuaguauaugaacucacauaauauuauuuugggucuugugucuuuugcccaguguaauuuuuucuuacaacuuuauugagauauauuucacauaaauucauagauuugugcaaccaucaccacagucuauuuuuagaacuuuuuucaacaucccccaaagaaaccuuauacccaguaguagucacuccccuuccuagcuucacccuucccugccccagucucaggcuaucacuagucuuucuguauauauggauuggacuauucuggacauuucacauagauggaagcauguaauguauggccuuuggugauuggauucuuggcauaauauuuucaaggcucaucauguauuauagcauauaucagugcuucauuccuuuuuauagcugaauaauauucuguuguauggauauaccagauuuguuuaucccuuauucaguugaugggcacuuagguuguauuuugcuuuuggcugcugugaauaaugcuguuauacacauuuguuuaaaaguuuuugugugacucuaccuuucuuccuaggaguagaauugcugaguuauaugguaaaaauguuuagcauuuugagaaacugucaaacuuuuccaaaagagcgguaucguucuaccuucccaccagcaaugugugagguuucuauuuucuccguaucuucaccaacauuuguuacugucucucuuuuuuauuguagucauucuaauaugugugaaaugguaaucucauugugauuuugauuugcauuuuccuaaagacuagugguacuaagaaucuuuucauguguauaucagcugcguauagaucuuuuaaggauaaaugucuauucuaauuauuuuccuauuuuucaguagaguuauuuaucuuuuuauuauugacuuagaauuuuuuuuauauauugugguuaaaaguucuuuguuggauagugauuuacaaauuuauuuucucauucugugguuuuuucacuuucuugaaggugucuuuuagugcacaaguuuuaauuuugaggaaguuuuucuucuguugcuugugcuuuugaugccauaguaagaaacuguuguuuaauccugaauuauaaagauguacuacugucuuuaaacuaguuuuaugguuuuagcucuuacauuuaugucagugauuaaauuaacuaaauauuauauuuaguuaauauuauauaguuaauauauaauaguuaauauaacuauuaauauaauuguuauauuaacuaaaauauuaauuuuuaguuaauauuuguauaugaugugagguagaguuucauauuuauuuuuuuugcauguugauacccaguuauuccaaugccacuuauuggaaaagaugauucuuuccucacugaauuguccuggcacacuuguuaacaguuaguuaaccauaauuaugagaguuuauuccuggacucucaguucuguuuccuugacuuauauuuaugccaguaccguacugucuugauuacuauagcuuguauaagcuugacauugggaagucugaguucugcaacuuccguucuuuuuuuaaacuuguuuuuuccaugugaauuuuaggccaguuuaucaauuucugcaaaaauaucagcuagaauuuugcuagugguuguauuaaaucuguaggucaaucugggggaauauugccguuuuaacaaugucacaucuucugauauagcaacaugggauggcuuuccauuuaaguagaucaucguuaauuucuuucaacaguguuuuauagcuuucaguguaaaaguccuguacuuuuuuuguuaaauauguuccuaggcauuuuguuuguuuuacugccauuauaaaugggauuguuuucuuaauuucauuuuaggauuauucauugcuaguauguagaaauacaauugauuuuuguuagugaucuuauauccugucaccagcaugaaguuuuugggauucauucuuguuguguauguugguaauccauuuccuuuuauuauuaauccaguuuccuguugaacauuuggguugcuuucaguuuugagcuauggugaaucauacugugauaaacauuugugcacaggucuuuuuaugggcauauguuuuccuucucuuggagugaaauguuuacuagcacuagaauugcugggcuauaggauaaguuuauguugcagcuuaugugaacuuugaaagaguuuuccaaagugguggugcuauuuuauauuccaccaacaacgaauuagaguucugauuguuccacauuuuugccaguguuugcugugugagucuuuuuucuuagaaccaugcuaguggguauauagugauauuucacuguuauuuuaacaugcauuucuaugaugacuaaugaugcugaguauguuuuguugugcuuauuggccagugguauacccuauuuucaaguuucuaagucuuuuacccauucuuuuuauuugaauuguugcuauauauauauauauauagauagauagauagauagauagauagauagauagauagauacuuuaaguucugggauacaugugcagaacaugcagguuuguuacauagguuuacaacaugccauagugguuugcugcacccaucaaccugucaucuauguuagguauuucuccuaaugcuaucccuucccuagccucccagccccugacgccccugugugucguguuccccucucuguguccauguguucucauuguucgacucccacuuaugagugagaacaugcgguguuugguuuucuguuccuguguuaguuugcugagaaugaugguuuccagcuucauucauaucccugcaaagacaugaacucauccuuuuuauggcugcauaauauuccaugguguauaugugccauauuuucuuuauccaguuuaucauugaugggcauuuggguugguuccaagucuuugcuacugugaauagugcugcaauaaacauacaugugcaugugucuuuaugguugaaugauuuauaauccuuuggguauauacccaguaaugggauugcugugucaaaugguauuucugguucuagguacuugaggaaucaccacaccgucuuccacaaugguugauuuauacucccaccaacaauguaaaagcauuccuauuucuccacauccugucccgcaucuguuguuuccucacuuuuuaaugaucgcuuuucuaacuggggugagaugguaucucauugugguuuugauuuguauuucucuaaugaccagugaugaugagcuuuuuuucacguuuguuggcugcauaaaugucuucuuuugagaagugucuguucauaucuuucgcccacuuuuuggugauauccccuuuaucauuuuuuauugugucuauuugauucuuuucucuuuuauucuuuauuagucuuacuagcuauacuaguaaaggguuguugccuuuuuuaaaauuuguagauauucuuuguauguucuaaauaugagcacuuugucacauauaugcuauaugaauauuuuuaccaguuuaugguuauucguuuguuuuuagugguaucuuuuucauuucucuuaaucauuuaauaccaguauauaagaaaauuuuucauaugcauguguauauguguggucuaaaguuguauaaauccuaucuuuuuauuauaaauauuuuauauaauuucuuauuaguuauaaauauguaauaaaaucauaaaaugaaaauuaucuuuuuaaauacuuauaguauuuagacuauaugucuguuuaguauuuuauugcauagauaacaucucuuauaguaaugacauaggguaguggucuuucuuguuccagauuuuuaauagaaauuguuuagcuguucuguauuaaguaucauauuauauaguauuuuuaugguaggugcuauuuauaguguuuagaaaauuauuuucuucuuaguauuuuucacuuaacagugaauacguaauauuacugguuuucuuauagccgucuaucaauacuguaugguuuuucucauguuuccguggaugugacagcaguuuguucaguuaaaaagucauugacuuccuggaauaaaucccuuuugguuuugguacuauugaauuuaauuuauuuagugguuuuaugauuuuauauccauuuucaugaguaagauuaguuuucuuuuuuaauguacuacauuuguauuuuuuuuauugguuugugauacuuaauaaaaugaauuagguaguacugaauucuuccuuguauuacgugacagcuuauguacauuagaaauaauuuauugcucagauccuaggcuuagaggggucuuuuauuggagguagauuuuuugauaauguuaaaaauuucuccaaaguuauuaauauccaauuuacaucuaaaauguaaauuguauuauuuuuguuagaaacccagccuucuuaucaacauuuuaauuacuuggaguauaaaguaagaauuguauauaguauucuuuguuuuaaacaguauuuuauuaaauaacaugcagucagugugggaaaauaggaaaaaauaauauacuagcagaaaguaaggagaaauccuucuguacccuuuagagauaaccuguuuugugauauauaacauuauagcauucuggacuuuuucauauguauauuuaaacacaguauaaguuuuuuuccacaaggauaggauaguauuuuaaaacaaauuuauuagagauaguaaaguguuuaaagcuaucuucucuacaacuuuuguaucuaucuucuuuauaguuuucuguagggcauuuuuauuugacuguuagucuguguuauuuauuuuuuaaagagcagguuaaaauuuuuuaagcuaaaagguauuuuguguuucuucauacuaccuuaucuuuauuuuccucuuucuuugcuccuuuugucuguuuuuuguuucuuuuucucucaaggaguuggcaacaggugcaugugcacacauacauacauuuuggcucauuuguucuuuuucuacaacgugaaggugaguggcagcgaggccucuugugagagagcauacccauccaucucacucauccuguggagucagcauaggcaaacugcugaaauggaguuggagcucauuucugcaguccaggcagaggacaauggcaauguggcagggucagucugagaauguauguuccuccuaccucaaggugccuuggagaagaucagugcuggccuucgaugugcucaggggauguacuuaugacucuuagcaugugauaugagguaucucacuacuucacucuuuccuccaucccaaauagugaacacacuuaacaacacuuacaacaucauaaaacuguucaguuuuagagguauaauugucaaaagcacaaugugaacaaaugcagcuuaaagauugaauuggcuuuauuaagcaauucaugaacagggcaacaucccaucuaaaaaauaauauucugaugagcaaagcagagaagacuggcuuuauaggcagcaaaaggcugcaaaagcagaaauaggaaacaaaaaguagguugguuauuucaaaguuacuucccuuacaggguuacaacagaggagacuucguuaucaugcuggcucaaguagaccaggccccuucugauuguggaucagauugcuucaaaucuccugguuuuuguuguuguuuuuuaaacugguacauauucaaguucaguuugauuauguggcaccuagcacaagugacuguauucugguuugauguggucuuuugggguguacugcagcugcucagccuaauacaguggccuuccauaaauuuuauuuaacauagaccucuaugaauuuaauuaguaggcuuuugagcaucagagugagacucacuacauguuccauaaagcugagaaaagccagguucagggagauuuucccuuggcccaguuacuuucuuuuuaaauauaaggaacauaucugaggauaugacauuucuuuguauuguagcuuuggcugcaucuuaugaauuaguguccuugguuuuguuuucuuuuuuuuuuauuuuuaaguuuuuuuuaaaauuuauuuuaguauuauuauuauacuuuaaguuuuaggguacaugugcacaaugugcagguuaguuacauauguauacaugugccaugcuggugugcugcacccauguagggacauggaugaaauuggaaaucaucauucucacuaaacuugguuuuguuuucuaaagaauuuaggacauguuauuuuggagacuguuuuuacauuugauuaugggaugcauuuuuaguuguuuaaucuuuggcuauuaaugucugcuuuuaacuuuauuauaaaaauugaccauuauaacuuuuuuuuuuuuuuugagacggagucucacucuaucucccaggcuggagcacacuggcgccaucucagcuuacugcaaccuccgccugcuggguucaagugacccuccugccucagccucccuaguagcuaggauuacaggugcuugucaccgcaccuggcuaauuuuguguuuuuaauagagacaggguuuuaccauguuggucaggcuggucucgaacuccugaccucaggugauccacccaccucugccucccaaagugcugggauuacaggcaugagccaccguguccggccuauuauaacuuuuuugagcuuuuaaaguugucuuuugacuaccauauccauauuacaaauauauuuccugauuccucuuaaacuauaguauuaaauauacuuagaauaauccaguuuuauuagguacuauucguauuacuaauguucuaauuuuuaaaccuauuagguuugccaaaaauugacugauguuaauucuucuuaauguuuuccauacuuuguucuuguauuuugaacaguuuuuacuuuuauacuuuuacuuuugauaaucuuguucuugcaugaaggcaugaaaucuuuuugaugagcuuuccaguuuuauuagcaaaugugcccucuuuauaaaauuuuggauuuuucuuauauuguacuuuuuccuaaguuugccccuuacccuccuuuuaaaaaguauugccaagaaaaacccuagcaggacacuagguuccuuuuuaagucuaucccuaguucuccacuccuuucauaucaaaguuuuaaaaaauauaguuuacacuuucucuuuucuacauuauuuagucucagggacucuuuauuccauugcagcuagguugcuaccccucuggauccaacgguuuugauguggaaaagauuaccagugauguuauaauuguuaaauugaauggacacuauaaacucuuugacaucacugcaguguuugauacugauuuuuaucuuuuuuuguaagcuuauucuguccuuguuauuuggacaauacauacuccuuuuuuaauuuuauaacuuaauuuugauauaauuuuuaacuuauaaguggcaucauaguacuugggaaggacucccauguaucuuguacauugauucauauguauauuuuucugaaucauuugagaguaaguuggagguacccuguacccuuaucucuaaauacuucauugcauauuuccuaagaaauaaggacacuuuuauacguaaauauaauaaaguuaucaaaucaggaauguuaacagugauacaguaggacaguguaguccacaggcuguauucagauuuugucaauuauuucaauaaugucuuuuauaaaagccgcuuuuccccccacccagucaagaauggaauccauggucguacauugcauuuaguugucaugucucuuuaguuuccuuuuauuugaaacuguuccuuagucuuuuuuuggggauuucuugaucuuuauauuuuugaagaguagauccacuuuuguagaagucucucuauuugacuuugucaguuucuugaugaugggauucaaguuauuuauguauucuuccuaucuaccuguuugucugucuaguuacaauaucacugcaguaaugugaugucccauuguccucacugcaucauaucaggaggcaugugaugucucuguccuaguacugguaauacugggaacaacuaguuaagguuugucugcuaaguuucuccacuguguuaaauuuuugcccuuucuaauuaauaugugggagauacauugggaauaaauauucuauaccucagccaucucucauguuuauguuuuaguguccauugaugauuuucuaauuccuucuauaauugcuaguuggcauucuacuaaagagaagagcuuuccuucuuauuuucuguuuauuuauuuauaucaguaugggcucaugguuaauauucacuggguuauaaugcauuauuuauuuucacaccucaguugucccagauuuggccauuagaagccucuuuggucuuuuccugaguuauuuuaauaugcccccaugauuucuugacugucucuuugcuuuaugacgcaagaauauauuccaggcuaucauguacuuuccuggcuucagccuuggaauaagcuauuucuuucagguuuuuuuuucuuuguaaaaugauugguauguagaggccaagaugugagagcuaagguguggucauugguacugagguuuuauugcaucuagguccuucaagugcacugaguuggaaaauuuguguauguuugugaauauacauacagauaccuguaucuauauuuuuauauuuccucaugaaaaaccauaaguuaguaccgauaucuccuguuguaaugcaauaucauaggguacauuccagucuuccacauuuguaguuacuuaucuuacugugaaaauucuggcucccuuguucucauuuguucaaucuuagaauacaugaaagcugccuucagaauuguuaaauccgugcuaccacaaaaaccaaaguuacuaaauagaguucaauauuucuuuuuaauuuuuggauguaaauuacauaugugaaaugcacaaaucuuauguggucaguucuuuuaguuuugacauaugcucuuuuugaguuuugacuguauacucuugguccccuguagauccugacuuuuccuuauuguccuuuacuggcuccccaugucuauguucuucuuuaguguuguuuacaaaguucuaguucucuuuguugucuuguguguuacuuuguguuacacuuauuugaaugacagccucugcaaacuagagucaagaucuaauuuaacucguuuuuguaacuguggggucuuucaucaucuuagguaaggugcuuaaaagguguuugaaugaaaaaaaauacacacagcaauauuacuuaugucaguuuauaaguuguaaguagacacuuuauuugagaaucccaaauaauuaaaacaucagauuuuuauaaugcuagaugaacaaucuuauucuaaccaguacauuuauuaucuuuuucauuuuuauuuuuuuacauuuuauccucugugaaauugagauauaucuuuagucaguaguucacauuauuggugugagccagcuaugagaaaucacuggcaccuuuguagguagagugaaagcaccagcaucauaaugacuuaagauuuaaugaaauaugguauaguuauuuuggccuguucugccacuguaucauaagaugauuuggggcuuuuguaauguguaaaagacagacuaaaaaaguccuuaauguugguguugggaaauguaaguugaaauagguacguuacuuuucuuuaucauguaauaguuccagaguuauccagcuccacagaucacaggacugugauauccuuccaggaagggcccugguccuguuuauucucuaccucuaguuaauggcaguggcuuuauaauagguaaaagauguuaauggcuaaaagauggcaguauuuauuugaacucuaacugauuaauuucagugagcauccucugccuauguggauaggcaguggcacaauccucccuucaugauaucuugcugggaauacuuggcagaggauaaugcuggguagauccuuggucugauaucucuaggagacuauacaaugacaaugagucugaauguguugugacuucuuuuuauuucauauaucaauuaaaaaaauuaacacuuaucaucuuuauccacaggagugaaaccucgguccggcugggcuauugaucccuuuggacacucaccaacaauggcuuaucuucuaaaccgugcuggacuuucucacaugcuuauccagagaguucauuaugcaguuaaaaaacacuuugcacugcauaaaacauuggaguuuuuuuggagacagaauugggguauguaggguuugaugaaaguugaucccauuuggccuagauacuauuucacaaggguuaugaacucaugccacuguggguuuuguucacugucagucuugaaaaaucagguggccuaaagauagucacucucguaauuauuuuucccaugugccugugucaagauucuuuuaaguaauaaugcagauauuuauagagcauaggagaaucuuuuuauguuuaaagaaaguagauaaauauaaggaguuaguauuuugccaauaaugcuuucacuugcuucuguuuuagaaagcacguuuuaucacaaauuugaacaugcauuagaacugauauccagucauauaucuuauauucagccaguguuccuuccuucugucucucgucucuacaucuuguaagaauugcuuuuuaaagccuuaauccuguccuccuaaaacagcccuaaugucaaaauaccaccugucuucacaguguguucuguggccacgcaggcauucuaaggauauacuugugcagcucuuuauuaggagagaggagaaaagaucuaggccucuugggaggccuuugccuuucucaaccccuauuuaauucagaccaccuuauuuucuauuuauuuaucgagccuuuauuaugggccauguauuauguuaccucugcuuuauauucauucucauuuaaucuuuuuaauauuauucuuuuuuuauggugaagcaauggaggcuuagauaugagaagccauuugccaaaagucauauaggucaugcauagagagcagagauuugaauguaguucuguguaguuccugaagcccaggcuccuaaccucugucauuguguucucaguaaacuuucaucugaaagaaauauuuuguuuauaaaacaguguuugagaaauuacugcauuacauuauacuuguuuucuuguguaaucuagaccccuuaaguguuucagaaaaaucauuuguaaauuuagaccguaacuuucuuauauguacuccuguuuuuuucaguaaggaaagcauuagcuauacaguuucuuaauucuagaaaauuaaaccuguagggagaacaagaacuuguaggggauugcauuccauauaguuugaucaaaugcuaaggagcauauuaauuugaaaaacaaagaauuugaagaagcccuacuuaaacaauugcccauaaauaucaguuaguaugaaauuauugaguacuuuuauguauuucaguauugugcuaggaagaaauguugaaaacauccuugcuuauagggaaauuccagucuaauuugauaaaauacggauacagccaaauguagcagauaaaauuaaguaugcaaauuagcugcaaaagaguagcgcauaaggagaauuagugggguauggaguauguccuuauccauaggagagaagaguuuuaggacuugugacaaccuuuuguggcgacuauaugcucauagcaagcauuagugaccagcaucuacagugucaccguugugaauaugauucagugaaacagcugacagcacugaaguacauagauuuuaauaguuuuaaauuuggaaaauaacaguuaacuaaauugauaaaacuggaauauuuuaggacuuaccugauaaauuugaacauguugcuuuuuaaaaaauguuuucgaauuaaguugagcuuguucacguguucgaguucuuaaugaagcaguuauuuucacuuauuaaaaauguaaauuuuuuugucuuucuguuacguaagcaguacauacucauugcugaaaauuggaaauccauacauaaauaaagggcgggggcuauuuaaaagcucaggaucauauucgcaaagauagcuuuuaacuacuagguagguccuccagucucacuuguugguaggcuucucaccucuccaggccaacaugugauaacauuguaguuuuaauuaaaaguaauucugcaucaggaaucagugcucauuuuccauaucuuauucguuuuguuuuuauuuuuguuucgcuuuuugaaaauuacuuuuucuuuuccugugcuucuuuguuggugaaaagucccauugacugacucauucuugguaaacauggggugagacuguagauucuccuggguugcacauccucuccucaccauaagaggaaauuuucuccaagagugaauuucuccaguguuuuuauaagucuaugcuccacacuuccuuuguucuuccaucccuuuuuuacuccguucuucucacccagccucugcagcuaauaucaugguaucucucagugaauucuguuaccugaauugggaacaguuacggcaggaacuggcagccagggauggacauaguuuuggaugagccagcuguaacuuuuacggcugcucaguuuguaucccuccuggucagcuggcgcugguucaugcuggggcuuuccugucucugcuaugcuuagauagaagagguagauagagacugagaugugugaguaucuuccuucagacagguggccauuaaauaccgcugggguauauguacuggaaguuaaaggggcugcugauuuagcacagagcuaaaucagcauuacuuuguguaaaguaaugacauuuugaauauuuuuugggaaaacagauuuuauaaaugcagguuuguguguuggcucuuuauuuuagaucugggaucugucacagauauuuuaugccacaugaugcccuucuacagcuaugacaucccucacacuuguggaccugauccuaaaauaugcugccaguuugauuuuaaacgucuuccuggaggcagauuugguugucccuggggaguccccccagaaacaauacauccuggaaauguccaaagcagguaugaaaaugcguauuucauaagacaacaucuugaauaaaguagccacuuagcugcuaguugcugaaggguugaacaaaugggcuuuauuagccaacauuauccuuguuugaaguauucauucaaaccagaucuaaagcaacuuaaaaaugccagagccuugacuaugccgguuauguguuacauuuuaauggaaagugaacaauacuagaucaauauacaauggauaaccuauaauacacuauuauuaccaucuccuuugcccucauuauaaaagccuucuacuguguuugauugauuucauauacuuuuguugaauaaaacuucuggucccuauuguacaaauugguaagaaaagcaauucaacugcaaaaacacauuuauugaaauggagcacauaaagaguguaauuaucuguucccuuaauaacaauuucaauaauagugaaugcuucccagcucugguguauacacaucuuugcaucauucugauguuuuugacuuacaguaaacuuuaauuaggaauauuuauacuuaaauacauuuaaauaaaaaucaaagguaugaaucauuucuuuagaagaaaauugugcuaaugauggaagcaucucauuaaaccaacuuacauguaguuucuaauauugguacuuuuaaaguuuaauuucuucacuuaaaaauuaguaguguauuaaaaugaaacauugugguguaauauaaaaacacuaaacucugcuaggaaaauaauauagcccauuaaauaaauuaaauaaauuuauuuuugcacuauuaaaucaguuuauuuucaaaagagaagucacuuaaaaaaaagugugugaggaagaaggugaaaugagaucuuuuuaccuucaaugaguccuuagaaucacaaagauuuucuuugugagccucucacuguggcagacaugaagguguuuuagcauggcagccuucuuaaagucauggagcccuucuaucaaaaugugacuuuaauaguuauuuagaaaaacugcccaagguuagggauugacuugauuucauuuucuugguuccuacagccaugagaaccacugaggaauucugaacaaccugcuuucuagcuaggguuggguuaaguaggcauaagagaauaagccaguauauugugugguggaagguguaauaaaaaggaaggguugagugugggggcacccuggccuguguaggugggcaaauagcuguuuauauuuacagguauuuacacuacucucugcucaggugaccagggauggggaaguucuuaaaagugaacaagauguuucagcuggggagucccagugcauucauaguauugugagcccuuuguucuuuuuuuggggggugcuacugagacuaccugaggcacauuauugaggaaaaaaaggcuuuuuuauaauccuuuugcuaugucaucuaaccuuucaacaauugccccucaggaugauaccuugugcucauuuaguuccagugguuuugaaagugauuuccaggcaccugggggcauacuguugaaugagucuauauaauacuuagagauuuuuucuuuuuaaacuucuuggccgggcgcaguggcccaugccuguaauccuagcacuuugggaggccgaggcaggcggauuuucugagcucaggaguuugagaccagccugggcaacaugguaaaaccccauuucuauggcggcgugugccuguaaucccagcuacucaggaggcugagguaggagaacuaauagaaccugggaggcagagcuugcagugagccgagaucucuccacugcacuccagccugggugacagagugagacuucgucucuaaaauaaacaaacaaacaaacuucuuacaaguauugaaauguuaacucuacugguuaccucagauccauauaucaccuucguuuugaccugaugaugaauugagaucaaacacaggcauuccagcucauuggccccuuucaagcuccccacuuuuuuugagacagguucucuuucugucacccaggcugaaguacaaugacacaauagcucacuggagccuccaucaccugggcucaugcaauucucccaccucagccuccugaguaacugggaccacagguacaugccacaaugcucgacuaauuguuuuaaaaaauuuuguagugacgaggucucccuguguugcccaggauggucuugaacuccuggggucaaaugauccuccugccucgcccucccaaagugcugggauuacagguaugagccaccaugccuagcccuguucaauuuguuaacgucccaaagaaaaugaaauuuaaccauaauguacagauggcaucuuuugauauguccagcucagcagguucuucuacuuugcaaguaaagaaauaucauucuuugucaaguucauuuuuggucaaguacuauauauuuuaaguuggcuuuuucuauugaccgucacgugauuugauguuucggggauuuuauuuuucuugguuacaguuaaguugacauuucuuaccugguaaaauaaaucaggagcaaauugcaucuguauguuuucaaaugugauguugggucaauugauuuguuauugguuccauauauuuaccauauuaccauuuaccaauuaccauuggaccauauauuuagugagugucuucuuccugccaggcguuacaggcugguuacuuggcuuucccaguguugacacuuucuggacaggcuugagaguuaggauagaugugaaguguuaaaggcaugccauuaacguuugugauuucuuuucuuuauaugugcuuuacacauauguauacaagauacucuauaucuaauaguaaacccuuuuuuaugcuggcugccuaggaaaucuaguuggagcucaauuauaucuuauaucuaugauuuauauauuugauuauuuuuacucauuuuuuuuugguagccuucuuucuauguggucaaucucauucuucauguguuuuuuaucguaaguaaccuaaaaguguuuuggcaaauguggaauguuaguaaauuacuaguaaagauaaaguaaugugcuaaugucagaaaacuaagcauuauauguuacauaaggacgcugugguuauauuuuacucaccaagguauuauguuacugcuaaaauuuuauauuugcaaagcaauuucagagauuacaaauguaaaaaggaccauaugagauuuaaauuuaguuaaauguuuauaauuuuuauaagaugcuucauucugucauugguguucuuugagauacuuucguaaguuuuuauauugugaauuagaauuuacuuuuggaugauccuugaagugaaaauuauaaaaauacuugucguuuaaucacugauuucuuaagcuuugucuuuguaaauauugugaacugcuuuggguucauccacuuguauaauuucauuuucacaagcccuuugucuuaguuuguauucucagacuuucuuaaaugaugcccuaauucagugauuuccaaaggacauucugcagaauacuauaauagaauaugaaauacaaaagcuauuccaucaagcuauugguuagaguccagagaaguagaaaccaaaauaacuaauucaacuccuaauccuuaucugauggucaguauugaaaaggacacugugacaaauacucagauuauugguggcaggugacaaguguguggauuuuuuuuucuuuagaagaggaaauaugacucuauaaaauguuacagauuaacauuuauucccuuuugguuuuguucaaaguacacuuuuuucuauguuuaaucagauaauuuuagauuagagaaaggaauauuaagacaaagcaaacuucaaagucuguauaugugggaaguccuuauugucuuacuagauaaaucauuuuaacaccugggcuaucugguauucaaucucuguggcugggcuuuaggaaguccuugguaccccacuuauuauaugccaaguugguacaugaccauauuucuccaaagauaauccauuggaaaccuaugaguuuuuccuucugauaagaauuuaugaauauuuuuaaaggauaaugaaaauuaguaugauaguuuuaaaaaaaucugucuuuaaauuauacuaaccuugcagauagauaaaauauacaguuucuuuuaauaaaauguacuuuugaauuugguuauuuccuuuuuaaucaauugucacauucacuuuuucuuagucaaauucauauuugcuguuuuuuuguguuuguuuuuuuuguagggcucggaugcuacuagaucaguaccgaaagaagucaaagcuuuuucguaccaaaguucuccuggcuccacuaggagaugauuuccgcuacugugaauacacggaaugggauuuacaguuuaagaauuaucagcagcuuuuugauuauaugaauucucaguccaaguuuaaaguuaagguaaggagaaaauauuuaugauuccguauuugaaauugaaccuuuauuauuaaaugagacuauaaacagaaauccuuagcuucuuuguccuacaucacagugcuucuuagaauauauaauucuuguguaaaauauaauccauuaggaagaaaauuauuauaugcuauaguuccauaucuaaaguugucccguuccuaacacuccuugaggauuaaagaggaauuuacuuuuaugugauugaaaauauguaccuaccaaguugugauauuuagucuucagggacuuacuguuuuuguugugcuuguuuuguuuuguuuuguuuuuuuaccaacauugaaagucuguuauuucucucugacagcugcauccuugugauuuaguagcaugacuggcagaugcagaugaacaugucaugaauuuugcaaacaaauguccuauguccagagaauacacuaacauuuuuuuuuaagugagaagacuucuaaaauuaaucguuugccuaugguucuuacucuuuuuuuuuuucuuauggaaaauuuaaaauguacuguaaaguucugaaaauagcaaaaauuguuccccuucuccccauauccauggcucagcugcagcauucuucaacucaagaccacucuuguuucagccaugccacacugcugucucacuccuccccauaggauuauauugaagccaaucucagguuucauauaguuucaccuguaaauauuucaguauguaucucuaaauuauaaaaguucuguuuaaaaauauaacgauaauaccauuaucacaccuaaaaaacuaacaauaauuucaugauacauaucuggacagauucaaauuuuccucaucucauaaaaaacaauucuuuuaacacaugcuuuguuugagucaaaauucaagcaauaaucauauauugcauuugaucaaguuuuuaauuacaaaauugauuuuuuauugauacauaauuauauauauuuaugggacaccuaugaauuuugauacaugcggagaauguauaaugaucaaaucaggguauuuaggauaucuaccacuucaaacuuuuaucauuuguuuguguugggacaacaggcuuuuaaagucuuuuuuuuuuuuuucuuuuuaaaugugucuuagagacucuacauaagaagauuaauuauucagcauguuuauuauuucacauauugacauguaaaaguagaacaucugugaaaauacuauagaaaggaagugauauuacuguuuaggaaauuugaaagcugauggugaacuauaguuuaguaagaauucaaguuuauuaaauaaaccuaaguaauaucaaauagauaaauaaaccuaauaaaauaucaaguuuauucaggauuguuacagcugaauuuuuaucagauuaugaacucggauccuagggguauguuuaaauuauccguguauuuuccugagagaugaugcucauacaugaauaugugaucagaggaagggauauauauaugaguaucuuaucuguaauuacaucuuacuaggaagugauuuugguucauagaagcaucuggucuccugucugacugaaaaaauuagacccugauuuuaguauucuaccuauuucauccuuugccuacuagaacaguuuuuuaaaagucauuuaaaaaauugaagugccacauacauagaagaaguggacaaaccauaagugugcauagaauuuugcaaguuuaaaagucuccauguaaccaucauccagauuaaggcuuagaacuuuuauugucccucagaucucuuuccagucaucaccaacugccgcaaaagcaaccacuacuuucacaucugucaccaugauuacuguugccuguucuugaauuuuauacgauggggaccauacacauguacuuugugucuggcuuuuucuuuucacauuauguuugcgagagucauccauucuguugcagguagcaguaguucauuccuuuuuaguacuguguaguaucucuaguauucauuuuuugaugaauauaccacaguuuauucauuguauuguuauuggguauuugggauuguucccaguuuuugucuaucacaaauaagucugcuuugaauauuuuguccauguuuugguuacuuguuaugaguuuacauggguauaaaaugggauguaauuuuuuggccauugaguaugcacauguucagcuuuaguauauauugccaaacuguuccaaaauagaugcaucaauuguguuguacaagagguucaguuguuccacacccuuucucaguuuguauugucaggauuuuuguuuuccauuuuuauccuuuugauagaugggaugguuuuauuuuuuauuucuccugugguuaaugagguugagucucuuuucauauguuuauugccauuugaguauccucuuuugugaaguaccuauuuaagucuuuugaugauuuuuuaauuaaauugggguugucuuuuucuuacuguuuauagcucuuugguacauuuugaauucuaucuuuuuucauauaaaaguuaugcaaauguugucuccuacuauguagccugcauuuucacuuucucaugcugucuuuugaugaacagaaauuuuuaauuuuaauuaaucaaauauaacuauuuuucuuuauguuuagaacuuguucuguuugaaaaauuuuuguuuaucauuugguucugaagcuacauucuuaugaagcuauccucuagaagcuuaauugucuugccuucaacauuuaggucuauaaucuaucugaaauggauugcugugaauugugugaggguagggaucaagauacauuuuggcuuauauagauauccagcaccauuuauugaaaagaccauacuuucuuccacagcaccacagugucaucuuugucauuaaucaugaaugagacugcauuugugugugggucugugucuacacucucuauucacuuuuauuggucuguuugacucaucucacacugucuuaauuauuaacacuacaguuuuauaauagguuuuaauaucugauaguaaaagucuuccaguuuguucuccuucccaaaauugcauugguuacuguuaguccuuuguaauucuacauagguguaggucaucuuuuaaauuucuaccaaaaaaaaaaaaauugaaggggauuuugagugggauugcauugaaucuuugguuugauuugagcacaaauaacuacaauuauugggccaucuaaucgaugaacgugguguauuuuguguauuaaugcaauugauuuuugcauuuuagccuuguauccaguaacuuuguuaaauuuauuuauuauuuuuaguuauuuguggauucuuuauggauuuccuauauaugaguaauggcauauauaugucuuccuuuccaaagcuuuaaaucuuuccaucuacuuucuuaccauguacaauggcuguguccucuaguauaauguugaguaggcguggugaaagcagacauaauuuucuaagagagaaaacauucguuagucauaauguuugcuguagaauuuuguagauucccuuuaucagauuauggaauuuuccuuauauuccucauuuacagaguguuuuuucaugaccagauacuaaauuuuauuauuuucuucuucuaggacauugcuuuguguuaggccuuuaugucuugugcaaugauugaaccaguaccccaagaugaaaauuugguagaguauaggguccaccuuaaugcauuuucuuucucuccaacauuuuuaucccuuaaguucuggcugcuuuaguucuuuaaugucuucaaagcuuuuucuuucuacaguuuaucuaguuauaucuguuucuugugggauacuuaaaguuacuuugucugaacuggaagcauaaauuuaauauuuucuuuuaaugaacuggagaacaaaaguaaauaacugaguucagauggcugaaaaauugacguggaauagccaagacagucauuuugccauuugaucaucauuuaacaauuuuuguaauuuuucuuauguguuguccugauagaauucuuacauuuaagauuaaaguuguugccuuuuaauguaaaaaccaugugaauauuuuuauuugguuauucuuaaagguguccuaaauauuuacuuuuuaugagcuaccaagagacuuucuagagaaauuuacuuuaaauaauuacuuuaaaaaauacucuagcacagguacugaguuauuuuucuacccuuaaagauugaauuaaguuuuugagaaagccuacuaggcuacuuaucuaaacugcucugggacauugccaagaaggaaguauuuuuaucuuggcucauaccaaaaacuaauugaaauauuuucaaaggguauacuuuauuguuaauacuaauucuguagcaugcuauagauuucuaaacuuugaaguucaaaaugguuuuuauugucuaaauaaaauccuuuguuuuauguuugaggaaagugagacucagaaauauuuagaucguagacuauuuugucacucuuauuauuuauacuuuccugagcucaucuguaucugcuggauaugaaguuaaugccauauuuccuucuauucgugacucauuucuuuuaugguuacacacacacacgcgugcacacacacacacacacaaacacacacagucuucuuccuaguaaugcuugugaguaauaauacucuuaguguuagcuaaaacauauugagugcguauuauuugcuguaaauugcuuaaaguacuuuauuuaacuuauuuaguuaucugaacauuuucugguagguccuaugauuguucccauuguagaugaggaaauugaggcacaaauagauuaacuugcccaagaucacucucuguuuggugaagccaagauacauuggcuacaccaaauugaauacaguugaaaauugcuuaucuuuaauauaaacauaaggauuuagaaauaaucaucuauuuugcuguaaaaauauauugcaccacaacuagauuacagucacuuauauuugccuuaucaguaucauuguuguaaauguuccagucgcaauuuugucuuugcagugaauaagugauagcuaaauuuauaccauuauuggccagucaugguuguaaguuuuuuuuuguuuguuuuugagauggagucucgcucugucacccaggcuggaaugcaguggcgugaucucugcucacugcaaggucggccuccuggguucacgccauucuccugccucagccucccgaguagcugggacuacaggugccugccaccacacccagcuaauuuuuuuuuguauuuuuaguagagacgggguuuacuguguuagccaggauggucuccaucuccugaccucaugauccacccgccucagcuucccaaagugcuaggauuacaggcgugagccaccacacccggccaguuguaagcuuuuuucuuagagcccuauucacuguaacguggauagacagagaaguuauguaauaugcucaaaacacaugucagauaagugguagagauggaauucaaagcuaugcuauugcuaccuugaaucaaaaugacuugcaauaucuguguguguguguguguguguguguguguguguguguguauguguguaggaaacaacaaaauccgcaucuuucuuuuaaaaggaacacauucccuguuaaauaaucuguuuauuuuugacaggacugccuuuuaauaucuguuuacaagauuugguaucguguuucuuuuugucuuugauuuguagaauaguuugaacucauaaaaacgaauuucuuacugcugauuuaaaucauuagucagaaagaccgguguguuuaagcagccagacuugccauucuuagcacuccuuggauuuaacuucuacucaguguuaccuacugguagaguaaguucauuuuuuuaaaaugaccugcuguucuuaaagucccuucuccuucacaagaacucaacugggggaaaacggagauagaggaggguaugauauaugaaauaccuuauggcuaacagaauuauucuucuagacuuuauggcuaauaaaacuguuauuguagacuucuggaacacuuuaauaugucuuuuauuuuugcugcugcccucaucuuucauuuauguggauuaauccaugcccaaaucauuguacacuuugaaauucuagagauauguaggaguuuucauauucacugauuuguagaucuaaauagcucuccuuuuaacugcugaaguguauaaguuuucccuuaguuuaauuugggccuuaauguaaguaaaaaaaaagucacuauuauuuucuucccugcuucugauuuuuauaaaaucugagcuauguauucaucuuaacuuggaaacacauguuaaauauuuauuauuaacuuucccuaacaguguaagaaguaaauaauuuuaagauagaaugaauaauugaagugcauuuuuuuaaaacuagauacaguuuggaacuuuaucagauuuuuuugaugcgcuggauaaagcagaugaaacucagagagacaagggccaaucgauguucccuguuuuaaguggagauuuuuucacuuaugccgaucgagaugaucauuacuggaguggcuauuuuacauccagacccuuuuacaaacgaauggacagaaucauggaaucucauuuaagguacuuuuaccuuucuauagcuacauguauuuuuucacuuuauauuaucauaaucuuuuuguagaguuuuacguaauauacaucauucauguaguacauuauguaguguuaagcucuaauuaagcacuuaguguaauugugaaauuuuaaugcaaucagaaauacgucuccaaacuacaaucaaauuauuacauggguuuuuguucuggaagaaaaaauaguuuauuuaaauuagauuuuuaaggaguuguauucuacauuuuguauuuuucuaauuaauuuaccuguguuauuugcacaccauauuaauauucagugacaccaucaugagugucugcaggcugguaaucugauaggcuucucauuggaaacauaggugagcaucaaagaaggaaauagggccucccagcagccaaacgugagcuucaaaguucacaguccaaaacuaauguauuuuguaugugggagaacuuuagacuaggcuucaucucaguucuuacauacuuauuugaagcacauuucuauaggcacagucaucugcauagaagaacaacauuugaaaaaaugaugacugaugggucagauagugauugaaaauguaaauggauacagagaagacagaaaagucuguagaagacauaaaaacacuaaacugacacuauccaggagaacuuucaaucacugauagaauguucuauagugauagguucuauuucugcacuguccaaaauauagucauuagguacaugugacuauugagcacuugaaaugugcccauuuaauuuuaauuaauuuaaaugucaauagccauguguggcuauggcuaccauauuggagagcaugguccuaaguaacuaacggaggcugguuguugauaaaguuaaaacuacuccagaggcucccaaaguuuucucuauguauagaccaguaaaguaauucauuuucaugaugaaucuugauguuugaguuagauuguacuuaccgucuuuuauauacuaguggacauugguuacauuuuggaaaggcuuuuuauuaaaaauuaugaauuuaagaguuguauuuuuauaugguaguuuuuuauuguuaauauugugcugcuauuaaauacuauuucaaaagccuaaccuuuuacuguuacucguaauaugccagaaaaaugucucauuuuaaaaaauuauuuucauuauuauagauacauauuaguuguacauauuuauggaguacaugugauauuuugauauaagcauacaguauauaaucaaaucguaauuuguauauucaucauuuauguguuucaaaauaacuaaaaguagaauuggaauguuucuuacaaagaaauaacugcuugagguaauggaauauaucuuauuaaauuuaaaauaauguuuacauauuauagugacuauccauucuuacccuacagaauaucaaccaguuaucucuuauacuauucuaaacuuuucuguuauaaaguggguuauauucucaauaauguagagaucguuuuggaccacugaauuagugauuuuuaagugccaaaaagaauauugguuuaucuuaauuuauugaacauauucaaggcauugugguuacugcuaguaauauauuuggaaaauccugcugcauuaaaacaaaccaaaaaaccauacaauaguuaugacuuuccaaauguauuuauuuauacauaaguuugucugaaaauaguaauauuucaucucucugcucauuugcaaaauguggauaaaauauaaaaguauagggaagacaauauuucccaaaucuucuuuuuaacauuuuagggugucuggauaugcauauguacuccuuuuaaaaccaggaauauuugccauggauauacguuaacauagauacacaauuuaguuaauucaagcuuagugauuguuacuucaugauuuuuggaaggauuagaauuuaaaaguggagauuguuuacucuccuuugauuauuucuacaguuuagagaaaugcaucauuuuacaaacaaaguauuucuagugucuccucuuuucugaaucuugauaacauuuucaaguugccuugauucugucugcauuguccuuaaaacauguuucguguauagaaccuucuuauacuuuuuacuucaucaagccaugucuccuuuuaaauaaguuuuuaagaaaaacuuaucuugagccauauccucugaugaaaaaacauaaaagguggaaauuauagcccccauguucuucuuagacugaagguuuuuuccuuuaaaauauacuacaaaggacauuuuuuuuuuaagagacagagucuugcucuguugcccaggcuggaguguaguagugugauccuaguucacugcggccucaaacucuugggcucaagugauccucccaccucagccuccugaguaguuaggacuauaggugcaugucacuacaccuggcuaagauagagucucucuauguuguccaggcuggucuugaacuccuggguucaagugauuuuccugccuuggucucccaagaugcuaggauuacaggcauaagccaccaugcccagccgacauacuguuuaucaucuuucaguuuguauuguuaaauucucuguauuuguuauauguuaucauucaaaacugaaacuaacccuuuccccugaacuauucuugggccauuauuuucugccucuccucuccucugagugucccgcucaccgaccaugccuuucuuucucauuucucuuaauguguauaugugagaguaaaugauauucuggugauguucauggucuauguguguguugcucuuggagagaagaaaggacagagaaauuuauccaauuuuucagauuuuuuucacugugcuauucauaaauaagccugucuugcugccaacagguucuggcuucuuuuucaggaucaucuagaacaaggacuccugauaccaguguagacaugguauucuuugaugauugagaacguaaauguguuauacgggauacauugguuguuuuauaugaacuauuauuaccaauaucuuuuucauaaauugcuuguacugcaauuauggauuaaaaaauuuguaaaguaucaaugucacaaguuuuagauuauaagcuaaaguguuuguuuuaaaauaaaaauaugacuuuuaugcaauuagggcugcugaaauucuuuacuauuucgcccugagacaagcucacaaauacaagauaaauaaauuucucucaucaucacuuuacacggcacugacagaagccagaaggaauuugggacuguuucaacaucaugaugcuaucacaggaacugcaaaagacugggugguuguggauuaugguaccagguaaucuaauuauagaaaaaucaucuuuaaaaaaaucauuaaaauuauggguaauaagauuauaucuuuuggugaaguuguuaguguauaucaaaccacauuaacaaugauaucccucauaaguauuacuguaucaaaacagcacugauauucaaauauuaagaaaucuguugacagagucccagcugcaccaacuuuuuauugcaaugcauuucugcaaauaggguaguaaaauauuauuacuacuguuuaaagcugauccuauuuucuucuaaauaacaguguggagacuggaguuaucuucuugaccaaggacuuggcaucaaauaaaacauaguuauaauguagagagauaaagauuccuacuucauuguaugucaguuuaaucucauccuauuucauauccaauuguucuuguauacuucuuuuuuuuuuuuuaagaggcauauugacauaauaagcugagaagcauagccaggaaggaaaaagaccuauaaaccuuaucauauguggaugauauaagccauugggaaugagaaaggaugaccuggguguugguaucaaagccaucuuuaacucauugaagggcucucagaugggcaagggaguagaagcuaaguuauuucuauauuaaagacuuugaaacaaugaguauaggcauggucugagauaacagaggacuuggcaaacagagcuuccuaauaagggggaagaaaucuuaccuuuuguaguagggaguucucuauccucacgccagccuuuggaugaccauucauucauuaggaucagugcagggggcauuccuagauuggggaaggaguuuugacuauuuuauuuacuguaguuuagacuauucuuccugauacuguuuaucagcaguguugugcuuugauaacauuuuaaagucauuuaaaauauacugugauuuucuuaaagaauagauuuuaaaagugaauauccuuaguacuacuccuugaugagaaaagcguauacaacacauaaaaucaauguuaaaaaauugacucacgacuuauauuacuaauuguaguaaauguuaauuaaauuuuuaguuacaauauuuugacuggcuuucuagaaauugggggaaaaagauauucuuggguuuucauuaguugauuucaguccuuaaaaaaugcauucaaaguaguaucuugaauaucuucuccauuuuuuaauggcaaauauauaugacacccaccugucgagguugaucugggguuaaaguagaaaacccucauuagaugauaaagaugguauuucucccacagaaaccauuuuugaaaguaaggucagauccuccuuuuuuccuucuuaccugcuccuggccugcuugguuuguugagaguuuaaaagugagacugcuuagaaucagaccaggguagagcuccuaagaggacauagaaaagucauuuuccuacaccgcccacuugcuaucucuggcugucauaucgaaagagauuugcuuauaggucauugagcuuuggcuacagaagauuuuuuguaucuugaccugucuggaagagcuaucauugguuccuccauauguuuuguguugcuuuuagcuuauaaaaacuuccccguguagaauugcguguuagagaaaaaaagguaguaagucucaaacuguacuuggcauuuguaaauuugcuauguuaguacuucacaguucauugaaaagucauaaacaauuaccaagucauuagcacagacauuuuaaggaggaaauuucaaaacauaaguuagagaauuauuaacaaagagguaguuaguauuggguguucucuugaacuuggacugaugacuacuauucauucaaauuuggcagaaauaucacugugaacaaguuuaugaauuaggggugcauuuggcugcgaguaauagcaaccagaaacagaauaaauccuguccugcuuauuuuuaugucauaugaaaaaaaucuguagacaacugguucugguauggcagcucugcagugucaucaggcauucaggcccuucuuucuccucugccauaguagggggaaucugagagcaugcugucaacaauagaucgaauguguauauaguuacaaacuggaaagcaagaauacaucauggcauauuuggagauuaauucuaaucauggcaugaaaaaaaugaauuagauugggacaauguuuguaauagucagcuuaaaaguauuaauagauaauguggcuuauguagaagggaagaagaaaugguaaugaggucauuuagagaaauguuuuagaauuccgcuaauuauuccuaacuuguaauuaagguaggugggagaaaacggaacacagggugagcgugaggguccuaaaauguagacaaacuauauaguggcagacaugcuaacaucuccuuaauacaacaaccauaacagcaaacuaagaaacugugauucccaagugauuuuucccgaaccguauuccguauuaauaggauaaguguauguuuggaaauuagaggcccugaaaaaaauccuguauuaaugaaauguugaaacguuuagaauuuuguuuuacccaauguuucccaaauguacuguguuucauuuuguuuuguuuuaagcaaagcagcucuauacauccugagaaaacauuuggggagugauauacuguagucuuuaguacucaucuuaugagaaggcugcaugugugccuuuaggaugcagacauugauccuggcuuucacucaguuuaauuaggacucuuuaauacaucugguuuuaggugguggagaacaugacuuucacucugcagauucaggcugccuaauaaagauagcccuguagacaauagaaaggaacuuagauugagggucuugcugucauaacugaaccauauucguaugguguuuuaguauggugaaaacacuuaaugcugucuaggaaaacauuugaauauguugggaaguuuaguuagauuauggcaugaacucaaauccauaagauuuuagcauuaaaauuauagauuugccauguaaauguauuuaauuaauaacauugaucaugaucacuuacaucucugaaggaaauauuaaugcucugcaaaaaagaaguuaacuucuuuuauagguuuucuuguuguuguugcaugacaacaaaaaugucuucaaggcauagauccaaaguugcuuucuguauuggaaaaaauaauauaauugaaaacgugauuagcgaggaguuucuacguacuucuccaauaugaauuugccuauggaugccuggucuguagagccuucaagaaacguaacugaauuaggaaaaaaaaaaaaaaaucuucaagcaaguucuuuuuccaugaguaaugcuucagcaguagcggauguauuucagaauuggucuggaaucaguagacuuuugauuccuuagacauaaaaauacaauuugaauauaguuaguaauuucagugaccaaaaaauuuaacagggauaaagacaauuucauuauucacaucugucaaaaacucuuguucugguucucuugaacaagaacaugaaacuaaauuaaacaaaacaucuauuuuaauucuugggguaugacuuguauacgaauugaauuuucuugugagcugaauuaucucauguuuuuauucauuguuaaaacccuuguuagagcuuuuucuaaaguagcaaaucauuguuuuuuugauagaaugcuucaaaguuauuggggugauccuacuggauauuauuauuuggugcgauauucauagaaaguauacauaguuugauuauguuuauguguuucagguguguccagaaagcuuucgguuuuaaauggauucuugucaguuauaucuucugauguacuuaguucuaggggaaaaaagagcagguuugucauagauucauuauagguuucacuuugaauacaagaugaagauacuggugguuuggcuauuaguaaugaaacugaaaauauuguaugcagauuuuuaaauuguuucucagacuaauaaaauuuuugauuuacagacuuuuucauucguuaaugguuuuggagaagauaauuggaaauucugcauuucuucuuauuuugaaggacaaacucacauacgacucuuacucuccugauaccuuccuggagaugguuaguaauuucaucuauggucaucauaaaaauguguaauuccauuguucuugcauuagcaaagaggaugagaagcuuaaugaaaaaagacauugaaauauaauuuuuuguacauuauuugaaagaauuuuuaucacuuaauauaaauuaccuguauguucaucuuuucuauaaauauuucaaaguaugugaaauauguaggguuuuagaauacuauuaagauguuaguaaggcaacuggggcauuauaacuaguuguuuugcuuggcuuuaauuagaaaccccuugauauuuaacuuuuuauaaguccuuaaucuguuccuccuaaacuugaauuugaauggucuucugguuucaggaugaguccauggaguguuaaguaaaauuaaaaaauuacuguucauuuuuauaggauuugaaacaaaaaucacaagauucucugccacaaaaaaauauaauaaggcugagugcggagccaagguaaauucauaauuucuuacaaauguuuaccacuuucuggcuuaauaguuuuugguuuuaugguucugguuuuuaguuagcguauauuuugaggcaaucaauuuauuaauuaaaaaacuccuaaaaaauggauuuucuuucaugacuguguuaugcucagugccaauagcuaacacagugcuuaguauauugacugcugaauaaauuauuauaacaauauuucucacagauauaagguauagcaugauaaauauauagcuuauaaaacauuuucuuaucucuauaaaauuuucagauuauauccuuucuugauuaaccuuucauuuaacuaccuuguuuucauuaaucccugauccuauuuuuauaugaaagaagaaacuuuauuauuauuggaagaucaagguuucuacuguaaauuguuuauuagauaacugucauuuugcuggugaaacagccuuguuuuagcacuauugauuuaugcuaaaguaaaugggaaggguguucagugaccuuaaaccagggcauuuaauugguggcuaccuaauaauuauaaagaaaugcauuauguuuuauugguauuucuuuaaacagcaagguaucuguuuuuaauaaccaaauauuuguuggucauuuccuaguugacccaggcacacagugguuauuuuuuguaauauaaccuuuaacugucagaaucaagauauuuaguaccuccucuugccaauuauaggauaaaacaauaauuucaaagaguaauucauuauuucaacuaaauauauuuuauuaaaauuauuuaaaaauaaauggaaugaauguaaaaagaauuuauaguugcuaguaaaguugagacuuuuuguuaagcauagacuaaagucuuaguugucuaaauuucuuuaguaaguagagacauaagguguauacagcuuauuccuuagaacgagauaauaaguuuuuuuauuuuaguaauacuaauguucucuguaacacggcagaagccuuaggagcuuucagauugccaggucauaguuaggaugaaaggauaaugacacugaaagaaauauuucuuauaaaauuacaaaauguuuucuuugucuuaaaauaaguuauguuuugaugcauuugggguuauaugccuguuccuuaaauauuguguuccuaguaaacucuggcauuaguaaaucuauuuggcuuuaggcauaguucucucaucuauuaacuuuucuuucuuuuuauauuuugguggaggaagaucuuuguuuuugcugguuauaagaauaauauaugcugauauaagugauuugugccccaucucugggugcucuuaugcugggugcagugaggcagggcuggaaccauaauaggucagaagaaaagauguucccuuuaguuuaucuccuuccuucacugucuuugccuuagcaaacaauaauugauaauuuugccuuucuaaugccagaagaagaaaguuaggaaauguaguauauuaaugaaagagaaaaauauuuuuaagcuuucauauugaggaguuuuaacuacagguaaacauaaauggaauuucgggggcuauuaguaaaaugauugcuuuuugauauuucuuuuuaaauaguuuuuauuuaaauaguauaggguuuaucuuccuauuacuucuuuacaguucuuuuuuuaucaaauauugacuuccuauuucuguagguugguaaauuaggaauacuucugauuggcagauucuuauuuguuuuuaugcuuauuauccauuuuauagguuagggcuucuuagauuuuagguuuuaaaaucucuauuuuacuuguuagcugcaaauuauuuuaguuacugaucugucaguaaaaauagaugaacaaugaaggaaugauaguggccuuuaaaauggaagaauuugauuguuuuauuuagcagguacugaaaguaaaauaauugcccuuuucaguuuuuaaauuggaagccuuagagguguggcugugagucuuugucauauucuucaugagucuucuuuaauguuguaaggguuggcuuuuuuuuuaguuauaaacacaguuccuguuugaguaacaaauuaucucucuaaauaaaccaugcauucucgaugggggagauauuuuuuccaagagagugaaaauugguuuuuggggauuugaagaaaaucuuacucuuuuuaauauauaaagcacagauauaguacguaacagguaaacaguuuguguguggcauuaaaauuguaugugggugauuaguaaaugucuaaaaagaguccuuagggaggugauaauguaaaaaagauugagaaauacuaacuuaaacccauagaauauaaauaauacacguaaauuugaucaugcuguuggcaauauuaguuauagcaauaaaccuaacauaacuuuguaaguauuuaaaaaguaguccaagaucuguuuaaagugacauuaguacauguugauaugccuaauuuaguucacacaguuaugugagcuauaucauguguggauucguaguuuuuguguagaaaacagauacuucagaauaucaacuaagauauaaaaagaaaagcccucccauaacgcauugccauuggcuuguuuaaugguucucccuggaugaccucccagcaccaauaauuuaaguuccucugauuuucuccauacaugcuuuccuuuuggaugccagucuugauuaaaaguauuguuaucuuuuuaguuaucuagguucugaaaucccagaaccuacuuugaccucuaccuuuuauuauuccuuaaauuucaucacuuggagagucuuuuuuuucucaucugugaaaugcaucuucucuuuuccuguuacuuuuugguucuaagccauacuucgugccugaauuacuucaacagcuucuuacccuuuugucuucaauuuccuaugccccuuauuuauuacaugaaguuaucagaggaaucuagccaaaaacagagcucugagaaagucacuucuaaauucagcauucucuagguacuucuucuuaccuauugaggaaagucugaccugauggucaaauguuuuaguagacuauugccuaacaaacuaaucuaaaacuuaaugucuuaaauacaauuuauuauauuucccacguuuuuguagaacugcuggucaguucuugcuuggggucucucauaccauugcaggcaauuggagauugggacuggaguuccccaaagauuugacugggcucagugugcaggagggcucauauacauugcugaaaguuagugcucccuguuggcugaggguucaguuggagcuguuagcugccaguacuuacacauggccucuccauaugacuugggcuucucuaaccauaguggcugguuccaagggggaguguuuuaagauugaaagucucaaaagugaguuuucuggguagaaacagcaagacuucuuaagaccuagcuuuggaaguccuagaaggccauuuucauuacauucuauuggucaaggaagucauuaagguuagccaagauucaaggggagggaauuacucuccauuuccugaugugaggagcauguauaggaagcagugggaaugaugguagucaucuucggagacuagcuaucacaguucaccuauaggcuaccucaguucacauaccuuucauguacggaguaaccucacccaccucccaagauguccaaagucucaucccauuaugcuauuagccccaaauuucuaccuagaucaggccaaaaugggucacucauauggcuggcaguuaaugcuggcuuguuucuuccaguauaauuauuuaaaguuaaucacaguagauuguaaacuccuugagaguaggaauuauuucuuuauuucuagcaucaugccugugguauuauaugcaacauagcaagaguaauuacagauucauugaaauacauuuaaauauugacugaagagaauauuaagcuucagacaccagauaugcauagaagaacaugguucacauucuaugugaaaaugugguauccugguauauauucuccucaggugguucuuuggucucauauuuggagguugggugccagagugcuucuaaguaaacuuuaagaccguuacaaauaaagauaaaccauaauucaauaaagcuuggaauuuguauaacuguccauuuaagauuuuaguuuuauaccaugagaccugaaaaauuucagauugcaucucagcaucauugcauucuuacagaguuaacuucguuaagauuggauauugggugaauguucagaauggauggauauaaaagauaguuccaaauagcugaaugaauuggcuuuaucagauugguuuuuauauguaagacuuauuguuaugaucaacauagccugauucuacauuuuguauuuuuaauauuguuauuguaaacaauucuucuggcacuaauuaucuauuaguuuaaugggauucaaggcuagcuuuuuucuuuucuuauguuaucaauauauuuuuauaccaaguaagaaugugucuuagaaaauaucuaauaucucuaccaguuguuuacacauaaguuuuaaaugaagaagccaaacucgcaaccuuauuuuuauuguuuggaaauggaauuucuaggaaaauagaauucugaccacucagauuguggcagcauuauuugauagaggcauuuggagcuuaacggcggaagugagauuccaugacuugaaccaaggcggcucuagucugagaagugagucuggugaaagagcuguuaguguacagagggagcgcacuuugugcucaacuguggaggagauggaaguguuagcugcgauaauuaguccaggaacuguccuuaauagcucauggauuaugaugguuuaagcuuaaaccuugacacguacuagaaaacuaguauauagaaaugucuuuccauuaguuaacagaaaaaugaguguaaaaagucaguaagauuaaagguuuucuuucuugaaacuggucggcuauauuuuuuaauuauccuaaagaauucaaggcaauaauagaauacaggauuugacauccuggacccucuccagcuucuguuauuuugagaaaagcugagauauuuuuaccuuuuaaauaaagcuguuuugaacuuuucuuuuggugagggaauuaguaacugaugguccuagagacucuuaaacacauaaaaacuaagcuauucuguauuccagucuaguuuaguuguaucuaggcauuaauaguacaguguauuuaugaauuuuauuggauuugaaggaugaguuuauaaacuguccucuaggaugcuuuucuguuuaaauauauauugcuuguaaaagguauuuguauguuuucaccuauguucugucucuguuauguguuaacucugauuuuuuucaagguauagguuggcuaguucccugauuauccagaagcacuuuucaucuugucuguagucuacuggaguguuuucagaaaggaugcuuuauccaaaagacugaauggaauauguuauauuauguaaauaaccaaaaguuucuuaaggaauucaagguaccugcaagaugcuacguuaguuaauuuuauguuaaaaauuauuugcauugacuagugguugguacuaguguuggagcagucauggcuugguagcaauacaaaauaaucuuauuugguguuugccauuccaauucagucaucacaggauuacauuuugccuaauuuuucaagaaaauauaaaggucucuuggggaggaaaugaggagaaaaggcuccaccuuuguuccagucccucccacccuuagcauuucuauguauuuuaugacaucaggaaugaugaguauuaauuccugacauacuguuucaaccucacauugacugaaauuaaauaacaucuauuauauuaaaaaaauaguugacacuuccaguuuacgugauggcugacuagagaccaugagacugacucuuaguuucccauuaaagcucauaugaaaauguagaagaugaugaacaguuguaggaauaccaaaaccuuggcuugacagucaguguauuaucacaaucuaagauguccacaaacuacaaagcugauagaacuggucugaaaaaugcaauuacuugcugauuaaugauaagcaguuagaaauaaaagcaaccugcaugucuuuuaaagcaaguauggagaaugauuccuuuuccuuuucauaaugucuacccccaaggcuuucaaauucugguauuauaucaacuagaaaagugaacaaauauuuuucuauuggaagagugcuacuuuugaggcuauuaggaaguuagguagcuuuucuuuuuuuucucuucuuccucccugccuaaggucucuguugaccaucuucauuuaauugaccaaguagaucaacugacacucuucauuccuuuucagugcccaugguaauguggccuuguagcuaacaggcuguuagcuagcaggccaauguacuucccucccuccagucuuucaguugugugauuaucaugaaucaguuauuuauuccuaaacaaguuguuguuauuuuuuucucauaaaccauuuuauuacgcuguugaauuacauaaaaacccuuuuuuaugaaguugaggacuuuggaaauauucagcaaaggugagucacugauaaauguuggcgagaugacugcaaaagauuugggaagaaaucauaaaaauauagaagccggcugcacucagauuuucuuaacauuuuugaguuuaaguucuugcuauacuuuagagaaaccuaagcuuggaaccacagaagauuaucacauguuugguuaugcagaaaauaugaaaacuccaauuacugguuccauagucaaaggauuugcauauuuugaauaugauacauguauauauuucaugguaaaguaaaauauuaagaauaacacauacauaucauaaugaucuucuacuuuaacuuuuauuuucagcucaacuuuaacucuuucuguuaauagaucuauugccagccuugaucacauugaugaaagggcuuccacuguguccauauuuugcaaucaauuuggagacuaaaucugccagaaauaaaguaggcaggaacaaggaaacuuaacgauagaucauugagcuaggaaaguccgcucaaggaaauugcuguuggugguggcaugggcaagaauacugugauauucuuuguugaagaaagaagccuucccuuuguucagaaucagagcugguauagaagacugaauaccaaucaggcacagccaccuuggauauuaaaccuuuuggaaacuugcgaucaggcuggauccaugcaugugagccuauuauucacccacucuuuuucuccaucacugaauccucuuuacauccuucaugacauuauuaacaaacuggccaugucauuuauuccuuauugugugucucacuugguagacuagcagcuccaugaggguagagagcuuguuugguuuugcauccccuggcaaauaccuggcacacaguagguguucaacaaauauuugucaaauaaacuaacuacguuagagaaggacuucagcuaauaucaaaauaaaaaggaccaaggguaguuuuagcaaacacagagucuagguaaaugucuacuucuuugaggauaagugauugaaagguugucauaggagagcugugaaaaagcucuacagacugauuaaaaaauagggugcagcaugaagacucagaaguguagcuuacuuauuaaaaugauuuauuacagagaccagaugaaaauuuuuuuaaaaaaagaggaccuggaacucucaaaaaguuuugaguuauaaucucugagaaauaugaaacaaggugaaacacugaaacaaaaagaugacaaaaaaugaaaaugaaaauauuuggaagaggagaggagugagauaaggagagauuguuggaggggcaauaacagaccaucuucacuagugaugcugaagaguaaagcugacacugaaagaggguauggaugugaaaaaaaaguccaugagauacuuuuuuaagaauguagacaaaaggaagacaaaugccaacaaugagaaggaagaugaugaucgguauggaggacaagauuccaacaaaagaauuaaaaaacuuuaggaaaaaauacagcagaggcaaugaucaaagauauaauugaugaaaaguuuucugagcugaaaaggccucccuuuauagaugaagagggauaagugcuggguaauaaaaaugaaaaaagagccaccccgaguacaccaugguaacuuaguucaacuaaaaggaaaaaggacauauuaaaaaagugcccaggcagaaagacuauauuguauaauauagaacaaacgcuagacugacuuagacaggaagacuaugaaguuuugaaaucauuuuauacucaaaguuaucuuucauaugugaagguaguagagagacauuuucagauaugaaaacacuuauaccacaggcacacuucccauauuuuuaaaaagaaauuuuaaaaauuucuugaugaggucaguucagcugacugauagaugaauuaaaauuagcaauuaaaaaugaagaauuaaaaaggcauuggaaacaauuagacguagugaaaucuaaaucauuauugucaauuuuauugucaaacuaaagguagaaguguccauuuaguuuugauagaauuuaacagcaccauggaucugcagcuucagguuauauuaaugccugaaauagguggagaggcaggagcauauaggagauccuaaauaauaguuuuucuucaagaagauuuaaaaaauaccaacuucuggugagagugauauuucguauuccauugccuucacuuacuaucaguguacuguuaacuccucaaacaucugucucugcugagaaaagucuccuaaguucuagacccacuggccaaguggauagcucucuugggauggcccauuagcagcuccauuucaccguguuuaaaacggaacuccucuucccugcuugaaccuguucuguggucccaagcucuuucaauuuuagagugaccagauaugacaguuuuuucacuauuagccucuuucacucucaaaauuaguuuggacaauaaauuauggggcuacccugaucaucuugucuuuuuuacuuucaacucguauccaaacacaugcuagaccuuuucauucuguguuuuguuuguuuguuuuguuuuguuuuguuuuguuuuugagauggaguaucgcucugucgcccaggcuggagugcaguggcacaaucucggcuuacugcaagcuccgccucccagguucacaccauucuccugccucagccuccugaguagcugggacuacaggcacccgccaccacacugggccaauuuuuuuuguuguuguuguauuuuuaguagagacuggguuucaccguguuagucaggauggucucuaucuccugaccucaugauccgcccaccucagccuccaaaagugcugggauuacaggugugagccaucgcacccagccucauucuguuuuuuaaaugugucucaaauuuguccucuucaucuucaaugcuacuacccugcuucagacugcuacugucccuccacugggugaugguaauaacccugugacagaugucccugccucacacauuuguuggcggaguuuaauacgguuauguguaugaacuucauaguaugggaccuagcgcuuagcaggcacuuaacuaauauuagcaaugauguaacuuagcucaaaacccuucuuuuuuccauuacccuaaggauaaacucuagacucuuuaacguggcuugugugccuguauuuuugucucucgcaucaucucuugcaucagcucagucugcacuaugugcuccagccccacaaugacucuauucagaacacaaaaauucagagaacuaucaauucuuggacacuccauuuuuuguuauauuaccucuacaucuuuacuaccugggggguuaaaaaaaacaaaaaagcaggccaggcgcaguggcucaugccuguaaucccagcacuuugggaggccaaggcgggcagaucaccugaggucaggaguuugagaccagccugaccaauauggagaaaccccaucucuacuaaaaauacaaaauuagcugcgcaugguggcgcaugccuggaaucccagcuacuugggaggcuaaagcaggagaaucacuugaacccaugagguggagguuguggugagccgagguugcaccauggcacuccagccuaggcaacaagagcaaaacuccgucucaaaaaaaaaaaaaagcgaaagaaccaaaucacaacaaaaaaucuccaaucuuggccgggcauggugacuuacccuauaaucccagcacuuugggaggccgagguggguggauccccugaggucaggaguuugagaccagccuggccaacauggugaaacccuaccucuacagaaaauacaaaaauuagccgggagugguagcaugcaccuguaaucccugcuacuugggagacugaggcaggagaauugcuugaaccggggagguggagguuacagugagucaagauugcgccacugcacuccagccagggcaacagagugagacuguugucucaaaaaaaaaaaaaaaaaacaaccucagacuucaccucuagaugcacccgaaugugcacacacacagacaugcacaugcacacauacaccauuugccugauaaauuucugauugucuuuuagaacucagcuuagauguuacaucuuacauccucuggaaacuugguugagauccuugaagcuagguaguguucucauaugacuccaugggacuguguuuacccacuaaaugccugcguaauaguccucugaagagacuugcuauaaaccucuugccgguauggguuggucuuguucauuauuccaaaauggugccuagcaaaucuuuaaggaaaaugaccuacugccaguagcauuugagcuaggaauugcacuagagggaaucuguccugcagaaauaaucagauauggagguggagagaacucuggaaaaggacgugcauuucagcuuuguuuaucaugugaacaaauauuuuaaaagacuuaaauguuuaucaguaaugaauuggucaaauauucuacauguguaaguuauauagaaagauuuuuaaaagaugccuaaauuagcauuucuuuuuguaauagagaacauagggcugguaaauucugggauuuuaacuuaaguuuuuaugaaauuuguguuuucaaguuuuauggaguaaaugaagaugacuuguuugaauugaaguugugaaugguugagugaaauauggaagaagugcuugguacauaggagguguuugcuaaacuaauaacuaaaaauuggagguggagagagugaaaauuaugagaaaaagucauguaaucauuaggcaauuaaauaauuuauccauagugaugaacccuuaugggaaaaguuuugauuuagaaucaucucgcauucauuguuuucuucuuuaaaggugaaguuuuuuguacuuguuggcuuuccuuuguuacccaauaugacuucuuguauguauaguguuucauuuuguauugcacugaacugcauacaacagaaaccuuauuacaauggcuucugaagaaagccuuuuauuauucuuauggacaaguuucaaggcagguaguuagggcucaugauggguuccauggugccgucaaaaguccaggcugcuuuuaccuguuagcucuaccacuguuagccuguggcucuuguucuugugaacucaggaugguuccugcuucuacauacaguacaucuguguuucguccagaaagagggaugagcaaaggaggaaggucauggcaguugggauaaacuggggacucaguaacuuugucagaauuuccacauacuggaauucuaauuacaugucauuguccagaacugugccacaugucugcaucuagcauggggaagcagguuuuuuuuguuguucauuuugauuuuguuuuuuaagcuaugacuguugccauccuaaauaaaauuggcuuucuaucaauaaaggagaaagagauaaugguuguuggguaggaaggagcagcaucugcaaauuagauucauuaacuagaucaaaaagcagcuaccagauuuucugucagcuacucuuccuugcccacuucggcucagggacuggaguuguguucugaauacucuaggagcaggucuauacugaauaaaucaguaaugguuguuagaaaugucuuuaaaacauguucucaagacuuaucaguuaggaaaaucauaccaaacacaaugaaacugaaaaauuuucuacauauucuaaaaccaaaacauaauuagaugcugcaaaauuaaaaauuuaaagagauaaagaaaagcucauaaaauaagagcauauauauacaauugagauuuggguuauuuaaauauuaagaaaauagaauauuuauucuuaaacauuuccuguuuauuuguaggacuaugugggccuauguuaaaauauaguuccuuauucuuugauucauacauucauucauucagugacaaauuuacuuuguauuucugucuugggcagcacuguacugguauguguucauauuuucuugccucuuucauuucuucuugauucuuucuugcucagaaccuacacaggcaaggucucuuuucuaagugaccugugauuuauacuguacuguguagacugcccauaagacaaacccucagugccuuaccugaaaucuucagggguagauguaugugaggguucagaauucuuuuuaauuuuaggaaaguacugugcauauguggcauauuauugcacagucuccuuugaaauuucugaauguuccgaucaaaaaauaaagauucuauaaagcuucaugucaguucuguuuagauuuacuaccaaaugaguuauaaaaaagcuuuugauuuuuucagagcuuuuuggauuucacaguuuagagauuguaguucuguagaguauugguuugggcgaauuaugaaauugcuuaaaauaauuagcaagcuuccuaaaaagaugcauuauagcagaaaccauuuugauucuucuaaauggcauugauuguuacuaucauccauacuugggugccucagcuuuucuuuguucugauucccaucauuucaaaaaucuguucaaaaaugucugucucuuaagaaaucuuugcuagcugagcagugcuuuucacccuuuuguaccacauucucuaaacauguagguauuuagguguugacuuuuuuuuucuuugcgagaauucauuccuugacuuuacugaguguuguagcuuccuaauuauacuucaagcuucccucaucaucugaauucauuuuuucaaaagauuuaucguucuauucuugcaucuccuaaaauaaugcuuuuugcauuucuugcaucaggcaguuuaaaguuuaugauaggcuaccuaauacaauauaauuaaauauauauuuuuacugucauuuagaaguucgaagaaaaguguuugucauuaggcuauuaccagucucacacauugauuuuuaagugauaugcagugugggauuugccuuagugcuuuaacagcauaggauuuuaaaucauucuuuucuucaauuucacaugaacuuuaaaagaaucuuccuuaccaggcccuuauaauuuagucugcuaugauuuuguucuuagguacaaaauucuuuuagauuuuauuugugaaaguaauuaaacagauagauugcauuuaaaguuauauuuuuuauuuuuauuucuugaaaaauaaaggcagaguagcuuaauguucugagaccaccugcuaaauugccugguuagucuguguuuuaauugauuuuguuuauauuuuaagucaaacuuucuuaauuaacuaauugcaugguucuaguuuauugucagauuauuauacagugaauucaguuugcaaaguguguuuuaauuguguguuuuguguggugagauuaaacuuauuuugcuuguuucuuauaaauaacaucuucauccaucaaggaccauaaucagaaaaugcaaaugauggggaggaaaaacaggugcucauauauauagaauuaugaugagguauuuugauauauuaaaauaugaaggcagaauugucauggaaaguaccauguauaauggauaaaggauuauaauaauuucuaguuaagauauuuggaaauacauaacuguauguaacugaagaaaaacuuugaaaagaagacgagguggugucaaagaauagcugguguuaguuuugguguguuugcuagauaauauaaauuuugaaugauucuguuuugcuauugcuguagcaccaacacuugaaguuguauaaaguacugugaaaauguuaaaguaaacuaaauaucuggaguaugagugauuuuuaaaaaaugauuucuauuggggugggaguaacugaugguuacgugagauuacuucaguagcuuauuguuuucaguuucuugcaaacuuaguucucuguccacuuuccacuucuuuuccucccaguguccaucaugucuucugaaauaguaacauaaagcuaauuauuaacccaaagcaguucagaacauagacuaaagugauguggcauauuucaaagucuuccacucuucugaacuagauuuuuuuuccuucuaaaugcagauuaauaaagcgugcacaacaagaggaacaaggaaaaggauuuuagugaagguauccugauccugaaaaagucagggagggcuucaagcccaucuuggacuucagaacaccucacaacuuugugguaaaagaaacauuuuaaauagagccuuuggacuuauuuauuucauccuuauucagagaguagcgcuuuuuuuaaaauuuuuauuuuuuuuaggcaagacaauuguaugugaaaucgcguuacuuuucaaacugaaacauaggguuucagauuuguuguagguacuuaauauauacucaaaauauuacagguaguugguuggcuuguguguuuuucuuugaaauguguucuuuuaucccuugugacauuguguuugcauucacugugagugauguuuucucuaguguuuuguaucuuuaaucgguucauuggguuguauaguagggagucuuuccuaggaccaauauuguuucuaaaaauacuuugaaaguagaaagugguuuguguuuuauuguuuucauauuuuuuaccagucauaugauggcuuacuaaugugaagagauguagcacuaguaaaaauuuguuguuuucuccucuauucaccuggaaaccucacacaggauagauuucauuugucaacacagauauagacagugaauacaaacaucuuugccauuucuguccuuaacaacaaaacagucuuauuuuacuuuguuaacuuuuuaagguccuuuuuauuugugaaaauuagguuguuuauguacuauguguucuuccaaaguuacagaguuauauucauuggagaaaugaauuuucuuccaguagaugaaaauuacauuuugauugaacaucauuccuuaugcagucacccauaaauauaaugucuuuugcugucuuuucagaaaauggcuacagaugugauuucugaauugacaaggaaauagaacaucuuaauguuuuagguaaaacagaugguauuuuuguuugaggcaaaacucagagaaagcaacuuaauuggugacaagacucuuggggucagccaaauuauauacaauuuguguuuguuuuuguugcuuuaauaucaaaaguuuuagaauacuuggaauauuuauucuuuuauuugacuuuacuauuuucuguuguguacuggaaauaguuguaaaauuuuucaaucuuuucuuuacaaaaauuguaaguccacauauuuauucugcuucgguuacauuuauggucuuagaaaugcuuuuugcauugugaaaaguuccugaaauuuguaguucuacuuuugaggguuaacauuuucauuuguaguuuuaaguugcauuugcaacuacaaauucuguggacauugauaccaacucuguucuuuccaugccuuugagcucuaggcagaucucacugucagaugccuggaauuuccggagcacaguguugugaagggacccuugcaugagagucagaggacugauucuagccccaucucugucacuaaccagcucauauuuuuggaacuucaguuucauuugcucucuauauuuggcggguauuaauagguaauccccgaggucacauccaguuaacauuugguuuucuugucuaaguauuaaucauuuauaaagcaaucauuuggauaaacaccaggaaaggaaguuuugaggaagagacuacuguggacaauaaccaaguguuuccaguaacugggacauaagauaaucugucuuccaaaauaucuccaguauuccaaaaugaagaccuauuauguagcaaauuuucuuuuuaccaccucuuacagaaauucagaacuggguagugaaacaaccgcuuguguugucaucauagcaaccaggggaaguagccuaauccucaccuccaggaaaacuccuuuaccccauuccuggcacugcagguggggaggcuuuggagugaagguucucugcuggggugaauauagagcagucugauaaggcucuguucagagaggcagggggaggguaaugggauucugagugcucuaguugcugcaucagugcuucuagcacgugcacccugacugccuuacccacugaagggagacagcaggucaccuucccugucucugacucccugacggauugaguuugaauccuggcuguaccauuucuauggcuacauaaccaugaguaggauacagaaccauucuaugcuucuguaaaauaggcuuguaaaguaacugcucagcacuguuuuaaggcuaauuaagugcuagcuguugguauuauuaucaucauagcugcuaagauuaccauaacaucugaaaaacucugcuacgagcuaagucauuuacuuaaauauagcaaaaauauuccuuuaauacaguuuuauauuugacuuacugcuuugucuguuaguauuauaaacaaacauaacugucugccccaguaauauuuucuaacauagagcuuucuagaauauuuacuuaauaauaucauacuuuccuugccauucuuaguuuagaaacuaaaaguuuauuaguaauauuuuguggaauucuugcauuugaggagaauaagguauuugcagcaaucacuuaguugccaacagcaauuuuagguacuguggucauacuguuuugugaaggacaacuuuauauuugcauuugaucacacaugcagcaugcuuguuuaccuuccuuuugaaucuuuuccuuggacaaauggcucuccaugggaugauaggcucauaauauuuuguccaugauuuuaagaaugauuucuccuaaauauagagaaaggugugaaauaaacuuucauauauuaggaagauaggguagcauuuauguacuacuauauccaaguaaaauucuaauuuuuauugcugaaagaguguucuguaccuuagcguugaauuuuuuuuucuuguaagagcaggccauauuuguuacuuaaccagcuaguagcuuccagaaaccaucauuuaaaauuuuucccuugugaauacaggagagagggcaaagggcuagacccacuucauuuaaucuuugcuuggucccaguuccaaggaccccaagcucuucuugcuuguuacucuuugcccaccuccauccuguuuuccaggacucaggauuuucuuuuauauauccuuggugguaugaaacuggaaguuaguccucauuuucaacaggaauaguguaaccugguauauuaguuuccuguugcugcuauaauaaauuaccaacaaacuuaauucuacuaaaaaauacacacaaauuuauuaucuuauaguuuugggggucagaaguucaagaccauuuucacuggauuaacaaaauauugguagggcugguuccuucuggcggcucugaggggagaaucauuucuuugccuuuuccuuuucuagagaugaccugcauugcuuggccuguggccccuuccuuguauaucccauccacuugguucuguugucacauagucuucuucucuguuggaucgucccucuaauaaggacccuuguaaauacauugggcccaccuagacagccccgaaugagcuccccauaccgugagcuguaauuuaaucacaucugcaaagucuuuucugccauauaagguagcauucauagguuauggaauuaggacauggacaucuuggggucauuaugcucccuaucauaccuggaaaucugauuuuuaaauuuccaguggaaaaauggaucuaucugucuucaccuuuccugccuaagcuaucaacuugaagcuaucuacuucgccguccugcuuugagccuucaccccuuaaguucuuucucugccuggcaacuagaaauagguauuaaaaaggaaaauuugaccauguuaaaccuuuuccaucaacugcacaaaaagcuccaagcuccuuguaaugacuaaaagacaacccacuccccacuaugacuugaguuuuaucuacuuuucuaacuucauauaauugcauuuuagagaugcacuuuacuguguagcgucuagugguaguggccuguauaucuugaaaauaacauuauuucccguauaucugugucuuuauuacugaaaaggauuucccugcuuccuuugcccuuuaaaaaauuuguuuguuuuugauguuguuauuguucugaauuuuucuaauaaacacguaacuuccuguagaauaguguuuacauccaaagcuauuaaaaggauuucuagcauauucacugauaacccuagaaccuagaggagguaacuauuaacaacaguuucuuuuuagaauuuuauauauuuuuauauuucacugcuuauucuuuguauauaauucagaauauucuuuuguauuuaauaaugcaacaaacauuuucuuguauuuaaaaaauucuuuauaaauauuuaauggcuauuaguauucuaguacguaaguauacuuuuaauuguuaauguguucccucaauuuaauauuauauugauuagcuaauauaauguuuugaauaguauuguuuagauauuuacauugcuuagcuguggaaauaguuuaaauauuuuuuguuuacuauauuucuguuuuucuccuuacacuaauuuuuuuuuuuuuuuuuuugagacagagucucacccugucacccaggcuggagugcagugauacagucucggcucacuguaaccuccaccuccuggguuccagugauucuugugccucagccuccugaguagcugggacuacacacacgcaccaccaugcuggcuaauuuuuguauuuuuaguagagacaggaugucgccauguuugccaggcuggucucgaacuccuuaccucgggugaucugccugccucggccucccaaagugcuaggauuacaggcaugagccaccacaucuggccuccuuacacuaaauuucuaaaaguaggaaucauuggauugaaagacagacuauuucuaaguuauaguuuuuucugauuauaaaauuauaaaugcuagauauaagaaauguauaaaguaugaaaaauaauuauaaugcugccaccuaacaauaaguauugcuaauauuuugguaagucaucaaguuauuuuucucuucuuucuugccaucuuuuauagaugauuuuaauauucuuuuaguauuuacauagaaaagcauagaugacuuauuauaguuuaauugaaauuauuacuuuuguguuuuuuuguguugucauuuauauuuucuuauauauuuaccccucuuugugcucuucauuuuucccugcaaucucauguuucccucugauauuauuuucuuucugccugaagacuuaacguuucuuucaguacaaguuugcugguaacccauacacucaguuuuuguuucucugaaggcauuuuuaucauuuucuaaggauauuuuugcuggauauagauuuuuaggcuggcaguauuuuuuuguuuccucaccaccucaaauauauaauuccauuuucuccuggcuuucuuaauuauuuugauaugucagcugaugaucuuauuguugcuucuuugaacaguguaaucuuauuuuuacuggcugcuucucagauuuugccuuuucauaggggauuuaacaugacacaccagguguauuuucuccguuuggggaucacagaguuuuuuuguaucuguggguuagucccuuuccuuaguuuugggaaauucucagcuauucagguaauuauauugugcuauuuucucuuuuauuuccaucuacacauauccuauuucacauauuagaucuuuucacugaguucccugugucccuaacguucuuuucuauauugcauauucuuuuuuucaccacuuccauuuguauguuuuuuauugacuucucuuuugcugaguuaaauauauuuauucugcuauuguuaaagauaucuuuggaguuuuuaacuguaaauauuuauccuuuuagaauuucauuugauuauuuuguaauguguuaauuucuaugguaaaauucucuaccuuguccucuacuugauucauguuuuucucuuuccuuggccauauuaauuauaauuuuaaagucaugucagcuaacuucaauaucugggucauguauaguucuaguuucuuuuuuucuugguguuuagucacguggcucugucuuuugugaugccucuuaauuucauauugaguacuagacaauugugcauaaaauuuagagagacucuagaaaauaucuucuucuagauagauguuccaaucaaggacuauguuaaauugagacugauuuauucaaccuguuguucaccuggcuuucuaaguaauuuuucaacuaauagccugcuuauauucuguaggcccuauccccugguggguucuggaaugucaugagaugucucugcucuacuuuucagaagcuuucuguucagguuuuaagcuucccuuucugcgcagccucaguauuuggcacuugucguaaugaaaaaaucaacuguguaccugaagccucccaaagucuccacaaaaugcucuuuugaucucuuuguuccccagugauuucuuccagacuuuccacuagguuuugcauggaacucacagccucucccuugcugagaauuggcaugccccagagugaaaaugacugcagaaggcuggucacuuuucugaaguuuuuuccucucuucagcaguuuuucuguugcccucaggcaaaugauuauuauuuuuuaucuggcuuuucuaguuggcuaguagaagugagagcucuuguuuguugacagcuacuccauuuccccuggaaguggaaacaucauuuauuucucaacuucaauuugacaaaaauaaagugcucaccuuuuuuucaaaagaguguuuauauuucuguugauuuauaagagcacuuuacaaguuuuacuauuuuuuuuuuuuuuaguuuuuguucuuuaaucucauuuuuaagauagaaaaauuuuuaguuuuuuguuaccaaaucugucagccuuuuacuucauuguauuuuucaguuauggcuagaaagaccuuuuguaccacagauuauauauuuauuuuuucuacuaacuuuguaucuuuuuuauguuucaaaauuuacauuuaucuggaaucaguguugacauauuguuuuaaugcaucuaguaaccauuugucuugcucaucuauuauuaaggauguauguauauuauagaauuguuuugcccaucucaugaucauuuuccuucccucaccuuucuuccaagaaaugaaauucagugggauuuugguuggcacugcauaagacuuacgaaugaauuuugggagaguugugcuuuugcauuauuuuaguuuucuuauuuagaaagauaugucucuccauucauuuuuauguucuacuaagugacauuuuuucauuuucugcguauauuauacauucugcucauuuuguauaaaauuaauuuucuguuuugauuggucuccugaagauuguuaaucuuccuaacagccgugugugugugugugugugugugugugugugugucugugucugugugucugcaugcauacguaugcaucccaugacaugcuauuacauaccuuugucuuauugccuacccuguuauauugaacuuaccaguuuguuucugugccucucccuccuaaacuguagguacuuuguugacugggauuauguauucauauucauaaguuuauaacuacacauaccauacagcaucuuucucuccuuucuuugcuugcuuuuuaacuuagccauaagccaugugguuacuuugaauguguauucucaccacuaccauguuaucagaauucuuguuucaagauaucuguauuaucaccuguuguuaauuuccuuuauuuagauuuauacaugccuuacacaaaaaaaggauuuaugacagcucauugaccuggguuuguuaaaucguucacuguacuacccagugugaugaugugccaggguccuuggucaggauaccaugagagucuuguaagggaaaggagagaagugaauuguuauugagauucuuuuuuugugcuuggucugagcuaggugguuuucuaaacauuuuauaauuuaacauuaacaauaaucuuguuucccgauuuuauagaugaggauauuaagucuuggggaagugaaauaacuuguccaaagccucugaaacucuaagugacaugguggggauuugaguuugaaugugucugacucaagagcccaggaaucacacaauugugauuuuugaagaucuaguauaacucaaaaagacacucuuaguuuuuaaggucuugaauuuuuuccugucaauaugguaagcauuauauuuuaaaccuagaaaacaaaaugguauauaucaaaagaacuucaaaucuagauauugcaacuucuguuaacauguaaauucauguuuccauauucagaauacuguauaaagcuuaauguuuuucuuuagguuauauuccacuaaugaggcuacuuagagaagaugaaugcauucuuguuugaaaugauuuuuuuaauauguugucauugauuaagagucagacaaaaugagcucuaauuuuugcuuuauucuuaacuuucuuuguaauauugaaugugccauuugccccaucuuuacaaagggacuaauuauauaauuuauauuuucgaagaauugaaaagcacuuuuuaaggaauugaaauaaucaaaauggaacugcucugauaaaacuauaaagccccacaucaguagauacuauuuacaaguaauaaauucuccuagugguauuuuucugcacugaugauucauuaacuacugaacauuauucugugcuagguaccuauaguaagcacaugaaauuacaguuauuuuucauaugccuuuugguguuugcuuaacugauuuuaaagugcacuuauaaagaacuugaaaaaauauguauuuuuuuaaucuucauuacacaaucauaaaaauauguaaguugcuuuuaaaauguuuccucaaauaucguuuuugcuuacuucaugcagugaggucaugagaugaacuccuuaguauauauugcaaguuuuuuucuguuccaguguuccaguauauaaauuuucuuucacaaauauaauauacuugaaauguaaauagcuuauugcuuaucugagcuuccugaggagagaggcucucuggggauauuggccuugcuaaggagaaaguucuucacauuugaauuuggaugcaacuaagggaaucuccacaggaaacuucagcugucacaacugucacaaagauccuuauaugccuggccugugagugaaguaguuaagaagauggguguggaggugaaauugcauuauaagcccuauuguggcacuuuuuaccugggccugucuuggcaacauuccugcucuuguugaaccucaguuuccuuauauguccagugagaagaaugaaagguugccccacagggguugcccaugcaggucugaggaccagcccaggcaugcaggaugcacucugaaugaaggucccucugaccaaggggcauguuccuuccacuuuguacugcagccaguccuagaaggaagccugugugcucccagucuguuguucacauuuuagugggcacugauuagauuuaccucaaagagaaaauucaguauuccauaguugucuuuuuuaacaugauaugaauuacuucuaugaaaggugaaggaauuuuuaguauacucauccucaguagaaucuucaaggacagccacguuuacacugggauucuuccauaaagugauucccaguuugauaggagcauacagauguucuuucauuuuuguccauucguuuuucuccagccaaaguagauuaucuucugcccucuaguuugauuggcagguaacauaugaaugcuuuuucuucaugaggugagaguuuuuccuuguauauggagaacugagauaauugcucauaacccugaauuaugggggcccaaugucacagugagaacuaggaggcuggacgugacuuggugacagaugauacguaagaagcuaaugcugaugugguggaaauuggagaagaaaaaagcacugaccuuacagcuaaaauugaaauuaacccuccccauucugaagauauaaacauaauucuuuuguuaauguggaucaaauauuguuaauuuucaguaagugaguaugauauuaugauauacugaaaccuauugguuucauucacaacuagagggccugaaaggacucauguuuggggauauuggcaguauaacaaauguuugacuaccaaaugugaugacaaugaaaauuaaguuauuuaugauuguauacuuauuuccaaaggaaauaucuauauaugaucauccuuucucuguacucuacuuaaaauguacauagauaggaguucgugugucagauaaauuuguucugugaugcacauaaaaaacaugcugugaaucucuaaucauguuaaaaauuauuuucuuagugcaacauuauacucauuauauacucuacacauuuagucuuugaauagauuccuggcaugauaauuacauaaucauucaguacaguagaaacaucguuauggucaaauacuaauuagcuacuaaaaugaaacaaaauagaaccuaguucauagcuuauuauaaaaagugauuuaauagggugcaaaaccaaauauaugguuaaaauuauuguuugcauuaaguaugaguacuuuuuuuucauagaaggaauuaguguucuggaugcuuauuaucuaauuuauugcuuggacacacauuauaguaucacagucuucaugaccuuuggcuguaguggagcacccaaagaacaugccaguagggauucuaggcuuagugugccuagguaugccucagggcuacuacagaauuaggagauuggccaaaguuuucaggcaccauuuucucaaguucuuuaaauacuagcucuguaagccucugggaacauggguuucaguaguaaaucacucauuucugggguucugcuuugaacaucuuugguacagagaaugagugauccaccacuguuuuucuuccccauugcaccuuagaaauauaggacagucccauugguaauaaugaauccuggccguugcaguuagccagguguguuugugaauggggaacagucaggcgaaauguaaucucugguaggagggcugugggaggcugcaaauagauugacaaaucucugagguaagucuguugaguauaccucucaagagggcaucacccucccucgccuugagaauugcuucugugcguaaaaugggauuuuaucuaaguacuaggaggauucguugcucuuuguaaauauguuugugacuaugugguuucaucuguucaucucuuguauacauauggaaucucagugaacauaaguaauacaaguuagguccuguuauccugaugcauacuguaagccuaauaggaauuagagacauucuuaaugucauuaucaccuuugguaucucagaauguugcuuuaacauaaaugcuucugaugaacaauuuauaagucuagugucauggauuuuguguuauauccucuuucuuuuucuucauuuuuccuguugucuuuuuucccuuuaguuuuggccccuguagguauucauuuuauuucuuaaugaacacuuuguaaugcaauuaaagcaaaaauauauagaacacauauacaggauggaagaauacugguaagcuuggugcuaccaucuauagcuacaauguauugggggagaggugguuguuauccaacuauucaguguguuccugcgguuacaaaauuguauaggaaaacaaaaauauuucagaucaugaaaauaugcacuagugaaucagugaguuauauuauuaguccaacauccucuuugaaauacucuucauuugaagacaauaugaugcaaauugauuauaaauuauaaaaucauaaaccuugcagaggaugcagauuucaugaagucugcaaugugauggucuagaacgucucugcucacaggcaaagccaugaaagaaugacagucuggcagaguuaugcuaguaagaaaaucaaggcuguuggguaccucaacugagaauuauuugaacaucagaacugggagaggauuuuaggaaaaauaaaguccuuaaauauuuuuucaaauauaguuuacuaauaaaaccaucauguaaaaauuaaauguuaugugaaggaugucauaauaugcugguauaaaauauuggaaaaauugugucccaaauuucaguucauuuauguuuuuguucauaccaaaaguugcacguaguugcaaauauugccuaaacuuauuuuaauaguuugcauuuuccuuuuucuaccuaaucccaaucaauuuuuuuuuucaccauuacuuacuauaaacauuuggggcccuguuacaaguggauucacuucaagugaccuuuuuuagaaucaacuuucuuuaauaauaaagucccauuguauauaaaauauaugugugaauuaugugauuuuccauauauagccauacauucuuaguggucuaaaaugaauauuagauuuuuaacuggaacucauugugaugaaauugcaaacaaauugugaauuuuuuuuauucugugagauuagguaggaaucaggguauuaguuguauggagcucauucuuuuaaacagaugaauaaaaccguauuuauauaagucuuuuucugggguacagaaaagcuuuauuacacaucuaugaauaucuuccauuuguaaagcauuaauucuuuagaaagggcuucugaaucauuauuuaauuacccuuuguacugugugauauuuguugugaugaaauugccuguucucugaaaguucucacagaauauuccuguuaauucuucuccaugaguugacucuaugacuguccaugaacugaaguauuaugaaggguuuggaaaaaauuagccagauguaguagcaugcacuacaccugcuacucccagcuacucaggagacugaggugggaggauugcuugagcccaggagguugagacugcagugagcuauaaucuccccacugcacuccagccugggugacagagugagacgcuaucucaaaaauauauauguauauguauauguauauguauaucuacauguauauguauauguaagaaguaaaaauauuuugagaucccaauaaugaagcagcuguuuuugcagguaccuuguggucuauaauccuuuagaacaagaccgaaucucguuggucucagucuaugugaguuccccgacagugcaaguguucucugcuucaggaaaaccuguggaaguucaagucagcgcaguuugggauacagcaaauacuauuucagaaacagccuaugagguauguuguagccauagaacuuaaggaggcauuguaaaacaaaccuagccaguauauaauuuguguauguacaguagcccccauuuagccaucauguugguguaugugaggugaugaaaguuguaaauaccagagaguuuaacuggugggucaaaugacacuaaaggaaaaaugauccuguguucccuaaaauguuaauuucuuuguuaguauauauauuguaucuuauuauauguuguucauauguauauuguauaucuuuguaaggaugcauacuguuuauucuaagguaaugcaguaauuauuacucauaaaauuuugaauguuuugcucuaagugaauuuaaugauaauuaugcauaucgaaagugagauaaauaccacccuuaguaacuuuggauaguuuuagguuuucauugcaaaggugacauaacacaccauggaagagaaaugcccuaaaauaauuaagaugcuucuuuugugagauauaauuguggaaaaucugugcucaaguuaauagguauuuuuugugccaaaguuucuuaaaauaagcaauauuaaacugaucacuguaccacuagaaagguuagacuuuuaaaaucuggaaugucauuuaaacggcauuucuggagauacagccauaaacuaggaacucuaagaauuguuucugcuugacagaagcuauugcuagcuacuuuuauuauuauuauuauuauuuuugagacagaauuucgcucuuguugcccaggcuggagugcaauggcgcgaucucggcgcaccgcaaccucugucucccggguucaagugauucuccugccucagccuccuguaacugggauuacaggcaugugccaccacgccuggcuaauuuuguauuuuuaguagagaggggguuucaccauguugguugggcuggucucaaacuccugaccccgugauccaccuucuagcuacucuuaaauaugcaucaucuuuuagauagaaagguaaacuauaauaaaaauuuuggucagauuuuacaggaagcuuuccaucuagaaaauggaacagcaacagcuccuggaaagcaggggucaugucuuaaacugugugcaucccccaugcucuguucagugucugcugaaccucaagcauuugauggcuaaugcuaacuuguuuaauauuuauauuauguuuaucauuuuuauuaaccgaaauaucauaauauugcaaaaaaaauuaauaauuaggaaauggcauuguuguaaagcccuuacauucauggaaaauuuccuucucuaggcauucuagaguacagccaaacaauugagaaugaucauacagguucacauauuggauaaaaacauuagugcuuuugauaggccuaccaacuuuagguuauuagguucucuggauaaacugagacauguaugguuuacccauaagauaucaaacauuuauagaauauuguuacacagccaugccuugguaucuguagaggacuggucccaggacccucuggggauaacaaaaucuauggaugcucaaguccuuuauauaaaauggcauaguacagaugaucccugacuuacaauggcucaaccuagauuuuucaauuuuauaauagcgugaaaguaaugugcauucaguagcaaccguacuucaaguacccauacaacuauucuauuuuucgcuuucaguauaguauauaauaaauuacauaagcuauuuauauuuaguauaaaauaugauuuguguuaggugauucugcccaacugugggcuaauuuaaguguucugaguacaugaaagguagacuaggcuaagcuaugauuuuggauagguuagguguauuaaacaccuuuuugacuuacgauauuuucaaauucuaauuggacauaacccaaucaugaguugaggagcaucugcauuugcauauaaccugcacacauccucuuguguauuuuaaaucaucucuaaauuacuuguaacaucugauacaauguaaaugcuauguaaauaguuauuauacuauaguuuuuauuuguauuuuuuguuuuuuguuuuuuuuucaaacauuuuuuaucuguaauugguugaaacuguggacauggaaccuguggauauggagggccaacuggauucucuuuuuaaaaaauaugauaguuuguugguuuuaccaaaaauauaaaugguuugccucucaguagauaacauuuaucuuuaauaaauucccuucccuaucuuuuaaagaucucuuuucgagcacauauaccgccauugggacugaaaguguauaagauuuuggaaucagcaaguucaaauucacauuuagcugauuaugucuuguauaagaauaaaguagaagauagcggaauuuucaccauaaagaauaugauaaauacugaagaagguauaacacuagagaacuccuuuguuuuacuucgguuugaucaaacuggacuuaugaagguauguucugaauaguucuaaaauucauagaaugcuuaucauuuuugcuacaauguguguagauuaauuaggcaaaaggggaaaaaagucuuaaguagagcuguaucaaauacucuugaguaaaaggaagcaugagcuuuuugcaccuucauugaccacuugcugcucacauguauagucuguggguggcgcuacuccguggucugugugucacugguccaccagauaaguacagaaauuauuuuuuuaaauugucauauacauagaaccagaugcaacaugcuuaacaucuuaguggugaguugcuuauuauuauuuuuuuuaaucuuuagcaaaugaugacuaaagaagaugguaaacaccaugaaguaaaugugcaauuuucaugguauggaaccacaauuaaaagagacaaaaguggugccuaccucuucuuaccugaugguaaugccaagguaagugguacugaugagaugacaaauggaauaaacacuuauugaaagaguauugaggaaaaagauaagugagugucauuauuuuaucaucuguugauuuauuagggauagaugaacuuuugguugcaguauuaucuaucaccuuauugauacuuagcaauuuguagucgaaaguuagauaaaugguugggcgcaguggcucacaccuguaaucccagcauuuugggaggccaaggaggguagauugcuugagcucaggaguucaagaccagccugggcaacauggcaaaaccccuuuucuacaaaaaauacaaaaauuaggcaugguggccugcaccuacagucccaguuacucaggaaggcugaggugggaggauggcuugagcccggaaggcaguugcagugagccaagaucacgccacugcacuccagccuggguugacggagcaagaccccguuagauaaauaguuuuuuagaguuggaauuuguuaagaugcuacaaugaacaauguucaguuaggauaaacaaugaacaugggaagaaacuagauuuuacguagaguuagggagcuuuauauguaugcauuuuauacagacacaaaaccucuagccguaugggaaaaauagauuuuccacuggaccauuuuucuccuuaacuuucagcccuuuaaaaaacaaaucuuucucacucuugacuauaaagguaguaauacgcaaacucuggcacauuuugaaaaugccagaaacuaaagaaaacauuaaaauuuaccaacaggugcacaaucccaugaaaaccauugccaacauuuggauguauuucuuauugucuuuuauuuuaugcauauccuuuucuccccguucucaagucuugacuuauugcauguacauauuuuguuuuucauuugugacagugcucacaaucugaugguauguuuuuuaaaaauccaauuuuaauauauacuguuguguuuaagauguugcuuauauucuuuuucucccgauucuucacuaccauaacauuguaauaagcuuucuuuguagcauucaaaaagaaugcuacaaugcaauucugauuaauugcugagaauaacuuucuagaagagucauuuuguaucagugucugaagucuuuuaaggacuuuugcuguguacugcuuaucuucccucuagaaagacuagguaaauguucaaucccaccagcauuuuuugagauuaacucuaaaaucccacuccaagcacugagaauuggccauauuacaagcuuugccuauaauaguaaguuaguagaaaaauauuuuucuguuaagauuuuugugguuacuaguaagguugaacguuuuuguaccuucauuuaucuuucauauuucuuuugugauuuuccuauuucuauucuuugacuguuuuucuguugguguguccugaugaucucugagcacucuauaugugguaaaauuaauccuuuucccuauauguuguaaaauuuuucuuauugugucauuuaguuuguuaauuauuuuauuguauuucucauuuauagugguuuuaaauuuuuguguagucauuucuuuuuuuucuguagaguuucuuccuuugcuuuuauaccuuuauagguuuucuauaccucaagaucagugaaauguuauccuaauuauugucuuguuagcuagggaccuaucuccugaaaaaguuacuuuuguuccacaaguuaugaaaccugcuaacuaaaauccaauacuggauuuuaagggauuguguaggcuacaguaaggacucuagguuuuuuguuuguuuuuguuuuugguuuuuuuuuuggcuguuugggguuuuucuuuuuuuuuuuuuuuaagucagugaagaauuaaagacaaacuacaacucauaugaggcauuccaggaugggcagugagucccaaauaugagcuguuucaguguuuucucauucaccagcuuuugucauuggacauuuuauuuugauugacuguauuuauacuuaaaaaaguaguugugcuauagaauuucaugcguagauaccaauaacuaauuuauuuaaaaccauuuuaucuuuaaauagcucuaaugucagauagaaagauaaaacaauugucauuuuuacagagagaaaauaaaaaacaucagggaaagaggcagucuagugcaucagaaaaaggcaagagcccagaacucaucaucccagguucucauccccucccucacuuucuagcuauuugguaauuagguacaagaaauuuguaaaccauuaagcauuuuaauaacuccagaaaauuuucccuagccaaagagguaaauuuggaagaaaauuacacaauucugaaaaaaaaauuuuuuuuuuuuggagacggagucuugcacuuucacccaggcuggaaugcaguggcgcgaucucagcucacugcaagcuccgccuccuggguucacgccauuuuccugccucagccucccgaguagcugggacuacaggcacccgccaccaagucuggcuaauuuuuugucuuuuuaguagagacgggguuucaccauguuagccaggauggucucgaucuccugaccuugugauccgcccaccucggccucccaaagugcuaggguuacaaggcgugagccacggcgccuggccgaaaaucuuacacuguuuaaguaguucauauugcaagccuaacuuucuaugcuauuguugagcuaagguaucuaauacuuuaaaaauauaauuacucauaaauguuuuaaauuugcuuccaugucacauaaguuaugugcuuuauuaccauuuuuuaaaauuuaaauaaaaacuaaacuagugguuuccaaguaguuuuuucaaguuugugaauuuauauucagcuaguucuuucaaguaaaaggacagaauguuuuauaguuuaguaaaccgagcuaugauuaaacuauguuucugaauccugcuuucaguuugcuuagaugacucccuguagucauccuugccaccugucccaaacccugaacauuagggggcugggaccaugguuauaauaauuauuuaccugggaaaauguaacuucuguagaaugauugcuguuucuaauaaguaacuauauggacaaauagaaggauuuuaguuagaaauuuguauagcugggaggaaugcuuucuagaccagugaaguuguaaacauuuuuauuuccuauuuucagcauuuuuaaaaauaaaaaacacguucaguuuuuaucacaugcauauuuuguuaccuuguaagaucugguuuacacuuaaaauugcaaauaucaggugauacguauuuucuauuuuugaaaccauaauaaacauauucuuuuaaaaguuuggaagccaaaauauuuuucuuaaauauauuauuuucuuuucagccuuauguuuacacaacaccgcccuuugucagagugacacauggaaggauuuauucggaagugacuugcuuuuuugaccauguuacucauagaguccgacuauaccacauacaggguaagaaaauaggaaugcaguuaugaaacauauguauuaugguuuuugaauucuugcuuuucuuaugccauucuuaaauuaacaguugguuuuuguagaugauguuuuucuaaacuugacauuuuuaauaugauuuaaaauaugaaacuuacccuuugauaauaaaaaaugguaaaacguuucaaucccuacauauacauguuccucuguauaucuucucuuaauuguugccauauuggucuugagcucauuaacugguaacuuuauuuuuaacaccugaaaacaauacaguguuuugauuuuaugaaauggaaauuauauuaaauacgacuuucaguuaauagaccacacacauauauggggccugcuuccuuaaauauagccuguaucacuggaauguaacuuuaagagaaaaauguucuaagcugguucuauuuguuuacagcucuuuacccaguagaguauaaaaccuagcaauuguuuaucauuuuuagaacaguauugagcagcaucuuuaugaacccaagugauaggaaauaggcuuuugauccuuuugagaacuuaacccugggcaauggaacugauuccauggggucugaguggagcugugguuuccaaagacuugcacauuuagguugguugauuuagaauucauuguuuguagaauggugugcuuuuccaacuacagauuuaauccuaauaaccaggguauuuaccauauuaucaacacucuuagaaaaagaccucauaaaaaugccauuuaaauuuaucuuugcuguuagcuaaguugaacaaauuagaaaagaaaaaauacuauuucccugaaucuucauacagguaaaaaauaaaggauuucacaaacuaaagauaaauguauagguaggcacgguuuccuuuuuagguauugugggaaagcaaagggauacuauguucagggaaucucuuaaaucacagaaguucaauuuucugauuucauaguuaaauuuaauuuugcuuuuauuuaacuuuuuuauuaacuucaaauuucauuaguauuugcuuuuuguuagaauuucagguauggacaaacuuucucaugcaacuucuuuagguaauaauaugauagguuuuucagaauaacccaugauucauaggaugaaucaagaaguaaaaguucucuggcaggugggaaaaauaaugcuagacacuaauuuuguguccuaaaugugacuucugaaguuaucugugaucacuuugcuaccuacaggaaaaccuguaguucugaaauaaucuucuauugaguuucucaaaacuucugguaagucagaaacuguuuuugaucaucuguuuguacucuuguguaagccauuauuuaauaccccugagagcucuaaguuacaucuucaacuuuauagcauuaccccacagaagauaugcugaucuauuuuuaaguuugcuuuaaacuauuguuuuuuaguggaaaaguuuuuccuggaguacaacauggcacacacuuuggcacaaacuugugucaucagguuugauuuaccauuguuuuucaucaguuauauuuagagaugggcuaugucucagaggaaaugcuguagcaacucuuccuaaaauuccaacuucucaaucagguauauuugcauaauugcuuuugcuuuuauuuaauuaugucacuguaucuucuggguuuuccuuggauuauccaggaccucuaguucucacaucauagggcaguuuguguagacuagauggcccuguucugcugcuaguggcuguagcuuagugcuugacuuggaaauuaauaggcucugacuugccuauuuacuuauuugagcaaacuacacucaucagaacuaaaugcuugucauuuuuccuuucccccucucuuccuguuucccucugggcagugaacuguccaguggcuaauaguguuaagcaggagcccgggccacugagguuugacuggcuccuggccuuccaaaggggcucucaauguagcccauuucuauuugcuggucuugccucugccucuuuucucuuuuuuauucuuuaguuuucuuucuuucuuuccuuccuuuuuuuuuuuuuuuuuuuuuuuuuugacagagucucgcucuaucgcccaggcuggagugcaguggagcgaucucggcucacugcagccucugccccacugguucaaggauucuccugccucagcuuccuagguagcugggacuacagguguacaccaccacgccuggcuaauuuuucuauuuuuaguagggaugggguuucgccauguuggucaggcuggucucgaacucuugaccucagguaauccacccgccuugucuucccaaagugcugguauuauaggcaugagccacugcaccuggcuugauuuucuuuuuucauguguuuccuuucuagauuauuugucuucucuuccuugguguucucgggcauaugaaaaaaauaauaaaugauggauaaauaaguguaaugcaaacuuagagcgccucacugaugaguuuuacaguaguugccuggauuaaaugagaagccgucauauauaaacuggacguaaccuguaaaucuuuuuucauucuaguccggaucauuuuuuuuuucaacaugaaagcaguugguaggaaauagagauaccagaaucaccugaaaugcuuucuuccaaacuauauaccuucccguguuuguauuugagcuccucuuaacaaaucucccucugggaaaagauaagcccgguuguggagagagucuuuccuuaguaaucuucaugacucaccugucucuccuguuuuucacauaccauugccugaacacucggguugucucaauccuggcugauugugguuuuaaugaaaucacuaaucaaggcccaugauagauauacgaagucuucaggguauuuggcucuaucagcguucacgcugccugaaagggugaucagucuucagggaucuguuauuuagugccaagucuuccuuauuaagaaauacuggaaaguuguuuaacauucuaaacuuuggccuccuguaaaucagacaccuggaugauugaucaaaaugcauagacaaaauguggcuuuucauuuuagaugcaaaggaaacgucagccaacuuccaugcuguuguagauuggcuuuuagcuaguauugcauaaaauaacaaaaaauauuuauucuugaauuuaauuuacuaaacuaguuuuggauauaugcuacuuuugucccccuuaaaccaaccagaugcaguuauuugcaugaguauuaaugaauagagccuauuuguuguuaguaccagauuuucaauccaggaagaaaugaggguuuggggagagagacuauuaauguuuuaugauuacauacuguaauuguauuagguuacuaaaccaguuaauuauacaaaagauuuuguaaucucagcaacaaggaauaaagaaacagaaaaugaguuaguauuaaagauugucuuuguugggugucuauuuuuguuaaaccuuacaaauccaauuuaaaaacuaaacuaacgcauaccugacaaaauauucuuacauuucucagucucuacuuuaguuguucuuugacccuuuucuccccaaaguaacuauugcccaaauuaagcuucaggagaaaacaaaaucaagaacgacaagcaacauuuccaaaauuauauaaacuuuuugguccuuaaugauuuugaaacagaguugagaggccguauaguucaaccuacuuuuguuuuugguuugguauuuaacuuuuguuucucuaucugcauucucuccagauucugaaaaugaucagaagugcaguugaagggcucucucuuucuuaacaucuuuuaaacuaauaaaagaacacucuguuuuccuuuucauuaucguucagacaucgcauucaaaagguuucuaaaaauacuaaauuagaagaaaucuugugcucacuagccuuaaaagcucuacaagaucagagcaguucagaauuucuaaugaaggcguggcacgguggcucacaccuguaauuccagcacuuugggaggccaaggcaggcggaucacaaggucaggagaucaagaccauccuggcuaacaaggugaaagaaaccccgucucuacuaaaaauacaaaaaguuagcuggguuugguggcacgugccuguaaucccagcuauucgggagacugaggcaggagaaucgcuucaacgcaggaggcggagguugcaaugagccgaaauagcgccacuguacuccaaccugggcaacagagcgagacucugucucaaaaaaaaaaaaaagaaaaaaagaaaaaaaauuucuaaugaaauauauuguuuugcccaugucagguuuaauaaauccauuuuauagcacccauaauuuaaugaaaugcaauuuauuucauuuguagaaaauaacacucuucugggggaaaaguugagggaggugggaauuaauuuuucuugcaguauaaucaucuuucauuuaauugaagcuuuaaacauuaccauauaggcugcuacuuuagcuuuuuugguuaaucuguaauuagaagauagaauauaauacaaacagaagcuccuguauccucuuguguuuuauuuaauacugcaccuacaaggaaaguacauaccuugcaauaauauaauaccaauaagugacauuguuaacuguggccuuauuugucuucagagcuguaauuauuggacuuuaguguccuaguuucugauaucaacagcuacuuugaagaauuaggucacuguggguaacgaguaugucguguacauuucauuggcgcaaggacuguguucuccuaggcagguguuuguuagcgaguuaguauguauguguguguaaaccauguuuuaacccuuaggggaaacaucuuaaaugcaauacuucugcccuguuuuccaccaacauauuauaaaguauuauauguaauggaucuuacucaaagaaaacaagcagccuggagguaaaauguaaugaacugacaucaaaaaguauggaaggaaagacuuuccuuugacugaaaugacugauuuucuugcauauuuagcaaucgaacagaguugcuuaguuuuucucugagcaauuuugaauauauaaacauaaguggauuuauaaccugacucuuggcuuuuagagaaucaaaaugagcuucaucuaguuaaacauauuaggggacuucaaaaaguuuguggacaaauggaauuaaaagauaaaaauuaaaaauauaaacuauuucucaacauaagcuucaucaaguucaugacgcuuuuguaagcaaugaauccagcuacucaguccaucccuaaggaacagaggguccuggaaauuuaaccaugucauuucagucuacuuauauuauuaaguaaaaugagugcccauuaaauauuuuuuuaagauuaggaaacaaaaagaagucaggaggagccaaauuagcacuguaagugacugccuaaugauuuuccauucaaacugucacaaaauugcccuuguuuaaugagaggaaugagcaggagcauuaugguggagaagaacucugaugaaacuuuccuggguguuuuucugcuaaggcuuuggcuaauguucucaaaacauucucauaacaagcagauauuacuguucuuugggccuccagaaagucaacacaccaaaugccuugagcaucccaaaaagcuguugccaugacuuuuacucuuggccagucuucuuuugcuuugauuggaccauuuccaccucuugguagccauuguuuugauuguacuuugucuucagaaucauacugguaaagcuguauuccaucuccuguuacaauucuucaaagaaauguuucaggaucuugaucccacuuauuuaaaauuuccauugaaagcccugcucuugucugcagcugaucuggacgcaaugguuuuggcacccauugaguggaaaguuuccucaacuuuaauuuuucagucagaauuguauaagcugcuaauuguuaguucucuucaguuagagcaggagcaaacuuaauuuuuuucuugaaaauugguguagucuucgucuucuacauugucccaucccuucuuaaaacaauuuaucuguuuuguaaagugcugauuuucuuggaccauugucuccauaaacuuuucauaaagcaucagugauuucaccauacuuccaccuaagcuucaccauaaauuugauguuuguucuuguuuaaauuuuagcauaauuuauauugcucugauaggggcucuuaucaaauccaagucucacccuucuuagugcucaaacuagauccuguucagacauguuacaauaaguaaguaugaguuuauuuugaugaaauccaugcauaguuuuuucaugauaugcauuuuccaugaaacuuuugaagaccccucuuauaagggaaucacauugggauuuggagauccaaauccuuaguuuugccucuaagcaaacuagaggaguauggguuuguccuuuaauuucuuagggacucaguuucuuaaucuauaaaaaagguagauguucaauuagguauaacugucaaagagucuucauacaacuuaguuucacauaaaaucucuugugccugacucccugcuucuaaauucaucuucuacacuuggucuuagccaaaaggccaagaagugauuaaauucaucuucuaagaaugccugaaucuggggcuuccaucccuggagucugccccacuuguaaacaaggucucagagcuucacugaaguucuuuuuauuuucauaaaaagauucaugaagacauuaagaugguuugcaaucaaucucucauuuuuuuccauagcuauauuccauauuuaguuugauuuaaaaguaaaaagcauuaaguaaguuauagcuaggcaggcuuagguaauuaaaacauuuuuggaauaucauaauaugcaauugacugcuaaggauuuuuuucccuguuaauuggaacuuuuaaaaauugaaauaaguagcuaugugacgaaucugaucauucccuacaggcaugaaagagaagguuauuuuaagggacugcaagcacauucugguuacacagauucagaacucagagguuaucuuuggggcuguuugagagcagcugauuguugaagccauaacuccuuagcaaagaagcaucauccccuacaaagguggguugcacugaacucaggugaagggcacagggaugggggaaacacaggagauauguaauggcucagaguugagacuccagagccaguucucuuguguuuuauucccaggcccauccuaggucugccacuuagcagcuguuugaccuugcacagguuacugccaaccuggcuuugguuuuaucauccugaaauguugacaguaguaaaaucagcuucagaggauguuuggaguauucaccgaguaaauauacaaggaaccuuacccauagugaguguuguaucuacuuacaagagugagugagccagauggguuagauaguuuacuauuauaagacaaagcauggucauuaaggauugggggaauuggggaggauuuaaugaaggaagugagucacugagaggcuaggucuuagagaaugucacaugaaaggcagaaaggaggaaaagaauaucacaaugugugaaauaagguuguuuagaaccccacuauaaggauuugaagaacucuuugucccuuauauauuuuuuaauugacuugaaguuuuucuuuauacauuuaaauaauugcaaaggauguuauuuugguguauuguacauggugacuuuuaaaaauaagcauauccaaugggcagugguacuaaaucauguguuuuuuaaaagccugcacuagcuuuuucuuuaacugucggaaacuucacaucauuauuuucuccuuauaauuacauucuauuucuccacagaauguuaucuuaauguaguauuuuugugguucagagccuuguuauuggucagucuuucauuacuucucuaaaacaaaaaucauguguguguguguguguguguguguguauuuauguauacaguuuuaaaagucuguuauaaggcucuaaguauuuuauuucuucuggauugagauauaaaaauuauuauuuguaugcaguuggucaaaaaacauaaauauguuccuauuuuaauaauuuuauuuuauaaauuuuaaugaaaacauuuuucucaguggguuguaccuuuuuaauuccuaauggauaauguauccauugaugaaugucacucauugcuagaaugauauaugauuuuauucuuaauuuuuauuuauauaaauaucagugcaaaggaaaguuguucacauaaauaaguagcugguaauggaaggaguuuucuuuuuuuuuuuuuuuuuuuuuuuuuaguauuuauugaucauucuuggguguuucucggagagggggauuuggcagggucauaggacaauaguggagggaaggucagcagauaaacaugugaacaagggucucugguuuuccuaggcagaggacccugcugccuucugcaguuuuugugucccuggguacuugagauuagggaguggugaugacucuuaacgagcaugcugccuucaagcaucuguuuaacaaaccacauccugcaccgcccuuaauccauuuaacccugaguggacacagcacauguuucagagagcaagggguuggggguaaggccauagauuaacagcaucccaaggcagaagaauuuuucuuaguacagcacaaaauggagucucccaugucuacuucuuucuacacagacacagcaacaaucugauuucucuuuccuuuccccacacgucccccccuuccacucgacaaaaccgccaucgucaucauggcccguucucaaugagcugcuagguacaccucccagacaggguggcggccgggcagaggggcccccccacuucccucccggauggggcggcuggccgggccggggcugccccccaccucccucccggacggggcggcuggcugggugggggcugucccccaccuccuggagggggcggcugccgggcggaggggcuccucacuucccagacggggcggcugccgggcggaggggcuccucacuucucagauggggcggcagggcagagacgcuccucaccucccagacgggguggcggucgggcacagacacuccucaguucccagauggggucacggccgggcagaggcgcuccucacaucccagauggggcggcagggcagaggcgcuccccacaucucagacgauggguggcggggcagaggcgcuccccauaucucagacgauggguggccgggcagagacgcuccucacuucccagaggggauggcggcugggaagagacgcuccucacuucccagacugggcggccgggcagaggggcuccucacaucccagacgaugggcggccaggcagagacgcuccucgcuucccagacaggguggcggccgggcagaggcugcaaucucggcacuuugggaggccaaggcaggcggcugggagguggagguuguagcgagccgagaucacgccacugcacuccagccugggcaacauugagcacugagugagcgagacuccaucugcaaucccggcaccucaggaggccgaggcuagcagaucacucgugguuaggagcuggagaccagcccggccaacacggcaaaaccccgucuccaccaaaaaaauccgaaaaccagucaggcguggaggcgugcgccugcaaucccaggcacucggcaggcugaagcaggagaaucaggcauggagguugcagugagccgagauggcagcacuacaguccggccucugcucggcaucagagggagacgguggagagagagggagagggagagggagacuguggggagggggagggggagggggagagggauugaaggaguuuucuuauaggaauaucauucaguacuuugaacuccugaguuagaugccauaagccacagacugaucuaucgucaaacauuaauuuuaaucaauuauuuuuaaagaucuacugccugacaaccugauuagguaugcuuucaauuuuggugaaagcaagcaauuggaaaccauguguuuugcagaaauauuuguugcuuagucauuaaaguccagucagacaccaauauguugaacuguuuuuguucaguacccacuaaagaaggugagagauaugcugcugcuuguuuuauuuuuuuuauaaguugggagaagaaauagagugguggaaaagaaacaucugucauggaggcaggucauuaugaggaaucuuuuccugccuaaaggugccuuagaaaggagcauguuugggaaaacaggaaguagguaaguucagaguaacugccagugccacagaugugcagaucaaauaucaugauuaguucagccaacuucucuccucuguccuagaccagcccaagccugggacacggggaaggcaccaaaaaacuccgguguugugagguauuuuauucaccucguaggggaguguuuuaguuagaccuuauuuauuuuaucuauuuugagguuaaaacugaugucgguauuaugaucccuccaaaacagagcuuccaaaaaauucuguuguuucauaacauuaguacuuuaaaaaaaaaaccaaaaagccuuucaguuuuguuuuauguuuuucauuuauuaugucuucuucaaguauaucauaguuuauugguauaaucuuuacccaacauuugcaauucauaugaucaaaaugccauaccuuuccuauuacagauuuaguuuuugacauuuucaugagaauuauugaaaugaaaggcauaaaguagguacacuagugccuaacucauaaguuauugguaaguaauaguagcuguuuaucuaguaguguuuuaugaauggcacaaagcaguauaucaucauuuucuuaaauuugugacuuggaaugaaauuuacuaaaauuuguauucaugaaagcagauguuaacauuuucacuuguggagaaauaaucaauaugaacauuuacagacccagaaaucggcagugacucagacgauaaauuagaucuuauaaugaaugguaaauugagugagucaacauggaaaaaaagaucauccaguagugggaauuauuaccauuuuuauuuugguacuuucagauauaaguacaguuuuuuuuuuaaauauggucacgauaauauuuucuuuuuagaaacauuuagauguugacuuacucaguuugucauuguugugagaauuucauauaagcauacuuaucgaauuaagcaguauauguuaauuaauaaccauaagcuugagcuuuaagcuaaguuggauaaaguuuacaaaaacaucacuaaaguaagugcauaauagcaaagguauuuuuauauuuuugaugauuaaaauacaaaacaaaauguuucccauauugaagagggaauauucaaaaucagaagcccuaguuuuuucugauagcuauuauuauccuacuucugcaacaaaaugaugauucugucauccucucugcucagacacagauuggaggaaaggagaugagagcaacaauuagauagauaacaagguucccuuugccugagagccaguauuuuuaagacacucagacauuucuuugaaucuuagauggguguuuuggagauuuauuuuaugugauuugauagcuauguuaaauuucaguuaaacuuuuauuugcagacuuaaauaugccgcuuaggauucucgccaucacuugucuuuuuccuaggugaccgugggccauuugcuauugucccucuugaucuaaugaguuguccuaaucacauuaggugccacugauaagauacuggacuuugcugggauaugagugagguucuuuuuugucguuuuucccaaguuguugccucucacuccuauaacugguugaguguggugagagugguguaugguuuaugaguauauuccuuggaaaaguauacuuugcauuucaaaauagcuagaauaaaaugaucuggagagguggagaggguugagcuaacucugagauucugcaauucaggguugaauuaggcggcuucagauaaauuguugaaggaucugagagaguuggugguacagaggaaguaaaagccugggauuuuccaaaggccgucauuaguuguugcucagagcuaugacuccaggguuuccauuugcauuuuuuggaguccuuacacccucauggauguuucuuuuaccucauauuucaggcauggcgugugucgggcuugcccuccaguuuuucuuuuaauaauaacaauaauaauaauuauuguuauuauuauuuuugcgauggagucccacucuguugccccaggcuggagugcaguggcgcgaucuuggcuugcugcaaccucugccuccuagguucaagugauucuccugccuuagccucugaaguagcugggauuacaggugcccaccaccacaccuggcuaauuuuugugggguuuuuuuuuaguaaagacaguguuucgcuauguugggcaggcuggucucaaauccugacuucacaugauccacccaccucggccucccaaaguacuggaauuacaggcaugagccaccgcaccggcaugcccuccaguuuuucucuccccacacgagggagcacgcuuuuugguuuccuuagacuggugcuaagcaacaguuaaaagggugaugccuuuuguuuucuguucucucucuccugauccacccagugggggaaggcucugagaagagcaacaucauuuugagaguggugcuaaaacccuguaagccugaguguucuguccucccaaagcugugauacggcucagccuccugacggugaccuacuugguuuuauuucuucuugcugucucagaaaauauucuaaagaugcuuaauauuauuuuacaaauacagguauaaauaauauauauguguacucuucugacuucacacauuacagauauaaaguaaaauuccucuggcaucugugucugucuccauccacucuucaggagaggaauucagauauaugugcaagcauacgugcaccacacggucuuacaacuguagaaaaguauaguauuguguuugugucgauuuucagcauaguuuaucaugcuauacaaaugcuacauuuagcuuuuuucuucugauguuucucugccaagagagacaguuaccucauucuucucauuugugacacagcauuccauaacauggguguaugugauuuuauuuauucauuucccuguugaagggcaucuaguaugucuucccauuuuuuuguuccuagugccaguaugcagugaacaugcuggugugugccuccugggcucaccauuauguacaucucagcuagguacaguggggaggaacugcugugcaauagaguaucugucuuuaauauuaaauauguauuacuuucuuggcuucuaaggugagugugccauuuuaaaagagaguuuuggguuguuuuaaagaguuuuuggggucuggaagccucuugugcuuuauuucacucaaauagcucuugcaggauaucagauuucaguucagugcccucugcccuuaaaaacaaaaacaaaaucuggaggucuucucucuacucgcuuacuacaaggccucucccagcccuuggucccagaguaacuugagccuucuccaauaguuggucugccagugagacaugaugauguaguaguuuaguccugguucugccagucuuguccuugggcgagugauuucuuccucagcuuagggucaggaagaaaggagucauuauauguaaagcuuguaguaaacauaugguacauaguaagcaucaauaacucuuggcuccugucauugcgacauagcugccacccuucacucagcauacguuuaccacccuucacucaguauacguuuauuguacaugucuacgugcugggaacaugaagauaaauaagacauggucucuagccuuagggaacuuauauucuaacaugcauguaacauauauguaaaaugaaaguucuuauucucucaucuuuccagcuacuuaaacuuuauccauagcccaguuuacuuuccucccaugucagcuaacuucugcaugauaaaggacaggcuuucauaucuuagcuauuucugucuaacagugauucaguacuuaccauguaccccaaauguuguuaagaacuggaaugcaaagaugguguguaagacagucuguaucugugagaagcuaacauucuguagggagauuaaaaaaaaaaaaaauccuagcuccgggugugagacuggaaucuacagcaucuauagaacacucugauguagugggaccuucugaaggacucuuuuuggccuuuuuauuaccacuuuucaccugugaacuggcucuguucuaccuugcguugccuaugcaaauaaggauaaacaaacuccauucucucuuccaagggggagagaauuagcagcaagagggcacauauuucucuuuguuaaaaccugggaauggcaucacuccuuucuuucccuagugacuaaucuuguaaaguguuaaagagaagucuaagucccccagagggacuuagaaagcccuggccauucaugcccagguggagccacuuuaguaaaaaaaauagcauuuuugcugccaugugaugcacagguaaaacagaccacuggauacugcugguuugcauuccugcuuccugggaaguucucccuuccauuucaugagccucuuugggaaagguacaaacuuagggaauuacugacacagaauaggaacaauuggcaauccuuucacucuuucacauauacugaucuuuaaaaaaauaauaaauuaucauugagaacucagggauaccuccuugcuuuuaugaccauuacagguuuuguuuggcuuguucauaauaagcauauuaaguuuaaucuuauuuuaaaagucuguccugauacaaacuuuaaauugauaucuugcugaauugugaauggacauaaaggcuccuuuuaaagagcuuuaaguguuuguugccacaacagggucugaguauaauacugagguugagaaagaugauuuucucaacagaaauacuuuauuauugcuagagguagugugaaauuaucauuuuuuccuugaagcauguucuuuuauaaaugcuuucuggagauacaugaauuaaaauuaaugauguucucuuuuguuaaggcuuuauuucauuucauguauucuguugaucuuugagacaauaucuaaucuagagagaagaaaacauaaaauaguacuaaaaacccaaugaauucuuuuagugaauuagaguuuacuucuugucaucagcuaagcucccuaguauuacgugaauacuaucaugcuuggugcuacauuuuguguuuuggauguuuuugguucauuuguagaugcuuaucuuuuguuauuaaaauuccauauacauuucauuuuggcuuuacaaaacuauuuugguuaauguaagcauacugaaaagaggguuugcauuuagagugaugcauuucguaggucagagaagauacuguuauuuaucaucagcuauaugugugauuucuuuuucaacuucccaauagugguggagauauuugggucaucuaucuuugcagguccuuguaauaauugucaucaggaaauguacauguguagguaacuggcagggguuagugguucagacuauggccauuaaaaaaaaaaaaaggcauuagcugggugcaguggcacaugccuguagucccagcuacucaggaggcugaagugggaagauugcuugagcccaggaguucgaggccagccugaacaacauagugaggcccugucucucucuuuuuuuuuuuuuuuuuuuuaaauaacauuccgcauuuccucacccauggagaugguacucauaauaguuuuaugaauguaggaagaaacugaaguuagcuccauucaaguuggaagagcaguauauaccggaaagaaauucagugagcauucugaaaauucugauccuagaggcuucagcccauuuaaguguuaauuuaucacuagauuguuauuuuuauuuuagaauuuccauuguacuuuucagauaaaucuauggugccuacacuaacagcauuuacauucuuuuuuuuuuuuuuuaacagaaaugucuuagccucuggaaggccauuuuauucacuaacacaugcuaggaggcuucagcaauauccugcuccauucuagaaaacagcaauuugauccuuuuuuccuccucagucauuaacaagauuaugcauuugcggugagaugauccuucuugaacaaguagccagaaaucauuuguuccaguuucuucucaaggugcugaauuaagucucgucucauaaaucuuguggcuuccuugaugauggauucaaaaaaucauuucuugacuucuauagguccuugcaguccuucaagcaauuugaagaguuuuucauauuuucgucuaaaguguugaauuuccuucacuaauugacauuuuauaucagcauuaauuucuucuugacauuuuggaaaagggaguauuucugugacuuuuaggucaucuccagagaaauugcugguaaugauuccuccuacaggugcauuucuaccagguuucugcaucagcccaucuuugcugcaaccacugaagucaucaaaccgagaauccaauuggcuugguggaauaccaucuccugccauaagcuucuuuuccuuggacauggcagagccuccaauaaggcugucuccugcucuuuguuuccuuaacaacagggccaucuucugccuuuucugagaugaaggagucucagauucccugggacguuuaaacacauuuucagguucuacagcaaccuucucugcuuuaucagucauuguuuccagaaggaccgauccaguauggcccaagggggauggaagggaaacugccugcuauggcgugcccugccccagccaaauacugggaacacugggaaccuguguggugcgccggaguccugaggagaagccuuguguucaguaggaucacgggugccagccccgacaaucauggggccugcauuuacacucuuucccacaaaccucacagaguuaaacuuccuuucuuuaacucuuugcugucaccuucugcuaagcucuggggauucuacuuguguccuaggaaaaagucuuccuuacuccuuuccuaccuuaugcauuuuuccuuuuuuccuuucugaaccucagaaagcgucagcuuuauugaauagaaugaugucacucuuucuucuuaugaccacuuuccuaauugcucucuuuagaagguccuguaauaucucucucgcaccguuuuuaaaaaaaauuuccauagguuauugggguacaggugguauuugguuacauuaguaaguucuuuagaggugauuugugaaauuuuggugcacccaucaccugagcaguauacacugcacucuauuuguagucuuuuaucccucgccccccuccaacccuuccucccaaguccccaaaguccauucuaucauucuuaugccuuugcauccucauagcuuagcucccacauaucagugagaacauacaguguuugguuuuccauuccugaguuacuucacuuagaauaauagucuccagucucauggaggucgcugcaaaugccauuaauucauuccuuuuuaucucauacacccuugaucuguauuaaguguguuggauuuccucuucucuaucuaugaaauugacccaaggccucacugaggaccugaagauacaauuaaaguagaaugacagaaacuaguaaacacuugaggcuuauccaaaugaauguuugauauguuagggacuuuuuaaagcuguccucuguuuuacauaacaaaggacaaaauggaucauuucauaacaaggaguccuaagagauaacuaaacucaacuaaaauugauuuaacuucuggagagcuuuccagauuauaguccacaaauacuaauauguuaauauuacuuucagccauaaaccaucucauuagaucuccugucucuuuuccuagcaauaauacacugucacuugaaccagcagaauguaaacuuuacuggcucauaauuucuggucuauaaggagagaauggugaaaaagugggcuagaauggcucuuuggggaaugguggugcagaugagaaguggacuggccuguagcugggcagcccuuuuuucauuucauguccuguuucuccucuagaacucagagaaucauuuacauguuauacaucaucuacauuuuucucaucccagcugcuucauucuuuagaugaauaauaugcuccccugaauaagugcuaucuaccuucugauaguuuuuaaaaagaaaaguuaaauugucauagcauuuauuauaugagagauguuaagacaagaaguagaaaacaagaaaauguaacuuuggaaagaguucuguauaguauauuucaaaaaggugaggcaaguaauuucuuucuauuaauccauauauauuuuuuuaaauuuaggaauagaaggacagucuguggaaguuuccaauauuguggacauccgaaaaguauauaaccgugagauugcaaugaaaauuucuucugauauaaaaagccaaaauagauuuuauacugaccuaaauggguaccagguaauuuuuccuuuaaaauguuuaaguaaugguuguauugguguguaauucuuauauauaacaauggcccaguuaauuuuggauccuuugaaaaaguauacuuaaaguugcaaauuauaucuaaaauaaaacugaauuuugacagaaaauuucggguucuacaguuagaagaaauauuugggagaccauuuuuuuagaacaucuuuuuguaaggauuuauuuguucaaaggguaaauuuggugaccacuaugaauguuaaauaucuugaugcuaaaaaauauauauaugaauuuaucuaccagaaaggaaacauaauuagggauugauggauuauacuuauuggguuuuuuuuuuuuuuuuugagaaagagucucgcucuguugcccaggcuggagugcaguggcaugaucucagcucacugcagccucuuacucccagguucaagcgacucuccugccucagccucccaaguagcuggcacuacaggcgcacaccacuacacccagcuaauuuuuguauuuuuagcagagacacgguuucaccauguuggccaggcuggucucgaacucuuggacucaagugaucugcccaccucgcccuuucaaagugcugggauugugggcaugagccacugugcccggucuguuuuuguauuagcccacucucacacugcuauagcgaaauacccaagacuggguaauuuauaaaggaaagagguuuaauugacucacaguucuguaugacuggagggguagccucaggaaacuuacaaucguagaggaaggggaagcagacaagucuuacauggcugcaggcaagagagagaaaagcccaggggaacugccauuuauaaaaccaucagaucuugugagaucucccucacugucaaaagaacaccauggggggaaccacccccaugaucuagucucugcccaccaggucucucucucaacaccuggggauuacaauucaagaugagauuuggguggggauacaaagucuauauuaguuguccucauaaggaauugauccauaccuauuaaguuuguucccuauauauugguuuaauguaugaucuaauaaugggcccuuguaaauuucaggaaaacucuuccucuauauguguguguguguauaccauuauacauacacagacacacauguauacauauacauagguauaucuauucagaaaugggcagguauauauuuaaucaaaauuuucaugaaauguuucaaauuguaguaaggaaauugauuuauacaaucuuaucagguugucaauucuccaauuuaauagagcacuuuugauuguuaccuaaaucucuguuuucugaguguauguguuugauaacauaucuuugaaauaccauuaaaaccaugagcauguuuuuaaaacaaguguuuuagaaauuucuggcugugaauagaaauaauuuuacaauaaacacuuugauuuucaacugggggugggugaaaaagauuuuaauaauuuucucuucuaugauuuccugcaaaaguuaaauuuaaacuuuuuccaaaacauaaaaauugcagcauacauucugaauuagcauguuaauucgacuacagccauuuggauuccagauaaaaucucaacuucauggugauucauuuuuuuauguacaaaagaaaguauuuucuuaaaauuauacaaaaccaguuauuuguauuuuuggguguagacaugaaugagaaacuuaguaaaaccgaauaacuaaaaaugugaauuuucuuuuugaggauggaacguuugacuaaaaaagaaaauauuacuuuuaagucuguaauauuucugcuuuuaaaauugaccauuuuuuaagcuuuggauauaguaguacuugggcaaaacuagguaucuagcuccaccaguggggaaucgggguagcaacaacacgauugugguaguuuuacauuuuuuaaaauaaguuuacauuuacaaguuaauuggguuuggaaaggagaaauagagaauucuuuuaagguagcuuuacuuuuuuuuuuuucuuuaaacauuuuacaguuguagcuuuaucaguuuauuaauuucccaaggcugccauacaaauggaaucacguaaaacaacaaaacuuuauucuuucacaguucuggagacuagauuucuaacaucaggguguuggcagggccauauucccuccaaaagcuauagggaaauaaccuuccuugcccuuucccagcuucuagugguugccuaugcuuggcauuccuugguuuguguaugcaucacucccaucucuaccucuuuugucauacagcguucucccuaugccucuuguaucugucugucuguguccaaauuucucucuucuuguaaagaugccagucauuagguuaggucccaacauaauccagaaugaccucaucuauuucugcagaggcuguauuucaaaauaagaucacauucauggguuguggguggacaggaauuugagagagggaggcauuauucaaccuaguacaaccaguaauuugagggagacauugcaggguugcugggaagauuaaagaucacauuugugaaauacuccggaccaugccuuucguuaaugggcacuuaauacauguuaacuauuacgguaacuuuguaccucuucuuuucuucacuuuuauauccaacuuucaugaguuuaaaugaggagaugacauuuuuaugugguaucauuaagauucacugauaauaggguucugagcuuagagucagucacugugacccagaugggcuuugggguuaccgacagucuuucucaaaaaguagagucauauuucaaacauucagguacuaggcugcaaggaauuggaauuuggaacuaucuacauugaaacuaaucaaaaagaguaagcacugaaugguuuuuaaauauaaauaugcauuugauuuuaacauaauaucuuagaagauuuggugcagagaccugugguauuuauuaaaaccaauucaagaauaauaagagauauuucuugaaaggggauagagagguauuauacuuagcauucauuacaaaagcaguuuguuagauuuagaugagaaaugaauacuuaauaccuuuauaauuuguuuuaugcaaauauuggagagcuagaagacuuuuaagcauuuuuauucugaauuuaaauaggaaugccuauuuuaaaaaucuggacaaguucuaccuuucccaccuaaaaguuguuuucuaauauccuugugguuuuucuucauauuguuuuaaauaauguuuuaauuuuuaaauuauuucuuccacugaauaaaaaggaagcuuugucuuuuucucuugggaagaaaaaucaccuguccucaaguuuuuaaaagaacauauguaaauaucacuuuuuguagauggaauuguuguguuuuauagauucaaccuagaaugacacugagcaaauugccucuucaagcaaaugucuaucccaugaccacaauggccuauauccaggaugccaaacaucguuugacacugcucucugcucagucauuagggguuucgaguuugaauagugguauguauugcuuacacucuuuuccacucugaaagguuucaauuccaacuguauacuuuuucuguuggucagaugugguauaaucucuaguuaaaaccucccugucuucuuuucagcuuuuuucuuucaacaaccagacuauuaguuaaguuuggguuuugugagaacaacauaaaaagaugaaucuccuaaaucuucagaugaagaacaggagaccuaaaauuccaugucaagauuucuuuuuaaagauaauuugcuucuccuaauaguauguauuuugcagaggucuccaucaucauuaugauuuaacggauguggaaacucagauucagagguuuagauaaguugccuacguuugcaaaguugggaaguugugguucaaacuuagguccuuuucugaaucauggucuuucuauucugcuaccaccugaaagaaggaagggaguagaaaugauagagauauggggauaaagagguguggcuuugaggauuccaaaagagagaaagugaugcgcagaaagugagagaaaauagucaauagacacugauuaauuuuugcaagucuuucuauugagaggcuuugauccuuuauaauacauauuuuuaauugguuaucauacaugguaucauuggucuucuuacauucuaagaguugguagagauacauaucugaaggagccagauaauaacugagugcagauuccugguguguccuuugacacaagcccacuuuuuacaugaggcguauacaugcauucuguaucuuacacacacacacaaaaacugcuacuucucauuuuucuuuguggccuucauuagauaagaucauauaaacucaugccauaaagacaugaauucgauuuugaaaguaguaaugguuccacaucagggauccaguagggaggguuagagacuugagcaaacugaagagcauguucccgaugugcaguggggcagcauuguugcugugugguuaggggcccaguguugcuaaauucaauuuuuuuuugaagaagaguccagaagucuggaauuuuacgugaaguuguucaaucuguaaaauauugauacaauuuuuuaaaaaacacuauguugagaaaacauaaaacaucuuugugccguacaugacucuugagccacucauuuuuaaacacugccuuaaauucucaaagcugugcccuaaauagaggacuagacaguaagacucaagccgugguuaacaaagcagcauuaucucacuuccuggaaaugugauguacauuuccuaauaaaccucauaagcauuuuugauuccaaauggugcuacuaaaaguuucggagaacuuaauuuacucuuuagguuaauguuuuggaaaaaaaguuucauuuaaauuuugaucuguccugucucacuuuuaaauuucuuaucagauauugugaaacauuacuaaagaaacacagaaauacuauccuguuuuaugaauuuguaguagcuacuuugagcuacuaucaagagaaagcccaugguguaguggguuguauaaauccaccuccuugacuagagaggaaauuuagagcaauacaucaugacugcuacuuaagugaugcucaaugaaugucaguauuaaauuauucuggucaguuuugcuuguuuguuuguuuguguguuaggucagauugaaguuaucauggaucgaagacucaugcaagaugauaaucguggccuugagcaagguauccaggauaacaagauuacagcuaaucuauuucgaauacuacuagaaaaaagaagugcuguuaauacgguaugaaaaaauaacuagcaugaucugauauugauuguucuuugucacccaaaacuugaaauuaugacuuuccacuuuuaaaauuuuaaaaaucauuuccaauauugagauuucuuuauaguagauguggcccacauucacagaaagagaacuucaguuauaaauaucguguaagauuugcacuuaggucuuuuuauuuuuuauguuugcuuauuauguagauaaaaaauaaugacaggaaaucacuuuggguaaauauuccugaaauuauuuugaaagacauaagaauugaaaaauugagcuaaauaaaaguuaaagaauagaacuuagucauauacuuaggagauuaaauuugguaaacuuuauuugaaaucuuaguaaaauuuauuugaaaucuuaguguacuuauucuagucuuagacucuucaguugaaaauguauuuauauguagguuuucuaugagguuuacuccucaaagcaaaaaucuaguacucuguguugaauggucuggcaaaagcccagcuggaccugaaugaccugacgauaugcuuguucaggcaaaguuaucuucagaguucuccguaaguuauugauccacccaccuuggauagcccugagcaugggcuuuuucuuuuugcucuauucuccuuucugcaccugaccauugcaaguccuuucugcucuuuucagccagugaucguaccuuucacuuuauagagagaacagccauuagacagggcucucuguuccaguuaucuaacaucuacucccacccuucccaucucuccuccuguuacauuuaaaagacacuuuacaguccaucauccuaggcaggucccaccacuuguccuuggaacuuacucucuucacccaccucagcauccuuuuacuguucauucucucccucucucuuucucccuugcuccucauauccaacacuuccugggagauucuuucuguuagcuuuugaacacucuguuuucuucuauuaaaaguagaaauggaauacagccuuccuucagacucuuauuuccauuuccuguaagcugcuauccucuucucuccuacccaauugagucagaguuuaugagaugaguuuauuucaucacuuccuucucacaauccauuuguuucagucuggcuuuagccuccaucauauucugaaagagcucuuuccgaugucaguagauccagugcauauugacuuucgucaucuuacuucaccuuucagcaguauuuggcacuggccauugucacucucuaaaauacugccuugccagggcuucuauggagcuaugcaguuugguuuuccuccuaccugucuggcaguucuuuaucucucuaauaguucucuacucagccauuaaaucuuagagcucucaaagcauguccccuggccuucuccuuuucuuauuuuuuaugcuaucccuuggcaaucucuucuacuccucugguuuuguuugcaucuuccacacagguagaagccacuaauacauaucuccaacuuaggcuugugucugaccuccugauuuaucuaucuaauugcuuccugauauucucuguuuagaaggacaccucaaguuugacauauccaaaacacucauaaucucucuucucucccaaaccuggcccauuuucaguguuccccccagucaacagccaccgccauccauacaacuccaagacagacaugaguucugccugauagacacuucuccccaucagccuuuucucacagaguaauugccaucaccuaucuaucucauugccugaauauuucaaauuuauaaucuucuuuacuuccaccacccuaaucuaaagugacuuccuguauuuccugggucuagccuauacacauccacccuguucucuuucugccguaugucuguucuuaacccagaaggcagaaugguuuuuuuuuuuguuuuuuuucaaagccacaucuaacuuuauugcuuccuguugaacccucugauaucuucucauugcuaucaguauaaaagucaaaauuucuuaccacggccuccagagccccucaugauaugggcccugcauguccccuaggcauuggcauuggcaugccuuuuacugugucugcuuuaggcccacugguuuccuuuaagucccaaguacuuuccauccccuccuccccaccgcacuuuugcacauggccuguuauccucugccuuagagacucuuggugauaguuccgguuagugcuuacuucaucagcugcuucuggaccagguuaaaagcccuuccccuaugcugccuccaaacugugcaucucaccuuccugcaagugugcgauuauuugauccugucuucuccccuccuuuggaccauaaacuccaugagaguggggaaugugccuuucuuugcuucuaggauuguuccuggcagaggacaugccuaauauaugucauaugaaugaauaucgaaaugcauagaugaaugagcuguuagaguacauuuugccacuguauuuauugcaauuucugccuauuaccuugucuucauaugcauguugcauuccuccuacuagauuccagggacuuguugccuucauuuucauuuguccuuauauuugguagacauucuuuaaacaaaauacuaguugauugaaugaaauagcaacagcuaauuaaagcaaaaauucuuccaguauuuagaauauuuuagaaaaaagaauuaguauccacuuuagaugucaagagccauaccauucuugagacucauauuuuaaaucaaucacugacaagauagcuuaguuuuaaggacuaaaucugcauaggaaaaucauugucugagugcugacagcuacugucuuuugcuccuccugaaaaaguuucucgcuuauaugacuuuauauugacacuaaucuauaaaacuucuguuaacugcaauaauaaaaauuuucacaucaaaucuauaaagcuuugacuuagaagugaaauaauuuguuuauucccauucagaacuccuuggauaguaauugauuuaaauuuaauuuaauguuuuuauguugauuaaauuuuucuuuuacucaaguauagauucugggucuucaauuaaugguuucuuuuaaauaagaaaugaacuagagaagagaaaauacauuuuaaugucuagugaaaauaauuaaaaagacacuuaauugaugaaaguuaauaccauguaacuugaauuuucuagaaagaguucuuaauuucaacucagacucaaauaucuaaaauaaugauggagggaagugaaguagggggauacucccugaauaggaagagauuuuaaugggaagcccugagcaugacagagccucauggaaauaaucccgagcugacuaaguggaaguaaguccuguccucagagaauucugcagagagucaguaaaaacaaggacuuggaugauauccacuguguaauaugugcagguguccagugaggacuguggcugcacgagguugaccaucauuuaugcuaaucauccucaaagccaauagaaauggaaaauaggauucaucucuuuggcauugccaggguuugaaugugucccccaaaaguucauguguugaaaacuuggcuaccauugugguaauguugggagugggaccuuugggaggcuuuugggucaugggggaucugccucaugaaugaauuaaugccauuaucaucggaauggguuaguuauugcaggaguggcuuuguuauaaaaaugagcucucuugcacucucuugccuuuucaccaugugauaaugcagcaagaaggcccucaccagaugccagugccaugcucuuggaauucccagccuccagaacugugagcugaauaaacuucuuuuauagauaaauuauccagucugugguauucuguuauggcagcagaaaauggacuaaaaacaggcauugacggcuuuaggauuuguuucuuugacgguuuauccuuaccccuuuccugcuacugguugguuaaugaggcacugagcuaggaacccuguaaguguucaaguguuaaaauuguguuguuguaccuuuaaauauaaggagaagaaauugggagagaucagauuaaaauauuaaauacuuauaugguuuagaaaagugacagcauaagggagaucaaccagguuuaaggguaaauacuuaggugaccagaagaucuacaguaaacuugaggacauaucccaccaagacccacaacucagcuccagcugauuguuuccacaauaggacugaaugccugcccagggugacacagauuuccaguuucuuggguaaaaaacaaaaaauguguuuuggguuuuuugagguugcuuuuuuauuaugaauuuuuuauuaaagaguuggcuuaaaaacaaaaaaaaaaaaacauuuuaauaccauacagaccuaccaaaaugugugaucuacaaaucugccccacagucuucagcuacagauacuuaccuccaaauguuaugauucaauguauuauucuucauuuucucuccuccuuccucuuugucuuuuuuacuccacccuuccucucuaguguucuucuuucauuuauuuauauugcauuugcuuauuaaauuaauagauuuacuucaacagacauuuauuaaguucccaccauguuucaagucaaacugaauaaacaaggguaacuuaaaaaauggucucuuacuaucucaccaugauuuaacaggaucguuuaacucaaagugagcuuaauaaagggcaccaagaagucuggcaagaaguucugacucauggacuaagggcuggaacccagugaggaagagcuguacuuugugugguuuggaucagaaggugcuagaaacuuucuuuaaugucagacaggcugcagagagaaagcuacacuuauacagucugaaaccuuccaaccaacaagaaauuaaauaagguuuauaguacuagauuaguuaaguacaaggcugggguauucauuuauaacuuaaacacauaaaauuuccuguagaaaacauguuuuuaaaacuuuggguuuaucauaugauuuacaguggaaagguuaccuuuguagagauuaauuuaaauauugaugguucaacaguuaauaucuuguugagccucuuguugcuguaaauaugauaagaaaguacaugaauggcagaacucugggugagacuuugccacuccaaccuggccagccuccagcaguguuauuuuuucauggugcucuuaggguagugaaccacaacucuucuauaaacuuccuuaucuuucuaaggacaguaaacuacacaguuuuuaaauucuugaaguccuuaauauccaugacauuguuuccuuuuagaagacucccaucaaaaugucuuugaaacugaaucuuguuuuucuaaugcaaagguaguuaaaagguaaaguuuaucuuuugauucuaaagggagcucuguuuucucuauaagauuggaugucugggguggcacuucccggcacagggucauggagcagugugcggcuaacuccaugaaauucaccuggggaggcuuuucagcuuugcauuuucaggaccccaccucucaagauuguguagauuugggauaggacccaagaaucuauguugauuagaggugccccaacucauucuguugugugguuaauuuggggaaacaccaacgguuaggaagaacuaauuugguuuggaggauugguauauaugcacguuauugcuucuggaguauagaagauuaaucaggaaguguucuggcuacucacuggaguggugaggaauuacuccaagaguguggaacaaagccagagcuuucucugaauguuucuugaccuagaguggacuuaauacuucccagauuugaugagggagguguuuucuuuucuguuugaaucuuuuauguuuuauuacucgugagugacuuugucagcaauccuaacuuagauuaugaaguccuuugaucuuggaguacauuuaaaauaucuuguugaaauuguucccucucuauucauguuauucuacgagcugcauuaaauuucaguguuguuggagaauauuauuuuauaugcuuuauuuaaucuuucuuuuaauacaauucauucagacccgauuuuuuaucaguaucuuaauauugcagugucccucugcugucuuaaaauuuuuuuuuucucucuccauagucugaaauguaaugacaucuaauguuagcuucuggcacgaugcuagucacuuuuugcuagcacccuucugugcaaugcuaaucugacauucugaauuuuaagcuguauaucucuauaaauccugucuuuucacacagaucaguagccaagccuuuuaucugagccuuauauuacaaaaaggaugcaaaaucagaagaugucaauggaguaaucauuuuaagaaauaagauacaaaauuaaauuugguucaaauguaacuggugaucaaaggaccuuucugcauaaauuauuuucuaaguuauuugugucuguuuuuacuccuuagguuaagauucuacucagucauugauuuaauuuugcaugucaucuagcauauuuaaucuaccaacauuaguagauuauuuaauguuugaacauacagaaguguugcuuuuaaccauauaccauagcaaaaacuaaagcauuuuaaauuauauggaauaaucauauacuauguaagugugugauaacuauucaguaacauauuuaacacuucuacuuuuggaauaaaaauagugaaacaauuggcaaugauuuaccaaguugaaagaaaacaaucagaugaucuaggcaugccgccuauguuauuuauauuuaaaaauuggauuuauuuugagaguuuuguuuucuuuaaauucugucauuggguaacauuuaguuccuaucauuugguaacauggauggacuuuagcuuugaaucaguauaugccuuuauggucuuguuaagggguauaaaugaaacuacaagaauaugguggaugaaaccugagaagggagauaauauuugaugaugcacaacauauaaucuauguacagcccaauccuuguacuuugagaguuuugugauagguugagaauuuucauaaaaagguaugccuuguccugaaauguuuguaggaaauguuuucaguauuuuuaguauuaaaucaauggaagauauauuuuaaacauaugaguuagaugugugcuguuuauuuucuuuuauugcuuacaacuaaacuugguaguuuauggaguauuuucuaagacuguuauuuauaaaauguaaugaaaccaaauuauucauauauuuuuauauuaaacccucucagauaauucuguuaauaugaugagaacuggaaauauagaccucuuaaacauuuuuguuuuuucuugauaggaagaagaaaagaagucggucaguuauccuucucuccuuagccacauaacuucuucucucaugaaucauccagucauuccaauggcaaauaaguucuccucaccuacccuugagcugcaaggugaauucucuccauuacagucaucuuugccuugugacauucaucugguuaauuugagaacaauacagucaaagguaugucucaaaauauaucuuauaaaaaauuacuguuuauuauguacuuguuuuaaggggguaaggaaaggagaaaaaaauaauguaugcuuuacuaugcuuugaggaauuauuaacagggcuucaccuuuagccaaaagcuucaugccuuucauuugacuauugcuguauauuuuagaguauauccugauacuaauuuacucuuaaguucuguauggcgagcaggucaggaaauaccauuaguaggugggcaaucugggccuuaaguuuagcacuagugacuuuucccauucauuucuccuuguuagacaauaucucucagaagcuagagaaauaguacuuaguuauuucuauaucagaggcuuuguauuuucguaccuuucucuugagaaucacugcaacucaguuucccauuagaaaaccaacuguuuagaagaaauauuagaggaaaagcauggggaaguuuuauuagguaugaaauuuaauuuaguuagacugcaguuauauacauaccuguuuuuaacaucaaaaagauugcauuuggaaagaauaagaauuagacauuugacauuguucuuauguguugcaaagcuguuuugauauugcaaauugacauagauuuagcuggaaauaguaagugguuauggauucuguggaaaauaucucaugguaaauggccuaaguaugaaaagaagaggaugcucauguuuaaagacaauauaagaggugagaaauguuuaauguagaacaaagaacuaaagcaauaaaguaaggauaaaugccuauaauuuggauauuagagauuuacaacuuuaugucuaagauauaggagaaaaaauauaauuuuuuuuucuuuauagauuuuuaguugagacaauuuugaaagcaaaggucagauaaacaggggaaaaauagcaauaguauauuguacaugcuauaccugucacuugggagaggccuaaguucaaaaguauuuuuuucccaaggcagugguuuuggcaccuugccuaaauaauguuuuaacaaagagccauaaauccucuagagacaagacaaagaagaaagcaccuucaggcuuccaaaagguaggaaaaugugggaggauaaauuuaugggaagagugaagucugcuccuagaugcucuggcacugcugucucuuagcuaauuagcaagccuuguaaaggggccugucuuuagacuagaaaaggcagagaggaagggaugaagaccucuuguauuuguaaauugcuguccugccaucaagcaggcagaagaagggacagaauggcccccugguuuuuuuccuucuucagcucaauaauccucaguuuuuugagagagaaguauuuugguuuccuucagagauaaggaacuuaugcuuggcuaugcaggcaaacauauaugacuuauaauaaugacuacaagcaaaugcucgaggcgugugugcguguguguguauugaaaggcuuuuuaaaaucauuaucagugaacuugcaggauuuauuuccuacccacuacaugucaguuacugccauaaaacacacaaaugccccugcccuucuagagcuuagauucuaaugggaggagaaaaacaagaaaaaguaagagaaauauguaauauguuagaugguguuaaguguuaugaaggaguaaaaagggaacagccauucaaaggagguaacacaauuuugauuaagguguguagagagggccucacagaggugauaauggaguaaaaaucugaagaaggucagagaauaagagacuccugcagauuucuggggguagagugcuccaggaaaagagcaagugugaaggcccugaggccggagagauauguggccagaacagaagcuccaugagagcuaugcuuguccuuuauucauggcuauauccccgugaagaagagugucugcacauaggaucucaaaaacuauuuugaaucagugaauuguguagauguuuuuucuaggauucugcugugguuuuuuguaggucuacauuuuggcuccccgaggugucgugucauaaauucaugagcuaaaagaaacagaaagaauagaguggagggcaucaaauacucugggcuugagguuaccaccacccagcauagaugguagaggacaucagcgaccugaagaacccagaggcuucuggggaggaugggcggucaccaucccuuagccucacuucuagguggcuccuccacuguaguuguuuuaaaugugauuguuuucuggaagcagcuggagcugacuagagucagugagcauaggguuuuaccuucuguaaacgaagccuggaacuuguuuuuuaugucaccuuuuuuugugguuacucacuucuucacauccuuccugcuuuugacuauuuucuuguaauacaaaucuaaucacuucucagaugaaaaaucccguugccuacugaauugguucagacacugagcauucagguccucugcagccuggccucuacuuacugcagccaccuggcuucccguugcucuucgugccuuuggacaggugggccacccucccuaccugugggcugagugacugcugacucagcuaccauuuauaacaugaggcuaaugucacguauugcugugucaggucuuuugcuaaaaacagacgaaauccuauugugaaagccuuuugagaacaaaggcacucuguaaacauaccuuguuauccuaaugacacuuacuccaacuugguugcagauuaggguuuuagcagagggaauagagagcaacuuaacaacauaaagauuugaccaagaagauuaaaaacugaaauguuaauaaugccuauugauaacuaccaugcuggcucauaaucagaacuaaauacuuggcaguuuugcauuaucauaucaguuggugccaguuccuguguuagccuuugacucuuagcacauauuuauaacaguuguuuaaaagcccacuaguaauccaaaggaaggacugguccauucaaaaccacuucuuuaaagaauucccuaaccugauaauagaaggauaaucauugaagggaacuguuguggguauugauucaaagaaagcuguacuuacaaaauguccaguguaauuccaugcuuauacuaaaaaaaaagaccaaaaugacucaaugaauaaguacagaagccagaccuaagcauuuugguuuggguuccuguuucugugugcuggaagcuuccaaugugcaauaaugggcuguucauuuggagaaugcaacucauuuuuccccuugaaauaaugucaaaauagacauagguuccaagcaagaccugaagucugcauuggccuguauuuaaguaagcauauuccuaaccaccacaguauuucaugagaaaugugucugaaggccaccuuagcaugauaaggacgcaugucuuccugccugaccaacuccuucagcaccaugauagagagugcccuugcuuggcccucugggccgcugucuaaagguuucucaauucuaaaccucaguugguuuucuugacuccugggauaagggguuauagauucgaagaacagugagggaggcgaguugcaggcugcagguaugacaacccacugaggugguucagcaguuccagcuacuaguccucaaauucacugugcccggaucacacaggggagauuuuaaacauagagacuuuuacagauuuccagaucucugagauucugauucuauagggcuggggaggagagccuaggaauuuguaauuuuuaaaaauguuucucaugaaauugcugaguuaucuccauuuccuaaauuaggaaagugagaguuagagcuaaguuaaaugauaaaaauaaaaucacccagugguaaauggcagaaucaggcguucugaaucucagugcuguguguggccucagaggguagcauuugacuuuuuuagaauuacuaaauuuguuucuaaaaguccaagcuuucagggauugcucuauauuaguagaugaguuuacauuuuauauagacauaucuugcuuuuagacagacauaucuugcuuuucugcuuuauaucaauuuuuggaaaaugauuauaugccguauauuuguauucagaugaaaaggggaacaaacaucucuggaagcccugccucacagcaugcugcguggccuugcccauuccagccacuaucuacaaacuuacccauuagcuuuccuauucuguuggccugucuuucaacucuuuuccuugaucacaccuuuccccuacacuaugaagaucuugagauacuaaaaagaagcuucuguaaagguuugaaaccuagggaacaugaacaccacugaaauacacuacaugcaaaagccuugucaucaggaaaggaccauuauuuaagaagaagggagauuggguagagaagaugcagggaggaucucaugggaggacagaugaugagucaggcuucugaagcuggagcugcugguucagccuggaauagagggacaaagaggaagcuggauaagcucagcuucauggagccauucuacuuggaauacuuuagaaaugugauauguaguucagcuuuuuuuuuuuuuuuuagauuauuuccacagcuuuuauauuuagacauauuuauuuuauauaaacaugauauauauauauaucuuaacucuuucucuauguaauuuauuuugauuuguguuuaacuguuucuugcaaauaguuaaccaucauuucaauaucagcaccacuuacugaauaagauuuucucucuccacuuguucauucugccucuucuuuucuuauaaaaggcaguuugaggauuuuacuuuauuugucuuucuuauaagaauugauuggugcuuuauugaucucccuagcuucuggaaaggugaaaauugugagaaaaaaaaauuccuuuguuguacguaucucagaacagccauuuaccuucccuuucuuucugucauuuuaucuuguugaucaaaacaggauagcuauuauuggacauuuuaaugagcacccuaaaaaaugaauuucuacugguuauaauaccaucuuaggacuuauaaugaagcauguaauuuucuaaccuuuccagcugccagaaugcacuagggaugaguguuagguauuuucaaagaaucugaguggguuggagaaauuuucccaccagauguguagccgugccuuaaucuaugugcaccuuacuaaccgugugaagaggguggggucccaugcauccuggagaauuuggccaaaguuauggccccucucuuccccacaaacggugguugcacacauaauguuuacuacaguuuccaaaaguuuacuguuucuuuuggugcgagagaggaaugacauaacucacaucuuaagaucuucaguagaggacuauucaccugcuuuuuuccuuaaaagagacugucauguguguauaauuuucagaauggcucaaauccuauuugaaguggggugaauggauagguggauaggugguagauggaaggaaauuacaauuuccaaagcuugguuucugaauugauauauuuuuugauaaguuauaguuuuaucucugcuggaaccaucagucaauacucuccuuuuucagccauaaauuggagggguuaccuccuuuaguuuacaguauuuuguuauuuuacaucaaaaauauuuuuuaucuuuucucuccuggcuagguaucuaugagcacaaauucauagcuagugcaaagguaggagaaggaagcuguuaaaagcuuaaacuuuggagucagauguccuggguaugagcaugucuccuuugcuuucuaaccaugagacuuagagcaagucacuuaacucucugagugucaggcuacuccuuaguaacauggagaugguaauaauacucaccuuagagauguucugaggauuggagauaauuuuaguguuaguaaagcacuuagaacagcauguggcacauaguaagcccuaugagugcuugacaaguaaagguucucaccugugauaguucagucaugaacaacggcaguugucacuaauaaugagguaaaaacauugccagaguaaaucuugaugucacuuugacuuauuccugauauuuuagguugguacaaaaguaauugcaguuuuugcuauuaaaaguaauggcaaagcuacaauuacuuuugcaccaacuuaauacuuuguuaauaauuccucagauauuuaaaaauaacauaucuaaaauugucuguuugccaggcauugugccaagugcuuuacaugaacuuuauuuaaagcucucacaacaacccuaagaagguaggcaauauuuucaucccaucuuacagaauaggaaaguaacugaccuagagauaugauagauaacugucaagggcacacagccaguaaugugguccugggagcacgcucaggugugucugaguccagauggcuucucagaaccuuauacugucuugcaugggaacaagaagggagagggagcacugaaaaugugagggaauacacugucuauuuuucuugugucuucaguaauaauaggacaccuacagaggauaucccauccauuggcgggagaagacuaagggcuaauccaggaucacugguggucauugcuauuugaguauaagagagaaugcuuugugauagagauuuucucguauauuuacauauuuuaauacaaacuuauauaucaccucaacuauuucaaagguuguugugcgauaaaaugaguuaauugaugaaaagcauucuguacaggauauggcacacagcaagugcucaacagguauuagcaaugacugauauugucacugcgguugacccucagucuucagagggacucuucacagguccagcuuagcuugcugaauuuauagagguuuacucaaagucacauaaaugguucaugguagaaaaaaucauuggucugauccagcuuucucuaagcccagcuuuaucugauggcuucauucugcaaaccaaaucaucuuuccccauacuccaccaaguugcuggaagagccucagaggcccagcuuagucuaugagcugaauguugguuuuauccccugaauuaaguuugcaauggguuuucucugugcaacuuuagaauacgccagccuuacuucaguaauucagccucgaaagugaucuaaucuguuuuacaaagauaguuaccuaccacagugcuuggcacaauuucaaaaauuguaaauuuucuuccccacauccucccauuuuaugggguccagauauuacuaaugcauuaaugaauguaaaagcaguucuuccaaaaucuguuuacucuccuagagcauacagugugacugcuugaagguaucuguuuuccugcaugcauauucaaguuaaauucacaguuucccuacuuugaaaaacaguuuucuuggaaauaaaaugucuagacagacuuugaaacugaaaaacugcugcuuugccucagguauuuuugcuugaaaacugauacuuucaugaauauuugauuuuuuaaaaacuuggacaagaugauugcuauuucaguucguuuuuacaaaagugauguaauuuuaguuuugagagaaaguauaacuuuuucuaucagugaaaguuaauuuuuaugacuuuuaucucuauuuuuguauugucgguuuaaaucucuuguagaauucaaauguagaauuccaaagguguuucccuccccacauuuuuuguccccuucuguugcuauaaaggccuuacauauucauuauuccaagagcaaauguguugcaggaauuuuagccaugcaugcuaucaagugauauguaaggauggacccaugaguuaaaauggacaaaugcuuuagguuaguagugauaugugcuuuuaaaagagcuuaaugaagaggguuucuaaucuguuaaucugaauccagacuuuguuaugacuuugauguacgacucuagacauauaauuuaggaguucccugagucuuuagcuacaaaguuguaaugucaaauaaaggaaauuuaugcuaagggcuuccugugugccagacauuuggccagaucuuuguuaagcuauuucauuucauuucaucuucauuuuauggaaaaggaaaaccugguuuugcugaaacccacagcuaguaaauugcagagcaaggauccagaucuccagcugucugacuccccacucaggcucugaaccacucuuacuacacagcucgugcacuagcgcauucugcccuacaaggcagugugaagcuacuuacauaguauuuucaacagguuaauccacacagugacuccaugaaggaaauaauacaagcauuaccuccauuuuacaggcaagaaaauagauauuuaggaagaagaaauuacuauccuaagguuucacaguuggcacaugauagaguccuguuucuuauucuuuuggagaucuaaugauaccauaaaugaaggguuuuccuauguguuauuuuuauaguacaugggcaggguguuuuaaauguauugaaaugaauuagaaauuuuuaucauaugauuuaaaauugcuguguguaucauguggucuugugaugacucagaauuccuuaaaugacucuucucuuccuucaaacaaaaucuuagcaguaccccuacaaaauaucagugugaaacaucauaacauagguuauuccagccaagacucugaggugaggacagcuuuaaacuguucaggcacauuaaaaucaaaucagugguggagauucuggcagcuauucaggaaagaugucucuuuaguacauuaaaaaaucuuauccccuagugaggaugaucaggcguuugggcauauuccugucuguggccagagaacagaggaaagaaucaguuuuaucacaaugucagugcugagcagcacaugacucuuuucaaaaacuguauguuucuuaauuuuuccagggauuuuuaauucauuuaucauaaacaccuuccaacuuuaggaaacaaaauuuauuaagauaauuguauuuuaaaauauucagaggccuaaaccauucaugacauugauacuuaaauggauaugagaaauuuuauugcaagaaaagguauacugacccucuuagcugacuugucauguuuaguauuuuuauuuuugccugccuaucaacaauagcuucugcaguaucaauuuaaaugauacaucaagcugguaaaugugagcuggccuaccaagugaaagcauaacuaaauuuaaauagcucugauauaaaaauaaugaaucaguacaucaaagauuaagaaugcaguuagcaaaaauuaauguucaauaaagaagcaugugugacuuuuaaguuagaugguaugucauucaaugaccagauaaggacuaaguucaggugcaguuuauucaacugauguguguguuugaaaaauaagacgaaaacauaaugcuuuauuugaauaaacuuuaauaaaacaauauauaauguauggacauaaggaaaccuaaguccucggggauuauaggggaaaccaaggcaugagguuaccuaacaaggaaccuuagaacauaaucuuaccuggcucaguacaaguaggagagaaugguagcaggugaaugggcagugagcauggaccugaggagaaaugaauuugccuaacuuucuugcuaaauaaaugugcuuuuggaugcugacaucgagagaguggugugugaaguaccauaaauauuugcuuuauugucugcgcggugugacugcauucugcucauuugcaggugggcaaugggcacuccaaugaggcagccuugauccuccacagaaaaggguuugauugucgguucucuagcaaaggcacagggcuguuuuguucuacuacucagggaaagguaaguugaaaagguuauuuuugcuuacuguuagugugcuuugaaauccucuuucugcaaaggaucuugacaauaagaucauguuucauugcuucuuuacugucucaguuucaucagucugcaaauuaguuugaaucuccccaucugaaaaaugcacuuucucaaaacuucagccuccuuuccuuguugacaucaaaaggcauagcuggaauuuaugcacauuugaaggcaaugcucuuguuauuuccuaggccuucuauuuccagccuacaaagugccuugcucccagucccccaguuuucuccuccccugaaccacacaugcucacauaucaucuaguucagcauugguaaaccuaaguccuacagaggccaaggcaaguuuauaauaacugaagcuuauagagguagccauaaagaagcaacugggaaaauugagacuguaggcuagugggauaauccacccacagcccaggaggcagcuguacguagcgccaaucaguuguuuucccuugggaaauaaauguaggucuuggucuucugauuaaugcagauuugcauaugagucaacacaccgugcaggccaaacagauccucagucugaacacagcuugcuggcugccuauuguuuauuucucuucaaguuggucuuucuggcaguuccaucaagccuguccuugaaaggaaacaaaccuccaaucuccugccucugucacugaaagggccaugacucagagaaggcagcugggcugauuuagguacacaggcaggucugccucaccaggcagcucagcugacccagcuuuccuccaaaaccucauaaauaaugcuguagaccagacucaagugauucaguuccaacccuacaaauuagcaugugugugggguccaaaaagauaagaaaaaugugguaggagcccugaaccuacuuagauagauuagcuucuacauuucuuuuacccuacccugcuuggagcuggugccaagaaagcacugauauuuuuauuacuuuuuuauuauacuguauuugcacucuauuguauuguugaugaucuaaguuuacuugguucugagcauucugacauuaaggccuugagucauaaggggguuauacgauccagagagacagauaacauggcagcggugagggaaauacuuuccaaaugaccuguccaccucuauagacugggacucaaugacauaaugaucccuccuuguagugagccugugugcucucucuuaacucuguuggaacaggaaaaagugguugaggacuaccauuguuagggguaaguauugacuaaaagagaaugaggauguuuuuaaagcuucuuggccauuggagguccuuucuuuuauugaaaaagccccugugcaugauaaaauucucaagcaauacaaaaaggaaugcagaauauguugcucaugaccauuacugguuuccuguucccuuccaagcguagucuguauguucaagcauguauauauguauauuuaauucacccuuuuuucuguaaaagagaacuuauauauguauauuuaauaacauauauguauauuuaauccacccuuuuuuccucaaaagagaacuucaacauacuguuuuauuccuucucauacuaauuuucacagaauauguaguugugcugcuaaucuucaaaguugaucuaaauauguaaauuuuaucauuuacuuuucagauauugguacagaaacuuuuaaacaaguuuauugucgaaagucucacaccuucaucacuauccuugaugcauucaccucccggcacucagaauauaagugagaucaacuugaguccaauggaaaucagcacauuccgaauccaguugaggugaaccugacuuucacauuuggauugagaaucauuggcuuuuauaccuuucuugguuugacgugcaauaaagaagcacauuauuuuagcuucuggcuacugugagaacaugaauucugugauucuguggguuuuuucuuuuuucuuuuaccaguacaguaagaaaaaaaaaaaaaaaaaaaaagccaugcuaucaaucaagauucuuuuuuuuuaaacuuucucccaugaacuaccaccaucaguaugaauugaugcaacaaaugaagaaauauuuaaagacagccucucaacagauuguaucucagguuaaaugcuaacuaauuaugucuguguuggggguugcgaagagauucuuaaaaguaucuguguguugaucaucaguuuuacaaaaacaccuauuuggcugaaauggaauaaaauguuuguggguaaaagcuaauggccaaaaugguugcaaucauucauacuaguuagaaaaauuauguguugaaauaaguggaaaagugcaauccauccacccuuaugauuaacguagaugauuuuuauaccuuuuucugauguaccucuugaccuucuccuucccuuccuacccuuucuaaguauuuccagaaauaccugauuuugaaucauucaacaguagaaaaagaggcauauuuucauuacuugacaaugugggaugggugcaauuuauuccaucuucacuaaaauagaagcaauuccauagguaccauaaaccuauuuuagguaccacaaggugucuuuuuacacagcucauuugaauacagguguucugagaagggguuucuauuuuaaaauuaccauaucaaaauaaaugugccuuauuuuuuuauaagucuuguuaaaucaguguccauauuacuguuuggggaagggggaauguuguggggucugggagaggguggguacuuucuaugacacauaaauuguguaauuuuugccugacaaugcuggccacauucugaucuguuucauuaaauuuguggugauguuacucuaaacauuuugacuauuugaauguacugagaugucagaaaacaaaacaaggaaggaaaauauuguuaauuaaaaugugcugcugccaaggaaacugcaacuugaagcaaggauuuuguaaaaugcaaaauccagcuacuguuuccauuucacaguaguuaacuauauuaaagagagaaugcuuuaaaauugaucuuguuuugaaacccacuuuuauguagcucaucaugguuuaucuuacuaaggaauauguuuguucauucaguucucaacuuuuguaugugcuaaccuuaaagugaaguucugagcccgugugccauuacagugcuuuuaauaaaauuuauuugggauuauuguuuccuuaacauuaaaauaauagcgacauuuagacuaugcaauuuuagcauagaaaggagucuuugaguauguacaguuuugaaaauucucuuugagauaauugauuucauauucuguggcuuucaaccuccauuuaccucuugucauuccaacaucuuuauagagaaauaaaaacccaauuucucuuucaccauuuaguuugauuaucaucuggauuuucacucaagaugcagcuccuaagauuauuguuauguuaaauucauaaacuccuucaccuuuaauaauuaaggaaacaauaccaguguugauaaagauauuacaagggguaauuucaugcaauaaacauguaccguaaguuuucuuccacauauuuugggaaaaaacuaaaaaaagaaaaaggacuuccuuuuuguggacaucuacagauguuaggguugccagaagcaaaucccaggaaugagaucaguauuuucauugcaucuuaaauguauaaccuuccugugggaguucaguuugucugugguuaagugggugugcuuaaucauucucgaaauugugaucagaugaaauaaaaaaaaaaucuugaugcaauaacagugguuuugccacuucugguuguuugcgauggaucugucccaugucagucugggguuuuauucagcuuguguugcuaccagcaguucacagguaaagcagaaauucucuuuaaccagcaaguuucugcuuuuuaagguuacuuuuagaauaaaucaucagggaaacagagaggaugcuuugcuuuggguuguagucaaaaacugauuaaauaauuuaaugucucuggcacacacuaaaaaccauacacuucaguugugaucucaguggcauauuuauuugguuagguuucguuacauuuauuauuacagauguucaguugaccaaguaguucaguguuuucuuuccuuuuuuuggaaauuuuaguuugaguuugugacugcaguguucaagaacucagcauccuuguuuucuacaaauacugauuaaaauaaaaugcuguaaaaugugauguaaaacauuaucaugaucuucccaugccuuuguuguacuugugccgaaguguuuugauauuccuuugucuggaagaaaauguuugcuuucauuuugaucauuuuguucaccuuggaaucaacagguuuugauauuuucucuuggaagauuuuauaucuuuuugggaauauguaauauaagaucucuaauaaaagauaaucuuaucauguacau

SEQ ID NO: 18406 - RNA, 6391 nt, Homo sapiens
agggauuggggaauuuuucuguaaacacuucuaagggcaauacagccaaaaaugguggcuugcuucuguaaguauacaauuggaugugcuaaauugaacaaaauagguucuugugcuauuuuacuuagguuucucuuuuuuuccccacacauagcaguaccaauaugaaguggguacaguuuucaaaccuacacguugauguuccaaaggauuugaccaaaccugugguauguacucccuguuucuugguauaaggagcuaccuuggcaauagguuuuccuuauuauuucauuggguuuuuuuuccccaaacacucuaugaauaaaaaaauuuuguccuagaauacuggcaaaugcacaacgcauauauucucuuaacucccuggauuauauugucuucaggguaucaaaguaaguucuaaaggaauaaauuauuuacccccaaauaacuguguuaauuaguagucucuugcuuuuagcuuggcauaauggaagaguugucagaauuugugauguagaauacuugauuuauguuauggaaaaguauuuuucuuguagccuucaagucuuuguuuucauuuuguguauugagccugggccuggacagugcuuuauuguucacagugagaaaaugcguuagcacaaauaauaaacaucuagaaggaacuugguaacccuguagaagcuaugauuucaucaauccaguuuuuuguguuacuuguaauuuuuaaaaauccuuucauuuccaccccucaaaaauaacccccuuuaacaguuugggauuacaguucuagacauuugucuguagguacucacuuugucugugcacaugucuaguuuacugcucuuuucuaacuuuucucuuaauagauauuggauauuuauuuauuuauuuauuuugagacagagucucgcucugucacccaggcuggagugcaguggcaugaucucggcucaccucaccucagccuccuggguucaaguaguucucaugccuuagccucccgacuagcugggauuacaggcacacaccaccaugccuggcuaauuuuuguauucuuaguagaaaugggguuuucccauguuggccaggcuggucucaaauuccuggccucaagugaucugccugccucagccucccaaagugcugggauuacaggcaugagccaccacaccuggccaguacuggauguauuucuaugauaguacauuuaagccccagucugcaacucacaugccugcaggagccaggccuauaagaaaagguggcagaauuggcauggugugccacugucuuuauaagcaagacagcagcuacuuauucuagccacuuguugcccugugggaaaucagaccuagugaugccagccugucuaaaucuuccaagcuaaacugaaauccagauuuucuugugaaaucuucugauuuuuaauauuccuaacaaauucaaaguaucuuuuaacacccuguagggaucagucagaacacaucuugaggcuauauucccccuucucaucccucaacuuaggacacaggcuaucaguauauucuguucuuccaacaacccuuuuuggaguaauugagaguggauaucuagcuuucuggcuaguaaguaaaucuuucaggagugaagugauuuaacucugaaucauuggauuaguaguauaauuuacugguuuaacggaugaaugaaaugaagguaauucaccuuuuggaagaaagucaaaaaugucaaacccauuauuucuaaggucuuuagguauuaggguggaagagguugaaguuauagguauagucagugucauaucauuuaaauuagaaaugaguaauuuguuuauuagggcagacaaaacauacgcgaauaaaaccuaauaaaaaauaugaauagaacuaacuuggcuuuguauaauaauguuuuauaauuaauaagcacuuuaaucuguguuuucuuauuuuuuucuuagagaaauacuaugagcaauagcauagguuuacccucuuucauaugugaggaaacuaaugugcagugagacgauaugauuuguccguugucauucagcuaccauuagcagagcuuaauccucaauccaagucuucugcccaggcucuuuacuagcagacccuggaguccuuuuucauugugaauuugaagcugaaucguuauuuuaaguuggaaaguuccuuuaguaauuuuguggguugccuugaaaauucuuuucauuuacacuguauuuuaacagauucugaggcucauaguccagaucugaacaugaaaguaucuagacacuucagcuaacacugccgucacucaguguuuuucuccucauuuauuaguaaacucugaaguuguucaauugaggcuaauguuuuaaauuugcuaguuagaaauagaagaggaacuaaaacugaaacuuuucuuuuggauuuuagguaacaaucucugaugaaccagacauauuauauaagcgccucucgguuuuggugaaaggucacgauaaggcuguauuggacaguuaugaauauuuugcugugcuugcugcuaaagaacuugguaucucuauuaaagugugaguauggccuuuccugacccgaccuguucgcugcuguaauaugaucaaccaggaaaauagugcucaucccaggaaggucugaacucuuuuuuuuuuuuuuuuuugagacagagucucgcucuguugcccaggcuggaguacaguggcacaaccucagcucacugcaaccucugccuccuggguucaagcaguucucagccucccgaauagcugggacuacaggcgcaugccaccacgccuggcuaauuuuuuguauuuuaguagagaugggguuucacuguguugcccaggcuggucucgaacuccugagcucaggcaaauugcccgccucagcuucccaaagugcugggauuacaggcgugagccacugcaccuggcccagucugagcucuuaaagugggauagaaacucuugguggguagagcuuaaguuugucauauguuauccuaaucaggaucaugccuuccugccauguuucugggaucuccauggagcagggagguagaguaggugaaugaacaaucguuuuagacccuuuggaugugaugauuuuuggcuaauacauccaucauuucaaaucuucccuaagaaacaccacuuacccaguaauuucuugcuugaacaagguaagccuuggagucacugcagggucaagcauaacugucuccuuugucuugucaucugcuccuucugcuguugaacgaggccccaucuggggcuuuggcagucuggccuucugacaaaaacagaaggccacgguuucccaaaacagacuauaguuuuguuauuuugauuuaucuguagauuuuccuaaaacaacagacauacagcagguguuacaacuaugucuaccacacuggugcugcucuucacaauuaauauauuuggucaauaaaagacuaaaggguguaaaagcagcagguguguguguaugcuugcacacuugacaugccagggcuuauuuuugagccugugggaaaaaguuucuauugcugucugcaguguuuauuuuggcuugaguuuuaugauagcaguuguuguuccagaugacaguuuuggcaaauggaagucuguaaaugguaguuaaugccuauaauugagugugagucugaccuacaaaauuauggaauuaugcuuuguuaucauagugacucagguuuuguuuuguccauuaauuucagacaugaaccuccaaggaaaauagagcgauuuacucuucuccaaucagugcauauuuacaagaagcacagaguucaguaugaaaugagaacacuuuacagauguuuagaggugaguguauuugagaaauucuggcauuuuugaaauaccaaaaauucacacuagcauauaacuuuacuuuaacauugacuagauugacuucuuucagcaagcccaugucuguugguuguacagaagguaaauaucuuuuaguguuuauggaagugucaugguaggaaaaguaaaugcaaauaaagcaauccuuuagaguagugcauaccuuaacucaggaaugcagauuaugcaaagauagcauuggaauaauuuugcucauauuucaaaaauucuagugaaguuuuuacacaguucuaauaacuguuucacauacuagcuggauuuuccaugucagugaugcacagcauuagguuuuucauucaucuguuacucauuugugcuuccauuagugccagcacagucgugugcuuaaggagagcauagguucuggagucagacugccaaugccagaauccagguccugucucuuaacagcugugugacauguaccucuauuccuucaucuauaaaaugggaauaauagugguacccaucucauaagguuagugugaggauuagaauggaaaauuuauguaagcacucagaauacuuugaucacauaguaagugauugguaaauauuaaaacaagcacuuauguaucuuuuauaugggaaguacuguacuagucauugagggcacaaauauaauaaagucauggucccuacucuuuuuuuuuuuuuuuuuuuuuuuuuuuuuugagauagagucucacucugucaccaccuaggcuggagugcaguggcacaaucuaggcucacuguaaccucugccuuccggguucaagcaauucugucucagccucgcuaguagcugggacuacagguguacgccaccgcgccuggcuaauuuuuguauuuuuaguagagaugggguuuuaccauauuggucaggcuggucuugaacuccugaccucaggugcuccacccaccucggccucccaaagugcugggauuacaggugugagccacugugccugcgcagucccuacucuuaaaaagaaaaacccaaauuuuauccaucuuugucugagggaaacgucucucauaguacacacagaaaaucuuauauuaacuauaucuuauaauuuaguccuuuugucuucaguuguuuugugagccugggauuuuauguuagauucuuuaggggaggccaggugcgguagcucaugccuguaauccuagcacuuugggaggccaaggcaggcggaucacuugaggucaggaguuugaggccagccuggccaacaugaugaaaccccgucucuacuaaaaauacaaaaaaaauuagcuggacaugguggcacacaccuguagucccagccacucgggggacugaagcaggagauggcuugaacccaggaggcagagguugcagugagcugagauugcacacacuccagcccaggcaacagagugagacuccaucucaaaaaaaaaaacaaaaaaccgugcuuuaacaaacagcuuacaugaaacauuuucauguuugauguuuuaguuagaacaucuaacuggaagcacagcagaugucuacuuggaauauauucagcgaaacuuaccugaagggguugccauggaaguaacaaagguauagcuugaauuucugccucuuucgguggggcgguggggagugguaucuguauuguuguuuugauacauugcagccugguccuggcccacugaguagaguuugcccuaaacuguggcaaacugggagacacaguugccacagcgguugggggcuacccaccccuugcaacagaauccugccauuucagcccaaguccuccgugaaccaccuaugaaguucucccuccucaauaugaguugucuagaccuggggaucccauuaaguggcaauccaugaagaucauugaggaucaaaucgauuauguaugugagaguguuuuauagaccaucaaguuuccuucuuuccauuucaaaacccuauagaaagacuagggggauaaaagaaaaagaaguaaagaggauuugaccaaauuaauaaguccgauuuguagucaaagaguucuguuaaauccacauuauaguuuuguuucuuucuuuuuuuagacacaauuagaacaguuaccagaacacaucaaggagccaaucugggaaacacuaucagaagaaaaagaagaaagcaagucauaaagccucagggaggccauuuuugccuaaauuugaaaugagggugggccagaugaguauguuuaaguggagagugcuuccagcugagaugauuugagucugcccuaacugcuccauugaguucucgugcccucaucagcugagggcagggaauggaacuuuaauggaagaaccacuuuuaucuauucuuuuuauucauuguuucaguucugauuucagcaaacaugagcaaaccacuuugacugaaagcagaaagagugaaaauucuauuuuguuacgcuacugguguucaauuauuaguuuguaccauuuuuaauuuaugucaguugaugcauc

SEQ ID NO: 18407 - RNA, 427 nt, Homo sapiens
gaugccgcccaaaggaaaaagugguucuggaaaagcggggaaagggggugcagccucugggagugacagugcugacaagaaggcucaaggucccaaaggugguggcaaugcaguaaaggucagacacauucuaugggaaaaacauggcaaaaucauggaagccauggaaaaguuaaagucugggaugagauucaaugaaguggccacacaauauagugaagauaaagccaggcaagggggcgucuuggguuggaugaccagaggguccauggugggaccauuucaagaagcagcauuugccuugccuauaagugugauggauaagccuguguuuacagacccagcaguuaagacaaaauuuggauaucauauuauuaugguugaaggaagaaaauaaaaucauaugaaagacugaaagaaaaaaaaa

SEQ ID NO: 18408 - RNA, 2112 nt, Homo sapiens
uaauaauaaguaguaaggaggaugaauuuuaucugacuuauuaccugaaagaaagagaagcuggcugcaaauccuauagucaucaagcuacugucuuuagaagacuagcguauugaaacuuuuuuggggggcccuuucuuugaguguauaugguaugagaagcuggcaagcuugugcugagaguccuggccauaauucuucggaaaugugagggugugggaggcuucagagccucuggaggaaguucuaggcagaggucaguugugcucuggcccgaccgcgggcccccucccacggaagggcagagcuagagggcccucuggggacagcaggcccggcgcgagcgguggccaacaccucucaagccuuucgaggugugccgucauccacgcccaccguggagccaacaguguccuucucccaacgcuggagaaacggcuagggcauuagccucaaaggagauuaaggaauuggauuucguagagauuggauuucgugcgugcugucucccauucagaggcauucccagaaaaacgacucacaaagaccacaacagcagcagagcaggcgaggucucagugcccccagagcucagccagggcgaggcaggacgacuucggggcagggcucuccugacguagggauuacaacaaaaggguucauccugcauuuuuugaaggagauggcuaaguaggguaaaucugugguuaagaucacagacuuuggagucgauuuuuuccuccuauuuuugcgagucggcccccucuucucugucccugcucccaaggcccccucaccgcgcauacugccacagccgcucgcagcucccguggcccaccucccucuccuccagguugcugcccccggggucuuuuugagcacaucagaucaucuugcucagaauaccccguggcuaccgccucuaggauaaugcccaacggccuugguaggauauuuggugccacacacccuccagucuccccucuaaucccuaaccuaccugccuccccgcccaggggcccugcucucugcaggcucuacuguguccugggcccucagcugagagaccaacccguccuuccaggaaaaugcgagccucaccaggcaggguuaugcucccgcccuccuccuuguaauuauuaccugacccucugccuccugcaacgccagggcuggaggacaggcuggccccuauuccuaugggcacuggccaacauccaacgccugggacauaaacugcacccaaugguaugugaacuguacuuuacaguuugcacgguguguucugguauuugcuaaaucuucacacaugcucagguggcaguacguuuuaaugauacaggcgagggaacuggggcucagaaaggucuagugccuugcgcaugggagacucaagugguagaaccgguggccgggcuccgggcucugagcggaaagccugcaggacucggaauccugaagaccuggguuuaaacccgcucagcuagggacugggugaggcaucgcaggcaagugacuucaccucccagcgccggugcccuagucuucaccgaagacagcaauuccaaucugggacuguggugaggcuuaaauaaaacacugcucaguaaguggccagcaggccuggcucgcagccggaacuauaaaugugaguucccuuucugacccccagguuuggcgagggcuccuccuguuugggcagcagcuccuccugagcucccgaggccacgggggugccaacuguggagcgcccgccgugccguuuagacgcgagagcugcgucggguaccagcgauccuuaaaggagcucggggaccaggggcacagcuuggagaggacagcgagggaggugacuggccucggggaggcgggcgguggauggagaggcaugagagggguguugucagccgcggcacacgccuuccccaaguggccggcgccgccccuugccaccacuucaccuccgccucuucccuuccucccuagcuccuggcagcgucucuagggccucaaaaagcaaggaggguccccgggcagcgaggccccauggauccagccugcgccugcucccaagggcgcgcaggucccgccccugccgggcgcccgcccccc
